United States Patent 11,001,841 (CCCTC-BINDING FACTOR (CTCF) RNA INTERACTOME) - sequence listing, part 18

SEQ ID NO: 45364 - DNA, 1042 bp, Homo sapiens
ggagagggcggatgtctgttaatgaggaagtatgggggggcgtggattttaggtaagcagtataaatgggtctgctaattctgctacctttattttctatacccaggctctgtctctgtgatgctaaaacaatgagtcaagttgactaatgtgacagtgtagtttaattggtgcagtgagtagcagaaatcggttatactggtttgatcaaaagtttgacctgtttacactttatgaacagactctctttcagattgctggaattctgttgtaacgaatcaaccctatatatccttagaatgctcccttgcattcagtaaccatagctgtgcatgttataatgtatgtgcatggaaggtggctctacgggggtgattgagggactattactggacaaaagagatcaggttaaaggctgttgattcatgggctgctatattactgtccaaaccacccttttgcatttggatcacgtcttggttagaggggggaaagtagcactttttgagaaccttgaagaagtgggagactgttcaacagctgcctgtatctcagtggtggccagtaaactgaaacaagtttataagggaataaaaatcaaccagtgacaaggggttctaatgttaaatgcatatattggcaaaatgccagtagggctatgtagggtggtgagcactcacaattgttcactaaaatgctgtttttaaaacaggaaagtagaatggttgagtgcaaatccatagcatgagataaattgagcttcttaaggcaaatcagcctaggcaaattcatttccgtgtttttgtgtatttggagatgccagctcgtcactcagcccatggagcttacaggtcctgatcacttgatctaattgtatggatgtggtagtttgtcttccctggggcagaaaacaaagctttaatttggaactaaaattgttattattttgcatctaaaggtatgagtttatagacttttgatgttagatttttaaattagaaggtcactgaaaatttcccttaaaaatgaccccaacgaattt

SEQ ID NO: 45365 - DNA, 1033 bp, Homo sapiens
agatcttcttaaggtttagacttgtaagggatacagtatcatttctgccttattatactggttaaagcaagtcacaaatctagcccaggttcaagggtacaaatgtgtgaatccatttggggccacccatgtaacagattaccataaattttatttaagtataacatcagctttactataccaaaacaggacttacggaaaactgttttggaagctgaagcttaggcagcttactactttccgcaaatctggattttgagtctgagcatgccacagggaaagctgagtctaaaaagtgcaaatgacagcacatctggcttactacgcaaatgggaatacctagcactctccttggttagaaaagaggagaacatttgtggcctctgaggtttttcctagtgtgccaccataatagggtaggattgacttgccttctgcttgagggcagtgggatctaacaaagtacaggacccaagagtccatgctgcttggaagtagtgatttacccgatctcgtgaattggaacagacagcatcccatgcagaaaatgggccacagatgggcagagatcgattccctctgcccttgtgattggatttgagacctaggggagaagggtttcttgactatcactctggccttgaccagagtgagcaacctgtcccccacgcgctccaagccccaatggcattttctgtttgcagtgtcttgaaaaagcttgggataagctactcttccttggagaggtgtcattatagtggagagaattctctttccttctagagactggaatggtaatcctctcttatggaaatacaatgaataaggtgctgcttctcctttccaagaacaggtagattcattgattgctatctgggtttttctcgcattatcacttaaccttatccactatcgctttattttagtcttagcagtattttttgtttgtttgtttttagttcaagttggctgctaagtaatgccatggttaaaggtgaaatgaagaaaatgagtgtttagtttttattacatt

SEQ ID NO: 45366 - DNA, 1057 bp, Homo sapiens
tttctgattcttagctgcctaattttgattagaagtaatataaaattaataaggttcaagacagccttgaagcaatttaaaaatacttttataaatgatagcattcttggttgcctttgattcagtctcttggtttagtacttggactctgagttttagttggctatcagttgaatgagctctacttaaattttggggttattgtatatttacctttaaaaagaagtaaacaggctaggggtggtggctcacacctgtaatcctggcactgtgggaggctgaggcaggtggatcacctgagctcaggagtttgataccagcctgggcaacatggtgaaaccccatctctaccagagatacaaaaaattagccaggctttatcaaagatacaaaaaattagccaggcatgtgcctgtagtcccaactacttgggaggctgaggtgggaggatcgcttgagcctgggaggtggtggttgcagtgagccaagattataccactgcattcaagtctgggtgacagagtaagacactgtctcaaaaaaaaaaaaaagtaaacaactgccaagaacaaaataagtaacccaagaaaaacatgacatcctagtgttgaagaaaaatattcagtactaaaaacattttttgttcctatccttaaattctgatttgaggggcaaggttattgatagagatattatgtttctgaggtgtgctctatatagaaaatgtttgatagtcagcaccttgaatagaattgtgtatatttgtgtataaggctccagtggagggatgttctgcagtgtgtctgtgttcctcatctatttgcagaggatagatttttaagggatgtagtgaaagaggaatctcctgagaggaaagaaagtaggctgagtttttaggtgttgaggcagtgaaagaagagaacagcgaaagacaatctagctcttcaggaagaacccgggatctagcatgcatgaaaacttccagtatgatttctggcaagacatttttttaaaaaaagtttatggtgtgaatgaatggcagaaaggataaaagtcc

SEQ ID NO: 45367 - DNA, 1050 bp, Homo sapiens
atagcaatctggtatacacagagatatttatataaaacacacttcttactgtgtaaactgtggtcaaaaaaagtttaaaagccactaatccaggggagaaattaagagagcctgaagtgaggtaaatgctaatattttaggttgacataagatgggtcttgataagttgtggggagatagaatagaaaaagagtggaaccaaggtggattcttctggcatacacagcaccaggctgtgtaaccctttgagtcagcagttttcaactccacatcatcttccctctttgcttaaaaatcttaccttagttcctgtgttttcttttgtttggtaacttactgagtcatttagctaacaacaggataggactatgggtgcctcaatcctgttgattgtaatgtacagccaagttgagaactgctacttcaagttcttttgttaaccctttactctccacattttttaattcactttatatagagatatgtagatgaaataaaaaaattctgtgtatcaaaatctaaagtatgcatcagtgaaaaattggacagtgtattaatattgagtacttttcagagagattaaaaatacattctgaatcccccccccatccccccacccccgcccctaaatagcgattaggcaactgggtcatggcatatttgactgaaataatgatagaatgttggacttagggtaggagagtgatgagaaagtgttctgtattttgtagggcatccagttgatatatgtacctcatgccgtataccaaggaggcagttatatgtacagttccagaactgaagaagaatattctagcctggagataacatttgagtgttatgccaagcacgattttgcctaaagaactttgcatgtgctcttttatgtattctcaaatatactcaggttttgttaaaatgttacctcattccagaggtgttttttgagtctcctgtccaaatcaagccagtttccccacatttccgtatcctgctttattttccccaacattttatgttgaaaatttacaaatgtacagaaaattataa

SEQ ID NO: 45368 - DNA, 1026 bp, Homo sapiens
tgattgaagatagtttagcatttcatattaaagtacatttaatttcattacagtttgtgaaagagacagacaatgaagtaagaatgcgactattgcagttcgtcactggaacctgccgtttacctctaggaggatttgctgagctcatgggtaaatgtaatttcactgtaatttctctgtacgtaattttgtgataataatggcctttggacatacaatagacttgattgaacctaaagattactcttctgtgctgtaggtagggcttcatttagaagaaagaaaaatgagtggctaatatcaaagcacttgtaagacaaaaatgaatgtgtcctcatatagctgaggtggccattgctttgctccctatggtgactgtgaagggagcgacattctgtagagagagttttcttcccaatgatctaattcttattgctggatctctgcaacaattttcttcttcaggcagaagcagcttacattgtgaatttctttattttgtatcattcatatgactgtgcaacatgttctattatttaagcagttgtcagaagaaaaaagtttaaaggaccagataaactttgtcttattttcttggtgtaggaagtaatgggcctcaaaagttttgcattgaaaaagttggcaaagacacttggttaccaagaagccatacatggtaagttcaagaatcctaaatacgaaggtgaaagccacagagaatcttttgttttgtttttttaaaaatatgtaagatccagtataactgcttattcattaaagtagtcagaatttcaattttgagaacagattaatacagcattctataactgaacactttagcatgttctcattaatagaaatatttgagaaatgcatccagtgattcaacaagtattagtgtacccactaggtataaagtaagatgtaagtattccctgttttttatgaagtttgtgccccatggtggggcacaaatgacaaacagataaacaaataactatttgcaaatcctgggaagtccttcga

SEQ ID NO: 45369 - DNA, 1027 bp, Homo sapiens
acattaacagacatctacaaggtaccctacccaagaacaacagaatgtacattcttctcacctgagcacggcacacactctaagataggccacatgcttggccataaagcaattctgaacaaaataaaaaaaaaaactgaaatcaaaccaagcactctctcagatcacagctcaataaaaatagaaatcaatatcaagatctctcaaaaccacacaattacatggaaattaaacaatttgctcctgcatgacttctgggtaaacaatgaaattaaagcagaaatcaaagacttctttgaaactaatgaaaacaaagatttaccatcccagaatctgtgagacacagctaaagcagtgctaagaggaaagtttatggtgctaaatgcctgtatcaagaagttagaaagatctcaaattgacaacctaacataatatctagaggaagcagagaaacaagagcaaaccaaatccaaagctagcagaagaaaataacaaaattaagagctgaactgaactgaacaaaattgagatgtgaaagccatacaaaaaaaatcaatgaaaccaaaacttggttcttcaaaagaataaacaaaatttatagactgccagctggattaatcaagaaacaaagagaggctgggcacagtggcacatgcctgtaatcctagcactttgggaggccaaggtgggtggatgatgaggtcaggagttcgagaccagcctgaccaacatggtgaaaccctgtctccactaaaaatacaaaaattagccaggcatggtggcacacacctgtaatcccagctacttgggaggccaaggcaggagaattgcttgaactcgggaggcggaggctgcagtgagctgagatcgcaccactgcactccagcctgagcaacagagcaagacactatctcaaaaaaaaaaaaaaagaaagaaagaaaaaaaaagaaacagagaagatccagataaacataatcagaatgacaatgggaatattaacactaacaccagagaaatacaaaaacca

SEQ ID NO: 45370 - DNA, 1030 bp, Homo sapiens
gccagtcaaatttagcagtagggggtgtataccaactttagcaacactgatgttagtaagttcttatttttaactttttaactttaattttattttttctgcttaggtagctaataagttctgatagcccttcttttttaaaaaaaaatatttatttatttatttgtgagatgggacctcactctgccacccaggttggagtgcagtggcatgatctcggctcactgcaacctccacctcccaggctcaagcaatcccacctcagcctccagaatgactgggaccacaggcacaccccaccacacctggctaatttttgtatttttggtagagatggggtttagccatgttgtccaggctgctgttgagctccagccatctgcctgcctcagcctcccaaagtactgggattataagcatcagccaccgtgcctggcccaaccctgcttctattaataacttttattaatacctcactaaatgaacctatgatgaactgttgaattgatggacttgaaaatacaatcagtgatacttccaaaatgtatatacagtagccaagggattagaaaagtggtaaaacctgaaacatatgttaagtaaactttgtagccagttatgaatcatggaatagaacaataccaggattttagagaaattaatgaagggtctttagttgattgcttactttgtaatgataaagagaaggtaaaactgcacctactttttatttttgaagttagagtgatcacacctgttaattcctgctttcctccgttctgcatgtccaagcatcagcaatggtatcactatttagatcctgctcaagatagtttaagaatctggaaactttttgaagtgtggctaaaagctgatttattttgctgccatgatagatgctaagagcttaataatgtgagatttcatggatgctaataaaatttatttccttattgtgctgcatctacttaatagactgggccctgtggtttgtttgtttatttaagtcatctgagcacttaataacaat

SEQ ID NO: 45371 - DNA, 1004 bp, Homo sapiens
gatgatgtggtttgcaggttgctgtgcctgattcacagtgtatgttgtataagccaatgtccatacctgattatgagagcttcttaaattatatgatatcaaatttgttcctgtaactctgtatacagtgcttttctgcaaggtaaaaataacctgtctatgcatctgatttttgctacagtttagacactgtggtttacaaaacagcatgcactcaacttgggactttatgaaaagtactgaatgagcaggaaaaggcacatactcagttttttaaatgtacaatcaacaagtaaaaataacctcatgtaagtaagccatttttatttgcctttctagatattttattttattgtggaaaactgtaaacatggtcagatttggctttttttttcattaactgagcaagactttcaggatattgtagatgcacagatggtaggttgtcctgaattctacattattagattactttaattgagatttgttaaaacggttaggactgttttgtccaggaaagataagaggaccaaacatataaggtgaaattcagaattccgtttccttctaactaatgaaaaactgcttactaaaaaaaaattttatactttccttgctaaggtcccatatattgatttgtacagatccacttagtcattttctcctttttttaagaaccattttcatctgatttttaaactcacgataccagttatctgttaatcaaaattgcattttacaatttaataatgtgatatttcctatgtctacagcataccttattaggtataaaacctactgcaacttagaaaaaggaaagaaaaaagaaaacttttccaactgctgcattaagatagggtggattttatgtgctttttttttttaagagttgaatttcttttcctgacttttaccttttacagcgtattacttagtgaacattacattttcagaatagatcctaatattttattgagggcctatgtgctaaaaactatgcatat

SEQ ID NO: 45372 - DNA, 1044 bp, Homo sapiens
catgcaacatttgtctttctgtgcctggcttatttcacttatcataatgttctccaattccattcatgttgttgcaaatgacagaatttttttctttttaaaggctgaatggtgttctgttgtgcacatatactacattttatttatctgcttctcttttgatggacactttgtttgatttcataacttgactgctgtgaatagtgctatgaggaacatggcatgcagacatctctttggcacactaatttcaagtcttttggctaaatacccagaagtgggattgctggatcatatgctaattctatttttagttttctcaggaacctccctggtttgctatagcagctgtactaatttacatttctaccagcagtgtgcctagcttcccttttctccacatcctcaccagcacctgttgtcttgtctttttgataatagccattctaacaggtgtggagtgatatcttattgtggttttaattcatggttgtctgatgtagtgaagttgaacaactattttcatatatatctgttggttatttgtatgtatccttttcagacatgtctattcaggtcccttgcccattttaaattgggttatttgttttccttctataggattgagttgcatatctattttggatgttaaccccttatcagttgtatggcttgaaaatattttatctcaatccttaggttgtctcatcaccctgttattttctttgttgtgccaaagctttctatttttatgtaattacatttgtctatttttgcttttgttgctttgggtcaaaactaaagaaccctggcccaaaccaatgtcattttatttattttttctatgatttatcctactagttttacattttcagatcttaaatcatcttacatcgatttttgtatatggtaagagatcgatgtcttgtttcattcttctgcatgtggatatccaggtttcctagcaccatttattgaagagactgtctttttcttatgatattttctgataatatctattattgtgttttctgataatatcag

SEQ ID NO: 45373 - DNA, 1031 bp, Homo sapiens
agtaaaaacatcttcttgtagttggaccggccatgactgtctacttcaaatgttctggaaaatattttaaaggagaaatagaacaccaggatatgaagtaaattgtaaataggtggttcatacgtatgtcagtttcaaggaagggaaattgcccttcttgtaagtacatgtctatactgctctttaaaaagaagagaggaaatacaagcacccactgaaaaggttctttttttgttaacattgtgctggttttcatgacttaattctaggtctttccttatgtagtggggcaatccattctacacagtggttgagtgcttaatgaacattttgctgactagtagctatgacagacatgctttggaatttgttaagagcagaaactgtgctgaaacacttcattgggagttgtgaagaagactagaagaggctttggaattagggaaattaggttacctaaaaatgcatgaatgagggtgtttgccgagatcagtggaataattgtggaaagcaccaggacttcttaatggtcatgaaatagtagaccaatgtatgtgtgtgtgtgtgtgtgtgtgtgtgtgtgtgtgttctaatgttggtatatatctagacaataaatattataaaatacaattctgaaaactcaataaatggtttcacatattataaatgtaaatctgttccatgtttattgtggatacaattatagcataaatgacacatatattttgagtatagtgcttcccttttatctgcaggggatacattccaagacatctagtgaatatatgtactagtgagtatgtataccctatatatactattttttttcctatatatacacatctatgataaagtttaacttataaattaggtacactaagagattaacaatgctaactgctactaataaaagatagcagttttatgtgaatttggcctctctctgtcaaaatgacttattgttactgtacttgcctattttcagacttcgattgataggagaaactgaaaggcaaaaacaaaactgc

SEQ ID NO: 45374 - DNA, 1095 bp, Homo sapiens
gtaaaactctaccactatttttcaagaaattatctaaaaatggattaagaaaaacttaaaagtaatactcaaaactataaaactactagaagaactcacagggaaaatgcttcagatcattagtgtatcaaagattttatggccaagacctcaaagtcacagacaacaagaagaccagaagaaaaatgatagcatattgaactagaaggcttctgtctagcaaagaaaacagtcaacagcatgaagagacaacctggtgaataagagaaaatatttgcaaactatccgtccaataaaggactaatattgaaaatatacaaagaactcaaacaactcaacagcaaaaactacacaatcctattaaaaagtgggcagggccgggtgtggtggctcacgcctgtaatccccgcactttgagaggcagaggcgggtggatcacgaagtcaggagatcaagaccatccttgctaacatggtgaaaccccgtctctattgaaaaaatacgaaaaattatccgggcatggtggcgggcgcctgtagtcccagctactctggaggctgaggcaggagaatggcgtgaacctggggggcagagcttgattgcgccactgcactccagcctgggcaacagagcgagactccatctcaaaaaaaaaaaaaaaaatgggcaggccaggtgcagtagcccacacacgtaatcccagcactttgggaggctgaagtggatggattgcttgaggccaagagtttgagaccagcctggctaacatagcaaaaccccatttttattaaaaaaaaaaaaaaagaatgaaagaaaaaatgggtaaagggagggggaggcagagcaagatagctgaaaaaactctcctgcaataccttatctccccaacccctgcactggaatacccagtggaacaacgatatatgcaaaaatcaccttcataagaacaaaaaatcaagttaatgatcacaataattggttttaacatcacagcaaggaaagaggcaccgaagagtataggaaaggcagtcttgaattggcaacaccacccgtcccccattttctggcagtggctgcatggcattaagagagaat

SEQ ID NO: 45375 - DNA, 1048 bp, Homo sapiens
aatatcattatcatccttatttttataactacttatatacttgttaaatatttagtaatctgtgtacagttaattcctagtagaagttatatttttctcaactaatagcttatactgttcttgtgaaatgaagggatatgaaaactaagttactgggtattgttaaggattaatttctgaactgggtggaccccagcaacaataaagtcacaatccttgtgcgcctggtatgggttgatcaattactaacatttgacatagactagagactagaaagtgaacaaagtttcttcatgccttccagagtttcttttcacattcatcaattattgtgattgttacaaggttatgtgaagagggtagaccagttatttttacttccttttaatagagaactgagactcaaagaaactgtgacttgaataatatttacagttaccttttggcaaactcctctttcaaaaccactgtttagagctcaaagtatactacgcttcatcacaagactcaaacggatgaatatattacatgtaaatatataatataattagcatctttggaattattgagcggttgctgttctagactgagaaaaaaaggtagcatttcattaaaatgttggtgttagagaaccagaattacaatgccattcagtattacataataggcctattctgacctgccattttgtggactagatgatatagggaagtaatctaaagtaaaattttactgtaaataaactcttcagtaattcaggaaagcattttatgtactagtgctccaaattcagtaaattaaattctgatgtaatgacctgtctggttccttgttcctaaatccatcaaatgaagctccacctgcaggtccagacagttctggcccaggcttgggattcaatctgatttcctaatcaagggaataaaaaacaaaacaaaacagcagattcaataatgcaatgatttagctgaattattttttttcctatgtggctctgaacttatactgcacttaaattactatgttctgatgtttactaacagctcat

SEQ ID NO: 45376 - DNA, 1130 bp, Homo sapiens
tctcttttaatatactaatgaatgcaaaagcagactctctaagtttgctctgaacacattttatagtcctttaaatggctttttgccatctttaataaataatttgttaatgaatcattttaggaatgaatgctatatctctaccagaaaactatatatttaattaaattgcatattccttttcttcaaaagcattttaatttttgttatttctcattaaaaccaaagccagccaatccattttagtggctgcactaaaacaattcatacagtgtcttttacattcacattgtatgaatataagaaactgtccttttatattttgttttctgatatttttaattcattctgaatgatgtactgaggggaggagaaatgtatttatagcttcctaaggtagagatcatgttctacccaacaattcttaaagctggtttgattctataaaaatgggccaataaatctgccagtcattcattttgtgaattttccctttatgttcaatttcaatattctctgtcagggaaaaatgaggaaatattattccttcatttgggtaggaattccctctgtactcctcgctctccctgtaacacaaggtgttagtagtaataaattctatgtgtccattttgaatgcatggttaatgttggggtgtggcaaaattcttatatcctatttaaccatttattctaattataaactctatgcagcttaaccctgtaattgacatctgaagttaaactgtaggcaagatatttctactaccaaagaagatagtgctgagagcagaaaaaaggcagtagaatagagctccatgagacaatttttttcttgttctttgttctttgtgaaaaataatatcatttaattaaagggcatagcttatctgggtgtccaagaattaaatcatccacaaaaagttaatcttgcatgtaacgttaagcttgtattacagtaatttcctaattttttaacttaaagttgattttgtttccaaactacatgagcatttatcatcttcattgtatacagtaattctttgctgccttatcactttgaaaaatggtatcttcagtcagcttttaaaaatagtgctattttagtttattatgcagagttcatttaaa

SEQ ID NO: 45377 - DNA, 1034 bp, Homo sapiens
ggtgttccatattggcacaatcataggaaaattatgttttatgctttatttatttttcatggaattttacttattgctatgtatctgtcctcaccttttaaattattcattccttgttctttttcagaacgtctgcagcctggtatagcccagcagtggatccagagcaaaagggaagacattgtgaaccaaatgacagaagcctgccttaaccagtcgctagatgcccttctgtccagggacttgatcatgaaagaggactatgaacttgttagtaccaagcctacaaggacctcaaaagtcagacaattactagacactactgacatccaaggagaagaatttgccaaagttatagtacaaaaattgaaagataacaaacaaatgggtcttcagccttacccggaaatacttgtggtttctagatcaccatctttaaatttacttcaaaataaaagcatgtaagtgactgtttttcaagaagaaatgtgtttcataaaaggatatttatatctctgttgctttgactttttttatataaaatccgtgagtattaaagctttattgaaggttctttgggtaaatattagtctccctccatgacactgcagtattttttttaattaatacaagtaaaaagtttgaattttgctacatagttcaatttttatgtctcttttgttaacagaaaccacttttaaaggatagtaattattcttgtttataacagtgccttaaggtatgatgtatttctgatggaagccattttcacattcatgttcttcatggattatttgttacttgtctaagatgcaatttgattttatgaagtatataccctttacccaccagagacagtacagaatccctgccctaaaatcccaggcttaattgccctacaaagggttattaatttaaaactccattattaggattacattttaaagttttatttatgaattccctttaaaaatgatatttcaaaggtaaaacaatacaatataaagaaaaaaataaatatattaataccggct

SEQ ID NO: 45378 - DNA, 2048 bp, Homo sapiens
ggcggccacggcggccgcgctcgggcgcccctcgcgcagcgctccatgcccgtgtggtgctgccgctgctccctggccggtcatttcaggtgacttcctcgccggggatgggaggggagcaggcggggatgccgcgctctcgagctttttggcctggcccgggccgggaccggggtggagggcgagcgcctggaccgcagcgtcctcccgcctcggccgtcctgcctggcgtgggggtggggtggggtgcggtgtggtggggtccttgctccggggagccctgcgctgttcccttttctcgctctggaccgcgcgggtcacgggactgcgggatcggctaggccggactgagtcggttacggcgagctgagacttcccagtagtgcaaagttttagtgaagggggttctacgaagtgcctgcctccctaaaaaaaaattatttcttaaaaagtcttctaaataatgtaatgagtggaaggaaggtagggaactacatttcagtgtcatctaatcacaaatagattctgccttgttaagatgttagccatggtaagacgtgtgtgttgtagaaatttaaagaatgaggcggttttacaatcaccttatggggaaaggttttaggggtgataaaatataatacatttctaaaataaaagtatgttttctagatctagcacatttggtcaacacctcagtcattggtggaaagaccagacactagaaactgattttaaccctggggtgaagaatggttaagcatagggaatactttagtaccttgctttacatatactgatgttccagaataattctatgtaagacttcttccctggtaaaatatgaaattttgatcaagccttcctaaatagtgggtttcatacaatttaggtaacccatgaacttggatggaaagaaaggtatatcatttcactaaattttaaaaactaatattcagttaaaatataagcaacaaatcacagtagtatctgtgactgtcatcagtagagatcataaaatatgtttatatcacattgcagttaatatagaaatactgtttatacttattcaaaattatagtaacacatcactgaatttattgaatgcaacagagaagcacatatatatatcgcgtttactttttatgactgttttaatagaattagttttcttgtaaatcctgtgtatatttaagaacagtattcagagaagaggttaagaagcgtcatcctatagtaaaagagatgtaaggcatagagaaagtttggaacttcttttgtaacagcgataatccaagcttgtctaacctctcagtgagtttagaatgagtctctaggttgtggatattaaggaaaaattgtttcatataataaactgcttgattttaacttttaggcaaatttgttgactactgagacagcggtttgaaggtatcagattcactatggaaacttttaggaaataggttcccctagtgaaacttgttaaactaaataaagcccatgagaatctaacatgcctttcagaaaatattgtgtgaaagctatttgacaccttttgatgcacagtgtaggattcatattcttttgactaatactgggtgttgaataccatttgcttcctgccgtgcacagaaatttggagtagggagtgaaaacaaagtatttgctatgttttggtctggagggacagaaagaaaaacaagctagctgccaaagataaacattatgattaataaaccacactttttattgcaaaaacagttctgttgtgtctaaagtatttttttttttagttgtttaccagctccttcaggaatatgtttctgatttaccagtgctatttctcgagcagtttcaggtcagttcaggtcatcctggccaacatggtgaaaccccgtctctactaaaaactcaaaaattagccgggcagggtggtgtgcacctgtaatcccagctactcgggaggttgaggcaggagaatagcttgaacccaggagacacgttgcagtgacctgagatcgcaccactgcattccagctgggcgacag

SEQ ID NO: 45379 - DNA, 1035 bp, Homo sapiens
ttcccattcccgtcgcctctgatttcattgagcagtggtttgtgtgtgtcatctctgatttctttgagcagtggtttggaggtttctgatcaaaatgactttgatcagaagcctccaaaggtacaggagaacctaacctttgcacatactttggagaaataccagggacagagcagaatataaaacatgttaaatgcagttgccaagaggtagaagcgggcatgggcaagacagctgaggcatctggatctgatcagaggcagtagttggaatgagtcagaaatagatggattgagcatataaaacttcctcccaagggtaggcttgcactgtgaggaggggtttcccttagtagccatgtctgattggtgtctgttttggtcaaaagaggctatgtaaggggaaaccaaatatttggggtacaggttactttctttgcttcaagaaagctctcagtatgtcctgaggaagtctcgcctatcctagggtagactgggaactctgaaggttatagggaagtagaaatgcctgtctctgcctgattcttttctgtttatcaacctcctctgggatcagtgagttcaatcttgtgaaataactgatctatcccatgcttatttatcatctgagagtagtaataaacacacttacccactagtagatacttaatttaatacttccagacattgtggctgttactgactgtatgaagataaaattaattaagggattctattctaaagtaatctgttgtataatgcagaacattacctgtgtgcaggagatactccatgtattgcatgaaaatgtgagaatgctaaaactaatttctagagagccaattgagaaagaaaaattggaaaataacattaagaaattattttaatatatttttgaagtctgggtaacatagcgagatcctatctctaccaaaaaatattttttaaattagccaagtgtggtggcacacctgtagccctggctactctggaggctgaagcaagaggatgacatgagcccgggaggtggaggctg

SEQ ID NO: 45380 - DNA, 1064 bp, Homo sapiens
tggtatcagggctagcctccctcaaagcaggtggcagcttgctacattctctttcttgggtgatttgtatatagtcacaaatgaggtttcacagggcctagtacatagtaagtactctgtgaaagtcagttataataataataataatatgccccattttcaaactgggtgttatagaagcagggcaagaaattatgagaaaaggagccactgcctaaaagagttgattgaaagagatcatagaggtcataggtataacaggtacttggcctttgggcttttcttgctttgtattgaacaaagcagaaataagtaggtcaagggagcttgatggcaagcagtagcctcagctcgtttgtttctcaggcatccactgcctatttctgtatccttaagaagagatgctgctgtatccacatcagcctagattttagaattataattgatggaggagggaaaagcttctttgttgctaattaaaagaaagttaataatattaaaatggaaagccatctaaaattttggaacttaatgaacatttttccttttgttcaaaaaatgaatatactgaatttttgtttccctgacataatattgtacatctgaattatgttgatcatagaccaaagttatcaacattgtgtaggcattggataatattgtaaatttgttttataaatttataactatatgaaagaaggttgtcgggataatatcaagtgatgaaggtatatgaaagtttattggagtaatgtttttgaggtaagttagccaaccatttaggactgcaggagcgcaccttgtccagagtcataattattgtaaatgagatggatatggttaaaaaacagaccaaaaaaaaccatgttacttcttgttttttgacggtacatttttttttttaaactctaatagaatatggaaggctccatgttgacaatcagctttggaagttggatggaactacctggacttaaatttaaggactgggtatcaagtaaacgaaggtaaagattgaactgtattaaaattctttggtgtacgttgaaaaagagaatgtggaa

SEQ ID NO: 45381 - DNA, 1021 bp, Homo sapiens
gtgtataatgttttataagcgtttaggaaaaagacaaataatataattgaaaaaattgacaaagactgaacaaaaattatatgcagaagaaatataaatgtacataaaaaaagtgaaaaatgatcagtttcattagtgttcaagaaagggcaaattaatatacaaacaattttttctcattagattgacaaaaataatattaaaagtcaacagataacattcaaaattgaagtatgggcaaatttcatattctctgtggttatataaattgggctgacacttttagaacacaaattcccaatattttgattagagaaaatttacaaatttaggtaggtctcacaccagttttacttctggaggagatggagggtaagattggagaagggaggagaaaaaatactcactttgtatacttctatatcactgaatattttagagtaagaatatcttcattacttaatacttatgtattacttaatgtatttactttaaaaaataattgcattgagttagaactgtctacacaaatagaaaatgcacccaacttgaagcacaaatgtattaatgagagttcacttttgtgtcaagtgaggacacgtccctctagaatgtatagcttagattacaaattaccaaaatgtcatctcatttgtaagaaaacacaagacatggtttgctcacagtctctctactgctactgaaacttttgtaaacattctttttcccttttaatgaacataaattcaacttctctgttgattcccagagactccttagttgtttccactgcatatgcctcactaaatcagacttcagttaattaaattcgctttacagctgctacaattcttttgggccattaggcttaaggggatctattaaaaatataattttatgatgtcaaattcaagagaaaaatggaagatattggacttgggcagaaaggtgaactatttctaagcaaataaagaaagccactctacccattattcttttttttttttaataaacaagttga

SEQ ID NO: 45382 - DNA, 1035 bp, Homo sapiens
ccgaaacttgattagatcccaaagatgggagaagcctccaaaagaggtgatagtttgtgtctctctaacatgtgcaattgaaacagcataaccaaatatctaggctgaaatttatgtcaaggtaagcaacaactgtcattcgtgctagatctaatggatgtgttttagacattttcatatttgacctataacaggtgacttcgttgaccattccttcctttaaaccctctcttttggtggaatctcatgacactaaaaaattctgatacttttactattattttttttttttgcaattcaatctctcttatgaattcttctactgcttgctctgtaactgatgctacttattctttcatttaacaaatgtttgttcagtatccaccatgtagctggcaccgttctcagcactgggcatacaacaatcaacaaggcaaatttggccccttcccttatagagtttacagtctagtgtaactgagaaactgaatgtgaacaaggacctgatgagtgagacccaacatgaaccaagaccaggtttgaatcacacacttccatcccactccatgattttgccagaaataattaattcaaattcctctgtagtaaggacttagacatctctaaagcaagccagatatctgtttagaagctctggccacctttcatccatctgcctcgtggatcttatctcttgaaatcttttagcacttcaaactcaagatctcaaaaattggtctgttttcttattctgtgaatggcatcctattatcaggcaaagcacttgcctcttgttctttttttctctcttaccttcatcctaagttcctaagttctattatgatatatcctatcacttgaatttaccccctattaactcttgcctagattactaaaaaaggtgcctaactgctctctattggttttaatcaaatcccactcaaaccattcttcacagtacagtcagagccacctttttaaaaatatataatttgggagtgggatttttaagaaaaataatacaaaagaatacag

SEQ ID NO: 45383 - DNA, 1032 bp, Homo sapiens
cattgtcgtccccaatactgagctctactatttacttggaacatattcttccagacattattatgtgtatattgacattgatatatatgtgtacgtgttgttgttttttccaacagtgagattatactatatgattagtgcagttgcatccccttttccttcattttatttaaaggctgcatagtgtctcatgaaccttaatttttttcaatcaagttccttttaatggattttcaatttgaatccaaccttccatgggaaaaacaggattgaaataaatattctcatatacattattctcacactcacgttcaagtaattctgaattctgaatggtagattcccaaacatgtaattcctcaatcaaggcttctctaaggtgcacacccaccagcagtttatagaagtgccaaaattatccactcttcacatacaattgtgaaggccttcctaaatgcattttttttttgccgtatcttatcacgatcagtcaatacataactcagttttaattaggcaattgtgtttgaactctggcattaaagctttgattttgtatttctaccataattagctataatctaaagcttcaggagtataattactacctttcctggccctaccctgtttatgactgttttcataaccttactcatttttactgaaccgttttgcagatcttgaagttggtagttaagaatagatagttgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgagacaggagaatggtgtgaacccgggaagcggagcttgcagtgagccgagattgcgccactgcagtccgcagtccggcctgggcgacagagcgagactccgtctcaaaaaaaaaaaaaaaaaaaaaaaaaaaagaata

SEQ ID NO: 45384 - DNA, 1001 bp, Homo sapiens
gttggaacaaattttcaatgtttttaattctcccttttctgcctgttcctaaaaactttcaaaataaccatttcaatgtaatttgtcttgaagaagtttacccaatatctttgtcattgcaataatgtagtatggtgatggtcaatttaattattgcttataaaatgaacttgattgcagtaaccatggtatcgatgagactaatgcagtgaagctttattactaatatatatagccttatcaaagcaagctaagaagcttgctttaataattaataatttaaaaatatttatttagatgggattcagttgtttaaagaagtgagataaattcaaaggtaaataggtattctctgtcaaatttaaatctctaaagaattagagattagttttttatttgtgtataatttaaaaaagacctaataggttactgtctttttaatgcatttgttattctttcgtattttttaagcatcggactggagttagtaccatcatctcttgagtctttcataactacacatttttatatttccttttgtgttttctactttgctttccttgaaggaacaagcattttgtggcctttaccttgtgcaattttagggagtagcagtgtaaaaggtccaagaccacatttacttgaaattcttcctcttttctgatttgtcttaccagatatttcccttcttgcctcattctctaggatttgaataaaacctttgccacttattttattagccttattaatgtcacctttccttcaactcaaatatttgagaaattttatgttacatatatgaatgaagttgaaagctactgtttggaagctaagacttgtatagagtagttttgtatatgaatggttgttctagctcagatttcaggttactcacaacagtattctttctaagaggatatatacaaatgtctctcataatttatgtaaggaaatattatgaaaatgagacttttttagtttgatgtgtgtttcccaaacta

SEQ ID NO: 45385 - DNA, 1059 bp, Homo sapiens
aatccaagcactttgggaggctgaggtggtggggatcacctgaggtcagaagtttgagaccagccttaccaacatggtgaaaccccatctctactaaaaatacaaaattagctgggtgtggtgatgcataactgtaatcccagctacttgggaggctgaggcaagagaatcacttgaacctgggaggtggaggttgcagtgagccgagatcatgccattgcacaccagcctgggtaataagagcaaaactctgtctcaaataaaaggccagggagtgggggagtttatctaagttagtcaaaaccaagtaattaaaatatataataagtagcatagagttttctagtgataattaatagctacaagcatggaataattaaatattaagagaggctgtctggtccaagttctaggcctacatatgatatgcactacattgaactgaatataggggctagtgagaatgagcaggctagaataaagaaagcatgcagctcattagaaggaaataaataaagctgggcaaattagaacagattaagctcaaaagatacttgattttgaaaataaaaactgatgtggagccataatgactattccatagtttgagtctttacagagatgatctaagcaggcatcattcaactaatatttattgagcaactattatattccagatattgttctttgaatgctagatgattcacacacagaccctgtcattggaaagtttcctatttaatagtagaggtaaaatatacatgtgaatcatagaatcaacataaatgcccatcagtgatatgctggataaagaaaatgtggtacatatataccatggaatactatgcagtcataaaaaatgagattatgggccaggcacagtggctcatgcctgtaatcccagcactttgggagtccaaggtgggtggatcacgaggtcagaagttcaagaccagcctggccaagatggtgaaaccccgtctctattaaaaatacaaaaaattagttgggcacagtggcaggcgcatgtaatcccagctactcgggaggctgaggcgg

SEQ ID NO: 45386 - DNA, 1021 bp, Homo sapiens
catgtatctttcccaccccttctactgactcacacacccatctcctctagaaacaacctcacacagacacacccaaaataaagctttaccagcattgtaggtattccttaatccagtcaagttgacacctaaaattaaccatcacactagacttcttatagttctatcccaaacaactgtttgctcttaatggaacatcatttgttccaaataactcagagaatctcagcttaaacttcactttttccaggaagcctttcctgacctcctaataccaaattttccatatatcactgtttccttaacccttcgtaacacttctcattctcatagcacaactttgtccttgcctatttgtgagtttttaaaccttcattgaatacttgtgaggggtatacacatgcaaagatttgaaaaagacagcaacaaatatcaacagcaataatagtggcagtcatggcagcaaaaacaaacaaatgaaaatgcaagagtcgacagcaacggaagtaatgctatgaagtgttttcaagtagggtggaagcccttatatcataacatgagatactgaaggaacacattggagtctgaaaatctctgcagctaaaacaatacaaaggagagtatcatggcaatggaagactatgtaggacttaagaagaggactcccttcaaggatttgctgcctagctgtagggaatggggattgcagacagcctctagctgttagctctttcagtaacttaagtaatccattcaacaaccgtatgacttaagggcttctattagcattttcattttacaaataaagaaattgaagtacaaagcaattaagaaatttgcccatagttatagtacctgccagaggtgagatttcaacctagatgtagtgtaactcacagtggccatgttatgttgccctggagtggtcagaggaaatgaagaattcaaagagctggcagtccaggatatgggggtctgctcgggaagatgtgctgaagaattggtcagtacagtgattaga

SEQ ID NO: 45387 - DNA, 1728 bp, Homo sapiens
atggaggttgtggtgagctgagatcacaccactgcactccagcctggaaaacaaagcgagactatctcaaaaaaaaaaaaagaaaaagagaaagaaagcactaacatccctactgcctctttttcccattccttcttctatatgtctccttcctgcttccttaaggttgttactgcccagctcagccagaaaccacatgaggagtggctctttgagagcatttgaggttccagaacacctccattcctgaggggagtctcttgagcagcgatttggggctgcgccagttgcttggtccttcttcctttggaccaaaggtacagaagcccaactttgtactaaacaaaaatgggcagccatagggctgggagtgcccactggagactgggacagaaatatctagatagtcatagtggcataagatccgcaaatggagattatagaatctgtgttttaagcaagtcagacaaaccagagaatgctggaaaatttatgactgataactagagatcaaggcagaggctatggggcagggtgggtgggggggttcaccagtgtttaagaattaagctagggatgaaaattttttgttttgttttgttctttgtggcctggagttggggaggtggtgatacatgaagacatctggaatcctgagtagttggcaagattgaatcaggagtactggtgtctacagtaaacacagaaatgaatctattcctaagacaaacatttttctgacttggatgctgtgctgtaaacactgctgtggaagggagataatcttagagcacagatgaagcaggtctttgggttcacatggtgaggaaataaatataacctaagagattactgccacaggtgagtcagtgtgctcactgggtaagatctgcaacttgtgtattttgacaacctgagaccaaaacatgaaggacaatctacatacaaatgtagtcaatataaatatacaaatattcgatcatagtattatggcatatttcccaggataaactcttaaaattcatctatgtagaagtatgtttaagtttgatatgtaagataaaatggagtccctctgatagagaggatagggaaaagaagaatcccatggctctgcctgctcaccccccaagtagggctccaggtgactcctgaacaagcttcctataatgcagtgtgagaaataccaatctggcttacccttttaaaaatcattttgaactcttaattaattccatttaatatactgatatctgtattcatggagttgtatcttagtattttaatccaaagcatttcctactcaagttggtatattatagaattttgaagaattttcagtgaaaagaagaaatattagaaatctatattctctttgctaaaaatggatgtgttactttaggtgagttgctatgctcaagtaaagggatttgagactttcagaaataaatagtagttgctggagggtgatagaagatgaagctacacatatcccggttatggcttctgtttccccatgcttccctgatttagccaactctacttactcttctaaattttaaaatgaaaatatcaataaatgaggagggtaaagacatgagtcaaaaggaagtagtcacaagtaaaaagctgcatcagtcatgtgtaataaacagtattaggaattagtctgcttgaatattctcattagcacaaggttaacatgtatcaaataactgttagagattt

SEQ ID NO: 45388 - DNA, 1051 bp, Homo sapiens
tggagtgcagtggcgcgatctcggctcactgcaacctccacctcccaggttcaagtgattcttctgcctcagcctcccaagtagctgggattacaggcatgcaccaccacacccggctaatttttgtatttttagtagagatggggttttaccatgttggccaggctggtcgtgaactcctgacctcaggtgatctgcccacctccacctcccaaagctctgggattacaggcgtgagccaccatgcccggctcctttacccttattttaactggattgtcttatttctgagttgtgagagatttttatatattctagatagaagtcccttatcagataatctgcagtttttcccattctgtgggttgccttgtcactttcttgatagtgtctttgaagcacaggtttttaattttcatgaaatccaatttatctctcttttcttacttgtgctttgatgttatagctaagaatccactgccaaatccaaggtcatgaatatttattcctatgttctcttaacaattttatagtttcagcccttatatgtctttgatccatttgaattaatttttatatatggttaaattttgtaaaggttaaatttcattcttttgcatatgactgtctggttgcagcaccatttgttgaagggactattctttcctcaattgaatggtcttggcatctttgttgaaaatcagttgatgtggttttacttctgggctccctttccttttcattgatctatgtgtctatccttatgtcaataccacactgtcctaacattgctttatggtatgtttttaaatcaggtaatgtgagtctttgtactttcttctttttttaaaattgatgtggctattctggatctatggcaatcctgtatgaatcttagaatcaatttgtcaatttctacaaagaagtcagttcgggttcttacaaggattgtatcaaatatgtagatcaatttgaggagtattgacatcttaagagtaattcttccagtccatgaacatgggatatttttccatttattttaatattcttt

SEQ ID NO: 45389 - DNA, 1094 bp, Homo sapiens
cagctactcgagaggcaaaggtgggaagatcgcttgagcctggaaggtcaaggctacagtgagctgagatggcgccactgcactccagcctgagcgacagggtaagaccctgtctcatgaaaaaaaaaaaaaaaaaaagtaaaatatcattgtttacagatgatttgattgtatgtttaaaacacccaacagaatgactaaaaattattataaacagtgatggaagaaaatacctcatatacagtagcaacaaaaaagaaaaaataagtaggcatatccttttttttaattttaatttttatttttgtttttttttttttgagacagagttttcactgttgttgcccaggctagagtgcaatggtgtgatcttggctcactgcaacctccctctcaggttcaagcgattctcctgcctcagcctcccgagtagttgggattataggcatgtgccaccacacctggctaattttatatttttagtggctaacagggtttctccatgttggtcaggctggtcttgaacttccgacctcaggtgatctgcctgcctcagcctcccaaagtgctgggatacaggcttgagccaccgcacctgaccttggcatgtactttagaaggaatgtacaacataattgaagaaatttgtgagtattactgagggatatgaaggcaggcttttaagtgaaaatgcattctttatttttggatgggaagattaaatattagaaagatgcaactcttctaccagtctgtatattttaaaggaccctaataaattctatcaggatattatttgtttgttttggggtaatatacaaatagagtctgaagtttaacaggaaagttatatgaaaagctaagaaaattctgggaagggaaagaaggaactaccccatcagataatatgcatgttatatagctactataatcacatatatgacaggcttatggatacacagactgattgatggaacttaaaacaggcaatcagaatagattcaattcatataggaatttggtatgtgaaaaaagtggcatttcatataagtggggataaaactgattaatgatgctgggaaaactgagaaaac

SEQ ID NO: 45390 - DNA, 1035 bp, Homo sapiens
ggagcatagaaaatctaaccagatatgaggtaaagccagaagaggcaacctggagaagtttgaactggattttaaaaaatcagtagctgtttgtcaatcaagaggatcaaggtaagagaaagaggcaaagacattcatgcagacagggaaaaggggattcaaaaacagtgcgcaaagtgcattatgcacttacaaactttataaagtctgatatgaagtgggacacagtggaagagagtacttgaaagataaagaaggcagagaccaaattccaaagtccttgcctgatacactaaggaatttcactctatcctgtaaacctgttgtttccaaaaaaaatttttttttatttttttgccccacaagatgtatataagttgatcacggaggtgtgaaaagaaaatattaaaatgtctatttgtatatttgcagtttaatcacccttaatctatttttaagtttatattatatagagtagtaattaataaaatatttctattatatctattacgggttgcatgctcaacatcttattctgatagagatgcatgatcaaaatgatttagaaaccactgctagtgagcgccgagatcgcaccactgcacttcagcctggaggacagagcaagactccgtctcaaaaaaaaagaagaaaccactgctaatggggccaggtgcggtggctcatgcctgtaatcctagcactttgggaggccgaggcaggtggatcacctgaggtcaggagttcgagaccagcttggccaatatggtgaaaccctgtctctattaaaaatacaaaattagccgggcatggtggtgcatgcctgtaatcccagctacttgggaggctgaggcaggagaatcgcttgaacccaggaagcggaggttgtggtgagctgagatcgcaccattgcactccaacctgggcaacaagagcaaaactctgtctcaaaaaaaaaaaaaaaagtaaagaaaagaaaaagaaaccactgccaatgaacatggatatcattgaagggtgctaagcagatctgat

SEQ ID NO: 45391 - DNA, 1060 bp, Homo sapiens
attcagatacctgatacatgaaaatagttgagagaattagctaatttaatctagatattttaatcgacgtgcatatttaattctgtttatatttcttttcattctgaattgttttaattttccagatttttagatatatccgtaatacagtaggacaaaagaatttggcatccaaaacattggtggatcaaagatttttgatttaacttcctgaataaataacttaaagactcagtataatcatggccaaaaaaaagtcatgatatcaggttagtttgccatattttttaaaacttataatgcagactattctgtttttgttttttatttgcagaaagatttatttttataacttgggaatatataacctgatataatagaaaatactgttttcccattgtgtgtagtatttaatgcagtaaataataaattaatactgacagtgaggccaaaaaaaatctaaatgttgctttcagcataatactttttaatgctaattaaaacagtccccatcatttgtctctgtagattattttataaactgagagctgcctgaatcttctcacattgacaaagtaatttgattccaagtttaagactagttttcagtttgatattttcatgttttgtgtgcttatggttaaataaatgttgaaagatattttcaagtttacttagaaattttaaattgtattattgctgattcaatttgcatcattctaattgctcatcctctttggcagtggattaattcactgttgggttaatatgcatctcatgaaatgatatcttttcattcctttgtatacctgtattaggtcagtatacgctttccatgaaatatatttgcatttctaatatagtttacatttattaagttataacgtatgacatttttcccaatatcattttttatacattttaattacttaatgttttaagagttctcttccagagttttgcttttcaattacgtttaaagactgtaaataacaaacagtaaggctgggcgctgtggcttacgcctgtaatcccagcactttggaaggccaaggcacgt

SEQ ID NO: 45392 - DNA, 1035 bp, Homo sapiens
attcttgttataatcatcatgcacaaaagcatttgcccacgtatttccatgaataatcaaagaaagttctgccttcgcagaatcatttcatgatctcgtactttgattttagaagtgatagtacagtgagggtctggaccttcctcagcttgtgatgatcacggacactaacagtaaatctggatgaagccaggtccttgagacccacagcacatctggtatattcactcctgttacactcacatgttcggtgctcccactttcacacacgccacatggggagcatagaaagcacccagcactaaaatcatttccagttttaaaatcactatgacaagtaagaggagacaacccatgtgagtggaccaggcctttctttgagcccctttaagtgaaagttatcttagaaaaggcccagggaagacagggggcctggagaatgaaagaatggccaggttaacaagcacatgtgagtacaaggtttgcatttagctcagctgatgaagcaagagattaaaacagacatggaacttgttgaaaattttgccaacaattgggcaaaagatttctattacaatggacattttgactctcttttaaagaaaaataacagctgacgatggtttaatattactaatataacaggactatttttttctgtcatttacattcaagtgaaagccattcgccaatcttccaaccttttgagaataccctgtcatgtaatatccaagtgaactggtgagtatctagtccccaacccaaatattatgaaaagccctgcctccttccaggtttctgaggattcctgggaaggtgtgcatgagtgcatgcatgtgcttgtgtgtgtgtgcatgtgtgtgtgtgtgtttgtgcttgtgtgcctgtgtgtgtggtggacgtcacagcagaggagctgaatgtgcagaaggcatggtggcttctgttcgtcaagtcacctccccctctgaatggttctgctgaattcctgtttctcttgccctgcagctattgttcttctaccacttcaccttt

SEQ ID NO: 45393 - DNA, 1044 bp, Homo sapiens
gctcacttcctagacggggtggcgggcgggcagaggctgtaatcttagcactttgggaggccacagcaggcggctgggaggtggaggttgtagcgagccgagatcacgccactgcactccagcctgggcaacattgagcattgagtgagcgagactccctctgcaatcccagcacctcgggaggccgaggcgggcagatcacccgaggccaggagctggagaccagcccggtcaacatggcgaaacactgtctccatcaaaaatacaaaaaccagtcagaagtggcggcgcgtgcctggaatcccaggcactgggcaggctgaggcaggagaatcgcccactgcagggaggttgcagcgagccaagatcatggcggtacagtccaggctccgcaagagagggagaccttagaaagagggagacgagggagagggagaccgtagaaagagggagacgggagaggtagaggtagggggagagggagagggagagggaggtcgggagtttgagaccagcctggcaatgtgctgaaaccttgtctcaactaaaagtacaaaaattaagctgggtgtggtggcatgcgcctgtaatcccagctacttgggaggctgaggcaggagaattgcttgaacctgggaggcagaggttgcagtgagccaagatggcgccactgcactccagcccgggcgatagagcaaaactctgtctcaaaaaataaataaataaaaaattaataaaattaaatataataaaatagcacttgatcaatttctgtaaaacttgtaaaatatgtgggacaaagtagcaaacataagaagccgtatttcttcatttcttcctggcaccacaatttcaaaaagtcactgactctgtgggacaggcagctctctggaaagatgctttgaagacaaaacaggagagagcacataggccccccacatctcttgcctgagtcactatactgcttaaaagataaatgacctggtccttgccttgtcctacacataagataatgtcagatggggttagtgattatgcctctgt

SEQ ID NO: 45394 - DNA, 1111 bp, Homo sapiens
ctgtacagtgcatgtagccctttgagactggcttttttcactcagcataatgcgtttaagacccaaattgctgtgtgtatcaatggtttatttctttgtaatgctgagcagtgttccattgtttgagtgtatcagagacttcttaatctttcacctattgaaggacatgtatgttgtttctagtttttggctattacaaataaagctgctataaacattcatgttcagggttttgtgtgaacaaaagttgttacttctaattcccagaagtgtgattgctggaccatatagtaattgtacatttaatttttaaagaaacttccaggaaggctaatttccagagtgattttacaattttacattcttaccaacaatgtatgagagatctagtatctctggatccttgtcaacagttagcattacaagctgagtatcccttatctgaaaggttcgagatcagaacgtttcagattgtggggttttttttcagattttagaacatttgcattatacttactggttcgacatccctaatctgaaaatccaaagtatgaaatactccagtgagcattttatttgagcatcatgttggcactcaaaaagttttgaattttggagcatttcagactttggaattttggatcaggaatgctcaaccagtgtcagggttttgttgttgttgttctgttttgtttttgttgttgttgctgtttttttttttttaattttagctgtcgtaatagctgtgtagtgtatcttatagtggttttaatttgaatttttcccttatggctagtgatgttgaacactatttcacatttcacctaaacatcccttttcatatactcacagatccctttttcttctttggagaagtgtctgattacatcttttctctattttctaatcaggttgctttcatactgttgagttagagagttctttatatattctggatacaagtctgtaaatcagatatgatttacaaatacattcccatccattgagttttagcttttatcactgtattttttatttcttaaagttctattttcaaagtatgtctgatcttttttttaatatatatatactttaagttttagggtacatg

SEQ ID NO: 45395 - DNA, 1037 bp, Homo sapiens
ctccccattttgacaccttggtcttctgttatacattcatataaaactctaatttcacactaaactggtttcatgaactcttcaaaacatattgcaacagatcaatcaacaagtatttattgtgtgcataccatgtgcccagcaaggtatataatcttttataggcaatgacagctacagatttgcttatttcctgcactgagtgttacttagttgatagaccatctggcttcagttttttgttttgtttttttttttcttttagttgcaatgattgaaaacaatgctttaaaatctatattccagtcaggcgcagtggctcacacctgtaatcccagcactttgggaggccaaagcaggcagatcacctgaactgaggagttcgagaccagcctggcaaacatggtgaaaccctgtctctactaaaaatacaaaaagttagctggccatggaagcacatgcctgtaatcccagctacttgggaggctgaggcacaagaatcctttgaacctgggaggcggaggttgcagtaagccgagatcgcgccactgcactccagcctgggtgacagagcaaaactctgactcaaaaaaaaccacaaataaaaataaataaataaaataaaatctatattcttatccacatctcttggtccaggaaaaaagcaaagtgtgggaaacagcaataaatatttgtggaatgaattattatcatgttagacagattttctattttatttagcactatatatacttttgctatattttgtacaaattacagaattgttgtctagaagtccagtatgcattaaaatggtcactagaaatgtggttctaaagccaaaagatggagatttcattagaatgtagaagaggaaacataaatttaactcaattagtaaatattattttagctcattccttatactaggaattatagccggcactagatatacaaagataaatatcactggcttcatcaagttcaatcccttctcactacatttttttttttttttttgagacagagtctcgctc

SEQ ID NO: 45396 - DNA, 1092 bp, Homo sapiens
gtggttgggaaagagggagggtcctgatcagattcttggtgaagtgggaggcgcagtttggtttcgaagatcaggtttaggtactcagtgcatatttggaatgcgatttttaaagggctgtggatattgacaaacccagaggcacagggggcgagggaacattcaccacggggataaagaggcagggatttgggataaacgtggcaagattaattgggaatgggcgaacacgcagaaactgaagaaagccaagttcacttaggttcaggggaaaatggtaaagagcagagccatctaattattatagttttgggagatgatgaggccaggaggcctttgagggtcaaagtgggtgagctggagaaaggtttccatgccgccttcaggatcaatgctaagataagtaattcattcagcagtattttatttatagaaaatgataagtatgagacaaaaatgggaagttagatgaaacttatcggttagtgataaacaatacaaggaatactcatggcatagtaacttcatgataacccctactagtttcaggaagtgagaagcaattagatttttgcattctggtggaaaacacaactttttaccttatgagtggagctgtggatgtgatagtaaatcgatctaatttagactcaagcccccctgccttttttttttttgaaacggagtttcgttcttgttgcccagtctagagtgcaaaggcgcgatctcggttcaccgcaacctccgcttcctggattcaagcgattctcctgcctcagcctccctagtagctgggattacaggcatgcgccatcacgcccggttaatgttatattttgagtagagacggggtttctccatgttggtcaggctggtcttgaacttctgacctcaggtgatccgcccacctcggcctcccagagtgctgggattacaggcgtgagccacgggtccagccgactcaagcctttctgaatcaagagtgcaaggaaggagtttaaaggattcagcggaaagcaatttttaaaaattaagcataagaagtgtttactgatgtgtgacttgctgacctgtccctatgcaggcttggtt

SEQ ID NO: 45397 - DNA, 1031 bp, Homo sapiens
gatattatacacaatgtataatgatcaaatcagggtagttagtatatccatcacattggacatatatcacttccttgtgttatgaatatcccaaatcaactctcagctttttgaaaatatacactaaattgttgttaaccatattcattctatagtactacagaatactagaagttatttttcctatctagctgtaattttgtatccattaaccagtctctccctatcctcccctcccctctactcttcccagcctctgataacttctattctgctatattgggacctttcaatgtggggatttgtctcaggatatagatatttctctttattgtgctaaatttttaaaaaatggaaaatgcagcatggagtattctatttgggatctttcttgataacaatattaaatatttaaggactaatgacatgtttaattactgtgaagcagaataaataatctggagaaaaatctttctgtctttaggtgtttacgaactgacacacaataacaaaactgtatctctgaagactataaatgcagtgcagcaaatgtctctgtatccggaacttattgctagcattttatatcaagccactggtagcaatgtatgtatttttcgttggaccctaatatttattttctcatgtattcatgaatcctcaaattatttaatgccatcctattgtcttgttctctttctgttttttccacataggagattattgagccagtgtatttctatattggcattgtttttggattgcaaggaatatatgttactgctttatttgttacaagttggcttatgagtggaacatggctagcaggaatgcttactgttgcgtggttcgttattaacaggtaagaaagctgttttaattgatttttaaaaactttttgtggctgtagtagtcagagttctgaaaatgcctcccctccccaacagtcctcactctaatcctcagaacctatgaatatgatgagatgccattcccatgattatgatactttgtatagcacattagacaga

SEQ ID NO: 45398 - DNA, 1052 bp, Homo sapiens
agctgcgattacaggtgcgcaccaccacggccagctgatttttgtatttttagtagagatggggtttcaccatgttgcccaggctgatctcgaactcctgggctcaaacgattcagacgcctcagcctcccaaagagctgggattacaggtgtgagcaagcatgcccagcataatttgctttcagtctctatagattagtttgtgttttctagaattatatattaatggagtcatacagcatatactttttggtggtggggctccggctttttttactcagcataattttggtattcatgtatgttgtttatattaatagttcattcttttttatcactaagttctattacatagtatggatatatcatagtgcatttattcagatactgatggacatttgggtagtttccagttttgtggggacatatgctttcatttcttttgggtagaatggctaggtcatatggctggtgtatatttaacttttaagatactgccaaactgttttctaaagtgatcgtaccattctatttttctatcaaaattgtgtgagagttccatgtcgtctatattcttgtatttccctgatgattaatgatattgggtaccttttcatgtgtttattggtcattcaagtattttgtgaaatgtctaagtattttgcccattttaaaagcttagattgctgggggcagggtctcacgcctgtaatcccagcactttgggaggcttaggcaggcggatcatgaggttaagagatcgaggagatcatcctggccaacatggtgaaaccccctctctactaaaaatacaaaaattatccggacatggtggcacgcgcctgtagtcccagctactcaggaggctgaggcaggagaatggtgtgaacccaggagggggaagttgcagtgagccgagattgtgtcactgcactccagcctgggtgacagagtgagactccatctcaaaaaaaaaaaaaaaaaaaaaatagaaaccttgtagcccacagcctcgctaaattcatttattagttttagtatttttttacgat

SEQ ID NO: 45399 - DNA, 1050 bp, Homo sapiens
agggtcactaaaagacatgggacagaaggcagagcaggttttattatagcaggatgatgatacattatctttaataatacttatgttgtattttgccagtcttatttcaaggagagtttatatgttcttattttaacagactagtatactgatgtatattagctatttttcttgtgttaattcattgttttttttgttgttagcttttcatgtagtagtgtactatcctttgtaagatctgtataacataaatttctggcaaatttttcaagtatccacttgccatttgaaatattattatgagcattacctttttaatgttctgccttaaatttttatagtaaatgtttatgtctcactttacttccagcttaatatctttgaaagtcattagttttcacccatctcattctgtgaactaggttctatgttgacttcattttttttgaaatttgtataactatagagatatatgattggtcatagaatcagtgtctattacctctaacgtgtgttctgaaatgtatttatttgtaatcctttttgctttaatattttaggctcttattctgagcatggccgtgcctactataataggtctcagcttatggaaagaggtaaaaaaattagatttttatattaataaaatgtactttatctacaaaggtagtgataaatttatatgtgtgggtaggaaacatgttgagacactatcctaacaaaataaaatgtaacattcttagtaatgcttaattttttttgttattaggaacattgcagaagagctaaaacatttctagaatgccacctgatgccattttctgcagtctaatgctagtgttaattcagtttataattggcaaaggaaattgctgagtaaataggaattaatattaaaacacgttttggtaactccaaaactttatcatctatgaaatgatataaattctgcaaattattggacctgaaaatttatttatttatttagtatgtatgtgcctgaaagatgatcaatttattattgtttggtaatgataaaattatttattg

SEQ ID NO: 45400 - DNA, 1204 bp, Homo sapiens
attaatgtgcaaacatgtacgttttgcttcttcaagtttgtctgttccagtattgaatatgctactaaatgaactactctgcatcagtaaagttcctcctgggacaaagcatgtagacatggatctggccactttacctccgaccactgccatggctgtacttctctataatagatggtaaatgttttcataaactcagaaggcgttgggcaacctctgttttattgcactgtggctttcaaggatattcttttaatggacccattctgctgcagggatttttcaaatctggggaactgtgagtctaatggtggagaaaatttgtgactgcatagatgaaaagcaatctgataaaaatgtggatgacttatgcaggatttaccatgtgtcaattaatgcttcatataatttatacaaacctaaggagtacttgaaaaaataattgagatgacatttataatgtatgaaattttctttttcctgtcttttcttcagggcaattaggacaattgttcaaagtagttttccagtcaaacaggcaaaacccggaccccctcagttaagtgtgtaagttggtggctatgacctttacttggcacttttttcattggagttttaaaaatgtttgcaagtttttaataacctctgttatagaagaagtagagcaggaataggagggcagaaggcctgtgtgaaggtttgtttgaaggagttagaggggctggagagtcaggtaatgtgctagatacagagttctaagaagggaagtgctttgggaattgtgccatttatctgaaagcagtcaagtttttttttttgttttttttttttgagatggagactcactctgtcgcccaggctggaatgcagtggtgtgatctcggctcactgcagcctccacctcctgggttcaagtgattctcccacctcagcctcccaagtagctgggattgcaggtgtgggccaccaagcctggctaatttttgcattttttagtagagactgggtttcaccatgtaggccaggctggtgtcgaactcctgacctcaggtgatccacccgccttggtcttccaaagtgctgggattacaggtgtgagccacggcacccagcctgatatttttttcatttaattaaattgtcttgaaaaagatttgtatgtggggaaattaatatatgtcaatattagagtacaatacaaaag

SEQ ID NO: 45401 - DNA, 1023 bp, Homo sapiens
tttccggggacagcacttgcaggagtgtagctgctgctttcagggtctggtccgggtggctatgggtgacaggagctgtggaatctactgttgagattcttcaccagactagtgttggctctcatcctgactgcatgcctcctttgcccttttttctagtcagattctttagcctttttaataattctgtaggcgacctaaaatctactcagtaaatcaatattctgcttaagttgaccagagttggtttatgttgcttgtgactaagaacactggtggtagcacctctccttggaatatgtgtttttttatgtctttttttctgtgttttcgtgagataaagacagttttggttctgtcacctcttaagtacctgagaaattgttaagcaaattggtgttcattattatttcaggtgtgctatgatttgggcgcagcatacttccagcaaggctccacaaattcagctgtctatgaaaatgccagggaaaaattttttagaaccaaagaactaattgcagaggtaaatccagtcataataggaacttaatgttcagttctttaaaacatctatacatttttttggctttgatttttctgatgataaaaacgtgttcattattataaatgtgtgatgttcaagaaagtactaaaactggtttttaaaaatctgtagtaatataacctggaaatatagccccttttataaatctagtaaattttcttccagcttttttctctctgtttttgtacagttaagctcatattgtaaatactctgtatcttgcttaaatctttgactaggcattataaatgtatcatattatgtggaagtactctgatttacttcatttcccttatgtttgggcatttaggtttattatacagctgcaatatttgtatctgcaagcctaaatttttcttcagatttcagatatgtttaagttcctacaattattgccatgtcaatggttatgtatttttctaaggctataatttatcaaaccacattactttccaggt

SEQ ID NO: 45402 - DNA, 1083 bp, Homo sapiens
cttgattggtgaaatatagtatcttttataaacttggctttcattaattcctaatatgggtaaacatttttactgtgtttatcatttgcatttttcttttttatgattcagatgactgaattgtaaacctagtatatctataactaggtttttatatggctggtgcctggaaaaattcccacttcaatctgctgtccttagtagagatattgattaaatgccctagaggtttaaatgctctgactattctagatagacccattagaaatactcattttactttgctaggaaattaatctgctttctaattttatggtatttcaggtatagtaatttaaaacaaatattttttcaaactttttttttttaatcctgtttgggtagaagcatttctattctttccaattgagtgatgattatgctctttgctcgctcctttaaatctctgctggtatgtgtcttttaaaacctttaagcttgtttttaattttaacactgtttgctctttgttaatgtcttgtcatacatacttggtatgataatgatgtccaccttttgtatgttggcctgaaaactctaagcttcagcaaactttctttgtaaagggtcagttagcaaatatcttaggctttctgggccacattcagtctctattgcatattcttaccatttttttggtcccctttgcatagtttacggcccacaaaaattgttcttagctcaagggacgaacaaaaacagaccataggctggatctggcctatgagcaatagttttttgacccctgttctaaacctttaacctttttgttttttgattcttccagttttaaatttttcttttctttttttttttttttttcctgggacggagtctcgctttgtcacccaggctggagtgcagtggcgccttctcggctcactgcaacctccacctctcctcccgggctcaagccattctcctacctcagcctcccgagtagctgggactacaggtgcccgccaccatgcctggctaatttttgtatttttagtagagacagggtttcatcatcttggccaggctagtctcgaactcccgacc

SEQ ID NO: 45403 - DNA, 1045 bp, Homo sapiens
agttgtatgtgtgtgtatttgcacgtgggagagagagagatctgagcactattttaacctcaccccctgggcttttaccacagttaacatcttggtgtatgccttccattacacttttttttccctatgtaacgtgggatcatactatgtgtatttagcaactcgtttttttttccacttaataaatcacctatctctttgcgttgtctcattttcgttttcattagactataactgttcagaaacaaagttcgtatgctcgaaccagaggatctttctcagattcagatctgtcagtacgcaatgagccctaaattcctcaaaggttgtacagaatgcacagcataaaataactgtgcttagtatgtttgggcagtcattccatctttcctccagtgtgccttgataatagaactaatgtgcacgacattacagattatcttttgtgtattttgtttttcatgttatagcttggacagcttttagcagctacatgcaaagaacttccaggccctaaagaaagtagacggactgccaaagacctttgggaagttgttgttcaaatctgtagtgtgtccagtcagcacaaacgaggaaatgatggcagagttagtttaataaaacagagggaatctacgttaggtatcatgtatcggtatgtattggtacgtttctattagttgtgtttgagttcttaatatttatcctatttatactattaacctattaaaggttgatttcaagaacatcagcttttattctgtatatcataaagttggacaatcttacgagttctgtagtactcacctgtgatgaacctgtctgccttggccacctttggaaagatcttttgtttatatgtcattttaagaaactattaatcatttaatcaactggaattcaaaatcagtagtatttaaggttggatagtattgaagacttcacatgtgattaaaacagggaagaaatgttattaggttagtataacagtagaatattacattccttttcacacttgcagaattggagcattaagaataaacct

SEQ ID NO: 45404 - DNA, 1048 bp, Homo sapiens
ccttcaataagttggtttctgtgccatgttccccatctctaaaatagtacctgcctaagaattgtgaggatgaaataatatatttttatttatttattttttttttttgagatggagtcttgctatgtcacccaggctggagtgcagtagcgcgatcttggctcactgcaagctctgcctcccgggttcacgccattctcctgcctcagcctcccaagtagctggggctacaggcgcccaccaccatgcctggctaattttttgtatttttagtagagacggggtttcaccatgttagccaggatgatgttgatctcctgacctcgtgatccacctgcctcggcctcccaaagtactggtattacaggcgtgagccaccgcacctggcctgaaataatacattttctaagctagatatttagaataaagactggtacatagtaggcttaactattatcttcatgatgaaagtactttaaattgacccagagaaaacaaaatatgactaaatgtttgactagagaaaagtatttctcctgagtgggactctttattgattccaagaatagtgggaatggcactggattgaagattacgtttttaaaaccaactacttgatatatagaattcttacacttgtaacattttgtaaatgtctgtaaaattgtaagccaatctaacttatataactatttaaatttaaataaataatggactatttgctaataatcccacaattcattttccactgtactgggctctggtgagttagggtaaactgtaacccctcagggcaacagaagtaccttgtctaaattcaccttgtaaatgatagagccatgcgtctgaatccacagcctgtattctctacccttgtgctttactgctcttaggaggtgggagcagttagcagttttttgggtgccggcctcgcttttctcttcacagttcaatcttctgactctgtacctgaaggtgtccacatttagccaggctcacagtactcttttcttgattcttgggggctgccagatgcactgatatgata

SEQ ID NO: 45405 - DNA, 1800 bp, Homo sapiens
tgaattggctagggcaatcaatcacagcactactttctgtaaaactttagtagttcagtgataccagttctacccaatcttggtgaattccaacttgtttgcttagttatcttctttagtgttttcctggtggtttttcagtgctcttcggtggtgtcataatgcctccattgcacactggtgacaactgtcccccttttctgaaggtgtttatgtaatttacttcctcctatacatgggaagaaatcatgcactgatttcataaatcaaagtcaaaccagacttctgggtacttatttgagattatttaggcctaattttaatagtctttttatgtctttgcaagtgtgaagggtcatattctgaaagtttctgtaacgttatatattttttaaactctttatctagactgttggcattgatcttgagacacttcacaaatcttgctttgatttcaaagtaattttattaacttttctacattttgaaatcagtgtgccccttagaactttctttcccctgaaactgcctgaaggagtactctattcctaccatcagttttggtgacttactagattcagatagcaaagccaaaaaactcacaaaaaaacataccagcatagccaaatagtttgtatgtgtctggatattatgtctgtcttccataggaatcttcttaaaagtcttcagcttcactggactagtactttttactacattgacaaaaggtaccatccaatctacacattctgaaatactgtcccactccaaacctagatagatagaaaaaagttagaaaagcatgaaggttgtacatcagaaactatcttacatatgtctgatgtacttgttgctgtttttgagatattttaaaagaaaccaaatcataaccaagaagtttagcatgtcaaaacagattatcactctcaaactatttacatgactatgttgaagggaaaaaggacttcagaacttcttaaccagtaccttctacatatgaaattgaaatggtcaaatcccaaagaactcttaaagcagaactataatgttgattcatttcaactgtatttaaattccatttggtctttttgttgatacacattcaggattggaaagtacttctaacagaaagataattactgaacagctaattttttttttgccaaagttttaaatgcatgtttagcagaatgttaaagttcagagactgtagtcccattagaagttgtgaaaaggtaagaagacaacaaatagagagtcttacctgaggctttcttaaccacttcaatggaggtaaaatggcacaaggcagcagcagtcagtattctgtactggaactctaatgaatcaatggctagaatacacagatctaaaagctaacaggaaaaacaaaagtacaagcaatttaggagaaagatgagtactaaatgtctcttgctaaaaccttagggatctagagataaataagccaccacccggccaggcgcggtggctcacgcctgtaatcccagcactttgggaggccgaggcgggtggatcacaaggtcacgagatcgagaccatcctggctaacacggtgaaaccccgcctctactaaaaaatacaaaaaattagctgggcttggtggcacgcgcctgtagtcccagctactcgggaggctgaggcaggagaatggcgtgaacccgggatgcagagcttgcagtgagcagagatcgcgccactgcactccagcctgggcgaaagagcgagactccgtctcaaaaaaaaaaaaaacaagccaccaacctgaaggaagtagac

SEQ ID NO: 45406 - DNA, 1029 bp, Homo sapiens
gctcactgcaacctccacctcccaggttccagcgattctcctgcctcagcctcccaagtaacatgttggctaggctgcctcagccgcccaaactcctgacctcaagtgatctgcctgcctgcctcagccgcccaaagtgctgagattagagacctgagccacagtgcccggccagatcctcctcctcctctacttacttactttgttaaatatgctagcctggaaaagtttactttgaatttatgttctaaaaaatttttttaacaaagtaattttaattctgatatttaacttgataggcactctgtgtatccaaatgtaaagacatcatacagaataattctatgccattataaagcttaaacacaactggcgaaaaaaatgcttttccccattttatatcaaaaagagatactttagtttggactcctaaagaatgaaagtactcagaaaagtgtaaggactttgtttttctagaaatattaagcaacataaacactggggacagaactttatgcgtcaaaagttttgttctagaattaaggagtgaagtcaatatgtcattttgtggtatagcctatttaagactatatatacactaaaacctgtaattaataacattaccattgaatcaataaaaatgtcagtacctgagctatttgaatgaatgtttcctgagaatactgaggtagaagaactttaggagcatctttaagagcatcaacttggagaaagagatttagccaggagatgattgttacaggacaaagttcccattttaaagcctattaaacaaaatttaaaaatgcctgttaatgaatgtagacacatacaccacattatacagcagagcttagaggttaagtacattccccatccaaccataaccattgtcaatattttgatgcattaacctcttagaactggatcctaatacctcagttttgactttttacattgtagtatttgagattcaattataactacttatgttacttagtaacatggtttcttttttgcaactaggaa

SEQ ID NO: 45407 - DNA, 1033 bp, Homo sapiens
gttcgtaatgacagtgctgcattattagagagaaattaattcattcttcatataatcttgcaaaggctcttagagtatgatatcatttaggaggtattaccaccagatatgattaaactccctcagtttttctgctaagttttgttttcatatcagtgccagaatttaacagtggtctctatcctacgagggaaagatagagtagctgcctttagttagaaatatacataaccaaaagtgacagacattaggaattgttcaaaaaggatcttaacctggaacagtggaatgatttcctacaagtgcattatttgccttttgagtaaaataaggtccactatcatccatctttgcggcctgatgagttttagaattcagagcttttcagattttttgaaaggaaatatgtatgtatacaaaaccacacatcacataaaagccctggcagggtctaaggtaacacactatgataaagcattaatatttctgcagtgaaatgtacgaagaactaattaggacaaactctgtagtttatttaaataataaaccagtagactgggtgcggtggctcacgcctgtaatcccagcactttgggaggccaaggttggcagatcacgaggtcaagtgattgagaccattttggctgatacagtgaaaccctgtctctactaaaaaaaaaaaagaaagaaaaatacaaaaaattagctgggcgtggtggcgggcacctgtagtcccagctactcgggaggctgaggcaggagaatggcgtgaacccgggaggcggagcttgcagtgagccgagatcatgccactgcacttcaacctgggcgacagagcaagactccgtctcaaaaaaaaaaaaaaaaattagctgggcatggtggcacatgcctgtagtcccagctactctggaggctgaggcaggagaatcacttgaacctgggagggggaggttgcagtgagcccagatcacgccactgcattccagcctggcgacaaagcgagactccatctcaatcaatcaatagataa

SEQ ID NO: 45408 - DNA, 1050 bp, Homo sapiens
agtgagctcccatcacatccttgcactccagtcttggtgacagagcgagaccttgtctcttttttttctcgagaccaagtcttaatctgtcatccaggctggagtgctgtggcgcgatctcagctcactgcagcctctgcctcctgagcttaagcgattctcctgcctcagcctcctgagtagctgagactacaggcatgcaccaccacgcccagctaatttttgtatttttaatagagatggggttttgcaatattggccaggctggtcttgaactcctaacctcaagcgatctgcccgctttggcctcctagagttgggattacaggcgtgagccaccgcgcccggcctgagaccttatctctttttttttttttttttttttttcagtggtttctctgcttaagacaggcacatcagggtcttcactgtcaatgtggaatatttatttgatgtcggttttatagttttagtggataaactttgggaataaggtagtcttcttattagtgaaataaaatcctttgaagtcttcatctgtagatttggtttcaaacatcgctgtaagccagcatccatgccactgcagggaactcatgcagctgctatggagtagttattgaccagccagaaagtacttacctggttactcatgttttgtttgcatagtaaggcctgggtgagttacatgtacctctcaaacattttagatgttgctctttccagccaccgccagttttatctcatgtggccaacaatagtggcacaccccagaatagtcagccagttcctcaaagcctatggttgctcactcactagcattgtgaaatgtttttccagaatatgccaccaggaaagagctgtttcttcagcactgttgatttgctcaagactaaggttcttggctgggcacggtggctcacgcctataatctcagcactttgggaggccaaggcaggtggatcacgggagttcgagaccagcctggacaacatggtgaaaccccgtctctactaaaaatacaaaaattagctgggcatggtgatgcgc

SEQ ID NO: 45409 - DNA, 1026 bp, Homo sapiens
cacactgatacacctgagttactttacctgctcaaacacaagtgcaatagaaaccaatcagtcctgtaaattaaactcctggaagccatataatccataactcagaacagaatttaaagtgagaagcagctgaatcagctgaatctaatggttaagagccctaattctagaatcagaccttagtgcaagctgaatgactttaggcttgacctctcttagcctccatttcctgttgcataaaatggggatgattagaatgcctccttcagtggttccgaggttaatgagataatgcatgtaagcatttaatacaatgcttggcactatagtaagagcttattaaaaggtcataagagtaacctgagtgtgctgggttttccagcgtttgggcaagtgctatataagctggggggtcaaggaaggcctctccagaaggtgagttctgagccaagccctgcatgatgaaaggggcaagcaagctctgtgaagctctaatcagtgactagtagcagaaggaacagtgagtgtgaaggtcccaccatgccacaggggtgcttagaggaccagcagtgtggccagagtgcagtgagggaaagagactggagaaggagaccagatcagagaggtgggcagggtctgggtcaggagagaacatgcaaaccagaatgaaaagtctagatttcattcaaaatgtgatgggaaatgaaaggattcaataatttcaaaagaatccccctggctactgtgtaggaaacactcgtagtgggtagatggaaggcaaggaaataagatgcagtgattcagaggatggagggtggggttaggaccaggatggcagcagtggagggggaggtaaatgaatgactgagatgaagatttattttgaagatagagacaataaggctgcttagtggactgatgtgaaatgtgaaagagaatcaaggatggtgcttggggctctgatctcccactgtgaataatgatactattaaagggaatgggggccaggcgcagtggctcatgcct

SEQ ID NO: 45410 - DNA, 1032 bp, Homo sapiens
ggcagcagatggtaccaagggcgagagtaaaagcaggtaaaccagttgggattctactgcagtggcccaggggagagagagcaaaatcatggagtcatgttgatgcaggtggggaggagtgactgggttctagatatatttgataagatttgccgaaagattgacttagggtgggacagaaggaggagtcaaagatgactgcaagcctttcagcataagaatctctaaggtcaggatgccatttgctcaggtggggaggatgaacctgagagagcaaatcaagattttgaccatgttaagtttggaacacctgttagatagccaaatgaagatgttgcagaagaagttggagtctggagttccgatgagaggtggaggctggcaatagaaattggagaggcatcaggatcaaattgccatttaaaaacagagaactagatgagatgaatcacctagggagtaagtattaatggagaatgagctctggagcacctggaacctttggaaataagaggatgaggagaatctggcaaaggaaactgagaaagagaaaccaatgacaaagggtagatgattctagggagaaaaccaatagggtccacctaggagagcaagaagagaggtgctgttgccctttcacatgcctccaagggtcaagtggtgccactggatttgaaaagtagcagaaggtcattgattactttagagagagcagcttgcaaagtcataaggtcagcagctggacaatattggatttggaagggaaattagctgggcctggtggtgcgtgtctgtaatcccagttactcaagaggctgaggcaggaggatcaggtgagcctgggagttcaaggctgcggtgaactgtgatcataccactgcactccagcctggttcacagagcaaaaccctgtctctaaataagataattttaaagttggaaacaaagcacaagggaaaacactaagttatgcaaaattagaatatattgatatcaataaccaaacattataataaaacccagaacacagaa

SEQ ID NO: 45411 - DNA, 1054 bp, Homo sapiens
ctgatactcccaaacaatattgttgcctaacttcctgctataagtggtttggtgtaacagtgcctctgcccagcctctgctcagaaccaccagagtgactccagatggatcattgggcttcttccatcctgggttacttcttgagccccactctttggcaatgactagcttggaggctcctgctgcagtgtcaggattgggccagtgggaatgcctctattttcaggtttctcacaggtggagatgacagaatgacacctcgtatttctagactcttttatgtatatttcacatatatttaaaaaattctgggcctggcgcggtggcttatgcttacaatcccagcactttgggaggcggaggcgggtggatcacctgaggtcaggagttcgagaccagcctggccaacatgatgaaacccccgtctctactaaaaatggaaaaattggcagggtgtggtggcttgcgcctataatcccagctactcgggaggctgaggcaggagaatcacttgaactctggaggcggacgttgcagtgagccaagattgtgccattgcactccagcctgggcaacaagagcggaaaaaaaaaaaactccgtctcaaaaaaaattctgactcatctgcaaattgaagaatgatgtagttggtagctggaaatcaactagctgcattttaaaattttctggcagtgttacctccatcttgcttcctttacctatcaaactgtagttatttaataaatgctaaatcagaaaaacaaagattctgatagtgtcagagagaaagctctcctagaaagctactttctgaaaagtccaaccaggttattctttaactgttttggtccatggagtagcaaggcagatttagagagcaaagaatagatacaacatgattttttttttctttcttgagactgagtctcgctccattgcaaaggctggattgcagtggctcgatcttggctcactgcaacctctgcctcccgggttcaagcagttctcctgcttcagcctgccaagtagctgggattacaggcgtgcgccacac

SEQ ID NO: 45412 - DNA, 1057 bp, Homo sapiens
ggagtttaggaccagcctgggcaacgtagcaagaccctgtctctactgaaacttaaaaaaaaaaaaagatcatccaggcatggtggtgcatgcctgtagtcccagctactcgggagactgaggtgggaggcttgcttaagcccagcagtcgaggctgcagtgagccatgattgtgccactgcatgcagcctggacgacagagcaagacactgtctcaaaaataaataataaataaatattcaattcttagccaggtatggtgcctcacatctgtaatctcagcactttgggaggccaagctgggaggattgcttgagcccaggagttcgaggctccagtaagctatgatagcttcacttcactacagcctgggtgacagaacaagactctgtctctaactagctaaattaataaatactcatttcttaagagaaacccttaataattaccatgtgattaggactgaaatgtctgaaggcaagctatctgggttcaaatcctggctctgccactccctagctgtgtgaccttaagcaagctacttaatttcactgtgtctcagtattttttccttatctgtaaaatggagatgataggacctccagcctgggtgacagagtgagattctgtctcaaaaaataaaataaaataaaatgaaagagacaccagagagctccctcatgccttctcccccatgaggacatagtgagaagatgcccaactatgaatcagaaagtgacctttgggctgggtgcggtggctcacgcctgtaatcccagcactttgggaggctaaggcgggcagatcacgaggtcaggagatcgagaccatcctagctaacacagtgaaaccctgtctctactaaacatacaaaaaattagccaggtgtggtggcgggcacctttagtcccagctactcgggaggctgaggcaggagaattgcttgaacctgggaggtggaggttgcagtgagctaagatcgcaccactgcactccagcctgggcgacaagagtgagactctgtctcaaaaaaaaaaaaaaaagaaagtgacctttg

SEQ ID NO: 45413 - DNA, 1063 bp, Homo sapiens
ctatggttgttaccattttacaaatgagaaaactgaggcttatggatattaagtaacttttctaagatcatactatgagtggtagagccaggattcaaaccgaggtggtgtgcatccagagagtgtccagggtccacatcttaatcactcacctggtttcctaaatgtgtctgtaccgaagagtcaccaaggggcacttattaaagtacagattccagggtctacctcagagatagcaaatcagggtctctaggggagggacctagtttctgtggtggtttccactcatgagcctctgctccaatgagctgtatttgcctgtctgtctccaatcttggggacagcagtttttcctatggcctcacctttcttacaggtgcaagaagagttgttgatttttcagcctgtccagctttgtagttgctgttaagatagaatggacttccaagctccttacgtgcagaagcagaaaccagaggtcctatcaaaatagttttaaattgtattaaacatacacaaaagtagagcaatgtgctgaatccctatgtatccatcacctaggttcaataattattataattttgctaattttgagaagcagtttaaaaactcatagagaccagtgcttaacagttaaaaaaacagggagttaaaatcgtcattcaaataatttgggaggtgaaattaattatttttaagtaaattacctaaatgatttgggcaagagccatatatgtatatatattacaaatagcataaaacaaaaaactgataatgttaagtattttggtagctcttttgtgtaatatcactttactcaaatcctccccaataccctattatgtgaagagaaatctgttttttattacatttccttctgaaactcagagggcaaaacagtccaattcaatcaccaaacttgtggagtccacagggtgttcccttatgctacaggagaccagagaggagttgcaaagcctatccacagttgtttggaagactttattgggaaagtggtgtttgagtagcatctattaagagtagactttatgtctaaaagcag

SEQ ID NO: 45414 - DNA, 1383 bp, Homo sapiens
atgcccggctaatttttcatgtttttagtagagatggggtttcaccgtgttaaccaggatggtctcgatctcctgacctcgtgatctgcctgcctcagcctcccaaagtgctaggattataggtgtgaaccacctcgcctggcacaattttctatttttaaaaaatctcatgttcagcaaaatcatacatcacaagttttatggaaaaaatagggtcaagggcagaccactcaaaacattaagaagtttttaagtagagccctgataaaaacaactctactaataaatatcttggcacagtttgttctctattgctgtttgcagctaaccatacagccaggccttcctttgcagctttgtatctgggtacacctgtttcctcctgagacatgaaggtccttgaggacatttgcttcctggagagaaaattgtcaccaaaattaaaaatacaatctagaggtagctttctgaaatcattttaaacataaagagatatgacttaaaaatttttcatctgaactgtcaatttccataaatagcttaatatagtgaaaaattgagaggttcttgaagccactaagtctaataaaaaaatgcaattccatggggttttcggttttctgctttttccttagggtcctcaaagatgaggaaggctttgtctttgtgagaaagctcattctagtcacttcaaaacatactggaaaaatagcatatgagctaatttggtttctgtgacatgatgattctattcccctattacctgtcacatgagagccagttaggactaagaaaacaccagggtggttaaatggtaaattttatgttatgcatatttggccactgtatatatttaaaaattgaggctctacaggagctcttgtttatgtgggctatgcctatcaatgtttaccttagtagtcagtaaaactgggatttttttttcaaaggaacaccattatgaatagatgatgctaacattggtgtatccaccactcagcttcagaaatcaaactttactgatatccttgaatccccatatgtgtccttccctgaatgcattcctttgtcccccagaagtacagactatccaggattcagtgtttatcattcccatgtctttctttatgggttttctaaatttagaatatccccagagacagtttaaaatttttaagccaatgcagccataacacagtatgtgtattattttggaacttttattgacttggttcatccacccctccaggtgccattggtcacccaaccccctccaaagcagaggggcagttctctctagtactttattagctgccttgatgtcttgtttccagtcccttcagaaattatggtggagatacacacatacacattaatggaata

SEQ ID NO: 45415 - DNA, 1106 bp, Homo sapiens
caaataacaacagcaaaccaagaaagcagcttagtctgcactgcatttgcatttcttagtttcattccctattcaaaaatgtcttaggcaaatgtgtgggaatgaacatgcactttaaaattatgggacctagtagatttaatggaatgagccctggattgggagccaggggacctggctttgaatggtcccaacccaggcacttatttaccttagtttcttcacttataaaattaaacacaccatctactgatgaatggataaacaaaatgtgatatatccacagaagggaatcttgttcagctgtgagaaggaatgaagtatggacatgtgctataatgtggatgtgcgttaaagacattatgctaagtgaaagaagccagacacaaagaccatacatttcacgattccacttacatgaaatgtacagaatagctaaatctaaggacataaagtaggttagctaatgggtacaggtttcattctgggttgatgaaatgttccaaaattgattgtgctgatggttgtatttaaaactctgcatatactgaaaaccatttaattgtacattttaaatgagtgaattgtatgctatgtgaattatatctcaataaagttgttcaaaaaaaagagaaaaaaatgaaacagtgatttccacccagcccagatatgttgtgaagctcaaatgaattgtttttacaaataagaaaaccacttaaaactatacaatgaaaattatttttaaacttaattatttcttaaattcgaggctgatatactaaaggaatttttccagtgacagttggcatttctataaaccagaattgtacctctgcttacagctctgtggatgaagatcagggaggaggaacagtttcaagttggtgagagtgttgaggggagggaaaaaatggctggtttgtaagatccttgaggtcagggattatttttatcttgttctcttttgtaatcccagtgcctagtacaatgcctgactcaatcaatgtgaatgagtgaataatgaatcaatggtcaaactaatgaactgggggtctgaatgaaaatgatgaggcactttcactcagccaataaacttttaccagccc

SEQ ID NO: 45416 - DNA, 1054 bp, Homo sapiens
caataccaaaaataaaactatctaatgaacttaatggttctagaaatgccattctggaattttttatttctcttcccgaggatattataaaactgtgccattaacattgcacatttgtctgctaattaaataggttagtcagagaattactgcttattctttccaacaattgcataatttacatgtatatagcagtttttcaaagcattttttaaattgaggttttagctttaatatcagtagggaatgaaagcaattgtagcaaaccaggaccttagatcatactaattcacttttgtctaagaattccaaaggaaggagagatcctcttttttcttctttagaatggaaagaatatgtacaaatacaaaataaattggaatggtggatggagatgagagagtgaaaactggaacagccttagtcttctcagtaataaattgagaggtcagatattgggagtgagggagcaggagaggattcagagtcttgaagagagtagcaaattttgacacagattctcagggaatatggtaggaagtgaacaaggaacaaataaaaggatatgaatatggcaccgaggcacaactgagattcacaactgtgagtctgtagagagtctaatagactggctgttttttcctctggtatcttcctggaagtcatgggttatgatttttcacctcatcctttttcaagtgtaaactgtacataagcatgttaaatcagtcacagtttagccataaatagttcccaccttggtctttattatcatttttaaatgattaaaatttaattttttaatttttaattttacagacaggtcacccaggctggagtgcagtggcatgatcacagcttattgtaaccttgaactcctgggctttaaagcaatcctcccacctcagcctcccaagtagctggaactgtacatgtgccactatgcctggctaattaaaaacaattttttttttagagacagagtcttgctatgttgcccaggctggtctcaaattcctggcctcaaatggttctcctgcctcagcccctaaag

SEQ ID NO: 45417 - DNA, 1050 bp, Homo sapiens
atgtattttctattaagttactgaaataccaaattataaaattaaaagaggccccaaatacttctcttctgacatgttaaacctgcaagttagagtgtaatttgctgataggtaacgagattcttaaaaacctcaatattctcaaccagtaacttcattgctatttattcattctgaagaaaaatataaaattcagaaaatggtctttgcacagagatgcttaccatagtgttagttgtaacagaaagaaaaacaatttaaatttccccaaataggaaacaattgagatgatgctaaatctcacataaatattgtataaacatattatgaaaagttaaatgagaaaatatttccagatagagaaaaaaatacaaaattatatgcaaaatttatgtatattaagtatatacacaaaatcatgtataaattgtcatttcaactatgtaaaataatcattgaaaaaagcctaagaagaaatatatagttgtaccatataaagttgccgatttttacctatagaagaactatttcacatggttcaatctgatactaacacatgaatatctttggaaagtgataaaatttccggtaatattccatgaatttttgtaatttcccacttttgcagaaacatattcaatttgtataattataaaaagaatttttaataaatagtctaaagaaacatttataatttaggcaaatgttttaaaattagattttcatttttggcaatattacaaatttgataccccaaaaagctttgcactaaaatacaatccaagatactttataaagtgtttggaagaactttttaatgcacggctgagctggcaacagagtaaggaaatctccagcagccaaacatgaagcaaaagcataaatcctgtgagagaagcctatgactgctctcagggcatctacggatttctggagatccagagattaggttttaatggcctcatagcaggcacagaacaaattttagtgtccatatagtgaaggagtcagattaaagacctccatgtgaagccaagaccctacctatcc

SEQ ID NO: 45418 - DNA, 2135 bp, Homo sapiens
gagcacactgttcccatgagtgtgagcactgcgctgggatcagctttccatatgtgatattaattagactattttttattttgtgtccttgaagtcagtgctatgggaaaacaacatgcattttgtggaattgtaatgaacctgccagtctatgtactgtgttctcctagcacagtgaccgttccataatctccaccccttgtttgctacctggagctgggctctaggcagagagcagccacgtcccagccacaagatattttgtgctactcatcatgatgaactgcatgaggatgctaacctcagggaaaagtactactgctcccagctgaaacttggaccaacccttcatacctacttttaaggactgcctttggtagaggatctgctctgtcccaggcgtgtgctgcacgagtccatcgtcatctctcagatgtgtctccagcttctttttttgctttttttttgagatggagttttactcttgtcacccaagttggagtgcaatggcgtgatctcggcccactgcaacctgcaacctctgccttccaggttcaagcaattctcctgtctcagcctcctgagtagctgggattacaggcgcccaccaccatgcctgtttgtatttttagtagagatgagatttcaccatgttggccaggctggtctcaaacaacttacctcaggcgatctgcccgcctcgggcttccaaagtgctggggttacaggcatgagccaccgtgcatggcctcaagcctcttttgattgttaaagagcttacttatctacatttggaattctgttagacctggcctgatttctgtaaggcagcataggtgttctgtggcacaggtttgctttcatgacttctgtatgctcaaagcatttctctcccgactatcccagtggatcacatgtgtgagctgagtaacaatcatacaaaccaggaaacatgacaaatagctgataatcctgttcccctatgtgcccatccaccacccctgccacctctccctgggcctccagttgctccctgcccataatgtactggctgttaactagtttgaatagcaatccttggaagaccacatctattctctgaaaatgctttgaacataccaattatttctaattgtagaatgtctatttaaggaatagaggattttgaattagcatgaggtaccaggttgactaatttctccgtctttttcagctgactgagttgaataccttcttcttgaagcatatctttgtgttccaagccagtcatccattaagttggggtagaattctctttattggtggcatcacagctcccacagtgaggtaattctgcacaagcctgactgtcatatgagaacattaacttgctttagattgtcctgtttagcataaggaaagtcatataaactagcagattttccatgaaaataccatcgtaaagaattgtacatccagaatatgacgaaaatgttttgttctcagatgtcagtaacattaaccagacatttaaaaagagaagcacttgatgaacaccacaccaatagtactatccattattatcagattcctttacagtcttggactgccgatctttttttctcctataacatcatattagaaaaaaataacagcatagtgatgctgagttttttaaaaatgagattactggaaaaatgcaaatgtttttatggtagaactgaagtcataaatgacattattttttgaatgagacttttagctttttcagacccaattaatttaatttccttttaaaaaggcccttcctgtagtcctccaggacaactgagataagcttgggtgttcccgccattattcccctggattaatgtggggccctagaggtgaggcttattcagacaccatccctcaagtagactgggcccagtgcagttcaaagcaagcattttcatttgtttcatttttcctatttagaaatggcatttgagttttataactaatacggaatactggcattaatgagtagcaacaccaaagatctgccaaaggtacaaatataatttaagcagttaaaagagttagcttttcagaagctgtaagattgtttatttcattatttttaatgtgcttgcaaaccccataagcagcgggcc

SEQ ID NO: 45419 - DNA, 1067 bp, Homo sapiens
aaggaagaaaaggactgagaaaacgcaggagccctggcttgccggtgagcagagccggcgcagccacagcgcggagccgcggcgcccactggtcctcggagctgccaatcggcgtgtaatcctgtaggaatttctcccgggtttatctgggagtcacactgccgcctcctctccccagtcgcccaggggagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcggtgagtgggccaggcggaggatgcgcgcgccgtttagggtgtttgaagctacgagaggagcccgcagggaataggggagcgccacctggggaacccccagtccccaagtatacaccggagatccgctgggacaaatgcgctcgtccggtcaccctttccccctcttcccttcctcagaaaagcgctgctcgctggcgttaccccgcggtccgc

SEQ ID NO: 45420 - DNA, 1034 bp, Homo sapiens
ggaaaatcatccaaaaagggtgattagatatttataaaatgtcaacttagagactagcagagaatctttgttaggcagtgagtcagtctttctaaatagaagctgtttcaaggcccagaatggctaacagtccatttaaattacttttcagtctccgtttgtttcatgtatagcagcaaaaatataaatgaagtcaaaagactgaatttaaaaaaaaattagcaattacagaatattatttccaggactttgcattttaatttgaaaactgcaactgtttcctgggatttagaagtagtgatttgggtttaaagtctccctttaaaggaagaaaggaaaactgcctacagttagtgaattcttaagttttatacttagctctgggggtaaaaaagaggttctcaggaactaaggctcaaaactgcctatgaaaaggaactggtagctgttcctttatggatcctggaggcagctgggaaagcctgttcctagtgatccattcatactttccactggcaggttaggactttggctgcggagcaccaggcaaggggaaaatctgactgagtgtggcagtagtgatatgctgctggttttctgtccattttgtacatgactgtttatctttagaaataatatattgcagactgctataaacacataatttgaactggaaatatgtttaagaaaaggaagtgttttgaactagaggaattttataaacattcttagatgtctgtaaattaaaagaaactgtcaagtcatttgggcccatgcattatctctcggtgtattatgaaaggcaggctctggaaagtttgcattagaagggtaactaaaatcgaaatcatgtaactttgcagttctttagaaaatatagtttggctgttttatgagtgaaacaaattgcttttgctagggaattttataaaaacaagggctctttctctcttagttgggtattagcagaaggaggatgtcatttaagaaggaaagatcttgaaagatcaggcttgcagaaaatggatgtctga

SEQ ID NO: 45421 - DNA, 1047 bp, Homo sapiens
aggatttcaaaaggtgaactggtttgttccctgggtggaactagttttcaagtctccaaaagcccccagagacctgactggccagctagaggtggcttggagtctccttaggttggcaaggcccctgaagctgacccagtcacacagagccccaccagccctgtcattaaggtttatagcaagtccagtcaagccactgtgctgttggcatacctgctggtggggatccagttgtcctgtgaggaatgccatctgggtttagattctcactagattgtccttcttccattgccaaaaatcaaactaaaagattttgcccatccttttcttcttcccaaggcagaagggtgcattgcagaatctccaaaccactgaattcttttcgtggactagaggccaaaataaagtcttagagaaaagccagaagtaatgaagaagaatctttgctaaaaccaatctactcttatttaacttttttagtcaactgtgacagtactatcattttcattctaatcatttggatttaaatcttgaagaagccctggactcattcatctttgttggtttccacgtccagtctgcctctaagtccagctgtgcattcattctgcagatatttatttcatacctactaggtgcttgaggtaaagcagtgagcaaaccaggcagatatccccctgccttcttggagcttgcattctagtgatctttccgttcattttttcatgccttcagtggccagcgtggaacttcctcaggagtgccaaccggccccagaatgccctggcccatgggaacctgcacttaaagatgcagcaccaacaggtgtttacccagctcctgacctgagctcagcactgcaaagaagtcggggtttggaaatgtggtcccttcctgcagcgctaatcttttttttttttcctcttgagatggagtctcactctgtcacccaggctggagtacaatggcactctgcaaccaccacctcactgcagccacctcactgcaaccaccacctcccaggttcaagcgattctcctgcctcag

SEQ ID NO: 45422 - DNA, 1077 bp, Homo sapiens
ttttattggaaattttaaaaacgacaaaaacatcttttggtagtatcatcatctaataagcatgagaaagatgtaacgtcatgacttgcacctgaccctttgtcttcttggatcttacatacttttggacaaccaagagtgaaaagggtggaaacttccgatctcgactgagtaaaaggaaagcctttctaagaggcagtcaaagatggaacaggctacttaagcaggaggcaggacccatacctggagctaagctggtgtttgtttggatggctgtttactgaggatctttagaggagattcaagccatcaactggctggggagagtcgctgacctttatagcttccttctaaccttagaagattctgtacgacattttaaaggtgagtgctgagcaacttaaactatattttatttcctttcctgataacttggtctgactgagactagacatcttttgttgcctatagttgaaggagtctggcattctaggaccaacttgctgttaaactgatggcaagatctctatttgccaaagttaggggactgtgtatgtaaccattgaaatctaacattacctcaaacttcaagggactctgacaggtactttaaccagttagaatggcacacttgactatctggtttgagtcagagcagtgagtgcctgggagaaaacagcaaactcaagacaccatgagtggactttagggagagggaagagagacagagggcccacaggccagcacgaagaatgtaaagggaaagtagccactgtcccaacctgccaggggtttgggaggcactgttaatttcccaagcattcacttatccgcactttgaccaggcaacccttcttcggctggacagggacactcatgctggaccttgatcacccatgacccatgtgtcatagtgcagagctttccttctgaggcttaagtgaccagtgtgacaagaaccctgaaacacctaatgtacagaaggactctaggtccatggtccccaacctttctggcaccagggactggtttcatgggagacagtttttccacaggtgttaggggggatggttttgg

SEQ ID NO: 45423 - DNA, 1771 bp, Homo sapiens
ctatatgtacatatttttgtatgtatatatgtgtgtgcataaatacacacgtttgtgtgtgtgcatgtgtgtgtgtgtgtgtgtgtgtgtgtgtgtatatatatatgcacacatgaatcttaaaattgtttttcctgtggccttaatttaggtgattagggaaatggacaagtcaataggtaggaattaaagacgttaactacaccaggagacttgaccatgaagtccctcctgcctcagctgagctaatttaacagggatacaaagagccgcagaacgattggtttgctgttggtttttttctttttctctccctccctgaaatggaatgcctttcagaatgttttggagtggggtgcattttagatatctctagtccttggcctagccctgacagtgaggtcttggctaagatacttaatgagttctgaatgcccctgtcctcacccttaagcagctgatttttcgaagttttgtttcgcttcatggtataaaaagcctagtcatgtgatctttgtaatgtttcttggttattttaatttttaatggtaaaaaatgcctgacagaaaaaaaaagaaaaacccaagactttcctgtgacacggtgcacttctgccttgtggacctagttggagagactgccttaccttgagaggtttttttttttttttttgagacagagtctctctctgtcacgcaggctggagtgcagtggcgcgatctcggcccactgcaagctccgcctcccaggttcacgtcattctcctgcctcagcctcccaagtagctgggactacagacgcccgccaccaggcccggctaatttttgtatttttagtagagacaggtttcaccatgttggccagatggtcttgatttcttgacctcgtgatccgcccgcctcggcctcccaaagtggtgggattacaggcgtgagccaccgtgcctggcctaccttgagagcttttaactacagataaagagctgaaacttcttgtgaaaatgtcttaattttattcttgggtccgtgggaatttagaactataggcttttaattgttcacagctggtgcatgaatagagtggtaataataattaggaataatatggttcacctcctaagctgttagttttaatccgttaaatttttttgaactgacgtctggcacagtcttcaagtgagaccatttggaggaggtccatcctaggtttcagtcaagaagtgtgcatgtctgtcttgtcctgctaatttgttacagtgatttctatggtttgattttaatgtttttcatctaaaaacacacatgcaaatccagcctacgctcaacaaaatccatccagacactcccactacagagcccttgcgtgacaattttctgtatctaagttagagggagcttgcagcctctcctacatccctctgcggtgggaggagccttgctaggggagagagggggtttgctctaagtctcttgtaaatggaggccgacccagagtgcccagagtgcagtgcttcctgtaattccccagagagcagtttggaaatcataaagctgatttacagttatttattccctgcccctccccccacactattttttgtaaaatcctcaaatttcaaagtattagtacaattgattagtgatgtttacttttcgtcatttcttaatgctccacgttacagaaatttttcaaaatgtttcaaaatgacatatttagtagagaataaggattaaagaaggaatgtgttcttgaagagtgatctggttggagg

SEQ ID NO: 45424 - DNA, 1067 bp, Homo sapiens
gaattatgtgttaatcacttcttatagactgtccagggatattcagatttttctttcaaataacattttattagtgtgtaagtcttaataagtgacaggtaaatagatcattccagtagctaccatgtatgattcataaaggcagaacaggcgtcctgggaaggtgttaggagggaaagctcggatctagggagactgctctgaaaacaaggaaggatgtttatggaatgaactcttttgttcaaccatggcgatgtctggatcagggcagccttggaggatttatggcctccagtctggagaaggtaggtgggctcgcattatctgtgttgtaagaaaagtgtgtgaggtctttgagcctaaggctgtccaggtaacaaaagactctgtcaaaaaaatatgtctatttagagttctttgagagtaatatgttgctatttatttcacatctgtgtcgggtattgagcattttccttgctttgcggttgtaacaagatcctcagctttcttccttttaaaggttggggagctaatttcttgtaggaaataacacattaaatccaagcgtatcactaaaacatgtgtgccttctctttttgctcaattaaaagattgagctgttcgtgttttgtttgatatgggggtacttattgaacattgtcaacctaaagcattttgagtaaccaagagaaaaatcaggatggcctaattcactaaaattccaagtacatttgggatgtatttttatacttcttaattatgagattttaaattgctttatttttaaaggttgagtgtgagctgagtgtgtgtctttttctgtagtcctaccatcctttctgcaaaactcaagtgaaaattatttatttaggatgccctattgagatatagtggaatgtctttgtttgcatttattctttttctgggattttggttatatctatagctgtaaataaaggggaaaggaaggcttggagtgcatgttaggacaagaggtcccaagtaggaaaaaaagtcttgccttagagctatgccttgggaagtgctttttatttagtaacctaatc

SEQ ID NO: 45425 - DNA, 1529 bp, Homo sapiens
ctcttaatttgttggagttttcttttcctggaaaaaatactgcttgggtctcagtttctccacatataaaatcagaataagaccataaattcatgtagttgaaaggggcggtttcaggaagaaaactaagataatgaaagcctccggaaaagggtctgggacgacattatttacagagtactttccacacattgtcagggtggggccgcacaggaaccttgtggggtaggcatcattgacctgtttcaaaaatgaacaaagtcagtcccagagaccttgaatggaggcttatcaaagctaagcatacggcttcaagtttaaccgtcaaatggtagagttagtcatggcttttggatgtgcgggccaggcatggtgcagggccaggtatgttttagccttgtggttcttttcctgatatttcggtcctgtgggcctccccaaagtggctttgcacctatgtttgttatgggcataaggaagttagaattctatgaatatgtactgattttttgtgattctgaatttaaataggcctctataaagctaatacttgaagttttgttgtaatgaagcatcacaaatacttttacataggaaaaaggaccaagctgatctccttaaagcggttgcaaaaaccacccagttgttatacgattgtttgtttcatgtttcttgttatgtggcatatttccagtaagtggagggaccaaatattttatagttacagaaacttcttctctccctccttgaagtttaaaaaagtggatcaaatgtctgcctattttcaaggaggcagggagacagaagatcttttccagattgcaggaaggccaacgcaggttgcacccagagaactatggaaaccactgttgaggaggaaggaattgggtgaaaattaaagaatcaagctagtaaaagtgaaaagaggcctttggtttttttttttggacagtttttaagggccttcataaatacttggtgtactcctcaaagaccaagcgttgaagggttaagtcagggaactaaaacttggattgtgtgttgacccctgtgtagctgtggccagggctcctgattttcccctgacgatccattggtagaacaaggccagtggtactgttttctggtgcaggggaggctcggacctgcaggggagttacggaggctggccactggtttggagcagacaggtaagtagcctctagggaggtggtagctctgtacaacagtctgttcccaatgtctgggtgactcttgttcccaatacttggctctctttttggatgtcagagtcatattcttcattctccatgtctcctgctaatttttggcattgacccatccaggatttatttcagcagctagcatggtgcctgacctatccatagtaggtgcttagtaaatactgcactccacagggggaagagggcaggcacgttctgcctattgacgtggtgggaagagagaccgtgcttagggacaggtttgggagcttcattatttctgccttgggactgtttgaatgcacc

SEQ ID NO: 45426 - DNA, 1049 bp, Homo sapiens
cccgctggaatttgaactgttgcctgtgttctgaaagtgtcttgaattgcttgggatcccaagcctgaagtttacagcatctcatggtgtccaggtatccaagaggagtcataaagttctccgaaaattgtgaaaaccatatacttaagggaccacacgcatgcagtggagtattcttcgatggcagcattttcttttgcgggaaatagcaaatcaggcagtaatgaggtgtaaggtcagaaaaactgcatagaaatcaatgactaggtgttcagagaagttaaaagaaattaataatttttcttctgtatgatttttgctttgggatattttggttattttttactggtttcggatgctattttaatgagtattttgtttatattttgtaggcccatgaatatgaaggataacttagattttaaaagttctttcttctattccccaagggctgatggacttaaaaatacctgtcagttgagccttcaaaatctttttattgacaagtgactcctgacttcaggcctaattggttcctgaatgtttagtcttggggcatggtcataacacaaactcttacttcctgcaggctgtgttatctgtaaagcttatgttttgttttttgtttgtttgtttgtttgtttgtttttgagacggagtctcgctctgtcgccaggctggagtgcagtagtgcaatctcggctcactgcaacctccacatcccaggttcaagctattctcctgcctcagcctcctgagtagctgggattacaggcgcacaccaccacgcccggctaattttttatttttagtagagacggggtttcaccatgttggtcaggctggtcttgaactcctgaccttgtgatccaccctccttagcctcccaaagttctgggattacagacgtgagccactgcgcccagccaaagcttgtgttatatattgggcttccattcctgaaagctggttttatactatacaaataacaaagtcaatatgaaaatgtgtcaaaaatatgaatgtacctcttaaatacacatattaac

SEQ ID NO: 45427 - DNA, 1029 bp, Homo sapiens
gctccaatgactgaaacaaaggccctcagccttgagggagctgacaggtgagttagaggtgagcatgtgatgctgctggaatagggaacacaaggtcattgtcatggattaggatgctctggtcctcagtgcaggtgaacttgaacctagccatgaaaaagcaccagaaatggctctctttgtaattttcacttctccccagcttcccctcccaatatgtagtgctgccccactgctgcatcccaaagccaatgccgtggatcattttaaccggctgctgctttaactggtttgtcttctgctcttttcctaaatccagctctgctcctcctccttggtctgcacttgtaaggcctttatttgatgtgcatgtatctcccattttatagcccacatcatttttcatcttggactataaattcagagaagatgtgggctatgcactttgaccttcacagcacccagcacagtaaaccataatgaatgttttggatgaggatgaggctctgaagttggaagctgacatggctaatgcctatttaattgaaggttattaatgcctctttagcagtgaaggctagatagtcttctgtttacagcagagaaggaacaagccctcaagctttttccagtggtctcaaagaattctctgtcaggtgttgccccagtacacactgacctgaacttagcatcccggagaatgaaagggacagttggggcagtggggcagcttccccccgagaagacaagcgtcttctcctctgggttcatggttcccaggtgggaattcagggcgggggtaagtcagaatatttatgttctagttcagcttattaaatatgagattttccatctcttagtgaatagagtttgccttctgtccagcatgatagttctaagtagggcgaccatatgtcccagttttaatacctatttgcctggattaattattaatagctccccctttaagagtgccctggtttggatgataaatattattgctatccttgttacaagggggaacatata

SEQ ID NO: 45428 - DNA, 1075 bp, Homo sapiens
caggaccatgtgtgaatggatttctcaagtgtttcattaaagatccgtcagaacggttagcactctaaccatgcttcagtctctggcttctgattcctttgtggaattaaaaatgcttttgggaagaggggctaaacaagccttttgtctgaatttccatgtattgattaatggacccagcagagcatcctgctgtgaattctgtctgctgatggtaactcttacaatgagcaaagcttttctgaactggcattttccactcagcctgtaggctgctgtattgggtgtgacaattttttaaaagccatcatgctagaatgaaaatgagccatttctaaatggcctattgatttgcaaaacctttttgtgttggattgaatggtttcatatctcagctgagggaaaaagatgcaggctatttttaatttattgttattttatcttaaagatttgagttgacaacgttttggtcatgatgtttacctactgttgaaaggtctacttgcatgtcatgacttgataataaatgtaaaactctggttcattagcttacactataaaagagttctacagctccacttacagtgtgagccacagtcagtaaatatggatccagaagtcctaattatgactcaagctcacccataaacttggggaccaccttcgcaccaacgctgtccactgggctatttatggaagaagccactaggaactgttaggcggctccatgtgtctggctaacagggtctttattcattcacctcatcacggtattcagtcttgatgctagtgtgcacgcttcctaagaattacagatgggaataaaaggtgtctgggtatacctggggagtatatgtttttgcctgctgatataggatactagggtagcttgtatgcaaaagcatgagcgtctaggtttaaaggattctttttgttaatatctgagttgacttggtatggatccttgtttgatttttttttttttaaatttttatgtatgtatgtatttgcttttgagacagggtcttgctctgttgcccaggctggcatgcagtggcatgatcacagttcactg

SEQ ID NO: 45429 - DNA, 1040 bp, Homo sapiens
atctgtaaaatgttggtgatgaccaccatctggtcttcctcacatgggcacagtgagcactcactggaatagtgttcttcctgtcatagatgtaaagcagcaaactgaaagttctggtggtttatcatgattattatacttgttggctgactttctcatgggcttcttagatgtttctcttaaaggcagaattttaatttaaaaatgcatattatgtaagaatattgtagttgactttgagaattcatgaactgaaacacttaaactctctcaggacctctaaatatttcttgactatttcagagcatttgatttgtcctaatgctatggagttataaaaccattaatggtatgatagctctggaaacaaacattaattcatttgaattcattagaatgataaagcatattgtgcaggggttttcaggcattcagttcataactatcgaaatgtggatcataacaaattttgtttgggtgtgttttcatgtctaaagaggatcttatcataactctcatacttattagttttatgtgaaatacaactagcaagcatatatacataacaaaggaaattgcagattgtagtttctctgagattgatctattttattaaattatttttattaaataattttttattttatttttatatttattttattattattaattttttgttataattaagtcattctgaccttataatttgagaagcatgtgccctgttttcatgctttagttttattgtaagcatctatatttagggaggggggtgtggttatgtgtttgtatatgtatgttcaagtatatctttatttttattttatttttgagacagagtcacactctgttgcccaggctggagtgcattggcatgatctcggctcgttgcaacctttgcctctcaagttcaagcgattctctttcctcagcctcccaggtagctgggattacaggcagcaatcaccacgcccggctaatttttgtatttttagtagagatggggtttcgccatgttggccaggctggcctggaac

SEQ ID NO: 45430 - DNA, 1028 bp, Homo sapiens
gttattagacccaggaatttttaaaacctgaaatcttgcaactgaatatccattttattagaccttttgcctttgtgaccacaggtgaaatggatcaggagtggcccaagcactgttctgtgagttggcatttttctgaagtgtgattttttttttttttttttttttagtacttacatacttccataatatttgcttcttttcttaaaaaaatcttttgtagagatgagatcttactatgttgccctggctgatcttgaactcctgagctcaagcagttctccagccttggcctcccaaagtgctgggattacaagcatgagtcactgcacccagctcatgacacttgctttagatttatatataatatatatatgtaatatacaatatatatgatatatgtaatatatatattatatatcacatataaaatatatattatatatattatatatcatatataaaatatatatgacatatgtgtgtgtgtgtgtgtgtgtcttgtgtttggatgtattcgctgttaattaattttcaaaagtttatttgcacagttgatgtctgaaagctggttccaagtcatttgtgtctatgacttatcggtcttgtgctttctgtgctttcagcaacattatagtgccaaaaatgtagctgtaatatcaattaggaaaaaaattacacataaatccaccaccctaaccagttatctttcttcttcattttctattccctttcagtgcttggccaaatatatatatgtatttgaaatatatgtgtgtgtgtgtgtgtgtgtgtgtgtgtgtgtatatatatatatgagaaattgcaatatagttgtaatattagaaaaaaattaatgtatgctttttaaatttaatatgtcgttacaaacacttttacttattactatgtggtatatgatttttaatggctatgttgagaaaactaatatatcatgcataattatttaccagacatagtacacccctgtagtgggcattgagattgtctccctgatttgtctttaa

SEQ ID NO: 45431 - DNA, 1028 bp, Homo sapiens
taaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttt

SEQ ID NO: 45432 - DNA, 1117 bp, Homo sapiens
ccctgcttcttacccttgccctcaaggtctgcaggaactgccccctgaacaatgcattataagtggacacagtggcggtagcatggctagttgggaggtcattatagtcacctagggaagaaatggtggtggcttggcctaaggtggttatagtggagatggaaaggaactgttcggggaggaacaatcagtaggtctttctaaaaggttggaagaagtaggaagtaaagaaaagaatcaaagagggcattgccatttttgcctgagtagtgggtgaatcatgttctgagaaggaataccatggggaattggctgctaaaccaaggttttctattgggccatgttaaattagagaggactattagacaaccaagtggaggtgtcaagtgaacgattaaatgtcagaatcgaactcagagaagaggtcctctcttggaactggagatactaatttaggggtagtgttagtgttcatttgcctgttggcactctgattcatttcctgctctttcatgctctactctgtatggcttgaggatgaggtgctaccaggagagtggggtgtgcaaggttgacccacacaaactacatctcccaagcttccttgccaactggcctctgggaaagtttggccaatggaagacactggcaaaagaccgcagtcagtaggagaggaaaagccagagtactttcccctgtctttgctctgggcaacatctctagcatgaatgcacttcctctgtagttaagtcaccaccaggcaagccctcctgcatggccctagctcccactattcctaaactcttataactccactttcctccttggtttctctactcctagggaggcatcaacttcctgatgttggtattctctgagttatttccctgtctccagtttgcccttacaactttgtcaacatctttgcaactgactggtattaaattctctctattgcactaccaggtgtgggttctgttttccttcctggacccctggtgatgacacaggagtgaacagcatatagatggtattaaaagccatgggattagatgagattatttacacaggtaagtacagtagcaccctcgcttatccaaaggggatacattccaag

SEQ ID NO: 45433 - DNA, 1109 bp, Homo sapiens
aaaaataaaaattttagcacattgactgaagaagggcaggagtaattgaaggacagaatggtattcgtgatgtggaaattcaacctcggaacaattgagagtggtatttgtccacgtgttgtatttattccatttgaagctagcctggcatttgagataaaaccaatagttaatacttattgtgttaattatcttatttaatcctttcaaagcttagtgaatttgcatatattttctgtattagtccattctcacattgctataaagaaatacctaagactgggtaatttataagaaaagaggtttaattggttcacagttctgcaggctgtacaggaagcatggcggcatctgcttctgggaaggcttcacagagcattcaatcatggcagaaggcaaagggggagtgaggtgtcttagatggcaggagcaggagcaaaggggaggggagatgccacacacttttaaacaaccagatctcatgagaactcgctaacacaagaacagcaccagggggatggtgctaaatcattcatgagaaacagcctgtataatccaatcacctctcaccaggcctcacctccgacattcgaattacaattccacatgagatttgggcagggacacagatctaaatcatatgaagtttcttcattttataggtgagaaaacaaacctagaaggaaactcaattacccaaggtccacacagctaagtaggcagctaagaaggaattcagacccaggatcttgtgaatattaaaccaagctttaaaccacagtttatgtgcagtttccagagttcatgaatttatctgcaaataaagggatggtatgcaagtaattaacagaattattgtgaggactagattaggtaaggcacatcaaatagctttgttgagtgtttggcacatcacagctcactgaatgtaagtttcctttgtatggcatcaagtgtgcaataaacactttttataaggtttctggtgcaaatctcatgcatttgttattgaaattctagaaatggaacttaaaaatgttatttagaaatttcagacttgtattttatttgacagcatcagtgggatgaaggaaagggtgaagagtgat

SEQ ID NO: 45434 - DNA, 1012 bp, Homo sapiens
gacacgcctttgccccacccgaccccgcccgcccccacgtgacgcccacgccccgcccactggcgcccacgtgacccacggtcgtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggcccccgacgacctggccttgctgaagaatctccggagcgaggaacagaagaagaagaaccggaagaaactgtccgagaagcccaaagtgagtatgggatgagcggcagtagagaacgggcgaagggcgggcgtggagaccctcgagcttgggggaggccgcgccccagccgggaaggaaaagagtgcttagtcgaaagccgagaggcagcactcccaagtggaggaggaggtgataggtggtcatgttatttggggaatggggggaactcaggaagtatagg

SEQ ID NO: 45435 - DNA, 1121 bp, Homo sapiens
cccactttggcctcccaaaatgttgggattacaggcatgagcaacctcacccagctcaaaaatttattttagtggacaagttatttgcatattagtgtaggaatgtttataaagatttgctatagtgtaattgccatatctctaagctcaatgaataaaataatagtgtttccttttgtttgctaccagatagccttgcacagtgcttggtactcaaaaataattattgaatgcataatatagtaagatgtccaacaaaagtatttatacagcttactcctattattcatgcttggtaaatacctatgtgagccccctttttctctttaagtggaaagtggctgtttgcctcatctggctgtaattttgtgaggtgaagcactgcctatataatgaccccataagattatgatattgtatttttactataccttttctatgtttagatacacaaacacttaccattgtgttacagttgccacagtattcagtacagcaacatgctgtacaggtttgtagcctaggtttgtgtcagtatactatgtgatgtttgcacaaagatgcatttctcagaatgtattctcattaagcagtgtatgactgtattctaatagtatgcagtgtcttttgtagtcattacttctgttccagtttcactgccactgccctactttaggactttattaccttttgtttagactgttctaacatcatcctaactagttttcctgcttccagtttcttttttgccaatcttttctacccactcgtgtgagtagagtcttttgaagcccaaccctgatcatgtgactttgatgttcacatcctttcagtagtttccccatcacctgttgaataaaatgcaaaattcatgacatggcactcgagtctcttcatgatctaaccctaccttaggcttgtctctcaccattactcctaagacaagaaataattctgcttagctagatttctgtgtctctttatttatgattattttcatttttgttgttgttgtttttggagaccagagtctcactttgtcccaggctggagtgcagtggtgtgaacacagctcactgcagcttccacttcccagactcaagcattcctcccacctcagc

SEQ ID NO: 45436 - DNA, 1084 bp, Homo sapiens
tgcctttatctttttttttttttaattatactttaagttctgggatacatgtgcggaatgtgcaggtttgttacataggtatacatgtgccatggtgatttgctgcacccatcaacctgtcatctaggttttaagccccacatgcattaggtatttgtcttaatgctctcttgccttttatcttttttatgatgaggattatatatatacacacacacacacaatgcctcctgtatgctcagtatcacttttagccaataaaattgagattctggccaggcacagttgctcacacctgtaatctcagcattttaggaggccaaggcaggtggattgcttgagctcaggagtttgacactagcctgggcaacatggcaaaaccctgtctctacaaaaaattaactaggcatggtggtgtgtgcctgtagtcccagctacttgggaggctgaggtgggaagatggcttgagcctgggaggcggaggttgcagtgagtcgagccgagatcacacaccactgcactccagcctgggcaacagagccagaccctgtctcaaaagaaaaaaataaaaatgaaattccagtgtttgtccagggtgaaacacatttgggatctcaatcctggtctcccagcctgctttcaaaacctgtactcttgagagtgtgagggagagtataccttttgttttgtactttactatatgttattgtatacctgtcttcctttactaggttctaagcttcttgagtgcaggcattgagccttatctttgtttcaaggtgttaagagttctgcatagcactctactgagtgaatattatgtaattttcttggaaaacagcagttttttaaaaagaaagataacattacaatgctgcctctagagcaagcctggactattttaagcctctgagaggatatatttgcttattatttttaatccattaacttcccaaaagaatttgcatctggagcattggacctgatggatgcctgtccaggcccttttgaccaccaggacttaacattcatctgagcttgttaatataaaaaaatggcccaaatgcttgaacgtgggaataaa

SEQ ID NO: 45437 - DNA, 1600 bp, Homo sapiens
tggtctaacttaaaacatagattgtaagctatatatgaaataactttgattggccctggtggggaagaccttaaagttcttgagagaattttaaactggggtacaatgagaggcccatgtaattgctaatctgtagaaagccaccatatagattaaagttccatgatcagagaaaactactttttttttcttttgtatttttttttcttttcttgagacagggtctcacttttttgcccaggctagagtacagtggtgcagtcacagctcactgcagccttgacctcccaggctgaagtgatcctcccatttcagtccctcgagtagctgggactacaggggcatgccaccacacccggctatttttttaaattattttttgtagagacagggtctgtctatgttacttgggctggtctcgaacttctgagctcttgctgatcctcttgccttggcctcccaaagtgctggaattacagccgtgagccactgcacctgaccaacaacactttcatgtaaaacccatattgacaatcacaagggtagacacattggatttgaagttttggtttgtaattagttactattcatgtaagtagatctatataatatgctcccatttagggatttgctaatttaagtatgattagtgattttccagggcaaggccttctcgaccagctgttggcaaaatgaaaggacacattggctctgctgtatgaaggagaatcacctcagtgtattcttttttccagcaacccaagaattatattgactttacttttgggataggaggcttattgtttcatggcatcaggcatgtgtgggaagttgctgatgacttctggaatcccagtaatgatgaaagctatataaattctaagagtttagtggaaaattgggagatctacacaggtcagagagaacagctgcgattagagctattatgtagattgatgttgcaaagaaggaactaaaattggcacagataggagcgtatgagcacctttggcttgctgatcatttcagagcctatggaaatgggaactgaatgttcctgaatctgtgggaatgcagttggtcactttcagactttgtgttgtttgaaagaaaagaatgtttcatatttcatttgggaggctacatcaatattgtttgcagttgttctcacataaatggcattgaacttgttggtgagtttttaagacagtttttgaccgaataatttctaatcttcctagtatttagtaaataaatcccaatgactcagtgtcatgtaaatgagtaaaatgaaggtggtatatggcagtatataagtgattatgatggagagtttcctgaagggattaattaaatgaagtttagcagatataagttttgtgagttgccagttgaagagataggagactatagaactgaagctgcaagattgttcagttggtataagtcttacatggaaaagtgtggccacaagaaaatcagaaaaggcaagtttggccagagaagatagcatgaactaaaagtagcatataagaataagatgatgatattagaggccgggtgtggtggctcacacctgtaatcccagcactttgggagg

SEQ ID NO: 45438 - DNA, 1085 bp, Homo sapiens
gtggcatgcacctgtaatctcagctactcaggaggctgaggcaggagaatcacttgaacctgggaggcagaggttgcagtgagccgagatcacaccttggcagtccagcctgggcaacaagagcgaaactccgtctcaaaaaaaaggtaaaaaaagaatgattctggttaaaagccagatttgggaatcacacacttgagtctactcatgagcatctctaagtgctatccatcattttattttaggaatgttaggaaagcttttgtagccttttgtaggctgtggcaatgggtcggaaagcttcttactcccagaacagtagagccatgaaattacagaattagaggttccattagagattgcctaacattcatttgtttatgtatcatctatggctgcttttatgctacaatggaggaattatgtagttgcaacaaagacatatgggccaaaaaataaaaataaagaacaaagatatatggcccataaaacctaaaatagtttctgttttgttttgtttttgctgaggactgttgatggcaatcaataaaatatttttttctgaattttattttgccatacaccctgaatatgtttataaataaaatattttctatctggctgtttacagaaaaagtttgctgacttttgagtagatcatacctgtcactttatagatgtagaaataaggctcggagacaatgagtgaaatattctgagattacacagttaattggtggtcaaattgcaaacacagttttgttctccttttaactgcttccattccattatttttgttagagggactgataccttggtgagataagaaaatctgtggtacagaattttgcttatgaattttatatatatatatatataaacactagggataatctatcaactcttagataacattggtgtacaaaaactttttaaatttaggtacagaggtaggatttgattgtagtatatatggtttcctgcgtataaatctttgcactgatctgctaagcagtttgataatatgatactttttgttgcctgtgcagccaaatgggcggactgttgaagtggctgagggtgaa

SEQ ID NO: 45439 - DNA, 1061 bp, Homo sapiens
acgcacctgtagtcctagctactcagcaggctgaggtgggaggattggtttcagtgagccaagattgtgctaattcactccagcctgggcacccgagaccctgtctcaaaaaaaaaaaaaaaagaaaaaagatatagatgtgcactttgatttggatgtgagattttccaagtaagacaatctatcataccacataaatggtacattcctgagattttattaattttccagttgcttggcattagaaccgactcatttttacttgacttaatctagcttggaagtaggcaaaatgaataagaaattcttaacagtggttccttctactgtgagaaaaagacttttcattcagttcccttttgtgcatcgaattaccctccctttccttttttttttttaatatagagacaggggtctcactatgttgcccacacaacatagtcttgaacttctaatctcaaatgatcctcctgcctcggcctcccaaagtgctgggattacaggcgtgaggtaccacatccagagcccctccccctttttaaaaaaaaatcctgtctatgcatagccccttttcaggaaaaaaaaaacaaacaaaaacaaaacaagacagtcactgatcggtaagtggtttctgggaaccacagtgcagcagctctagcttcttggaatagtggtatgaaatggttgctgctggctgggtgtggtggctcacgcctgtaatcccagcactttgggagcccaaggcaggtggatcgcctgaggtcaggaattcgagaccagcctggccaacatgatgaaacactgtctctactaaaaatacaaaaattagccggatatggtggcacatgcctgtaatcccagctactcgggaggctgaggtaggagaatcacttgaacccaagagacagaggttgcagtaagcagggattgcgccactgcactctagccagggcgaaagagcgagactctgtcaaaaaaaaaaagaaagaaagaaagaaagaaatggttgctacagtttcttaatgcttccaatttcaaaatgtctttgaagaagtggctaa

SEQ ID NO: 45440 - DNA, 1076 bp, Homo sapiens
aaaagaacaaaaatgagaaaaaaaatcaagcacggtaaggagatagagataaagtgcaggttgtgggcacttccctgcacctgcaattctcctacttcttccatttaggaaaataacaatagtaccaagtggaataaccttgaatctcctttaagttaaaccccaccaaaaggggggaaatcaattgcagacttttctactcttaaggagatttgtgacagttttcacactctcatcctgatattgtatcacaaggttactaagatggagaactgctggtataggcaaaatagtgaaatataactagtatgcttcttggataatccatgctttcccatttaaccatgcccagtttgtatatatatttgggacaagtgagaaaaataaatagtgccaaaatgtgaagcaatctaaagtaggaacttgccatatttggccagaaagtgggtgaaattgactctaaagcaattttaattttatcaagtgcattttaaaaaacattgttaatattacaaaaatgaaaatgttgacacaatagaagtagaaaaaacaaaaatctcagaaaatagaacacttttttccatgaggtagttgaaaaccttatacaccagtcagtagtctgcagaccaaaacatcatagcaagaaaatactcagcattctttttttttttcttgagacagagtcttgctctgtcacctaggctgaactgcagtggcatgaccaaggttcactgcaaccttgccctcccgggctcaagtgattctcccacctcagcttcccaagtagctgggactacaggcatgcaccaccacacccgactaattttttattttttgtagagatggggtctcaccatgttgcccaggctggtcttgaactcctgggctcaagtgatccacctgctacggcctcccaaattgttgagattacagatgtgagctgttgtgcccagccagcattcccttttattcatgctctcattcctttatcacttctggcattaccatgaaaatctttagatgtttatagggctataaatattaaagatgtcagttcaccaaatttttaaggacca

SEQ ID NO: 45441 - DNA, 1058 bp, Homo sapiens
tagaaaactgggaacactttaacacatggaaaggtatagccatactggaaatgtcccaaggaagtttgtgacaaatgaccaaatctttttcagttttaaatgttttgagatgcaagattatatgtatttaggggaaaggaaaagggggacagtggtagagataaagcaaatggagtggaacgtgagctgggtcagaaaaaaaaaatgagtacaggccatttcaggcattgaacatcggtaggggagcagatgattcaggtgcaaagaaaatcactccagcactttgttctgagaaaaaatccacagtcagtgcagcttggttaaaaacaggaatgttcaaagaggtaccagtcttgtaggaatcaaatgctcatatgtatgaataaaggaatgtaaggttgagatcaatttgtggaagacatcatatgtcatgtaaggaagttagaccttgtaaaaggtaggaaatatctgcagcggtttttttttttaaagtaagaatgaaaattaattggattgataagatatattgggaaggaaactcttgaagataagaattttttctttttttttttttttttttgagatggaatttcgctcttgttacccagtctggagtgcaatggtgtgatctcagctcactgcaacctccgcctcccgggttcaagcgattcttctgcctcagcctcccgagtagctgtgattacaggcatgcaccagcacgcttggctgatttttgtatttttagtagagataggttttgttatgttggccagcctggtctcaaactcctaacctcaggtaatccgcccacctcagccttccaggtgctgggattacaggcatgagccaccgtgcccagccaataagaatttttcctaatgtctcacttgcgtgtcatcctcctattagatgatagcgcagttgctatcagtaaagacttgtatttagttatgtatactcggctcctaaaacagtgtctgacacatagtagttattttataaatcttggttgtatgaagaccatttaagagaagaccagtttaattatccactcagtt

SEQ ID NO: 45442 - DNA, 1408 bp, Homo sapiens
tcattgcttgatacataatgtaatatatataaataaggaaagaacatgtaactaaggaaatgtcttcatattcttagtgggtgagtattcagaatatgtgtcattttcctctttgctctgttgtactttctttgagcaagttattctgctgtgaacaactttgttagtatatatgttatgttcaagcctcctgtttttaaattaaggcaatccttggtgatcaaaggatagtaggggaagtgagtaataaatataagtcaagcaatcatagaaatgtgaaaatatcccagttttaagaagtcatgtacctgttttttaatattcattttcttttctttaagtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattggtaagaagtgttagaaaaatttaactttatttaaaattactaatcttgtacatttttaatttttcagaaatagaaaaaaaaactatgaatagaaaaataagtactgctctgcagaaataatagtaataattaactcatctcacatcctttttgtagagcaaggtgggaattaaataagtaaataacatcatttactctttacatagtgctttcacatactttatcacatttgattatcaacatagctaactggtgtaattatatattcttagtgatgtgatacatgtaatgtgtgggtagactttttgattaatttcaacaattctgttgagtctaaataaaaatagtaaatggaagtacagttgataacatccacttatattttacagtctgcatggtgcctatttataattaaattttcctccggattttaatataaagaccagtagttgagaagtttatttctgttgagagctatcaagttaaaagcagcttaatttgtgtgtgtgtgtgtttgtgtgtgtgtgtgtgtgtattatagaaaagaaatccacattacatgtgggcaattgcaaaatgataaggaaaatcccaaaatgccacctagtgacaactgctgttatttatatttcttctccctccctttctcctgcccgcaactgtatatagtgttttttgttgttttttgtttgtttgtttgtttgtttttttaatggagtcttgctctgtctcccaggctggagtgcagtggcgcgatctcagctcactgcaacctccacctcccgggttcaagcgattctcctacctcagcctcccgagtagctgggatt

SEQ ID NO: 45443 - DNA, 1041 bp, Homo sapiens
ataggggaatgaatacctctgaacagaattctgcttcttttgcatctctcacacttaactctgctgtttctggtatgtgaaaaacagtcttttgttcagctaacaaaaacatttgtttaattttagtgcttgttatttgaaaaactaatcaacatcaagtactgctatcaatataaatagcaggtattataaagtggcagaggcctttacaacaggaagagaagacctaaattcttatgtgcaaatggcttaattcccctctctaggggagtaaggattctgtagcttgagatcactgacagtgtattggcacacagacaaatacacatgcaaggccttccattcaggttcatattcttctgttgctaatgtagtcctgccatacttttagttacaatttgacattttacttctgttcaccgttactcatcatgagtttaaaactaaccctttcaggttatggattcccacataataactataagtatctgtagatttataaaatacatgattactaataaactactgttaattctgcattacttaaatggatatatgttttattaatcatatagaaactacatgtatttaacaaatattacataaatatgggaggccaggtgtggtggctcacatctctaatcccagcacgtagcgaggctgaggtgggaagatcacttgagcctaggagttcaagaccagcctgggcaactacatcaccacataaagttaaagaaaaattagccaggcatggtggtatttgcctgtggtcccagctactcaggaggctgtggtgggaggatcgcattagtccaggaggttgaagctacaatgagcaatgagccatgattgctccactgcactccagactgggtgacagagtgagactctgtctcacaaaaaaaaaaatatatatatatatatatatattttttttttgtggacccagtttactaattttgtagttccgcagcgtctggaatcactaacctagaaagggggtcagcaaactttttgtataaagggacagatagtaaacat

SEQ ID NO: 45444 - DNA, 1025 bp, Homo sapiens
tcggaaagctcatgccgtcttcatttaaaaaaaaaaaattatgagttttttttcctcacaaacctaaatctcaaaatgtactttgtctgaatttttatttcacatccttttttactatttactgttttctactgttagcacttatatgttccctgtggggttttccaccatttttaagcatatgttttccttctccaagtagagttaagaactctctgaaaatggggactagcactctttcatacactcaggacctagtgcaagcctttatacataggtgttcggtggtaataataatgacaataaaaacactggactatgtgccaggcactggtcttagtcttttggattttattatctcatttaatgcttaaaacatttctatgtggtaggttttatttgtttccacactttccagatgaaaaagttgtgacaagggaaagttatctagcttttcccaggccacacagttagttaaatggaggagggtggtattcataccttgctagtctggctctagagttcatgctcttaaccactatctggtacagccttggtgatgatagtaatcatcaaggtaagctggcgacacagtggttaaagcacagttcttacagattaagggagatgaggagagaaagatcagggaggaccatattgtgaaatgcatgccttgaattgctggctaaaggttagggggctgggggttttcagtactagcttagacagtagatacgaattttagtcccgactctaaaatgtagtagtacctcatatggttagggctttgtcacttgtctgggagctgtaaaatcgagcaaataatgtgtcatatctgttttcataggttgttgtgaggctttaatgagataatgggtgaacatgaaagctctgtaaattacagtcatctctcagtatccatggggggttgattccaggacccccctcaggtaccaaaatccccaggtgctgaagtctcctgtgataaaatggcatagtatttgcatataacctacatatgtctt

SEQ ID NO: 45445 - DNA, 1477 bp, Homo sapiens
cacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatag

SEQ ID NO: 45446 - DNA, 1050 bp, Homo sapiens
aaagaagtagaagggaagaaaatcgcaaggaactagactaaaagaatctcgacccttgaatggagttacacgaacggccagatgaaagaaggaaggcccggacctccactcagggccgactaggggactggcggagggtgcacgctgatggatttactcaccgggtgcttggagctccagcagctggctggagcccgcgatgacgtcacggactcgggtcacatggccaagtccgccccgccccctccccgtccccgccgctgcagcggtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctggtgagcgcggcgcgcccggcccgggaccctgcgttgcttccgcgcccctagctgggcttctggcccggcctcgcggtggggtgaggcgtgcgctcatccgcctaaagttgtattattagaaacttaattctccgggtgccgcgtccgcacttcccccggctgggccagcgccgactgggggaggccaggagtttggggcgatgggggaggccaggggcgcggggcggagggccgcactcgacccttggcgcccaggtggtgtgggtcgccgatctccagcctccgcgcagccccgcggcctcgcgtagggcgcaccggggcagacaaactgagcttatctgccgagcacgtgtttcctttcttcttaaagcccgtgggctttgtgtttcgacggctgcggacggagcggtcgcggaggtgacggcgcatattttgcagctctgtggttagggttgcggatttgtcaatgctcgttctcc

SEQ ID NO: 45447 - DNA, 1044 bp, Homo sapiens
tcaggagttttgagaccagcctggctaacatgatgaaaccctgtttctattaaaaatataaaaaattagtggggcgtggtggcacgtgcctgtaaccccagctacttgggaagctgagagaagaatcatttgaacccaggaggcggaggttgcagtgagctgagatcgtgcgattgcactccagcttgggcaacaaaagcgaaactctgtctcaaaataaataaataaataaaacaaaaagtaagagtccacaataagggctcatttaagtaatttcctgttttgcaagataggtaaagtggatcttttttatatgttttcttattgttgattcctaccaataccgtttactaaggctccaagtgtcatgtactttactagatactttgcataaggttaatttttacatattcctggtgaggtagattttcttattcccattttacagatgagaaaactgaggcttagagaactttggtgatttacttgagagcttaaaatcccatggttggtttatgatctgagtgatgttttaatctgttctgtttccactgttttacttttaaaagttgtgcatgtgttttggttttgtcttggaataataaaagttttccttcagtcctgaagtaaagtatattgacttcaggtatttattattattattactatttttaaaattctgggccacgctaactttgggagacttcaggtatttattctagagatcattttttgtttgtctctttttttttcttttattgagttgtgatttatgtactacaattttttttttttgagaccgagtctcgctctgacgcccaggctggagtgcagtggcgtgatctcggctcaccacaacctccgcctcctgggttcaagcgattctcctgctcagcctcctgagtagctgggattacaggtgagctccgggctaatttttgtatttttagtagagatggggtttccccatgttgttcaggctggtcttgaactcctgaccttgtgatccatccgccttggcctcccaaagtgctgagattacag

SEQ ID NO: 45448 - DNA, 1946 bp, Homo sapiens
gaattttgagcttgctgccagggattggtttagcagagttggccagggcctgtgaatggggtgtggtggcttcttgggaggaacctgggttactggtaagagcgtatatggcatttgtaatcaaagcaccaacaattgaatgtcagttgaaaactttatgcacctgtattttatgaacatggtatgtgcatatttccctgaagtctgagtcctcatctgtagaatggtgtagtaatgatcagacttgatagggaggcagcactgtttttataatataaaatggtgcatatggggatggtggtttcttagtttagttcatcacctatgaggaagacgtcctaaaaggatggtactgttgactgaactggtgaatcagaaagacctggttgaatttggggggaaaaacttccataatatattaaaaaattatatctgttgaaatgaggctctaataaaagatacaacatccattttactccttaaactttttccctcagagtctataaccaaagagaccatcctttgacttagaagttcagcaacttacaacatggccgccattatagtccaactccaaggattgccaagagtggctcattttcctgcttgtgtgctgtagagtttttcttaacagttggttcttttttatttttatttttttgatacaagatcacagtttgtcacccaggctggagtgcagtggcaccatctccactcactacatccttgacctcctgggctccaggtccctgccaccccagctccccaggcagctgggactacaggtgcgagccaccacaaccagctaattatttgtattttttgtagatatgggtttcaccatgttgttcaggctggtctcaaactcctgagctcaaatgatccacctcccttggcctcccaaagtgctgggattacaggtgtgagccgccgtgcctagcctaacagtcaattttttttttattttttatttttttccttttttgagactaaatctctctctgtagcgcaggctgcattgcagtggcacgatctcggctcactgcaacctctgcctcccaggtccaagtgattcttctgtttcagcctcccaagtagctgggattacaggctcctggcaccacacgtggctgttttgtatttttagtagagagaggatttcaccatgttggccaggctggtttcgaactcctgacctcaagtgatccgccctcctcagtcttccaaagtgctgggattacaggcgtgagccattgcgcccagcataacagtcaattagtcacttaatctgataccctaaaattgtttgtgctataatttttctctctcaggatgtttaggtctgttactttctggtgttaatagtgtcacctcagaaatcatacaaaggatacaacagatttgaaaataataactagaaactctagaatgaaaaaaaaatactgttgttgataaggtaacagaatttgtgttcactctgaatagaacatccaatttattattttccccactagataataggctgccttgagggctttgccataatatatatgtgatgcttagcattgtgcctggcatatatttgtggcacaatagattaatttttgaataactgaatgaatgagttaatgaatgttatagcgtttattctacattttacttggctgttgatgtatgtttcttccactggactaatgttgggcacagggaccgtgtcttttttttaaaccatttttctgttcagaaaaaaaaaggtttagctcgcccccagcactcatttaattttgtataaacaccctatgaggctgaagcaaatctgagtgattttcattgtaaaataaaataaaaattgttcttggaattatttctaaacagaatatcagtattgtctatttcagaaaaatcggattgttcaaatgaatcttcggccaacagctgttcaagag

SEQ ID NO: 45449 - DNA, 1057 bp, Homo sapiens
caaacagaaaaacagggcacacatgaataccacagggcaagtacaaagagaagggttagaggccagatggataagctaaaaataggattatctggacatcctgcagtactttcagcacagtgtatctaaaatcgacgtcgtcatagtccttccactgaccttttccatttctgataatgacaagatacatcctgtcaccaggcttgaagtcttaggtcttctttgcttctttttctgtgttctttgcttgtagtcagttactgtatctctagtaattctgcctccatgtggaaaggtcttggggttccaaccttggctctcccacacataggccctaagataaagtcactaaacctcaccacctaacatggaagaagaccatctcacagggttgtcatgagaattggagatgaaatgccctattacttcttagccagactattgtaggtgtttccagggtcaaaggagaaaaattacaacaatttagttttaagatcttaattggctttctagaattgggcaacacttcatctcataaaatagagtatcctgtgagctaagcagaggagcttggctttttagagagaaatgggctgaagaaaccagaaacaaagaactaaaagcagatgagtcgtttcaaagggacttttcttttaaggcaggggcaggaagacagaacaatacaaaaataacatggttagcatcaggtgacttcaggttatctgaacctgagcacggtgactgcattttggtttgtagtctagtatgttgaggccctattgtgcaggagctcaatctgcaacaatggccgcctataatttttatttgacaccagattggattcctgcctctaatttagccttcccacttctgccagtttgttctttctaacaacatagctctgatcatgtcatatccttcctcaaaacctttatggcattttcattaactattagaattcctgtcctagtttcgaggcctcttcaccacctggccccatcctacatttttggttctatcctctaacatttccttttataccccctgaccctggcgt

SEQ ID NO: 45450 - DNA, 1759 bp, Homo sapiens
cttgtctctcagcagacaacaacccagtcttagctggtgcctcacttaaactctgcaatccttgctaccccagccccatcaaagttaatatgtgtgtgtattgtccagcagtgacaggaagaataaaggaaatagaaatgaagaggtagaatgatcaggattttgcagttggttgagtgtgcaggataaagatggtaaactcagatgatcaagtttcgtatatggacaggagacttgtagaggttaggttttggaacctaaattcctggattcaaatcccatctctacagcttggtagttgtttgttcctgggcagtgttttttaacctctgagcctcagtttgctatgtataacatgggaataatttagtacccacttcgttaggttattgcagggcttaagagagattccacataaagcacttagcatagtgcctgaatgtttttcattaattattaatagcgaggccattttttaaattagagaacaaataaggagggcagaagtgggagatgttaaagaaggtgattgtcatttagaggagctgagtttaaagtagccaagggcagtactcagaagacaggactactggcctggcctggcctggcctggcctggaaagggttattgcagaaggatgatcctggatccactatgtagctttgcattcattctctgaaactgcttcctagatggcttcaaagctctcaaagctccactagtttgaacctgtaaaatgtttgattaactgagacaacttgggttgcttacctttagctctagagtgtagctgactcactggaaagtttttgtgctttttcaaccactggcgccagggctgatgcctgtgtttgtgtgtgttgttcactgctctatggtgcctgggccagggggaatgaggtaaaatcctgctgttgtcttcactccaagccttgtgcacttggctgcaactgaatgggctggcagcatttctgccttgggaatgtttatctgctccctccatgggtggggcttagtgttgagagtcaagccactgaagaagttgcctgtggccagcctgactccatgtggtcagtgtaattttctattataaggattgcatcctggggttacttaaattcttttttttttttttttttcttgttgcagatcatcaatgctgtggtactgttgattttattgagtgccctggctgatccggatcagtataacttttcaagttctgaactgggaggtgactttgagttcatggatgatgccagtaagtagtagatatttgggtattttcaagggcagggaatctgactgccagcacttcctattaaattacaaatatagactcgtgagttcatttgagctgatatataacttgtcattgcaaatcaacgaatatttgtgtgcgtctaacattctgtcttctaggtgcaagagtctaaataagatctattttcatcttatgttaacttacccacttaaaaatgattgcattatcatagactttctaccctgggccttttggccttttttgagaggaaggggtataaatgccaggaaggaaggtgaaaaggcttgtgcttatctccttgtgtcttctattatgtttcagtatttatttttattctaggagtgatccttttccattctagaaatgatgttgcagattatttgggggaatttagggccttttcccagtgaatggaaatatgtacagggatgtggatgtggggtaagcagggaggaagctaggctcccagcttga

SEQ ID NO: 45451 - DNA, 1218 bp, Homo sapiens
gctgataccaaaagcttggcgttttcactgcactttgcagttctcaccatgagtggttactgtagtcaatcaagtgcctgccctatttgtgtgtgcacatggacacactcacctaggggtcttttttcctcttcagagccatcaccatttcttttagagtcaccgacctctggccatccagctacacatggacagggttagaaaaactcaaggcttgagagtcgctctccatttgctcctttaaggattcaaaaagtcttttaatgaagtgtatccacttgctagaaaattgaacttggtacaagttgtggaacatgtttagttgcataaaagttcagtaaaagctaaacctcggggaacgtgtgtgctcttcaaacattaactcttgccgtccctctttcttctcaggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctggaacactgtgatagattaactgtagaattcttcctgtacgattggggatataatgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttc

SEQ ID NO: 45452 - DNA, 1060 bp, Homo sapiens
tatttttttagtagagacggggtttcactgtgttagccaagatggtctcgatctcctgacctcatgatccgcccgcctcagcctcccaaagcgctggaattacaggcgtgagccaccacgcccggcccacccaactaatttttgtatttctagtagagatggggtttcgccatggtggccaggttggtctcggactcctgacctcaagtgattcgcctgcctcagcctccctaactgctgtgattataggcatgagccaccgcacctggcctggttacaccgttttaatatgcactgaattttccagtaatgcagtaaatcaaagcaagtttgtactttttttggcagggtggcgggggtgggggtagtttactaaggagtgttgaccaatttggaaaattacgtcattagtggcattgctaccttctctttgaggcactggtacaacacacctgtgctgctttgcctttgtagctgttgaattcatggtaattttatgtataggtagaagtaaagactggtattaaaatactgaactgctttgagaacagcttggtaaataccagctgctctgagcttccctacctcctagtgtgtccatgtatagggcccttcggatttcctgcagttagcaatgaaagagttaatcactggtaccttggggttgaagggcttccaggaccatccagctttatggattgtgccaatgcctgtgctggtgcctgtgtggatgttattattccctgggttcaaaatctattcataatatcatctagtgtagttgtggtgaaatagttacatacagaaatacatattattttattaaaattacttcttaggtctcctttatgttacatttagggcatctattgtagggtatgtctcgatatgtgtctaataggttataacattcatttcatttaaaaatagagaacagctgcttcaaactgaatcagtaaaaataggggatgttgagtttgagagttgggaactactgactggtaaatcagtcggggtcccactgtttttgtcctttatcttgcttcaaattgaaatcatt

SEQ ID NO: 45453 - DNA, 1033 bp, Homo sapiens
tgggtgacagagcaagactctgtctcaaagaaaaaaaaaggatgaaaaaatacattttacagaaacgaataaatagttcaatataaataggttatcagagacttaaaataatggacagaagagaagatgatgatatctgttggctcaccaccattggatgaggaatgatacacaaagccctgaagccagtagttgaaatatgacatgtatttataatatggcatattattatttagagatggggtcttgctatgttgcccaggctggacttaaactcctgggcttaagtcaccctccccccttagcctcccaagtggctagaattacaggtgtgcaccaccatgcctgccttaatgtgccgtattatttgcctttgccgtggctcctagaatttgattatcttacatgtggaattagacagttatttggaggcaatttaatattgtgatatttgcatcttatacatgaaaaatcaataccagaaaaaactgcttaggagcctttgctatgtcatagactgtaaaaccgactataagaataacttaatttcttgtcaagtaaattcttctaagttaagtaaatgcctatgaaatattgttttgtaacaaaaggcctattgccaatgtttggagtttgacttcattgatctgaaggatgtggtttgaaggctatttcttttccctcttagataatgagaaagttagacagctgcttctggagggtgtgcctgtggaatgtacgcatagctttatctggaaccaagatatctgtaagagtgtcacagagaataaaatctcggatcaggtaactaatagtgtaagggttattggtaaagtcatgaatgacaggttaaatatatcattctagagaccataaaaagttattcatacttcatagaattccatagactttcttttgttttcaaacaagttgttgatccctaactcatgatatgtactgtgattttcttctgttcttatggataatctaagaataaggatagggatctaagaataagataaggatcttgtct

SEQ ID NO: 45454 - DNA, 1047 bp, Homo sapiens
agagacggggtttcaccatgttgcccaggctggtctcgataccaattttccatagatccaccggccttggcctcccaaagtgccaggattataggtgtgagccactgtgcctggccaagcactgtttttatatcttagtacctatccatttagacttttcttttttcattggaagtgtggccgatgagggtcatgatttcctttatattgcaaagtatattctaacattgggaatttgttgccccctaaattgtaggctcccggaagcacagaagctgtctctctttattgtggcatttgcagtgtctagccagtgcctggtgcacagtaggtcttaataacctttatttgttgtctgatgaatgactggttgaatattgtagttccttgatggtgagcttcatgagggcagaattgtgttttcttgttcattgctgcaaccataactatagagacaggcagtctgcctggcttgcttttttttttttttttttttgaggcaggatctcactctgtcacccaggctggagtacagtggcgtgatcatggctgaccacagcctccacctcccggacccaggtgatcctcccacctcagcctcctgagtagctgggactataggcacctgccaccatgcctggctaatttttgtagagatgaggttttgccatgttgcccagggtgttcttgaattcctgggctcaagtgatccacctcctttggcctcccaaagtgctagggttacaggtgtgagccaccctgcctggcctgtgcctgcgtttcaaactatttgctgagtggtggatgaatgagtgactagtgatgtattcctggattgctaccttaccagctctttgagggcagcaatcacatgttatacatccttgtgcctcccatagtatgtagttgagaggcttctatgtgtttgttaaataatagttaaaaataatacttatttcttactcttcagagctttttatgcatgcaaattttccatagatatacatatttttttaaagaatggtattacatacattattttgaaac

SEQ ID NO: 45455 - DNA, 1050 bp, Homo sapiens
gctgggaagtccaagatcaaggtgccagtaaatttaattcctagtgagggccctcttcctgggttacatgtgtcctcacatgactgaatgagagaaaactctggtctttctttctcgtcttacaagagcactaatcccgtcatgggccctacccactaatctcatcatggggccctaccctcatgacctcatctacacctaattaccttccaaaggccccacctccaaataccgtcacattgcaggtcagggcttcagtatgtgaatcttaggggacacaaacatttagttcatgacagctgccactacaagggcatgtgggcactaagttgccctggccagaagtcacttctgttcacaattcattggccaaaactagccatactgccccagtataaagaccaggggggctgagaaacgtaagaagcacaggcatagtgggtgggcgccatccaactctgccacgaagccacacacacctgtgcatacatgcccgtatccacaaatgcacacatatccgcatacatatgcatacacaagggtacatacctatcaatcatgcccgaacacatgtaataaatattacagtgacctacatagacacatggagcctgcagaacatcatgtgtccaacaaaaagcacatgcaaaataatccccatgtgagaagggctgcatttcttaaagaagattttttttcaccattattggcaaagttgtatgcttaggactgaaaaaaaaagatgttttgggagaaaaagaacagcaggcaaaagcaatggcaacaaagaagagatgataatgttctctctgtttttgaggataatagagttctggaggcaagcagttcttgggcggttcatatagagagtagtgagacataatctttgcaagatttagcttgagagccagagacaattgttttatttcttataactattttgcatatatatatagaaacaagagaggcaggcagaggggatgatacacccactgcctcaccgctgctttgtggcgccgcagctgtgtgggtgttgatgccgccacagag

SEQ ID NO: 45456 - DNA, 1087 bp, Homo sapiens
ctataatgtatcctgagaggacctttttgggttgagtctatttgggaaactttgagcttcctggacctggatgtttatatttcttccgtgacttgagatgttttcagcaattatttatttaaataggttttatatgctttgtctgttctcttcttctggatctccaaaaatacatgcttttttttttttttttttttacttaatagtatcccataggccctgtaggcgttcttctcattctttttaattatctgttttttttgtttttttttttcggctaacctgggtacagcaggacctcaaaataatgttcagcgttgtttagttataatgttgctgagacaaaaatgatttctggttaggacctctgtctttatggagtttgcttgttctccccatgtctgcatgggttttctccggatactctggtttccttctgcttcccaaagatgtgaatgtttggttaactggtatgtctaaattgtcccagtatgagtgagtgagtgtgtgtgtgtgtgtgtgtgtgtgtgtgtaccatgatgtaatggtgtcctgtccagaactggtttccactttttaccctgagtgtctggataggcttcagccacctgtgacactgaactggaataagcaggttggaaaatgaatgatcacgttactataaaataaaaatgcgtaaagtatatgataatcatacaaatgcacaatatattatgcgttcagaaagcactcagtgatctcaccatattcattgtttttttaactgtgtggcattagaggatgctcgttttcactttgcaaacatttatttcatgatttcattcataaccattgtgacttctgtcattcgccaattcataaatttggtaaatatttattaatcttaattttattaatttagtagtgtactaatttgatactaatttaataatttcattaatctttcttaaatgtacatataacctacatctatttcagtatttgatattagaagtggtttgactctttacaatattggtgatgtttttgtgactagacgtaggctgtaggaacttttgtttatatcagttagcctaggtaaaattag

SEQ ID NO: 45457 - DNA, 1054 bp, Homo sapiens
taggttattggggaacaggtggtgtttggttacatgagtaaattctctagtggtaattcgttagattttggtgctcccatcacacaagcagtatacgctgtaccgaatttgtgtcttttatcccttacctctttcccccaagtccccaaagtccattgtgtcattcttattcctttgcatcctcatagcttagcttccacatatcagtgaggacatatgatatttggttttctattcctgagttacttcacttagaatgatagtctccaatctcctccaggtcactacaaatgccattaattcattcttttttattgctgagtagtattccattttatacacacacacacacacacacacacacacacacacacacacacacaccaccccccgcccccacggtttctttatccgctcgtcgattgacaggcatttaggttggttccacatttttgcaattgtgaattgttttgctataaacatgtgtgtgctttaaacccatgtgtgcaagtatcttttttgtataatgacttcttttccactgcgtagatacccagtagtgggattgctggatcaaacggtagttctgtttagttctttaaggaatctccacaccattttctatagtggttgtactagtttacattcccaccagcagtgtagaagtgttcctggtttactggagccatgccaatatctattattttttgatgttttgattatggctattcttgcaggagtaagttggtatcacattgtagttttgatttgcgtttccctgattattagtgatgtgaacattttttcatatgtttgttggccatttgtgtatcttcttctgagaattgtctgttcatgtccttagcccactttctgatgggattgttttttttttcttgctaatttgcttgtgttcgttgtagattctggatattagtccgttgtcagatgtatagattgtgaagattttctccgactctgtggattgtctgtttactctgctgactgttccttttgccgtgcaaaagctctttagtttaattaagtcccagct

SEQ ID NO: 45458 - DNA, 1032 bp, Homo sapiens
taaaattttctgaattttctaaaatctagttagatatttaaaaaagaaaaaagttatcttaaaagacttgtcttcaagtttagaaattctttctgttgcttgatctattgttgaagtgctcagttgtattttttattttattcattgagtttttcagttatgggattttgtttggttgtttttttaatgacatctatctcttttgaatttctgattcatgaatttttttttataaccttgtattatttatgtgttttctcctgtttctcactgaggctcttcgttatcatttcaaattctttttcctttttctttggatctgttactagagaattagtgtgttgctttggaggtgtcatgtttccttgcttttttatgtttcttgtgtctttatgttgatatttgtgcatctagtgtaccgttcacttcttctagttttgcggattgtcttttgttgggaaagactttttttcttatagatgcatctattatgttgcttttgtagggtgctttgtctttgattcttggtgggtgaagtagtatagtctgcatgatttctttggctggaatcaggattagtcttgtctgtgatttccccagtggcttaggctgtggttcttaggtaaaggctttggtgtggctttttcttgggaggaggaagacaggcagactagttctcaggcaccactggtggcagtgatgggctgcgcatgacagtccttggtgccctgtgtggcatatgcaggtgattgtggtgatgggtctagatgggccaaactttggttgtccaggcagcttttctgggtgccagaggtagaagtggtatggtgagtctggtgggtcctcagagtcttgggtagtgtgatggcattggtggtagcaatagcggtggcaggccaaccattgggtctccagtggcaggccagcagtggtgttgggctgggtgtgccggtccccagtcccctaggtggtatgcataggtgagtgctggtgatagtggcaaactgagcaagttggtatataggcccctgg

SEQ ID NO: 45459 - DNA, 1032 bp, Homo sapiens
tatttttttgtagagatggggttttgccctgttgcccaggctggtctcaaactccttggcttaagtgatccacccaccttggcctcccaaagtgttgggattacaggtgtgagccaccatgatagccctggaatttcttgattatcctgaagcctgtttttatctctttttaatgtttagtcatatattcctttattcatcataaatcccagttaaagggttaaagcaaagtgaaattgagtctcaagagtatttaacttgcctgattaaggcatacaactaggaagtagcagaactggaatagagttttattattatgtgttttctaagctttagtcttcacatttaacaaaaggagagtagtcctgattttacaactttgttgtgagcataaaagtgtaggtaaggcccaagcatcatttcttatatatcgttaatgcctcctttgcatcttctgtggaaagaaatatttgattaaaaggctggaagaagcagctatggaaaatagaaaacaaatagaactggacaatgtaggattgtattaatgagttgacatttgtggtgaagaaattttattttaattaattaattaatttttttgagacagagtctcgctctgtcacccaggctgaagtgcagtgacgcaatcttggctcactgcaacttctgcctcccgggttcaagcgattctcctgcctcagcctcccaagtagctgggactctaggcgcctgccagcatgcctggctaatttttatatttttggtagagacggggtttcaccatgttggccagtctggtcttgaattcctgacctcaagtgatctgcctgcctcagcttcctagaatgctgggattacaggcatgagccactgtgcccacccagaaatttaattttagtatagaagcaatttagtatggtatagaaatttaatttagtatagaagcaatgccagttttactttgggaaattatttatagtgaattagaattctggatcaggagttggaagatcttagtttgaatcttctctc

SEQ ID NO: 45460 - DNA, 1027 bp, Homo sapiens
tttagcttttgatttatgatttttaaaatgtaattaaaatcttagggagttattcaggacatgtctttttattttttatctgcattttcatttaagattaagggatttgttacaagggtatattgtgtgatgcttaggtttgggctcccactgataccatcatccagatagtgaacatagtacccaaaaggaagtttttcagcccttttttcctctccctccttccctccttttagaatccacactgtctgttgttcccatctttatgtccatgtgtacccaagatttagcttccacttctaagtgagaacaggacatgtcttttgatacatgtgaaaattttctgtccaatgtagtgtatgttttcaatgtatgtgattagtatctaagcataaatattgttgtcttatttaacagttttctgaacattgtttgtctgcctatcattgtatcttggaaaaagaattcagtgacttctgatcccattaagtaggttttaatgtggagtaaatgtttattgttgaactacttgcctctgactgtcaaagttctgtagatggaagggctggacttaggtgtctgaacactggtattaactactgttcctgtttgagtatggctgtataaaaattagttttgtttttgttaccttatattttattaaaaatatagtattttctattttacgtagccttactgtacttaatatgtaaaatctacatgtttttttcttggtagtgcttagtcacctgtgttttacttttttccacacggtgtataatgcatattggtttgtttatattctgttactttttccttctatatttgaattagcttctttggcaaagataaacatggaaaagaattaactcagtaatagtgatggctctgtctcagggaaatacgcttattttctatagccttgggttttctagtaaatttggggaatgtgaaggtaaattgaagatacattgaaagcaagtaatggatatatggaagcttactatataaaatactctttttgatc

SEQ ID NO: 45461 - DNA, 1047 bp, Homo sapiens
ttagaattcattgctcagcttagatttgaagaatgtttggaattaatttctggttcatatttttgttaagaaaacaagatcatgtttctacattagcattttgagcagttgatatcagtccagcaaaaatcatgccaaattaaatctagcatttttctaagaatgtttaaaattattcttgtaatgttcgggtcctttttttttttttttttgaggcagagtctcacactgttgcccaggctggagtgcagtggcgcagtctcggctcactgcaagctctgcctcccgggttcacgccattctcctgcctcagcctccccagtagctgggactacaggtgcccgccaccatgcccggctaattttttgtattttttttagtagagacagggtttcaccgtgttagccaggatggtctcgatctcctgacctcgtgatccgcccacctcggcctcccaaagtgctgggattacaggcgtgagccaccgcatgagtccttttaatcaattaattgctttttctctataataattgtagacagctgaagagggatcaatttaaaaaaattcaagtttacttcagtaatcattctagattacagaattgtgctttaaaatagctacattgtatatatcagtactagaaacatccaagaaataggagtctacattacataaaaatataaaatataaaaagctttattataaagaatgagaataattagttgatactcaatatagagaagtcactgtgcttaaaattgtaactttctagttcaagaactttcattaggcctaagttaaatattggtttttttaaaaatgtgagctttgactttgcatttaaaagtgatgaatatatctatgtcgtaagaatgaggggaagtaaataattggcaaacacatgctgaataccttttttaaaaaagtaaccttttctttttggaataattttagagttacagacaggttgcaaagatagtacagagagttcctttatgttctttacccagtttcccttattgttatgttatcacagtatatttgtc

SEQ ID NO: 45462 - DNA, 1048 bp, Homo sapiens
tgtcattcagtcattttttttccattcatagagcacaagcaaagtagatttagcatgattcttaagggccctaggattttcagaatggtaaatgaacactatcttcaacttaaagttaccagatatgttagcccctaacaagagcatccgcctgtattttgaagctttgaagccaagcactgacttttcctctctagctcagatgacatcttcttccaggagaaggctgtttggtctgtgttgaaaatctgttgattagtgtagccactttcgttaattatcttagctaggtcttctgggtaactgcgtgcagcttctacgtcaacccttgcgcttttatggtatggagacgtcttcgttccataaggctcatgaacagacctctgctactgtcggacttttctcctgcagctttcttacgtctattagcctacatagaatttaagggttagggctttactctggattcagccttggcttaagggagtgttgtggctagttcgattgtctatccagaccactcaaaattcctccatatcaacaggctgttttacttccttatcacttgtgtgtacaattttaatttccttcaagactttttcttttgcattaatgactgggccaactgtttggctcaagatgcctatgttttggcctgtcttggcttttacatcccttcttcactaagcttaatcatttctagcttttgatttaaagtgagagacagggactcttcctttcacttaaatacttagaccattgtaatattactaattagcctaatttcaatattgttctgtctcaggaaataggcccaaggagaagggagagaggggagtggctagacagtggaacagtcagaacacacacatgtatcaattaagttctcagtcttaaatgggcatgttcatggtgccccaaaatagttccaatagtactatcaaagataactgattacagatcaccataacagataataataatgaaaaattttgaactattgggagaattaccaaaatgtgacacagaaacacaaagtaagcatgtg

SEQ ID NO: 45463 - DNA, 1050 bp, Homo sapiens
gaaagagcatactatattgttttatacagtcttaggtacctagttaaagttcatgacggtcctgtgagataagatgatattgtctcttataaactctttctaattttcagagaggttaaataagttgtccaaagtcacacactggcctcacaagattttcgtagaggattgtctgatttgaacatctttgattgttttattacttgaaggagcgaaggggacatatataatcttctgttaatcagttttgaaggccctgttaatcagttttgaaggcccagtatgctttttgcctatagttaaagtaaatttccatggagtgaaaggctagctaataaatctgaactctgctagtattagttaatagtatgtagatattattgtaattctgatcttaaaatgatggatattaacattaggtggaatcttagacattatcccagttactgagtctttatgacgtacttttggtttatagccatctgtgtactgcttgaacattttattcaaggatgttagctactttctgggccaaccattattgggcagctctaaatttctttcttttatttaatcaaagtttgcttttatgagaagtttatacttggatttctgcctaagaataatgtttcttctctgatataattattacttatatatatcatgaggcattttcattctcagagaaatgtgtgaaaacacatatttctttttaaggttgagggacttctaagttcccattttttacttagcacagtgccaattgttgattttaactagcaaagttattgaacagatcatttgcaggggaaaaatgcttctgtgaaatctttgagttcagtgttaattagaagttacacgacttggtgctggtaggctggtggtattgatgtggtgtgtgaagggcaggtgaggcagatactgatccttttgcctccctggaagtgaaactgaaggcatcatttgccccagctcagagtgacaccagggtaaattcttttagttttaatggatactgggaccttcaagtctaaaaaaaattgccagtaa

SEQ ID NO: 45464 - DNA, 1053 bp, Homo sapiens
tgcattaaaaagaccactgtagaaggatttgtattcatgtaaagatcttagtgatctctaagatatgttgtttactcatatcaagtaggctgtagacatacacctatgtgtatattctcattaaaattataaatgtatatttgagtgcatgaaatgaatatacagaggtctgcagggatatatgataaactcataaaaagttgttacctgtagagtgtggagttgggagtaaatagtattagcttttcattttatctatttaattttttaaaactttaaaaactttttttcttttcattgagtattgatgtgtaagttaagtagtcactgtgtaaagaaatatacatcttagctttttaaactgttttcatttctaagttgagttagcaaagaactgtactcattttattttggaaaaagtgaactaatcttattttactgtacaggatatgagtaataacaaaaatacatttttggaaccagtttgtaggttcaaactttgcattttgggactctatataaatctttagatccagctgttgctgagaatattctttcaattgctatgaggtgtgttgattttaaaagaatggatggctgttcctcaagtgtacatatggcaaaaatttaatggtatcgctatgaacttgaatggattgtttaatttctttgcatcgagtagtaagaaccacacttccatcatttttatttaaaatttagaagaaggaatttttttttatagaaatgcccatttggtcctgaaatttcatcagctctctgttatagtttgtcaacaaatggtacaagcaaagtctttcaaagtatttgttaattaggccatattcatttttagtcttcgctactatacagtcaagacctacttgtttctatttcctttaatttatcctggagtttgtccaagttgagttttaatgagttgtttatcccactagttacactaggatttatttttccctagagagtaatgtttgaattgatagtttttaaacctattctgtaaaatgaacatatgttcagactaagacttctgga

SEQ ID NO: 45465 - DNA, 1033 bp, Homo sapiens
tttacttttctgaatttataaaatggactgtgctatgaaaaagcattttatttgaaatttcctattctaaaaatattctgtgtttaaaagaatggtggcatatgtattgaaaaattgattaggtaagtgacaacagattgttatttgtaacctcaagttctgtcatttagaaacctaaaattagtggaactaatttttgcatattgaggagttgaagaaattagaatgatgttaagacatttctttgccaaataattttatttttatcaaatggaatgcctataaaatttataacagattaaagagaaaccatcagctaagacagttttaaaaagccagatttccaggtggtcagttttcttgtcttttttccccccgagaacaaaacctcattctgtgctttgtattcttatggagtgcttaaaggattgtgccttcaaatagttctatctaaagatccacgaaatgtgtatgtatttagggtgtaaagttttagcattttattattttgcgtctgaggactctcattacatagtactcagcactgttaagctttgtttaatatgttttgtgtaagtatgtgatcctttgctttacaactagttttcatttcccacattaataaagagattatacaagctgtgtacatttttggatctctcagacttaggttctgataatgtgtgaaagaagaaccattattattatcattatatatatttttttgagatggagtctcgctctgtcacccaggctagagtgcagtggcatgatctcggctcactgcaagctccgcctcctgggttcatgccattttcctcccgagtagctgggactacaggtgcctgccaccacacccggctaagattttgtatttttagtggagatggggtttcaccgtgttagccaggatggtctcgatctcctgacctcgtgatccgtctgcctcggcctcccaaagtgctgggattacaggcatgagccaccacacccggcccagaaccataatttttaaagtctacgtttgactgta

SEQ ID NO: 45466 - DNA, 1062 bp, Homo sapiens
ttattttaaccaataaattttagagaaaaaagcactctaatattgcatcactttgtacttagtttcatgtattttctttccatatgtgttatgaaattgactaatatgagaagcaggcattttgttttttttctcaagttattattttcatatttatgccttttttttaagtttatgtatgtggataatactaaatgatcaccattgggtattattattttaaccaataaattttagagaaaaaaatcactctaatattgcatcactttgttatcggtatcacaacaataattagttatcattcttctcctgacatagctctggagcctatgggggagatatcagagttttggaaagttttccttgcaatatcagtttataaacaaatttatagttattcctttaaaattttatctcagcttttatcactacctgactttgcctagtcaatattttttctaccatatattcaaaaacataactacttcatgtaattaattagcgtaagttttctttgcctctaaaaatgttgaaggtacctgactatattactacctgaaagactgtttatttcatattccattttgtcatatttatggtcttcgatccattgtagataatcatggcttttagagataaaagcaatcatagtcataaccaaatccagtccctgacttttttcaggtgaagaaactgggccacaaagttttaaatgcaacattatacagctttttgatggtagagtttttactagagtaaaggtctagggattagtgtatctttcagtaaactcccttattaatttttaatgtatatgaactgaacttttctaatcccagcttgtattgtttatattaatagtagcaataatgacaatatagtatctgacatttattgagcatttacatgccaaatgcactattaaccactgcccatttattattctactcagtgctcatgattactgtgtgaagtagctagtgatttatgcctgttttacagatgagaaaacttagcgtagtttaataaatttcagggctcatgatgtgtttaatttctttg

SEQ ID NO: 45467 - DNA, 1044 bp, Homo sapiens
tcaaatggacacaattcaggtggcaaatattggaaaatagcaaccaattagtacacaattatataaagacaaaatacaaattagcaaattgatagctccgagtattagtccgttcgcatactgctgtaaagaactgcctgagactgggtaatttaaaaaggaaagacacttgattgactcacagttccacatggctagggagggctcaggaaacttacaattatggcagaatgcgaaggggaagcaagtaccttcttcacatggtggcaggagagagaattgccaacgaatgaggaagtgccatgctttaaaaaccgttagatcttgtgagaactccctcactatcatgagaacagcatgagggaaactgctcccataatccagttacttcccacctggttcttcccttaaaaccttgggattataattcaacatggggtttgggtggggacacaaagctaaacaatatcataagggttgatttgggacaaggtatttctcaggataacattctctaaccatttgcaaatcatttaatgtgcttgttaaatgcagaattctgggccatagctcaggatgactgaatcataatttctttgagagattatgagtcttcttgaataccctagagtttaaagtcaaggattttagaataatgtttaatacaactatcatagaaagtgtatgatcttcttaattattcatacatagttaaagaagcttcaaaaataaaggatggaattatttaaccaaagtgtggaaagggaaaaagaagcaaaattacgttggtgggttttcatgaataattggcaaaatgagtgataaagtcttctgtgatggaatcagattgtgttaaacaccctagatctttcacatagcaactgttgtcctctgggcaaaaattagttaccttccctaatctattgcatcctcaatctgtaaagtgaagataataataatatctataatataggcctgttgtaaggactgaatgagataatgtacataacacatacttaagtcctcagtaaatgttaattgatt

SEQ ID NO: 45468 - DNA, 1031 bp, Homo sapiens
ccttttataagcttttctggacatgttctgcattcattagcaaatatgaaaacttaagagttaaaaatgctttacattttatgagactcagtataattaaatgtatagctaatattatcaaataaagttgaaatgttatattatggtgttagtatattttaaaatcaaacattctcaagtgactcatgttttatttttattattgttttataaatatttcttttcagttgatagtggaaaagagaagttgattcccttgcttcagggtccttctgacactaaagaccttcatagcaccaagtggctcaatgagagtagaaagccagagtctctcttagctccagatttgatggccttcacaatccaagttccacaatatattgactactgccacaattccggtaagtacaaacctatcattattcccttgttttgcttttttttttttttttttccagaaaggcttttaaaattggtatatatttttttttttttaggtatttttgtcaattggcttactctgcagttgtgctttttcaaaattcaaatgaagaatttttgtatcacttttgttaattgaaatgtgtttataaataatgattttatttatatgagagaatttagctgtgtgtatagtggttaacttcagattcgtatatataaggaacaactgagttttaaaatatagcatatcattataatgcatattttcttgagatagtagcactttgtaacccaagtttgtcatgtgtaaattggtgtttttaccttctgtaattttttaggaatgaaaagatttgatggtagaactgagaagaaaatctcagaggtcattatctcatttcttagagttttatttttttctggtagcactttgaatagaatcgatttcattttattcaacactgtaatagcagagctatacctctcatgttgagagaaggtatcagaaggatcaatgaagactgagaaaagaaaaatgtatgataggtagagatcactatcagccatgaattcacttagccagtatg

SEQ ID NO: 45469 - DNA, 1032 bp, Homo sapiens
tgaatcaacttctaatgaggagtaagcatataaacaactacagctgaataaatgaatgatataaaggcttattttttgggttcagcttcatccattataaattatgttactttgagcaagtaaacctttctgagtattggtttctttttttctttacttttttttttgagatagaatctcactctgtcatccaggaaggagtgcagtggtgcttgcatcctctacctcctgggcccaagagatcctcctccctcagtctcctgaatagctatgactacaggcatgagctgccacacctggctaaatttgtgtgtgtgtgtgtgtttttgtagagacagagtcccactatgttgcccaggttggtcttgaactcctacgttcaagcgatctttccaccttggcctcccaaagtgctgggcttataggcgtgagccacagcacctggcctagtgttggtttgtcacctataaaatggagatactcttatctgcttactaagattgttgtgaagattaaatactgtatcctcaagtacattgtaaactttaaaacataatgtggattttaagtattaattattcttttcacaatagtaccctatattaaccagtgattgaaaatgtaaggtttttctgagtcatttcttttccttccttaatctcaacatcccagttaatggaatccactttaaattttttctcaaggtaaaaatttgcaaacctatgattatgcatttctgaagctaggagcaaatcctttacctagtttcgttattctccttccacattgaaatgtaccctggacgctatgatgttaggagtcaggaacagttgcaatagcaacaggaaattactttgcttgcttcctttgaaaggtcccagattctggaaggatgccagagggagaaatcccttgagccttaagggtaaccagtttccctcatttatatagcacaaggtcaaattttttgcattttattactgcttgtatagtaaaagtaaactggtattcagagtaaatagtagcttcatt

SEQ ID NO: 45470 - DNA, 1027 bp, Homo sapiens
aggtggaaggatcacttgagtccaggagtttgagaccagcctggacaacatagtgagacccctgcctctatgaatgaatgaatgaatgaatgaatgaatgaaagaaggaaggaaggaaggaaagaaagaaagaaaaagaaagaaagaaagggaaatcagggtcaactcatgaaatctttttttgttaaaccttcgataaagttgaaattttccaaattcttaatggaaactaatggaagttaatactctagataatgatcttacaggaagagttaagaacaatagtaaatttgaataatatctaaaatcatctaacttcaggtaaaataggtttagttaggagaatgctatatatacttctgtagagacactatcaaagtatttttcagtgtatctataataggacattagagtttgatgatattgccgttcttttttgtttttaccctcacttccagtcagttcctgtcttcttgatttgggctttatttagaattattagctatggttagtgttactttgggctcaagttgagaactagaaagaacatttccttgagatagctggatgagttgacagagatacaggaaatgtcaagaatctaaagacgattcatttctatgtgggcatgagaatttctgaaataatgagctgtagttgacgaaaagcaagcagagcttagtgaataatcttttcaggaagaaagaaggtgaccaggccaaaatgtatcacctctgcagggtgataaatagccactgaatggagaggaaagagtgaaggaggaacaggcaatattaaagtaagttgctggtaagtttttaaaaaatcagtttgatattgttgaatcattaatcatcagttatcctaaaaacaagatttattataatgacttatcctgtgtagaaaaatacatctattttgagtgggagactttcaagatcatttctagtccagaagaaaagaaaaggcaaacattttatttgggcaagtgtcattagagttaagcatctagtgagtggaggaggta

SEQ ID NO: 45471 - DNA, 1079 bp, Homo sapiens
aacatggaaagttcttccatttgtttgtgtcatcttttattttgttgagcagtggtttgtagttctccttgaagagatccttcacatccgttgtaagatggattcctaggtattttattctctttgaagaaattgtgagtgggagttcactcatgatttggctctctgtttgtctgttattggtgtataagaatgcttgtgatttttgtacattcattttgtatcctgagactttgctgaagttgcttatcagcttaaggagattttgggctgagacgatggggttttctaaatatacaatcatgtcatctgaaaacagggacagtttgacttcctcttttcctaattgaataccctttatttctttctcctgcctgattgccctggccagaacttccaacactatgttgaataggagtggtgagagagggcatccctgtcttgtgccggttttcaaagggaatgcttccagtttttgcccattcagtatgatattggctgtgcatttgtcataaatagctgttattattttgagatacgtcccatcaataccgaatttactgagaattttttttaagcatgaatgcctattgaattttgttaaaggccttttctgcatctattgagataatcatgtggtttttgtctttggttctgtttatatactggattatgtttattgatttgcgtatgttgaaccagccttgcatcccagggatgaagcccacttgatcatggtgtataagctttttgatgtgttgctggattcggtttgccagtattttattgaggatttttgcatcagtgttcatcagggatattggtctaaaattctctttttttgttgtgtctattccagtctttggtatcaggatgatgctggcctcataaaatgagttagggaggattccctctttttctattgattggaatagtttcagaaggaatggtaccagctcctccttgtacctctggtagaatttggctgtgaatccatttggttggtaggctattaattattgcctcaatttcagaacctgttattggtctattcagggcttcaacttcttcctgtttta

SEQ ID NO: 45472 - DNA, 1026 bp, Homo sapiens
aaatagaaatatgatggtttgctttacatttgaaagggatttatgggataaaggtccgccttaataagcacactaatttcccagcatcctgatattttttcttatttatttatattgttttgctaatgtcaggatggatagtgggggctatgtaaaagaccaaggacctcccttctcctgggaatcctaatctttgttacactaatgtttaaaatacaacatcagtaatttcttcctcttcttcaattttctttttactcttcctgtgattttggccaattaatgttgatatattttgttttcttagtaaatatttgctatctttgttgtgttacttgtttaactttaatcttagatgattcaaaccatttactaatgtaagatagaatagttacttttggcaattttaatgcaacttattactttgaaaatgttagaagggacccctagttttcctttgtaaattgtcgtttatttggcagagaaagcatttaatctgtaaatgctgctctgtgttttatagaatggtgaaccttacaagtattttatcccaaatagatgtttattaaaattttaacttaaatatttgatgattattatgaataagagtttttaaagcagtcactttgctttgatattcacagtgtgaacaagctaaaattttctacctactttctcttctttttattcttccaggtcacctttgtgtcaggcattgctactttggcaaacctgcttgcctttgacctttggttactcagttttagtttggttttgagccagtgtgtgctgaaatctttaaaactaaacaaatatttagcattcatttgatttaccaacaattgtctttttaaatattcagtcactccacaagaaaagtaactattgtcagttacagactgtagtaccaaagtcagattctggaacattctataaattactaaaaaactatcaggttataatttagattggctcagatgattttaggttgttttagaagctgacggtatttttactcacaatttt

SEQ ID NO: 45473 - DNA, 1062 bp, Homo sapiens
tacttctaagctagcaagttagcatccacaatttcatggatgctggccaaagacatgagactcattgagtggagacaaagaactttattatccacaacattagcaataatcacagtattagcatttttttgtgttagtgccctgagcccagtttccataaggtggcatgaagagggccaagaattctgaatttagggaacttgaaccttttataatggatagaaagcatgcctgccctattctccagagggaggcgctgtgtctcctttgcaagggtgtgagcccacttgccctttgcacagaagcaggatcgtatttctatcttctgagactgttcgctatgcaaatatccttaaaaacacagtagggaacaatgacaatcaccacctctacttaaaagacccatagagaattatctctcaatagtatgttccttctttaagtgaattcttgaaaacgacagtacaccttaatcatctttcctcccctttctctcatactctctgctagatcttctatgtaaatataaagtataactatccttctataaaataatttatttccttttgtgtaataaaaagaattttacatatataattcatcaatatataattaaaaaaataatttttatgattttattttgtgatttgttttttcttcttaacctctaatttttatgatgattggctacttttctttgggtaattttatgtcttttctttagctttatttcttataacgcagatattcccaaccacattgataaagattttatagtttcagtaaatcagaaccatctatcaagtctgttatgggcaagactctgttctaagtgaaattgagggcagaaatattaagaagatccctacccttaaagaatttaaaatataatcatatatgcaaggaaattcaaattagctattgtagtatttaagtcgtatttaacaaccaaaatgctaaaataaatttgtttatggtattttatacataagtattattattttgtgctttatgatttttcctaaaatatgacattaattatgtttattttgtggaatcatt

SEQ ID NO: 45474 - DNA, 1079 bp, Homo sapiens
atagtggaagccacagagtggttgagatttctcaggagaccatacagagcaggatgagaagagagtgcaaaattacattcaaaggaactctttaatggtagagtaaggagaaggagccaatggagggagttcagaagcatgattatgagaagtaggcaacaaagctacatgtatatgtgtgacacaattccaaagagttgcaagaagaaggtgcatgacatgctgtagaatcatcaagaacaatgaggctgaaaaataggctgttagtctgtggtcagttggccagaggacctttagttgttaaggaatggatgtgaattgaagaaggagggacaacctatgtacaccaatcattcaagaaatttgattatatagtcacttggggtatgtgtatagcaatagagatgtaaagagacaaggagacaaaattggagataccacaaaggctgaggataatttatacagtgagatcataggtaagcaagatataaaacccatgcacagatgtgagacttaacgatcaggaaaaatcatttcttctttaagacagaggtaagaagataagactatgtatcattatatattcatttagttatttttctttccacaaacaagtatttaggtgggacaagtattttttttttttttgcactgttttagagaatctaagagatcaaaaaatgtataattttctcatgacaagcctcctatttttctcatacagggaaccagtttttcaggttaactttggaatgccctggctgagaagaggggttcattcagatggttagcgggccctaaaattttattttttctttacaaatgtcatttgaaaatattaaagcatgaaggtagacactattatataatatgcaatttattttatcagggataaaagatggttttaaaaaattttactactttggaacagaaaaaggttgaaaataaaataaagtctatctaatgaagtacatctaaagtaaaataacttgaaaatgtaattcagaaagtcgtcagagaatttaatgaaaatatatgtttactaagttgttttgtacattgtaagaaaaattattttt

SEQ ID NO: 45475 - DNA, 1088 bp, Homo sapiens
ttgccaggtagtattactagaggatgcaaggtcaaattcaggatctattttaagatagagccaacagattatagtaattttcaggatgtatggtgtaacagagaagggtcatggttttgtttgtttgttcgtttgtttttgcagccagaaaggtggattaggtatttattgaaacttggaggactataagatgaagagcataggggcttttgagaaagagactcaagagttttgctttggctatgttaaatttgaaattcctattaactatccaaatggagatgttcagtacgcagttggataaatagtctggagcttacaggatagatccagacaattccctggaaatagaatcctcatagaggatacttaaagccatgacattgagtgagatcctctaagaagaaagtgtttgtagagaagagaaatggcccaagtactgaacccttggacatgccagcattttgtggtctggagaatgaagaattaccaagaaaactgagaaagagctacaactgaggtagaatgggaacatggagatggtagtgttcagaaagaagtgaagactgtgttttaaggatgtggaaatgatcaactttttcagattcctctaatagttcagtgttaaacaatggctctaaaaaactaccacagaaattttagtgactcaacatagcagaattcatttctagttctaggaaagtccattactgagtccacagtatgatagctcttctccaagcagtgaatcagccaccttccatttagccactctgaggatccttagggcctcagattcagaaaagagttttaggaagataaagattttgctgatgacatatcatgagttctagatggcagaatggaggagattgcagtgtgtggagtgagagatgaggtcaggtggggattgcacaggtctgtttagtgatgagaatctgggtgatgaggggtattgttagaattttgggtttttcctgatggctgatgtaaacagaatacaaatggcataaaggaattagtactggggtttctaatgcagaattaggtggcaaggctgtgagtattggggctggagggatgtggtc

SEQ ID NO: 45476 - DNA, 1054 bp, Homo sapiens
agtcacactttgaataatttgttcttcttaatgaatcttagttctgagtataaaatattggaaaacagtgacagcctgttgcagatataagcaaaaaactacctctctcaacctaaaaattcttactgcttcttaaacatctcatgatatgctatctggaagtgctttagctcatttactcccctgttcaaattttttgttgttgtctatgtgatttgttttggaatttaggccaggagaaaggaattttaatggtctcagtggattaatttggtaatctatatataacttgaacattgaattctagagacattcatatctttactttgctatttataacaagacagtgttaatcagtgtgctcactctttctcactcactttctcattatctctctacttcttttctcctctttattccccttaccttactttgtttcttgtttttttttcttgacagatttcagaattcctgccttgccccatgactttccattgagatctaggtagactgtattgtttatatcctgcaaattatggaggagaaacaaacctaaatagttgacgtgattttaagatcacatatcttgaattggtagaataaaaaaagaaacctaggttttctgagtcctcccagtccatgctttcaggaaacttttatttaaatatattaatctcactggtatctgaaattctgtcacaaagagttttttgattttttgtttctattttaaatctcaaagcttcttcaaataagcataagcttcatgaggactgggattgtgtttgttttgctcaccacagaatttccagttcttaatctaagccttaagaagataataggtactccataagtagtttttgaatgatgttttttgacatgttgaaattaggggatagtttaattttccatccctccctcctttcttcttttcttcttattttttggtgagctacattttctgatttttctcctattagcccatattatttatctaataaaagtattttaaaaactataccatatagcaatagatatattgtattttaaaaac

SEQ ID NO: 45477 - DNA, 1114 bp, Homo sapiens
gtcactatttgttattatccgctttgtttctttttcttttctttttttttttattttgttctagccatcctagacaataacctcttaaactggagagagcaattaattttaagtggtttgtttcttttttttcttttttttcttttttttgagatggagtcttgctctgtcgcctgggctggagtacagtggcacaatcccggctcactgcagcctccgcctcccaggttcaaacaattctcctgcctcagcctcccgagcagctgggactacaggcacttgccaccacacccaggtaatttttgtatttttagtagagtcagggtttcaccatattggccaggctggtttcaaactcctgacctcgtgatccacccgccttggtctcccaaagtgttgggattacaggcgtgagccactgcgcctggccaaattaaagtgtttttaagaactgtgttggtcaggcagagagtaaatagattgatttaatacatcatttaatatactaaatacacatcttaatatttataaaactgaagcttacattatgaaactggtgtttatttttactataaaaatagtaaaagtggtgtgaagtggaatctcattgtggttttggtttgcatttccctaatgactaataatgttgaacttattttcgtgctggttggccatttgtatatcttctttaatattttatttctttttatttatttatttttttggatcaggtttcattcttgctgaggctgaagtgcagtggtgcaatcacggctcactgccgccttgaccgccggagctcaattgatcctcccacctcctgagtagctgggactacaggcacacactaccatgcctgtctaattttttaatttttgtagaggtggggtttcaccatgtttcacaggttggtatcgaactcctgggctgcctcagcttccaaaagcactgggattataggtattagtcaccctgcccaacctaatattttcttctattcaaatcttttgcctactttttagttgtatttttagtagagtcagggtttcaccatattggccaggctggtctcgaactcctgaccttgtgacttcttacagttgagttgtaagag

SEQ ID NO: 45478 - DNA, 1028 bp, Homo sapiens
tattactagtttttttttttaaatatttagcctggaaatgattgcatttcactatctccttagattggccccattacgagtaaggaaatgcaatgcattatgacctatgcagaaagaattactggtgactgctttatacttaagacaactgtgagtgtggtagacagtttgtgcaataaatagcacaaatgtatgattacatactctctcagattttcattttcatgaaatgaagttcagctttgaatcattccagctctttgacatctgagcttttcttcttacattcctgacaatatttaggaaaattacttgtgactttcattaatgatcttgcaagcttttctaacttatttaatgtctttgcattccttatagtagctagataaatttttttttaccgatttctttaaggttatctaattgttttccctacttaacaggcaacattcatattactttaatggaagtcagtgaaagcattgacaatttctcatccagacccatcacattcctaataaagagcctttgcaattctcctagaatgtttctcttccaaatagtcccacagctcactctctgaagaattacactttttcagaaaggccttactggagtatcctattttaaaatgacaccaccatcagctagtgtcccattactctgctaattgttctccagagcttttatcaacattgacataaactaaatatcagttaatagttggttatctttctttctaccactagaatgcaagctctatgaaaacaatgagtacgtattgctcagtgctctgtccctagatcctagaatgaggtcacataattttagctcagaatattggttcaacaaaagaatctgccttactagaagcaatctttatactgctgccaatgcttaagacccagccgtttttactcattcattcccctccctcccttccttccttcctttcttccttccttccttccaacttccttccttcctttcctaactctcccttcctccctccctttctccctccctcc

SEQ ID NO: 45479 - DNA, 1069 bp, Homo sapiens
atatttgtgttccctcaaattcatatgttgagcccttaacatccaatgtgatgtttatgaggtggggcatttaggaggtaattaggtttctgtgacatcatgaggttggagccagtgggattagtaccttaagatgaagaggaagaaataccagagcttcctctctcttggtcgtgtgagaacatggcaagaaggttatctaattgttttccagcctcaaagagtgttcttaccaggaaccagatctgccagcaccttgatactagaactcccagagctcttagagatggatgtctattgtttaagccactagtctatggtattgtgttataacagcctatgctgaccaagacagctatccattccatggcactgatgttaccgataggatcttgtcttatagagagtagtaggagtcttcaataccaatttaccctaagtcacacactgttataatattcacatttttagcaaaactatagggtaactactaatacctttgttgttggaagggcaatgctattcttttcagtcccttcttcttttaaaagcagtgattattctagttttgcattgtttacaattgaaataatgttttagagaatcttagagtattatatttctttatgaataatgaaatgttgacaaacaagtcacgattaatccagtagtgactttcagaagtaaataatagttttattagtaacatagatttctatatgtaaaatgtttttcacaaatttgaaatcaattatctcttaatactattatcattattattacattttgtacatgcagttcatttcacatttcctaacacaaaacagtattccaaatgtagaattttagttacagagcaaataaaactgaaggttgctcattttcatttcctttctttctatgcctttcaactgtcttcctcttctatgaagatggactagatatcatttataatgtcttgattttctttaaagtacctattacttaaattaacatcacttagaattaataaacactttatctttaactgtctattttattttattttaagatggagtttcgctcttgt

SEQ ID NO: 45480 - DNA, 1050 bp, Homo sapiens
ggcggctctgcctgatagaatgtagaggaacagattcagcttctttagacactttatcacagaagttgttaaaaaggaaaacataagatatctcttagcatggcagtataagctccctcagcctatctttcctactgattattcctatatactctaggaaaaattcaaaaacaaacaattgactacccccacataaatgcatgttctcaacttgttttaaaataattgaattgcaaaatgactttaaggcagcttttagaaatttttatgaggtgcaaaggaaagcatactaaatgaaaaggcaataaatctcaattgaggaataaaaagtataaaaagagtcaaatggaattttagaactaaaaaatacagtacctgaaggaagaaaaccatattatgtgggcttaaaggtagcttggagatgatagaagaaagagttactaaacttgaacatagatcagtagaaattactgaatttgaaaaagaaaggaaaaaagtttttttaaaaagtgaacagagcttcaatgattgtagaatagaaaagtcgaatattgtgtactacttggagtttcagaaggagaggataaaaggattgggatagaaaaaaaaaaaagaggaaataactacagaaaactttgcaaatttggggaaagagatagtctttacgcatccaagaagttcacctaatcccaaacaggataaacccaaagtaacaaacatttggacacattgtgattaaaatattgaaaacgaaaaataaattttttaaaattttgacaattttgacagcagatataggaaaagacacattccatataagcaaataatgatttgaattagagtagatttctcattagaaaccacaggagacagaagacattggaacaatattttggaagtgctaacataaaagaactgttaacctagtgaagataccccacagaaatgaaagagaaataaacccatttttagatgaagaaaagctaagaaagtttgtcaccagctgctctattctacaagaaatgctaaaggaaattctgcaggatgaag

SEQ ID NO: 45481 - DNA, 1054 bp, Homo sapiens
agatttggaaacagagcagaaaattaatgcacaaacatgtttaacaataccaaacaaaatgctgtaaatccaaaatgaaaactgaaactgcatgaggaagtacagcaaagcttttactgaggagtgcttactaaatttgcagccacagttttcttagcattcttaccaagtataccaagtagtgttaaaaattgaagtcttagtgattcgagatgttattttctctcagttctccatccttggaatatgatattcttctgtctgttggaaggagggtttaatttaagcatacttctactctataaacctatacataaagaaaggctatatatattgccttttatttaataagcatccttatctggaattagtttatgctttttattagatgttgtgttgcattagacagctaaccaaaaacctgatttttttatagcttctcaagttgtaggaatttctattgtagcagatttagaactacttattttgtaaaagcatttatatgaaaactgcacaaacagtgagatatttgctttgcttggtgtatttgggacaaagagtaactatactgtcttcaggtttaactctataattttctctaatagtaaatcccagaacactgttactttgctatgcttggtgcctaagtgttcttgcagtaaacacttgcctgtcattctatgaaaatcttccccattgggcctccttctgaggttgcagggaaattgaattttcttctgactgaaagatgttataaaacaatgaggttaaaataaaagcctcatgtaggagctgaatatacctgtgtttagatggcatgtctgtggtaatgagagccgggactttggtttgttttgtacaggattttaattatcattcctgcttttaagtgtttagagattagtggcttctgctctgacaacctgtctataaaaaatggaatactgaccatattatattgtctttgtttaaattttaaggggtattttgttctgacagttaactactggttatgactcgttagcacaggaaattaatatttttgtttgagaca

SEQ ID NO: 45482 - DNA, 1050 bp, Homo sapiens
ggaagtgtttagatttattttcctctctttgaatgttcattagtgtctgtgaaaaacattcttaataattttaacaaatattcataaagaaaccgtaaatttatcgttaatgttcttcagaaattttttctaaatttataaattaaatgccatttaaaaagtttctttacttagtgttttttaacattttattttaaatagtataaagtattattactgtatgaaaaaatgatatttatattacctcaactagtattcactttttgccttatgttaagggagttaaggatgcagcaattaaaaaaaaaacaccctttcttcatgtggcttacctttcaagtatgcttacattccacgtttaaaatatttttccaaattaaaacatttatacattgaaataccttttatactctttacaggattcaaatgttgctattaataaagatttattatgagttagatttttttagattagtggtcagtagtaaccctctccccagtttagacacttagaacagacaacatcactgtgatcactgtggcctcttccactgggggtataccttaacaatccttctccatctgttattgctcattgtccagcaacatgctaataaaactggtagcacttttcttgctttactatacatctttttgtttttgagtgcagaaataaaaaagaaggggaatcaaaagagaaacagtgaaaatgttgggaacagtgaaaaatgctttgagagcaggctattattgggaaagatgattatactgcacaaccatttaatgcttactttccagggtttttttaatggtcaattaaaaaatacaaaaataatttattttcttatcttccttcattataaagtctaaattaaaagcaaaattagcagtgataactgaattgcatattttttcctctcaccatgtcagtgggtgataggcaacaaaatgagaggaagaaaatggaagcaattgaaatgtaggagtgatgggataatatagctcagactcattactgctttcctatttctcttttttttctgtttatgt

SEQ ID NO: 45483 - DNA, 1016 bp, Homo sapiens
ttcaaggccgacattattctttgtgatattcataggactctactatcgtacctagtacttaggaaatgctcagtaaatattagttggtttgaattcatgaacaagattatgctacacaattatattgttgctacatattgaaaacaataataatagttggagttatggaaaagtcaaataggtatgaaaaggtgaagacttcttattgttagttgtgtatatctagcacaaggcccaacacacagcaggccctcataaatatgaaattcatctgttaaattgtgtcaagtggctgtgctcaccatttttgctcttctccttaatgtatgaacttgagtcctaggaaatgtcaccaaagtagtgaaggtcaaataagtaagaatgataaattatcatctgaaagctatcatgtttctttatctgtattctaccgtttttgcttcaggagattttagtgtgtggccattccttagaagtgaatataaccacaaacctggacttcttcctaagtgtggctcaagttcaactcttacatcagttaatagtagcaaatatgactggactggaaccatcaaacaaggctgcagaggtaactgttacctgattttgatcaggcttactgcatttgttccaactttacattcacagtaggaaaactataattaagctgactgctttctgcttaattattctgtgtttaactttattcaaaatatagtcataagtcattttggattgatattctttattttagaaatttgtttggtctctattcctcttatttatcatgtacctttgcaaaattgctgtggactgacctcagaggaacctctgttatatacataactttattagcctgctgaagttctaaagtatgatgcgagaatcctggtatagctttcatttactcggatacattacagtaataaggcctcttttggaagtgaactttctaagagtactatgggaatatcttcaataaataacttgtaaagcatttgtttcccatgctcagt

SEQ ID NO: 45484 - DNA, 1040 bp, Homo sapiens
cagttgttctgtggcaactttgcttttatatgttttacagattgtgcatcccctctctcctacgcacccctcaaccactgttccattaacccataagacgttctttgaagaaagtgtactgtggcagaaaagtagtttgaaaatctctggaaacaatgagatccagaacctcctccagctctaacaagtcatgattctgatgcattgaatttagaatatgaacttggcctagattactccattttaactccgtgtcgactaaaggaaagctgtgaacaaagtcagttttttcccacatagctgcacacaggtgtgacttagtggaaactgtggaactcagccagatctttagctccctagtgcagtgctctatctccaagccctacttcctgttcttgaattcagtgatttgctaaaatagagacacctggttccagcaccttgcaaatggatttttcctttcagcattttaaagtacattcatgtattgatgaagagctttctctggaaagccatctgtctgaaatctgcaggaaaaaaaaaatctccctagctgtcttagatattcataatggtatgtgttgcttcactcctctactcctgcctcctgttcccttttcctcatgttttcattcattttacaaaacaaatatttatgaagcacctagtatgtgcccaacactacatatgtagcagtggacaagactaattagtccctacaattaaggatattgccatctagtaaggaaacatgtggacaaccacaacaacaaaaactttaaagatttttgagtcatggttaagagctatgaaagaaataaggttccgagacaaactatgtaggatgtgattttaaaatgaactccagagttatattgccagtgttcaaattccagtttcaccatttactagctatgtgtttttttttttttaagggggcagacaggatctcgctttgtcacctaggctggagtgcagtggcgtgatcatggttcactgcaaccttagactcctaagctcaagctatcctcccaagtagc

SEQ ID NO: 45485 - DNA, 1033 bp, Homo sapiens
tgactcccattgtaatcatcaacatttacttaaaacaaatgaaaatggggggaatcatttaaaggcagtgattagctttaatgttacaaaacccaactttgcttagagcagaaaagaggtttacagttgggattaagttgatcttccttggatatgtgacttcatttttttttttttttttcactgaatagcaccttgtgcttacttgtgctgaattttaatcaaatgttggccacattagaatttaatatgaaacaaccaaattttaataagaaagagatcaaggacaacacagagcagcacataaaatgaattaaaaggaattaattgaattgatatttcacatattatctgctggttatacttaatattcattaagtataaagaatacacttccttctagcaagatatgaaagacttggttctaaaagtaagagcaagtggacattgatggtcaaacattccagcagccaatttaatcccttccttttcctgttactatggactgcagacctggggtttcaaaccaggaaatctcttgcccttcccatcacatcttacgaggtgcagagtaggtacagaatcgcagagcatgtgaaatactgcttatagagttagccaaaggtctggatatccacagggagatggtggcacttaccttgcatccagagcaatttggaactggtttcttggttgatttttgctgtcctgacattggatgatgatgatgattattattattattattattatatatatttttttgggacagagtcttgctctgtcacccaggctggagtgcagtggcgcgatctcggctcactgcaagctctgcctcccgggttcacaccattctcctgcctcagcctccctagtagctgggactataggcgcccgccaccacgcccggctaattttttgtatttttagtagagacggggtttcactgtgttagcaaggatgatctcgatctcctgaccttgtgatccgcccgcctcggccttccaaagtgctgggattacaggcgtgagcc

SEQ ID NO: 45486 - DNA, 1028 bp, Homo sapiens
aaatattcgtgaccaagccaactaaaagttctgtattttgtttaattgtcttaaaagttacaagtgaaaaaggtaagtaaagttcatgggtcatgaaagactatgaaatactggagactacagtatctgatttatccacaaataaattgcaacccagacaacactaggtctgttcccatgcctttccagttgtacctcaatcatagcagggaaaggttaagactcaaacaaaatggaagaatttaaacgtactatactcacttttaggtgcttttcttttttcatcctcattgctttttttattcattagttactcatattttatccatgtttaatgatgtctgtctttgggaaacacctctaaaatattaaaaatccttctctcactaagctgtgcaagttagtaaactctagttttggaacttgttttttccccctgtatgtaagaaaaactatatacccctaatccttttacaatgctgttcttaaatctagttaaacacaaaaacagcaactatagctttgactaaacatactttatacaactctaacatgtagtgtccagcaaatgttttaaaataattatttgcatcaagtcaaatcagagttgagattagctacttaatagtaacaattttgttatgagactataatgaacaccaaaatctatttttagtacagttttttctttatgcatactcaaacagtttaggatgataacaaggttagcaaaataataaactgtaattacatgaaataagatttattaacttctagttataaggactgatttcttggaaaattgtgattaagagattgccacatatttttttcaaaaaaattgattttaactgtatttttaaaataaaacataacttaagttttgaatgttaatttcattgtgtagttgaatgtcttaaaaattcatgctttgcaatttggataaaatacatgcaaacatatattcaaagtataattttgataagtggtaaaaactatccaccaccaccaaaaagcaaatatactca

SEQ ID NO: 45487 - DNA, 1084 bp, Homo sapiens
tgtgacagcatttagtgttgcctgtggtcacaggaaattgcccgcttgtccatataagccagtaggctgtttgctaggaaagcttctagcaaagcaaccctgagtgatgagtaactgacaacatcttagatgttcttttactccctggttggtcccctggacttgttggctatgttggcataacatactggggctgagcaagggaactgaggacaggaaaaagcatgtatttacaacccagttaccaattagaaaaatgaaattactaagaactaatagcagtagtttgtataaagcaacatggtgctgtaaagaggcagacagaatctgcaccccagccctgctacttactgaccagctggttgtgtcaaaagttactctgtagtgcatttcccaaatgaaggcaaaaatatttaatttataggactttgagaggattaggtgacataatgtatgcagaatacccgacacattgcttggtacaaattaagtgctcagtaaatattggtctttgtatatattcctttccccaaaatcacaccacatgaatatggaggtcatagattactaaatgtcagagctgaaaaataccttaaaggtcatccttttttatcaataacctttattatccttttctcccattgacctcatggtctaggcacactgcatttagtattagataactaactataccaacttgatacaattttaaccaaaacaaacaaaaactttagaacacctccacaacttagtctcagacaaattcatgatttcttttaggttcttaggaatactaaaaatacctcatggaccaccattactatgtgggacccactaagtgtcaaggaaccttgggttgaagcccatggagctagtcttaactccctcattgagtacagagtgaagaggttaagcggtttgcccagggatactgtatggtggagttgagactagaacacacatctcctggctgctggcctttctgttataccagtctttcaaaacctggattatgtagatcaagaccattttctaaggcactgcagtaaattacttagcaagtcatgttgttttcaacattatt

SEQ ID NO: 45488 - DNA, 1057 bp, Homo sapiens
ccaacctaaactggtttaagcagtttttacgtatgtgaaaagctccaaaccagtgttgtcctgaggcatggaagagtctgtcagatttcttccctctgcgttacgcagcttcagcccttaggctccacatgctgactgccagcagttccaaggccttcattttcttaacctcaagaccagggagcaagaggaagggtcatgttcccaaaagtattattataccttagtggttttcattgaatattatgctcattcctggaccaaatcaatctccagagaatatcaaacataaagtcccataaagttccccatcctgctagactatttcccggcaaaccagtcattggattccgttgtcaccagaacatagctatagctagctcagtgcctgccttcattgcagggcctctgtttctgaagcacattgtgtgtcctctggtcctctttagtgctcacctaagtctggccgactttctctcttcttgttccagcctcccaaatgtttgtgtgatcattggcttcctaattctgtgcaattttactgatatttctgtccccacctttatctttattctcttgagaattctagctatcccattctgtgtccccaagccaaaaaaaaaaaaaaaaataggatttgtgtaatagtaggaaagtgtttttctatatttgttttctaataattcaagtctggaatttttttttcattctctccttgccctagtcaataaagtcaataagaacttgtaattgtataacgttgggggggttaagaagagccttccatcaactctacttaagttctctaagaggtaggcactttgcaagtgatatgcatcatatagaatgatatgaattttgacatttcagtactagttcttttaagacaaagcctcataattttagtacaatatcagtatttagcacaatatcagtattttaaagtggttcctgcataatagagatacctaacatgatccaaattctatatgtattatgttatttctacaaatataagattttgtcatgcttacaaatactcttttttaaatgaaag

SEQ ID NO: 45489 - DNA, 1051 bp, Homo sapiens
attccttttctgggtatatttactttgaactatagcatatagtttttctcataaatctaacctgccactatctgtttttaagactttgtaaacttcaagtggttatgatgtgtgaagtttggattaaactaaaatttttagaaaacacacgttatatattttgattgttttgaattttaacatgggccagtaaaaaacttgagtgtctagcagagtaacatactgcactctgttactgtaggaaatcacagaaaattaccctttcccatcatgttaacaatagacaaatgaagcagctgttcttattcttaatgtagttgcttgaaaaacttgcacaatttaatgaaaatgtctctactcataaaacttaaaatgctcacacatggaaaaagtcataatgttttggcaaatattactttgttaggaatgtgaatgaggtatacctgcttcataactagaactctgtataaacggcatgaaacggtggtggactgccaaccaagcaagacgactctgacaaaggatgaattaatactcttcaaaaatatagatagttctttcccaaacattttttttgataaggatgaattatatactcttctgtatttttttttcaggcataattcttgggtcatcatttctactcagtataaacgattttctccttaaaacaagtctcaaagaaagaagccgcattctgataggaccatgttgtgctactgccaatctggaagctaagtggtgtaaacacagcgggaatccaggcccagaacaatccataccaaaaatatccattgacttaagaggaggtctactacaggtctgtgggtattggccatatttttttcataggttattaactagcctctgttcattttttgaactgtttcactaaattttaaatctttgtgtggtaagaaagggtatttgtcagattgctacttgttaaattttcaacaactttattgagatataagtcatataccagcaatctacctatttcaagtatacaattcagtggttttttagcatattcagagttgcacaatca

SEQ ID NO: 45490 - DNA, 1034 bp, Homo sapiens
gtgcagatctcaatatgtatgtctggttaattctgtataagttgtttgatgataatgttaaactcttgatctgtgccaagactttggtactttcctgtccatatttcatggtcatcttctcacaatattaaagcatgtgagagcagattgcttgtaaggactttttatctctacccacaaaatgctgactcatgacagaaggcatcttggaaagagaaatggcttaagggtgtatggctctttcttcatgtgataaaaattaaacctctggcgagttgtataaagtgctttttaatatatctatatattttttcttcctactcccttaaggtctcataaaagaaatcactgtccactcatatttgggaatctttgagacagtgatccacagcctgtgtatatatgagtgtgtgaatgtgaagaagaactccttttcatttcccaaaacctttattcttgtgtatatagacagtggaggaatcagagaaagcgtgatgatgaataagtccctgaatcatttcttttctctctgctggttgaactctctcctcccaaaaagtgactgtggccttccagatattgtttctctccatttggctacttgggtctgcccttttagatgtatctagatttttgggtaattcatttagtgttataagccatttatacataaatcttgacatttggaactgctttgtcacctgtgtttctagttacacactggtataatccaggatttatccagaaaattctttcctttacccttccctaaggctaaagctgagtttttgtcttctcttccttgaatggaaggaatacttacattttttccccaggtttgcttttgaggccctttgctattttcttttaggtggtgattgaactctgtatacgaagtcctccagggagttggcctttgccatgcagtccttcttgcatacacagtccctgaagtactcaggtgctgctcaggtctcagagttcttggatgatggtacttatgagctctctatgtcgtattgcctactctatga

SEQ ID NO: 45491 - DNA, 1024 bp, Homo sapiens
gataaaatgagttaggacaaggtcttagataccacattcccttactgggaaagaaaaccaacttgcacaactttggctggctcatatttcttgttatacaggcactaagaagcagcggttgccatgaaatactttatttaacctttacaaaaatgttttcttagtacagcaaggcagtttagttaaatgaaaataaataactgtaaaaattttggatttctcttatatccatctattgacttcttttttctaattaaaaattaaagataattacagttgtccacattgccatgatgactaaaaaatgaagtttatgtaaaaatcacttgatcttttcttaggacatgtgttggcatgtcttctattttacattaaactgaattttactgaatagtgaatgttacatctgagaacagtttaaaagaaagtttttattcaaactttaggtaggtttctctattgtttgtattttgtcaaaattgattttcaaacaaacaaaacctgacaatttgactcccagaatatttattcaaatccgaatgactaacagacagcctctccaatttcttatcttgttgctcccatttctcagctcacctaaattattcatcatcatttccttctaacatactgttaactctcccactgaagaattgggtctaaccaaatgcatgatcaccattgactatcattctgttaagagtttgtctgcatagcatcagaatctcctggttgttgacataacttaagcaatcaaagtcgtatttattttacttatttttaaaaaaagaaaatgtgaattatttcagattttatagacagtccctcctcttctgtatgtacatatatatcaaagttctttgaatctgtgcttttcaaccctttgtggtggtaccaagggtaaacagtcttaaggactgtcacacaattctagacttaaggcagctgttaatatcacagctcatgttttttcagtcacgtatcatttatagggaagcctttagaagaatgaaaacaatagata

SEQ ID NO: 45492 - DNA, 1025 bp, Homo sapiens
aagctgggtgtggtggcgcatgcctacagtcccagtttctctggaggctgagacaaggggatcacttgagcccaggagttttaggctatcatgcactattaccaagcctgtgaatagctgcttaactctaggctggacaacacagcaagacctcatctctaaaaaatcttttttaaaaaatcaactgggctgagcacagtggctcacgcctataatccagcactttgggaggctgaggcgggtggatcacttgaggtcgggagttcaagaccagactggccaacgtggcaaaaccccatctctactaaataccaaaaattagctaagcatggttgcgtgtgcctatagtcccagctactcaggaggctgaggcacaagaattgcttgaacctaggaggcagaggttgcagttagctgagatggtgtcactgaactccagtctggatgacagagcaagactgtctcaaaaaaaaagaatcagttgatcttatgtgtgggtctatttctgactctttcaattctgtttcattattttattttttatatttatttatttattttgtactccttgaggagcaaggctaccccctaggcagcctgcccacagtagcctgtttcattattttaaatgtccatctttactccattaccttcttgtcttgattacaatagttttacagtaactcttgaaatcttactgtaataagaggctggaaaaaaaaaagagactggaggtagtacaagtcttccacctttgttctttttaaaagttgttttggctattctaggtcttttgcttattacaaaataacttgcttgtgtttgaattgggattgtgttgaatttatggatcaattttggaagaactgacatcttaatattgaggtttcggatccatgaacattgtatatttcttcattcatttaagtcttcaattttttttacagcaatgtcttatagttttcagtatgtagttcttgcatatttttgctaaacttattcctaagcattatatgtagctcatg

SEQ ID NO: 45493 - DNA, 1048 bp, Homo sapiens
acgagagaaatttcttttctcacacttctggaggctggaagtttgagatcaaggtgctagcagggttggttttttcaaggcctctctccttggcttgtaggtggccgtcttctcccagtgacttcacagtctgtccatacatgtatgtccaaatatcttcttcttataaggaaaccatttttatgggatctgggccccctctcatgacttcatttcaccttaattagctttttaaagaccctatctccaaatacagtcatgttctgagatactgtggggttaggacttcaacatacgaatgttgggggatacaattcagcccatagacaggttataattgttttatgtataactgaagctgaatttctctacattcttatgtttaccttaggcttgcttgttgccagtaactgtttcttttctaggagcatatcagcgcttcccactgtagttgcctataacaatcgagctcaagcagaaatcaaattacagaactggaatagtgcttttcaggattgtgaaaaggtcttggagttagaacctggaaacgtaaagggtaaaaaatattatagaattcttttacatttacagcaggatccattaataaagaccatttgtagatacttgtaatgtttacattaaaaatatttcagataaactcaaatttctgtatgtgaatcaccaacttcataaagttgcttttaaattgaacttgtaagttaagctcctgattatttgtactgaagtagctaataatcccagaggatttaataaaatacatatatattttaaagaagtatctcaataaacaaaaaaccaacaacaacaaaaataaaataaaagagaagtatcttggccaggcacagtggctcacacctataatcccaaaattttgggaggccgaggtgagacgattgcttgagtctaggagtttgagaccagcctgggcaacacagcaaaactctgtgtctcaaaaaaaaaactcaagcttgcatttgaacattctttttctccaaaaaaaattaagtataacttaatatagattttc

SEQ ID NO: 45494 - DNA, 1049 bp, Homo sapiens
gccaaataggttactcaagaacatttcaggaagaggtaaaacctaagccatgttttgaaatagactcaggtcaatgagaagggagagctcagtgtgactggattactttactgtagaatttccagtaccacattgcaggaggaaggaacttggtaagaaaaattctgccactgcaggtatgcttcacagtgcaggaaagagcagacaggagacttacgaagcaacctgaattaatattctgtttttaatagtgacccaagttcgaaaatagcctaaaatttaatcttactacctgccgttagatctcttttgtatcagtttcccatctgtaaaataggaccaatttatttttatttttaaaaaggaggtcagagtgtcccttttgtatcagctgttttttgttcttttttgttgtgtttgagatgcagtcctgctctgtcacccaggctgaagtgcagtggcacgatctcggctcactggaacctctgcctcccaggttaaaataattctcctgcctcagcctcccaagtgtctgggattacaggtgtgcaccacttcgcccagctaatttttatatttttagtagagatggagtttcatcatgttgcacaggctggtcttgaactcctgacctcaagtgatccatctgcctcagcctcccaaactgctgtgctggaattacaggcatgagccactgcgcccggcaaaataaggccaattattttctgtaattaagcagcggattgggatgactatttcaataaacataactttgatcctaattcatacttgtgctaaaacaagggcaaagattttgttagggtggctacaataaaaaaaaaaaggtggacaataacaagtattggtgaggatgtggagaaattaaaaactgcatacattgctgatgggaatgtaaaatggtgcagctgctttggaaaagtttggcagtccctcaaaaacttaaacagagttgccattttgatccaataattctgcaacccctattactgaaagtagaaaacatatgttcacacaaaaacttgtacaca

SEQ ID NO: 45495 - DNA, 1051 bp, Homo sapiens
caacttttaattccattgtctgatgtgagtggttgttatttgtttcttttagtgcatcgccaaaatataaatcaacattaggttttattccattgttaccatgttcttcagcaatatgattcaactgtgaaacttctgaacaggaagcagtttgggtaaccacagaaatgctacactgatgtggggaattttccagacggtcattttctacctcaggaagaatgttaacagtagcaaagcgggtgtgataatcactggaaccatgactacaagaagttttcatgctttctaggtcagaacaactaaattcagaaaaatgactagagtgagaatctgctacagaaggcatactgtcactgagggatggagcctcaaattcacttgagttcgtgctttgttgttctaacaactgtgcatccatgtcctctctcgtctcatttatcttcatgttaccctttttcctcagtttaccactttttgattttttccctgctgttgcttctttggaccacttggtggcactagatttaccttcaggcaagccactggatgaaccgccagcatgacttcgggtggcactgccatcatccacactactgcttccactgttgtgcctgaatttggatggctttgactcaatatctacttgcacctccatactgttgccttctctgaaatataagagtaacaaatacaaacataattgctgacttctttttgttcagatgactgggggaagggtttctatgtggaaaattcagactatatataagctatgagaacaccttaacgcagaacacgttctacttaaaaaacatacttgatataacagaactctttataatgcttcaatgttttaaaatagtggtggacacatttattgcttatgctgttctagacactatgctacctttttttaaagaacagctttattcagatacaattcccctgtttaaagtgtacaattcagtgatttttagttgtgatcagagctgtgcaaccatcaccactacctaacttcagaacattttcatgatcccaaaaagggatc

SEQ ID NO: 45496 - DNA, 1068 bp, Homo sapiens
tccaagtagcagtaaaatatagttacttaacattgtgatttttaccaaatgaacacagctgcgttcccttatttttttcttaacaaaggtaaaacatactgatcattaaaaaaatacaaaaaggaataaaaagatgaaaatcccttgtaatcccacttccagaattaacctctactaacattttgatacatatattttcaggctctttaccctgtcttctcactcccctctgtatatatgttataaaacatgctatcttgtaacttgctttttcttattttacttaacctatcaggaacatctctttgcacatcaataattgtaaaggtagtgttcttacagcttcttaaaagtaggacctttcattttctctggatagacccagtgacttttacctgttccagtgtcagaattctggtaatcttgcctggcatcatgggtgagaggaggggtgttgtttttcaaaggccaaacatcttccagcttctttgtgggttataatcaagattatgatataaagctgtagaagggtaagcagtcagcaaaagctatggctgatggtctctctatttagcacgtggcatttttttattgaaattttctgaatgttgagacgatcttccagaaggagggcaagggtcatgcatgttcttccttggggttcttagcccccactgccaccaagcctggctgtgcagtggagtgccgtcttctcaggagagtcttcgtttcactcctgaagacaagcatataggccccttttggttttaagtgctatgttgctactgataaaaaaagtaaaataaatccgagcgtgacatgaaccaacccaaaacaacaatcaaaaacagactggaggatgtgatgaaggttctagaatctgaaatggtccttttacaggttaacgaaacctatgaactccttctcaggataatgcttttgagctcataaaatgaagttcataagattacaaatgaagccattatattgataacacatttatccaaatataaaaaacataggctggatgaggtggtgcacgtttgtaatcccagcactttggaagac

SEQ ID NO: 45497 - DNA, 1028 bp, Homo sapiens
actacctcatggtactctgtgctttccataaatatagttttttttcagtccttcataatggccactgagcaggaatgatagtgattttagcatgaccatttttaaaaaatgaggcacaatacatatgaactatgcagcttgaaaacaatttagaatctatactgtgctttacttcctttccgaacatagttctaggatgtgcctcttttgcaatggttactggaggtagggtggtgatctgtttttcctgcattactcagtgtatttgaaattcattctcagtaggaaacccgaattttttttgttaaatagagttgaagtatacttactatagccagatttcctatttgtctcataattttttctcttcctggatatggcaggaaataggacttgtttttcttttccaatgtgtattgtaccttttctgcaggttaaaccacaacgactggattaagcagtatgaaacactagccgaaatggtagttccaaggtctagcaagtaagtagaagtctttgtaaaaccatttgtttcctagaattccttttagagtttggatgttggcttaggaaatatgtttgctgtcttgcctttgtgataaattaacctcatgagtgagttctatgaactctagttgtaataattttagacctagaagggacttggcacagtctgtttgacaacctcctgtttatagacttagaagtttgaggccagtgaggtattaatagtttgcccaggatcacacatctcatttgtggcagggctagaactagaacctaggtctttggtgtggtactttttctgcctcactgtgctgccttttgaaaattctttattcattattgcatacctactatgtgtctataattcctcattttacttggcaaaggaagtgtaccagaatggctactggactgccgtgttgatctccagatgttcaccatcactttgagcttagattttacctaatttgtgtgttccttttatttaaaaaacaaacctgtttttattaagcactttttaa

SEQ ID NO: 45498 - DNA, 1028 bp, Homo sapiens
atttttttaataccctcccaacaattaacacagtagttgtattttcatttgttttttatgtaacaatgtctgactatttttagatatcctaacagacttgtcatacacctagcagcaattttcctagtgctcaaaataacatatactctgtcaatctcaatccccgctcctttcccttggagacctttcttcttcagccatctgcccttctgtcaaatgtgttctgattacttctggactagatttgtagttgtcacatggagaatttctcttgtcattcttcagtgttgaatcagctaattcctgggtcccatattattttccttccttgtttattcatatattccttcaatttgtttcaggaatattacatcttctagttgcttcctaaacagggatacttgaaagtttaaattttgtattccttacagtgccaaaaatgtcagtagtctactctctaaatgtttgggtggatctagaattctaggttgaaatgcatttttctttagaattttatagtcattttttcattttcttctagcttctgatattgtcaaatattcacagtttaatttagttacatgtattctgtttttttcccccctctggaaacatttatgaccttctctttgtcttgatgctctgaaatgttttattgatatgctttgtcagtgttcatttattgttttggagaatcatgcatttattctgtaaatatagagaaatggccatgtagcagacactgctttaggcactggagatagagcagtgaacagaatagacaaaatcctttccctctttgaatttacactctagtggtaaaggcaaaaattaaataaactagtacataatgaaatgccagatagtaataaggatttaagagaaatgcaaaccatggtaatgggaaagataagagcaggataattttagataggatgggcaggaatgcctctttgaggtgaattgagtggagactcaaatgagggcacaagactcactatctgggtgaagaggtgaggggaacagca

SEQ ID NO: 45499 - DNA, 1049 bp, Homo sapiens
tcctgcctcagcttcccaagtagctgggattacaggcacctgtcaccacgcccagctaatttttgtatttttagtagagatggggtttcgccatgttggccagtctggtcttgaacacctgacctcaagttatccacctgcctcagcctcccaaagtgctggaattataggcatgagccaccgtacctggccaaaacctccaatactttttaaaccattatagatcccccaaaataatactggtatgtacaaactcaacttagtgataaagagatggaaatatctccatctatcactcaggactgtccataaacaagggaggcaaagagcccaacctgaacaaaatggtgatgttcattaagctggtcctcagcctgcctcttgctggtatacttgcctgtctttaaaaacttgaactctatcctgtcaatccagggaaggatctcatttcattcattttaattatcatcactttagttatatggttgctttacttttcttatggacattagaaaataaaagtgaatagacaagatatatttcatatgatataaagacatatttcatatgctataaagagacaagccagtacttatctggagcctaccaattaagataaattcttttaaatatttagtcttaaaaacagaaattattttaaaattatgaattggctaattttttccaagtaagtgcattttcatgttcacctgctttgtatttaatataaattattgtgttgaggccccattaacagccacaagtttttagtcaacttcaaaaatttctactcaactcttatctgtaatccatttagatttgtatctcttcccatcaatcatgaatacataaggtaatattttatagttggaaagcattgcttaatatattgaatcaataaaaatgttgatttcatatatttaatttttataatctttacagattacaatactgtgatgagactgttcctgtaacttttgatccacacacagaatttcttggtcctcagaagaaaacagaacaagtccaaagagacattggattttggt

SEQ ID NO: 45500 - DNA, 1054 bp, Homo sapiens
tggatacttattttttctttgctgtttcactatgtttaactcacctctttacccacccccaaaatttgagtgagtgatttaggtgcttttctatgttattgatgcctagggaaggtccaactcagtgatccacgtggccctactccttcagcactgctgctttctactgggtggcatctatctacatggcgagtgtgttgcctaaaaggaaattcagtgcttgcagagctagtgttactaatataaccttgtaaagtgcagaattacattggcaattttggttgcatatcataaaagattaggttagggggaaaagggtgctttctagcttttttatactgaagcaaaacaacacactattcattaagataccaaaatgtgtattttcagcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaagtatgttttgaggcatttgactctattacccttttctgacttctgctctcatctcaccaaaaacaaagttaactgccattcaagggagtagtttatgtgctattatttaatagtatgttagtgatgtgtttgaagacttctacagaaggccttttcttttttcttttttttttttttgagacggagtctcgctctggagtgcagtggcacaatcttggttcactgcaagctccgcctcccgggttcatgccattctcctgtctcagcctcctgagtagctaggactacaggcacgcgccaccatgcgcggctaattttttgtatttttagtagagacagggtttcaccatgttagccaagatggtctcaatctcctgacctcgtgatcgcctgcctcggcctcccaaagtgctgggattacaggtgtgagccaccatgccccgcccagaaggccatttctttttctttttcccaaaaaagggaagcagtgactatctgag

SEQ ID NO: 45501 - DNA, 1023 bp, Homo sapiens
tactcatcctctttgtcttccactgcaaattttgagcagcttataattaattaaggggaaataattccaggtaggaaagctgtttcatcatgtagcaatatgtcaacctttacaggcactgaaaagaagcctaacagaaaggagcatccttctcttaaagccttcccttgagtaatcaattccagttacttgggccagttttcaagtgatttacaaagttggtaaaatagaagtttaccttactttttttacctttccctttcaccacttcactctgatcttctctttttctgcttttcctgctcatgttttggctcatctaaaatctgagtgtaccttagcccagtttatataccacctaaaaaatgaatggactgtagtaagatgtttgcctggcatcttgtcagggcatttggtagtactgccttgaagttgttccacctgctgagtcactggcactacttcctgctacaagctgtggtttccatagtgatgtttcagtgactttcacacaatagaacctgactggttaaagacctgagctgttttctataatcaagtcttttactcatctagaaatgggagcatggttttgatcattttgaaatgcaactttatgagtaaaaatcttacagaataaaatgcacaggtatgttttaaggactgaggttgttagggtagaatcctgaggaagaaaataaggatggtggcaacaggaaagggttacttacagagataaagaaacataagtaaatataaaggatttacagtagcccttcaggtaagaaaagttatatcaaatgccttgttattaagtcttgccacttggtcactgttttgactcttctctttgatggacccagagaaagcaggttgctatgcaatctgttcttttatattccccattcatcatcatatttttagagaaaaggagggggaaagacttaagggttatcatgggcaagaagagttaatcaggaaatcaagacatcttgttcttagggaacattcgtggtcagcttg

SEQ ID NO: 45502 - DNA, 1046 bp, Homo sapiens
ttcacagcccctctccaacttgtttttccagcttcatcttccactccaccctttcatgtatctttacttttagttataataaaatttttactgtttctggagcattgaaggggtaaaggggaccctttcataagggagatatgtatagaataaacaattcagtgaatttatatgtcatatatactatatatcctgaaatatttgaaattggaaccaaatcagtgttgctttcattttaaaatcacctttggaagtaattcagacaacattaaagacataaaactctcattactcattttcttcaacttcaataggaaatcttatggaattgttttggaacacaggcttccaatctgccaccagattttgcagcaggaatttatataatcatgccatagctcaaactgtctcacaatttaccatatgtttcaatatttccaatgttttcaaacactcttctctctttcccaccccttccagttcacatttctcagctttgtcccagctcttaccccacaattctcatttatttctctgattcatggttaatctttgttatagccttccagtttgaagttcattctatactggttctccttcctggactttttttaagtcacttaaaataagcagtgcttaatcctgaatttagaattcttgatttctggcttgggttctgatctctcagatctctcagtacatgttttcgtggctttactacttttttttttttttttttttaacctctgtttaaatttaccagagccagaaacattacggtttagactcaggctggctcctgtaacaatataatattttcaggaaaaattttcctcttagaaaccctgtattcatctggttagagcttaggggaatttctgtagtctaaatctaatcaattaaaatggctttttataagtagctggatttttatgactgcaaatattgctttcctgcttattttccttctaatcctgtgtttacttagctagttcaaggagtcaaggcagtacagtgtatataaggaagggctttggcattagtca

SEQ ID NO: 45503 - DNA, 1039 bp, Homo sapiens
tgcaaaaatcacaagcattcctatacaccaataacagacaaacagagagccaaatcatgagtgaactcccattcataattactacaaagagaataaaatacctaggaatccaacttacaagggatgtgaaggacctcttcaaggagaactacaaaccactgctcaacgaaataaaagaggacataaacaaatgaaagaacattccatgctcatggataggaagaatcaatatcgtgaaaatggccatactgcccaaggtaatttatagattcaatgccatccccttcaagctaccaatgactttctttacagaattgaaaaaaactatgttaaacttcatatggaaccaaaaaagagcccacattgccatgaccatcctaagccaaaagaacaaagctggcagcatcacactacctgacttcaaactatactacaaggctatagtaatcaaaacagcatgatactggcactaacacagagatatagaccaatggaacagaacagagccctcagaaagaataccacacatctaaaaccatctgatctttgacaaacggaacaaaaacaagaaatggggaaagaattccctatttaatcaatggtgctgggaaaactggctagccacgtatagaaagctgaaactggatcccttccttacaacttatacaaaaattaatttatgatggattaaagacttaaatgttagacctaaaaccatagaaatcctagaagaaaacctaggcaataccattcaggacataggcatgggcaaggacttcatgactaaaacaccaatggcaatggcaacaaaagccagaatagactaatgggatctaattaaactaaagagcttctgcacagcaaaagaaaccaccatcagagtgaagaggcaacctacagaatgggagaaaatttttataatctacccttctgacaaagggctaatatccagaatctacaaagtacttaaacaaatttacaagaaaaaaatcaaacaaccccatcaaaaagtgggcaaaggatatgaacagacactcct

SEQ ID NO: 45504 - DNA, 1054 bp, Homo sapiens
gataatttctatagtatgtgagctgaccttcctaatattctgtcagttcatgtctcaaatagaaaatatatacatataatatcattctcaaaggaggtgattataaaaaaacatgtaatgtaaattcgttgtttacattttcatgctcaaggctgttgatttttttaaatgtatgcaatttattttttctccatgcttgaattgtcctgctgcttattattctagagcataacagtgaaaatgccattaatgtttttggtgaagaaaatcagcatgagttcgggtttatgccaagtaggctgtttgttagcattttcactgacagcactcccttattaggactccatttttaatatgtgttcttccagaatttagcagttttttccttctgtggattacttttgtagttcttaatagttttaattagtttgtagtctttggctagttttataatagggcgttataagaaaatatagctttcaattattttcaaagtgagaaaaggctcagaattctctttctgtggaaacatattacacagttgatactattgataatcatattttatttcattcacttcatgatctgtggttgatttacggttgcagtgtttttccaagttacttttaaaaatatcttttgactccattttaagtaaatattacaaatatccattttatatgcccatttaaaaggaatacataatttaaggagaggtatgtgtcctttctatctccctagaaactccatagccttttaaaaactttctataaatgacaggtttttttgagcttttatcttttacatttcattgtcataactttgttattctgaaagtattgtatgaaaggaatgttctaaagatagtagtgcaattaatagtggaaagtgacattaaaaatgcaaaatgaattgtggggtacaaattcagattcttcatttgtatgaagcctgaattgttatagagatcatcaggtctctcatgcttacaataaatgaattaatagtaattacaaattacagtgagacacatagtagtttgccatccctatct

SEQ ID NO: 45505 - DNA, 1029 bp, Homo sapiens
cttttctctcggcttttctaaaaagagttaatggtttaataattagattttatattatctctaggttttcagtgaagcataatggattaattgatggctactagaatttattaaaaaataaaaaaaattctacttcctcatattaagccaaatgtttatttcccagatcttacctaaatgttctttcctgaggccagtgctgttttgaaactattttaatggccttcactggggtgtggtaaaaacattctaattactttgctaaaaacaaaggtttcatataaattgaatttttcttttaggataattgccattcacttttgttttatatgcaactgagtgggattttgcagtttcctctgtggacaattaaagtgatgaaataggagaaagctaataattgctttgtgtggtaatactgacaacttctgcgtatttgtcaatctgtgttaacagtatcgatcaggatgggatcctcatagaggggcagataatgtttctactaaatcttcggacagtgatgtaagtgatatatctgcggtttcaaggactagtagtgcttctcgtttcagcagcacaagctacatgtctgtccaatcagaacgcccaggaggaaacaagaaaatcaggtaaggggatttcaacaacaaacttctctaaatatgttttagaaggtctttatgtttcccggatgaacataaaattatttatttctaacaggttaatatatattttaaagccaggggagcttaacttcagtacatactactttttaatatattttaatccacatttcagacttcctgcacagaagaaaatgttatgaaactatggataattttgcttactacatcactggaaataatatcttttttcatgtttgtaatttaaaaattaagacctcttatatctttattgaaataaaagtgatggctgagacttgaatttttcatgttccaaggaatatgaaaaataatatattttgttattagaaaacataagaatgttactttttcagtaggatgcttt

SEQ ID NO: 45506 - DNA, 1058 bp, Homo sapiens
ttttgtttagggtttagtttgtcaagcatattttcttttattctaatactccttctgagccacctttccctaaaatattcatcttttttctatttttttcatctgtgcgtatatttttaaatttccagagtgttgaagatgaataaaacacagaccttatgctcaagaaaaggtgattttttttttcctttctgttactgtccaaaatttattctttggacataaatataatcattggcctcaaactgtgaactggctacatattgaagattctcaattaataattaaatatattattctcaaaaatttaggaaaattactaggttaaatgttgatacgccatcatattattttcctgtgtggtaaacttgagtgtactcatgacttcacagtcactatatgggaccctgcaagtgacaaatttgaggctaggtaacatacatggtctgaagagaaggtctatctgaaggtagaggactgagaaggcaaacctactagagtaagaacctgaagatggaggaggagatgggatcagaaacatagctggataaactggcttgaaaaaggaaaaacaaatatgaaaatagataagttattagataaggagttgggaagttggctaatactgcctgatggccttaattttctcaatcacataagaagtaagaatataagagtttaaaagttgagttgggggtttgaagatttggaataactactgaagaaaatatgagaagtagcttacaatggacaaattaaagggttgttgaatagttctgcaggttggagacaaacagtttcaagagacaccagcatgagagagcagtgtgatctttctcactagcactgagataggtaaagtgtagaaacagttaagtcacactatagcatttattgaggagtgggagttttgatggatggggttgttggaaaaatagcagtagaaagaaactgagagtgcttgtataaatgtcagtgctaaataagaaggaagacaagttcatgtgggaactgatgaagtaggataaaacagatgaaatccaagaattggaaaatta

SEQ ID NO: 45507 - DNA, 1079 bp, Homo sapiens
attttcctggtctctatgtgaagatctatatgtaattaagttaaagagtcatcatgtgatgaatgatgtatcataatgatttcaatattttgagatggtatttactattgtaaaaataaatgttattgtaccaccatggatttcaagatcagacaagacaacttacctcccttctgaagagtagaaactcagcaaaacggggtcttcctaaagaatagtgaaatgattctggatgatatcacagtaattatatgtaaataataattggcaaaggagaaaccttttataaaggtatgttgaccaacacacatagaggctaagttataactctcttctgtcacactatttgtatgttccattgcctgttaattggaaactcatcttttaaatcactgtttctaaagaattgagtatgacttgataggcatcataacctagtagagagcatatagagggaataaggagacttgaattctattgcttactctgggttatatattaaatatggactctttaaaaacttatccagcagatctgagtcatagtatgtctatctgactgatggaattgacacgtgctatcctaacagcatttctataaagataatatttttaaatgtaagaaaagtacattaaaatcacatggtagatataagacatcagtagccaattcagcctcataggggaatcaagagttctgttttagacatgattttgattttgagatgtccattagacatctaagtacagttattacatgattaagtgcatagatgaattcagagcccagtagatcaaagctaaggatgtaatttaggagtaatccgcgggtagcatttgaagccatagaactggataagattatatatggtaacttgaatcaagaagaaaactaaagactgagccctaagacattctaccatttagaggtcaggaagaagaagaaaattcatcagaggcttaagagaaggcaaccattaaaggaaaaacaaaaaaaggatatcttagaaaccaaatgaagaaaatattttaagaagcaggacatgatcaactgtgtcagggactctgacaggtcaagta

SEQ ID NO: 45508 - DNA, 1051 bp, Homo sapiens
attacatttgctattccatgctggtaagaaactctggcaatcatatacatttttgactaattttaagaagataaatctgaaatacatttcttgattgtagaattcctacttttaatgtccctgaaaatcagaatatagcttactttaaaagcaataaatccatttaatgtagttttctttttttgtaaaaagtattgatgtgtcttgttaatgatggagacttctaattaataaatttattttgtatagttttatttatattaacaagtacatattttgatctttctttgaatctacctggcactgttctatgtacagaagtcagtggtgcactaggaaggtaagatctctgctttcacagaacgtacattctagaggttggcaacaggcaataaacacaataactcagtgaatgtgcaatgcaatttcagattggcataagtatacgaagaaaataaaatagggtaacgtgacaaagagtaactgttgggactgcctgacaatgatctgttagacacaaatttcctagacttaatgctgttgatgggagacataaattaatatctttctttgaaaaatggagaggaaccactgtcaagggtgaggggacaaatgtcccctagagactctcatctaccccatcccctaatggcccagctgaaccatattaccttttgaatggtgtaaagccaggaaaaaagcagatgtgtcagaaatggagttaagttgggataatgtagttactaaggtaggtatagaacataccctcgtggggcttccactctctaaaagatgcacaaatccgtccaaaataattatattggctctcaggaaactcagtccaatgcactttgatttttcagacatgtcatttatttatatgatatttgcattttcaacaaatggagaacaacgcaattgcactgacaatgacatgattctgtccatattatgggagtgaatttctatcacaaaatattgcattatgatattatacaatatatgtaatattaacaatgtaatactttattataatacaataacattaaaa

SEQ ID NO: 45509 - DNA, 2026 bp, Homo sapiens
tctaaatcataaagttcattgcatacgttgtgtagctccagagatgaagatatgggagatgtagatgtatttgatgtgtactgaccccaatttcttacaaaagcaatataaacaaaaaatacatctaactaccatgatatatcacttgtttttctatatttttatgtaatatacatgtaatcatagtatagatataatttcattgtgattataactggaaatatttttcatctttctacatggccttcttgactttcattttgtattcctgctctgtagtctctcagttgatttgttataatttatttaaacattatactataaggcacttgaatagcttccaatttttgtaactaacactgaaatgactcaattagtgcaatagtttttttacgtttttaaggttttcttgaagggtaaatttcaaacagtaagattagtggattaaatgatatatactttttaaggggtgatggtgcaggaggaaaggataaagaaaaatattttaaatttggcattagacttctagagttcctacctcattagaaattctagaatatcaaggtacattttgagcaggaagtgatatcatgaaacaataatttgcccagaggctaaaggcagccaccttcggagagtctgttaaagtgattcaggtgtgcagaaatgatttccttggccgtaggtgggttttgaaaaggaaaggaacatggcaatctactccacattgagcacctgtcctgggtgctctaaggttaaataagagacagaaaattctactctaaaggttatgaaatacttgattagtgaaaatattcatagaataaataatcagataaataaaaagagagtagtgtagattgaatcagataggaagactgcatagactgaatcttaggctgaaagatgaagaaaatgagaggttattggtaggaagaatgcaaagatgtctttcttaggatagggagagagcaaagcagaaaacttggtaggcaattgtaattttggtgggggacactgaggaaatgaataaggtgtcatcttaatggatattttagcatattagtatactctttacttattcattggttcttctatttattggtgacttttggaggacacaaaagtgtcataccttccctgatgtaaagattgtcatattccatcttatttcacagttgaactatatagtcctccttcagtatctgtggagaattggtttcagaacccctagcagatactagattccagatagaaaatgacatagtaatgggctgggcgtggtggctcacgcctgtaatcctagcaacttgggaggctgaggtgggtggatcacttgagatcaggagttcgagaccagcctggccaacatggtgaaaccccatctctactaaaaatacgaaaattagtcaggtgtggtggcacatgcttgtaatcccagctactgggggggctgaggcaggagaatcgcttgaacctgggagacagaggttgcagtgagccgagatcacacgattgcactccacagagtgagactctgtctcaaaaaaaaaaaaaagaaaaaaaagaaaatgacatagtatttgcatataatttatgcaatcctcctgtatactttaaatcatttctgtattacttatggtacctaatacaatgtaaatactatgtaaatagttgctatactatattttaaaattagtgttctcttttatagttgcattatttcgtgtgtgtgtgtgtgtgtgtgtgtgtgtttgtgtgtgtgtgtgtatgtaaatatttccaatccatgattgattgaattctgggatgtggaaacctcagataaggagggctgactgtacatcaaatttaactagaatttttaggtgcaaattcaactttgtacttacgtaaaagatcctgactcagaatcctttcattggaatcagaattgccatgagatacattaactggttctcctgatttgcttgagcagatgagaataagactcagaattttgctttctggttatcctccttttaat

SEQ ID NO: 45510 - DNA, 1062 bp, Homo sapiens
agatcattggcctttcaatttgcaagtctgatctttcctcagcttatattagaaatctcatttgaattttggaatggtgatataaaagacgaggttttagatttgaggacttaattgctgagaacatgtttgctggaaccagataaaacttcttccagtggatggtaagcctgtcttggggtagcaaacttaaggaatgaagtaaattccattatcagatattcaatttcaatatttaaaataggtgattaaatatgatgcataatctctggagtagtttgtaaaagtgaccaacgtaagtcatgaaatttgcggttaaaaagaattctctgatacatttttagatattcatccaataaaatcaacaagcagcagttagttagcatcagtggtttttgtttgcttgttcatttagcaaaatataatgtggaaagccccaaaggaaaccatattgcttagcgggggagaaaaatgatttcccttttagtccagtcagaatggcctcccatcaagacagactgacgtgctcagccaggaccaccttacttagtggcctggacttgggcttcgatatgcaaaacagacagagattcctcagtttgttcggaaatttgcaaacgtaggcacttttctagggaacaactttatttaattcctcccttcatttagttttccgtgcaattcagaatcctcagttttcaaaaatgattgatgatttccaatgccccagagaaaatttcagcctctgttaaaacttagagtataaaagtgtaaaacttcccacatctttataaatgtattgtttaaataattcactgctgatggattaagggttaaaatccaagcactatttttgatatcaaaatgatactatcatatctcaaaatgagtgttcatgctaattccgaatgcagaatgacatattgacttgtgaacacattgaattgaggtcagttgcttcttcattgtgtgtggaagttacggtattttacgtaattcaatcgataggcattgtctatgatagtgaattacctctcttggacttttcatctgtactagggt

SEQ ID NO: 45511 - DNA, 1032 bp, Homo sapiens
aactcctggatttgtcaatattctttgtagggtagctccagtttatgggagtaaagacaacatttttttttttgggttcagaacctctaacttccataggtaaaatgagggatctgtccaagactactctgcagggactgtctgcccaaaccaaagctgtcaagtcctaacttgcttttgattaagtactctgataattaagtattcatgctatctttgtttgtatttgggggcaaggattttggagataataatttgtgactattatttgatatttgtccaatggacctaaattttttttcccagtccatggcagcctggataggaaaaaaacaaaacaaaaacaaaaacaaaacacttttttagctctgaagcccaaatctgaattttaggatgtaccacacttgagaaaggaaaattattttctagaaaggaatctaacagggtccttcattgatggaaagagccctaagactaccaactacttctataaggtaggagagaaaaggaaagagaatcagggacagaaaacagttgcctggagcctctatctgcaggaaagctgttccttaggaagggaaaagataggcaaagggagaaaaggagagggaagtgggaccacagcaggtgaagactctggtctcttactagtgcagtagcaaagaaggaagagagaatcgcacctttctctatgacctttgtatgctcagtgttccaactgctggtaactctggcagaattggtgtcctggaatataaccaagcagattagaactcccttcaccagttgagtagtgaagataggagtctgtaaagaggcagatgaggccttggtatgcagattagatgttgtgggcttaactattttcttatatcatttatcagtgtctttaatgtagacaaaagtacaaactgaaagaaaattggcttataatcatagctgagataaactttttgaggtcaacgaacatgttcctctgtggagtctacttcttgtccaagggtttgctgtggtttatctgttctttcttct

SEQ ID NO: 45512 - DNA, 1032 bp, Homo sapiens
tggaatgggttcctgcagattagaaagctggtcactgcattagctctggtgaaagataaaggtggctcaaaatagggacacaagaagtagagatggtgagaggcagtcaggttgggttatgtttcggaggtagagcttttaaggacatgatggattcgatgtgtgcctgaaagaaaatgaaggatcaattacgactcctcactttggggcttgagaaaagtgtgcatttaatcgtttagttgctattgttccaactagatacaacttccatgaggacagggactttttctcctttattcactattcatacccactagcacaaggcatgctaagctagagaggaggtgccccaaaatatttttgagtagttattataaaacattaacacatgatttaaattatttgccgaatacatttccccttaggttgtatttttttattttttgatagcttaatattcagaagctctaactatatttagatttgtgatacttgttttttttgttttgagacgaagtcttgctctgtgtccaggctggagtgcagtggcgcgatctcggctcaccgcaacctgtgcctcctgggttcaagtaattctcttgcctcagcctcccgaatagttgggattacaggcatgcaccactgcacctggctaatttttttgtgtttttagtagagatggtgtttcaccatgttggccaggctggtcttgaaatcctgacctcaggtaatccgctcgtctcggcctcccaaagtgctaggattacaggtgtgagccactgcccctggcctttgtgatgcatttttattttgctttcttatataaatttatgtccatctatttattgcttcgtgattctttcattgtgtctaaaatatcactccctgctcaaaagtttgattaataaccaattttgcttcttatagttattattttgtgtttaattctttaaaaaatctgaaatttatttttttatttttatttattttattttttttattatactttaagttttagggtacatgtgcaca

SEQ ID NO: 45513 - DNA, 1030 bp, Homo sapiens
gatctggagtagggtccatttctaatttgcctttctaacaagttaccaggtgatgctattatcaggtgatgctaatgctgctggtccaggtaccaaacttggagaaccctgtgggctgataaactgcttgtaatcagccaatgaagccaggcatcattttggaagcagttattttattaaaatttctttttggaatgttttatcaataattaattgcataggaaaagaatcgctttaatagggcagaatcagaatgggtattctaaaatggaggattataaaagagaaattgacctacttgatgaaatgtgggctagatacaaattgtattaatttagaagaaaaaagtttacatatgcaatgactaaaacccgatgctaaattttttgttgattttcttctctaattaaatgtttccccctcacatctttgtagtgaattgattatcttttcttcatttcattcatgtaactgtattgttacacatgaaacaaagaaacgtatgctgaatgtttttaaggaccactcttaattcatctttgccctatgaaacgatttaagaaacttggtcgccaaagcccttttttagtgttgtttggctactgcttctgttgttgttttaatttaacctgtaccttgtctgattcactctagcaaaagaaggaaatataaatccattctggagttaaaagactccgtgccccatttaaaacatccttttatacctatatttaaaaataacttagaaatcacttcctttttacttgtactagcttaactttgttatataaacatatagggtattatacactaatttttgatgtaaacgtatttgatagttttgcagaatgcagtttgttagataagaatagtagcaatattttgatggtgctttgaaatttctaaagaaaagtgtatatgtggtatctcatagaagtctataaagttatagattttgattaattcatttatgccacataatatatataaggagttctgtgtttaggttcagatcctttcctttcttact

SEQ ID NO: 45514 - DNA, 1045 bp, Homo sapiens
ctggaaatctatcatacagatatatcaaacactttgcttactatatatttaacaacgcgatttgatgtaatttctattgttgctatatgattagctcaagacactgtattttaggtcttacgtaaactgtaatttttttcaatgcaaattatggcccaggcaagttagccaatactgagaacctatgttacctgtttctggtcagcatggatatgtatatgtggccgtatgtgatcatgcatgtatagaggcagaaagaggactacataaagaattttctcatttcttaaagatacagtgacctaagaaggagtgacctaagaagggaaagaaaacgtgcacaagttagacaaggaaatatatatatatatatatatggaaatagtgtcaaacttgggctgattaaggaaacaatgcattcactcccaagcttccttatggtaatgtgcatcattctaatgtggaaaccactcaccagcacgcatctgcctcatttaatctgtgcattctgtactcctatattctgtattggtggctgactcctaaagggaataccaaaatacaataacttttaacgagaaacaacaattctacaaaaatgcaaagtgataccaaaaaaaaaaaaaaatggacagggaaagtagcttatatgctaaggaaaacccaactcagatgtgttttatttacaatattggcagttgtgctgggtgacttttaaggtgcccctaaaaatatcaaattattaataaaaggaatgcatattgaaaaattatgtagtatgcatcttattttcacactgttaattgtcaaatgtattagatgtattcattcacctttttagtttatttcacaattgtttaattatttttctagccaatgatagacctaggacagttcaaaacagtgtgggacaattctgaaacttggataattcaaataaatactgggtgtcgcttcagaattctgaggctcgtttgacaggggtttctgaacacctgagcactggggcagtacggtttatctgagaaagatagttctgaccttt

SEQ ID NO: 45515 - DNA, 1033 bp, Homo sapiens
gtcaccctaagagagatgattttctctaaaaatagaacagagtcaaaggatgggaaaattatctaaagaatttgaggcatagagctgacgtcatttaagatggatcaggatttatctttttttaaaagagtttgattgacgacgactccacaacctttcttgatggctgaattaaataatgaatcaactcccgtctgacgtgtttcattttatcaaatgcagattccacagtggaaagtactttttcccttatgttattcaactaaaagatatgttttgttatcactattgctcacacctttgttagctgttatgattaagtggaacctaaacaatctttaagaaaattatcttacatgtaaacatttctatggtgaaattctttcatgtttaaatgtttgtgattcctgtttaagtatacttcaaattcctatgaatctttcatggtttgagtgaaaagctagacacactaagctggtagggttcaagccaatataaaagtcattgtctcattatttcagtacctctcaagtctgttttttaatgtaattgttctttcttccttataaaattttacttggacacttctttgcttggaatctaattcacagaacatttgctcttcactattctggtttttcatctgtctttgcctatattttatttatcttatctgtcttctttttagtaaacatcttttcttttctttgattgtcctcacaaattttgtgttttatcactctcacaagttcttcagtttaccaatattcttatatgtctaattattcaataaatatttatcttgcatttattgtaataattgttaaaagcacttgggagaagttcaaggtgtaacatcatgctgtctgtattctcatttttttgatgtcatttccctcctgtgggcttctttaattattcatgtaccatatttgagtcactgatgcaataattaagcatctcatagaatggagagtagagtatggtttaaactacagaacgaagtgtacagattttagattctggcatgtta

SEQ ID NO: 45516 - DNA, 1063 bp, Homo sapiens
gtttttataagctatatatgtgtgtgtatatatagtttataaaaatacattatatagttttctatagtgtgtgtgtatgtgtgtgtgtatatatataacttttgtgttacatgctctttgaaggaaagaaaggatgatcacttttaatgattggttattagcagtattacagtaatagcaatgctggattaaaaacttgcaattgaagaagagaagctctgattaactcaggacaacatgtttattcatttatctctaaacaaacaaactagcaaataaataaatagctaactgcaaaatctcatgattttagggttcttcatgtgtgggtgaagtgaaaagtgtcttattcatccaggtggccttgggttgcttcttaatgagagaatgtgatggaaattttctatcttctaaggctgttacatttttttttcccaaaaaggaagataatcttatctcttctacagatgactgcatattttattgccatccttttcaaattgagaaatctgcatttacctcttagcgtctacacttaaatgcttgaagaatctagcccaaccaacatattgtaagtgaactcttgaatgagctgatagccatgaattttgtgaggaatgcacatgccagaattaggaaagtacaaaatccccgcctccccgctaggctgtcttctctgttccctttgtttcttctgagggcttcgcagttttgcagaacagccttcttatctctctttccttttctccttgggacttgccttccacagacctcttcagacattcttgcagaattgttcccataagatctctattttcaattggctgtataccttccagttttatggcccatccagaacagctcagttcactttctgaagaagaaatgagaaagtgcaaaatgttaccaaatctttcctcctgtgttttcaaaaaaccacatttgatgctttctattttatatgcttttacagaaattctctttaaaaatcaaatatatgcttatcattattttaataaaaacctctgctgagtaaatgaattttataggattgggggaaaaa

SEQ ID NO: 45517 - DNA, 1033 bp, Homo sapiens
tgtttctttttaagactgtaacatacttgagggcagataactttttttaaaaagtcatgttactcctttctggcttctgattctgcaccttgtacacagaaggtagtggctcaaaatgtgcaaattcttccaaaacatttacataatgtggtaatgtctataattagttttaagataaatacactttagttaaagtctgtctaaccagtgaaatatttaatactaccatttttgaagaacaatgattaggagtcagccattataaacaaggaggaaattgttggaaaaacttgttgcatttctatttttgcagctcattggcttgttactggaagtgaaagaatgtttattatttcaggaagtaaaggccattagaagcttatttgtctgagagaatctacaatattggttttctataacctgggatatgttatgaaacatgtttacaaaaattgtgacttcaggcttggtgagcattttttttttataatagctagtcctttgccagatctgtaatgtaaaattcgaccaatttttctatgtatcagatatcatgcttattttaaagtatttttctgtttcaatgctgtttttattacactgcatagatcaaggaattgaaatgctagtgagtcacttgaactccccgttgagcatcaaatagtggtaggtaaccactagctgtaagctcagttattgctgtgataatcttttgagagtgggtgattatggtagtacattgttttcttgccattgcttttctcataggtagctgctcttagcttcatttgactaatggaaattttaaattctgcttcatggttcacaggggagtagagagcaaccatatatcttatgcccaggtttctgaactgcatggtgcttgaaagaaaagagcagcatttacccagggagcattggtaccttatctaatttgccacttctttcttcctttcagaatcatttcatcttcctatgcctgcattcatgcacgtatctgccacttacacggaggttatattgcataactgag

SEQ ID NO: 45518 - DNA, 1062 bp, Homo sapiens
atggcactgtgggattacattttttttttttttttgagacggacttttgctctgcctcccagtctggagtactgtggcaggatctcggctcactgcaagctccacctcccaggttcacaccattctcctgcctcagcctcccaagtagctgggactatgggcacccgccaccatgctcagctaattttttgtatttttagtagagacggggtttcactgtgttagccaagatggtctcgaactcctgaccacgtgatccacccaccttggcctcccaaagtgctgggattacaggcgtgagccaccatgcctggctgggattacattttttaaaaatccagttcacagaagtggttgcaaaggtcagagtaaaagtggtttagtgcggactaggagaacatgttacatcatagtgggagagcctgtcacatcatactttcagtgtaagaatatttctaaaaaaaaaattggggctatattgcttcccttaattttctctatttgttttgctccactgtattaatctgcttgagcttctataacaaaattccttggactgtgtggcttaaacaactgaaatttattttctcgcagttctggaggctggatgcccaagatcaggtgccagcatggtctggttggtggtgggggctcccttcctggcttgcagatggccaccttctagctgtgtgcacacgtggccttttctgtttgtgcacacggaaagacgggagctctgctttctcttcctcctcttataaggactctaatcctattggattaggctcctaaatttatgagctaataatctaaccataattacttctgtaaaggccctatattcaaatactgtcatagtgggaattagggcttccacataggaatttcggagggacacaagtccctcccaaatgttcagttgagcaaccaccaatgggtctgttaagtgaatggtattaatatagtaagaatgtatcttaagtaggtaagttagcatgtagttgatatccaggtaagaaccagacagcaacccctttattagattgacctctactgaggcca

SEQ ID NO: 45519 - DNA, 1033 bp, Homo sapiens
gcccatagaagggcctggcttcatgaagtggcctcagttccagcgagtcatgtgggcctaagccttaatcattgaccacatgtagcctcaaatgcccagggtaaccaacgacagagtccaacagccagcctgcagggagcagcagcatcagtccaggggttactgagaggttactggttactgcttgtttttttttgtttgtttgtttgtttgtttttgattgagtgagaataacaaagtccgatgtgttttttagaaaggctgtcattgtaattaaccaggctagtacatctgcagtcctgggttctctggaggctgagggaggagatctcttgagtctaggagttcaaggctgcaatgagctatgattgtgcctctgctctccaacctgggtgacagagcgagactctatctctataaaagaaagaaagaaatattgtcattgtagcctctgtgtaacggcctgtaagcctggatgttaggagactaaagcaatgattttggcaaaagatgatgaggacttgaaagaaggcaggagaagcagagactgagaagagggaagagcaactatagactctaaaagaagctgtaggactttgttaaagatttcaagagcaaagacagataagagtagcaagtaagaaaaggtggactactgggggaaagggactctgtagaactttgatagttaaggaaggatagggtaagagaatccagacaaggagactgaaaagggactgtcaaaatgacaggaggaaaactagaagaagcgatttaagcttcttttttgtaaaaatttaaggcattaccggtgaattatgacttatgctgaccatctatttagctaagcatggcccgatttagatactagagcaggttcaataacacggagatctatcacctgagctttggatgactcacatgaaaagctggccaggagatgagaaaatggaggcctctttttaaaagcttttcagaaatggatctttctggttgtcattattccttctgcttgactcataatcctacttct

SEQ ID NO: 45520 - DNA, 1067 bp, Homo sapiens
ggtagcgaaatacctgcactcatgaatcatttgcagataatagtggtttagacattctctgttcaaattgataatgggtatctgatccaaagcgatgcacatttttaaggtctatataaggagctcatgggggaaaagtccctttctttcagatctcatgtacatcatcacgtcagtagttagtatcctagatgtagaaatgtagaataaggcaaactggagagctcttctattgtttgagtctccagattactttataaaaagcacatctactccagacagaatccctctttactttgtgctattagcactcttgtgaaagatggaagtgtacatttgcatttttctttgtgcctgcattcttcaagtatttgaatcagtatttatgaaattgtctttttgaaaagttatatttttaattataaaggaggagatctatgctttaaaaaggtattgaatttgtttagaatatttaaacattttatatggtgctaacattctatttcattaatgtatggattggtttatttgaaggattttctaagggtggaatacatgattcacttcagggagtaatcttgctgtaatcactcactctcattctgcagagtgcataagctgcaccttgggagctggttgaaaacgtggatttttggattatactcacaaagatttgaaattagtaggtccggagtgtcttttttttttttttcccaagattaagtgtcactttatggcccaggatggagtgcagtggcatgatctcagctcactacaacctttgcctcccaggttcaagtgattctcctgcctcagcctcctgagtagctgggattacaggtccccaccatcacacgcgtctaaattttgtatttttagtagagatggggtttcaccatgttggttaggctggtcttgagctcctgacctgaagctatccacctgccttggcctcccaaagtgctgggattacaggcgtgagccaccgttcctggtcgtgtctttttttttttttttttttttttttttttaaataagggagccagataggccttaaaatacatcat

SEQ ID NO: 45521 - DNA, 1034 bp, Homo sapiens
taaagatgcttttgcttccattttggtggcttaccatgggcattattttatttcttaattgctcctcctaagtttgttgtgaaagtgagaccacatagataaagaactcaatataatgtctgctatattataagtacttagtaaatgctgtaagttttatcttcattattttaaaattgagaagaattgaggaaggaaatggaaaaaaatctaatggcagccagtaagatgaataaacattttccattgttttaaatatggttgtgcaagtatttttttttactaatgcataagtgcattccttattttctcctttctggaactctataatatcaggataatgtcagtggagcagttaatcctggttatctagaaatggaatgggtgacccacctttgatgttgccctttacagccacatacctctgcctggcttagctataaagtaggaagtaccagtgtggggttactgtgggctgaatgtctccattacctttgggggtagaatcagctctgggagctctgttcctgtttccttttggattcagtatgatcttttctgcctccctttttcttcacctggaatgaaagtggttctaggtgaaggctagtactagattggctaattgcgattatcaagcaaatctgcatgttgaacgagactagtttttatccatatgttttattttcgtctttatttattcccaattacaaaacactaagataggctgggtgtggtggctcacacctgtaatcccagcactttgggaggctgaggcgggtggatcatctgaggccgggagttcaagaccagcctgatcaacatggagaaacaccgtaaaaatacaaaattagacgggcgtggtggtgcatgcctgtaatcccagctactcaggaggctgaggcaggagaatcacttgaacctgggagccagaggttgctgtgagccaagacagcaccattgcactccagcctggaaacaagagcaaagctcagtctcaaaaaaaaaaaaaaaacaaacccaaaaaccactaa

SEQ ID NO: 45522 - DNA, 1029 bp, Homo sapiens
catatttggtgacaatggatgcatttataataaaatattgtttgaatttgaaaaataaacctatcttgcaaaatatataagcaagataagaattgaattaaaatgcattaggtgatatttgatctaaggaatagtctggctacatatatcgggcagagacatggattctcttgagataggcaactcagtctctgatgcggtgaaatccacaattacccccaaaatactcacggtttatggaaaagaaagaatttctatgggaaatgtagagcaaatggaatgcttggatgacacagagaatatttttcttcttttaatattttttttccaaaaaaaaaatcgaaaccacattttatataaaaactagtatcaaaataaaaaagcatttttatttctcttctccctccagtttgaaaacacttcgttacataagattcttcccattgaccctttgggtccttgtgcagcctcagtttaggtctgttagaggagccactgctctgtggggtaggacttcaatctcagtggaaatgatgatgctggaatcaaactttcaatcttctctaaatttcttttttattggcagcttgaatggcctactttattcttttgcagtagggccttccattaggtatttgttttgttgacatgtgaatgctcttttgtcaaagattaaccacactgcctcctcacaggcaggatgccatttaagatagtcttttactaaattcttagagtaaggatgtatgtcaggccagttagggggcaagtttaggtgacagctgatgatgagtaggcttggtactctctcctcattgagctgttgagaagatggtcacaaaccgaagtcagaggaaatgcgtgatctatagtgtacacagttgaatgagatttaagaatccttaatcccgttatgttttaaaacctttagtaactcaaaacatgttacaaagcggttagcctggagagtcaactgaaaaggtgaaagctcaatgaagggtgagagaaaccctagtagttcttagaaac

SEQ ID NO: 45523 - DNA, 1051 bp, Homo sapiens
ctgcagatggcagtgactagtgccattattgcctgggaaagtctgtaaggggactccagagaattcatcacctgttccctggtcttgttccctaattaactggatttggacatgtctattcatggtcaaacttagctaaaatggtgacaaaattgcttagtttattttactccctctgctctgttcttattctgctcttttctgtgctcttatacccctgcccttccttactcttcaattctaaattatagccaaattcttctaaaagtagagataacagtataacccaggtttggatgtaaccttatacccctctctgtcttttgttccccctatttttcttctatataggaaataagatgttgggactaataggaccaaatgacacagagaattctgaggatttgcagaaagtcacacagttgatgatggtgcctgcattagagacctgggccactctatttcatgggggcacgggcattagttgaagtaaatgagaatgtattaagaactctttgctgcaagctgtggaaacacagttgaatcagcttaaagaaaaggataaatttatttattagaattgcagagtattttatggataccaagggcaggaattcactgggcctcaagatttattagtactgaagattcagaaaccctcaggacgccttcaacatttgttatggcctctgatttctccaagttggcttcattctccttcctctcacgtccaactgctccttcagtagacagaagctttgaacttgatagctcatacttgcatctaccagtgagttatgcccttgactttcttgattctgtcattgaaaaccctaaggaaaagacttactgtcccagcatagcagaggaacacacctaaggctaggaggtagagaagtgattttcagaaaagtaaagatatcggaagacacttcataagtgctcactacaattggtgacaatataaactgcctttagaatatgaaagcctcatgaaaaaaaaggattggtttttgttctgtggatgcaaattacaggaagatagatttta

SEQ ID NO: 45524 - DNA, 1703 bp, Homo sapiens
tccttgataatatttctaccattcagattagtgaaagcagtaaagctttacagcttctgtcgtcttaaaaagatatcatgagacaggggaataaggacttggattatggtttgggagatttagttgtttgtaaaaataaaatgattagtacagttattattcaagtttttaatcaacggaagcaaatggcatctgtttgttatcattctttctacagaagacaaaggctcaggtcccaatggtgctgactgctggtcccaagtggttgctggatgtgacttggcaaggagtggaagacaacaaaaacaactgcattgtgtacagcaaaggtaaatgcaagattgtttccctctctctttggaagtattaaaacctgagcattgcaaaacagcaccagaagagctggaatggaagtacaaagtataaattgatcctcttccttttttcccatttgagttcctctaatgtgtattttcagtaaagccacctgtttttcttttttttctgtacaacatgaaacaaaaagtgacataccattaatttacttagtgccttatacatttacctaaccctgtatttgagtggcttgactaatatctttctcttgctgttagtatcattgatagccaggtttgacgaaactccaatttctccttttagacattatctatcaaaaagtaaaatccttctaaatttaacaatttgtgtcaaggtgcatggtccaagaggctctacattctagccagtttcctgaagtcatgcatgatgagaggatagctggaaatgaaacctttgcaaagacagaattcttccccatggtgatttctgaagggcaggaggcaaactctaaagaggaagctgatgacttgcagggcattgcctttgatttgctcagtgtgacatcaacccagactgtgtcatgtagctgcaccctggctacaaaggagcagcagctccatgatggcacattgtggggctggggctgactgtccatagcacaggaccttcctcacgtgtggtgtagttttggggcacttttctccacattcaagtcttggtcctagctctgtactcttacagtataatccctaatctcactttttcataaatattacaaaaccttgtgcttctcatgtttaatttctcttggctttctttttaaaccaaatagacctactgagatcaaagatgtatttgcacattgaacctagaaaccataaaagcatacaagggaacaagcaaataagcaccccatcaatatattaacatataaaacactaatcataacatcaaagactcttaaaaacttgctagaaacaattacaacttgttctataatcattacaatttgtacacttataagaggattgtctcttaactaccataagcctttgaaagttgaaacaccagaaagagggaatttgcaagctaaaaaaaaaaaaacaatctgcacaccaggatctgattatacttttttccttctataattactggtcccatacccactaattttctaacccggaatacctgtggtatgctggtgggagctttcagctaaaagggatgtgagattttctcaggatatgccaatataatctatcaaagtgaaaagaaatggtatagggaatcagtttaccaatgccgacattcagaatacaaaagataccttggaatgtaggaccacttgttggggacaaatttct

SEQ ID NO: 45525 - DNA, 1028 bp, Homo sapiens
aaaaaaaaaaaaaaaagaaatcaaagcagactgcatcactagattttcctgtaccttcagtctatctgttatcttcttgactgtctaaccaaagtgatccaaagatgaatgaatttaaagattttctactggtcttggtgtgtgaatatacatggacttcttcacttttcaggtctttatttctctttgtcttattaattgccttccacaaagcaatagagctatcttaaaagtactttgaaatccctggatgaaaacagccaaagccctgaaaaatatcagcattattatatcagttaataggcaattgaagctatgaaaggaataaccagaaagacaaatgaatggccaagaggtaaaacaattatttaaaggagaaataatgggtaacagtaaccagggttctgagaacaggaataaaatgtatcaggaggagatggatcttaaaggaatgtggtacacttagacttaattagagaactgtgaaaatggacacttccagacaatatcagatagctttggtaactctttatgtgaattagttaaagcagaaagaacagtcttagaatatgttttgatctgtattttatagaagcattgccagagaaatacatttttaagaaacttctcaaaacctaaatggctgatatgttaaaaagaaaaaaaaaagcaaataaataataaaatcctgagaaacaagaaatcatacagtgaacagcaattggctgttatgccctaaccttcaactctgaaagtatgatgaactaatgtggttgatctcttagttgaaacaaatgttcagaaatgttggaacggaagcacaggagacatgagggagtgtgctggttttctggccagccaaagcgtccactgatattagaggatgagcaattcatttaaaaatacaaaatcaaataaattgtttttaccataaaagtgagaggggtggcataaaacaaacataattacagaattactaggttttacaaaaggtttctttttttcttggaaagggctatacagatatt

SEQ ID NO: 45526 - DNA, 1047 bp, Homo sapiens
aaaattaaatttccaatttaatcaagtataatgttcactctaagatggtctctgtcattgtgatttgtttttcagtagtctggaacagcgtttcaattttttgaaaggcaaaggtaattatgagaaattgggagtcagtttgtctaagtaaacacccccacttgaaatttccgatacgtgtccccttgggattctcagtaaaaatcagctcgttatggttaaaggagatgaagaagatttagcctcacacaaacatataaatggaaaagaggagtattttaatagccttttaagataattgtggatattcctttatgattgagaaaatcaacaagtaatttcttaaaggttggtagattttgaaactgtatcgatgacttttgtactccattgcattacaattcattggtctctcttatgcattggttgttttgaaaatagtgattcactaagttatgcagatcttgcaaatgctaacacattcattataccatatcaaataatcactttcattacacttatactgatttaatcataaaattcttgtgtgtgtgtgtgtgtgtgtgtgtgtgtgtgtgtgtgtgacagagtttcgttcttgttgcccaggctggagtgcacaatctcagctcactgcaacctctgcctccgggttcaagcgattctcctgcctcagtctcccgagtagctgggattacaggcatgcgccaccattcctggctaattttgtatttttattaaagatggggtttcttcatgttgatcaggctggtctccaactcccatcctcaggtgatccgcctgccttggcctcccaaagtgcttgggattataggcaagagccaccgcacctggccataaaattctttaagtattggtatactgtcaagttttctgaaattctcatttttacttgaaagatggaattttatttttggcataaaatactttaaattgtttttgttctttaaaaaaatcagttcagagggacctgattagtaataggcagagaccttatcagttatgttttggaagagtataaaggct

SEQ ID NO: 45527 - DNA, 1030 bp, Homo sapiens
tcctaactattttgaccataacattggaatcatagttcatctactcaccaacacatttatattttagcaccaccaagctttaagaagtgctttgtaccacctagtgactttggcatattgtttgtaaaaaattgagttgtggaagataactcaagatagtaaaattccctgcttcactatgaacaaccccaattgtagtactgaaatttgtattatcttcacatttgtcaatgaaacttttttcttctcctaaaacttcagttttatttaaacacatagaagagaaattcgagttctgaatgtttctgacctggaacaaacaatatatagtatttgactgtttcagcgtcagcattcttttcatctgttttgttgaaaaaaagaagttgtaaaaatacgcatggaaaaaatgaccattgattatatttttatattctgatatttagaaagaaatatatttaaatatataagagcaatatttgaaaataccaaaatatctgaatggacaagtaccaatgaaagatgggacaaagagaataaatttaataaattaaaaataaagggaaatttcatgcttcactatgaagtaaatgtcttagttcatgattactttctgaaaaaatggttaagagttatagactgggattgactaacttttgtgaatgaaactttaaacttgtcaaaaagtgtctaaaatgcataaaatgtttttaacatatttgagtttaattaatatagattcatttctaatatatgaaaacttgttaaagaagtatagaagaaaccaaaatatactgtactttaaatacagaaaaaatattaaagatggactagtttttcagtccaggtatattagatatttcacattgaatctcttatcattctccctttgtcaccaacagaacaacacagcttacatcaaatatgctcccataatatttcaagatttcaagttcaattctttcctgacataatatgttagaatatttctctttgaaatatattttctcttgtactgtgaaatcatgtc

SEQ ID NO: 45528 - DNA, 1037 bp, Homo sapiens
aatataaagtaattaccacaaatacaaaaaagcatcagtatctgtatttatttactatgaaaagaacttaatgggtaagaaaaccactaaaagtggaatggaaacctttatagtgggtgtgaaaatataatttgcacatgcaaaataattcaaatcattaaataggtatgaccagagcattctttatgataatcaaaactcatgagtcatcagtgacttctcattattatgaagatagggttatataaattttttatattatatgactccttgttagttcttcagccatacctttctctgccccatgtcctcatgtctctaccctgccctcttgccatcagttcccagaatccatcctaccatgctgtctcttacctcactacaatcccattcctcacaacccctttcagaatgcacagagtgtaaattagttacaaagcataccatttagttctgatgacattctttgtagcaacactttttggagaaaggaaactgtacattgatttatattctgccatacaataatagtttgtctgtagattataagtagcactgtgataaggtacatgattgtgtgtgtgtattaagaagagtttcatcctttaatttactcatctttatagtgggaataataatgttcatctgagtgttggattcctcatatctgaaagtaggaagagtaataactaccttgtggtgttgtagagaaccttctggtatgtattcatggtacaccaggcattgaataacagttagttccctctctggtcccttcctttttccccctgtaaataagtagtgtcagaatatacttataaattactatggtccaaaggacattaggggaaaccagttggcataactggactctataattactctcttgtgtgtgctttgtgtcttttttttcaacactgacatttataattaaggtttagtgtctgccttccccagtggattaaactctatgaaggctgttaccctgtgcaggaggccttctcagtcactgctctatctccattgtctgatacgtg

SEQ ID NO: 45529 - DNA, 1056 bp, Homo sapiens
gaaatatggatgtgatttaccaaactccagataggtaccatgctcattttggaatttgttgtaaacaaacacataaaaacaggacaaaaccacttgtattcaagaaatggaaaattgttcaggatggaagaaaatgtttatgagtaggagagtaaagaagagcactaggaagctacttccaaggcatgtgtgaagggctttgaatactaggttaaagatttttttcattgatgagtagaccatagaaagctagaaattctttctgcacagagcaatgacattttttaaatgatgtttccagagaaagtatgggagtgtgcaggattggctggaaagtagaacgcagacagaggtgataggtgggcaactactgaaatgggcagagcatgacatgagaagagcctaagctacggtcgcatggtgcccttctgttgagttggaatagaaacacaagtgtggagatattagagaagaaggtttattttatggactctgtttttccatcataaaattgtcacataaagagaatactgatccagtcctccatggagagaaccagtgattcttggatgagcaaataagttaatggagtaacagcaaagccccatgaataatggctttgccctcacaaaaataaccttgtgtagagaaggtcaagtgtacgtgcattggtgcaggctattccgcagcttgtcggcaactcgcgttgggacttctgacaagcagctgcatcctaagttacattttgaagaagacagagaaagaggagcagatgaagttgttaatgctgaggtctcagccatttatttgttgttgtttctttgctctactacactacatgcccaacatttaggaaaatatacttaggaaagcatagccaagcgcactgaaacacagaagatgcacatatccagataaaatatttcaaaatcaagaatatactatatgtgctcatcataaatctaattttgttatccattttaaatttttttgaattccaataggccatatattttctatatggacagctgtaacatgtgcttcttgctactaaat

SEQ ID NO: 45530 - DNA, 1049 bp, Homo sapiens
aattatctgaacatcttgccattaaaattaaatgtgagtgaattttgacatattcattttcctttgtaataaatggagggtaatatttttattttgaaatatttatagtgtaaattactaaaatggtatttctctcctattctaataaatctgtttttacataagttctagaggttaatggctagattttaaattgctttccattttgataataagtggatttccaagagagatgatgttattaaagagactttggtcactctgattctctctttatatgagaataattcatatttgtacaaacttaaaggtataagatgaagccacactggtatttttctaaacatatagtttggagtattgttttgaaaggaatttctttttcttaatgatatagttcttttgttaagcctctattctaaaatgtttttctttttataaagattgggtatttttcctgatattcatataacacctctcaaaagtgaataatggcaatgattccactgaaaattaactttgaattaatgcgctgtaactgtgatcaaatattgatcagttttctttattttgtgcatggttgcaaagtgagaaatataatgcaaactctcaaataattaatttgattacattgaaaaaaattaatctaaactagctacacaaagtcataaaataaaaatgttgaacactcaacattcaacgaatattatttattgttgtcttagactaatttcattattgtttatgataaatatttttaaagagcaatattttaggtatttttgaaaggtctactaaactcagaattattattgaaaaatgaaatgtaaatacttagatctttgataacaaagtaattaaaatgtatgattttgcctactgtgtataataagggcttatatttgatcaaccataaaagttatttaatcattttaaccttggaatactaccccacaaaacactacttaatggaagttagctgagacgcattagggtatcaaaacatcaagtcggcaaagcaagagggcctagaaaattcaagcccagct

SEQ ID NO: 45531 - DNA, 1030 bp, Homo sapiens
tggtatataactggggaaacacatccaaactaggtgtgagtttctttgtgtgtatgtatattagaagaggacaaaaaaagcttccttgaagagtgatgcctacatcagctctatttgaaggataaacttagataagcgtagggtgaagttttctagccggaaaaacagcatgtgcaaaaggcctgtggcaagtagtgcatggcacatttgaaaagcttaaaggaggccagtttggctagaataaggacaggaaaatgatttggaggcagcctgagctgtgtcgctatacatacaccatggtatccctgtgatctcacaacttcatgtaggaattgtttgcttctcttctgtggcaattcttgacaaagtaaatcccaattctctcaaagattttgcaggagcagtaacggttatagaaacgctatatcttctgcattcatagaatattatgcacatcacaagctctagctcttcttctcatatccaacttgaatgtcacattttaccccatctcagctctgtagcttttaatgtgtctttataccggataaccctatgcaaactgtattacagtattggctatctatagtgtccttccatacagaagctatattgtatcatcatctaaccagtacctcacagaattactgcctgatagtaaattaggtcagtttagcacttctcaataaatgtttgttgaattgaattgtcttaaatgtttcagttcttcagataaaggcatcatatagaacatcttgttagtacatgtgcatggagactattcatgcatgtatttactgaagtaaaagaaataaacatgttgtaactgtacttaatcagagaacacatataaaatatttttgaaaaaattaaagcaaaacaacttactaatattatctttaacctatgtgttacacattatagtaaaacagttatcgtgatcacttcagagctgtgctttcaggataggatatgttttatttcccagaatttgtcatttgttaggaatattttagcttgcttcactttt

SEQ ID NO: 45532 - DNA, 1120 bp, Homo sapiens
agtttgactattagaaatggagtttctattcaggagtgtcgttcatataaatatttttgcacatttatagtttttatttttaaaattaatgccccaaacaatgctataccacacacacacacaaacacacacatcatttcacaattgctttacaattttataattaaccacttagccagattttggatataaacaaatccagactcaatggcacagtactgataacacatgatataatctttaaccttatgataatgtttcccatctagctaccttgttaaagttgagtagatctttattggtaaaactagtatttgtcatgttaatttatgtattgaaagagattttttaaaattcctcgtcaaatttgtctaaatagatgagaattatatgtaagaaatagacatatttatagaatatatagagaaaaaataaaaataacatatcaatcatgatgactttatttctttctttttttttttttttagtttcccctaatctatccagcttttaaaactcaatctgtgatctgacaaacaaaacaaaacacaattctaataatttgggactctgtgaaatttcaaaattatgtaagtctcaagagttttggtgttttgaagcccataactattttctagatttctagcatacagaatattagcaagtgcatatttattccaaaattgcagcggacaatagaggtctgaaagctatacaggaccaatctccttccagaataacagtctgaaatcaatgatataaatcactccccagaaggagaccagggccaagaacagagtagcaaacgaaatgtgttttctagggccaataccttctgggacaatacctcaagcaggtgattttttacaatctgccctagttaaagcttccaggaaagagttcttgccattccaagtaaataattatgagaagagagtagaactaacatttttgaagtgactattctgtgttcaaccttgtgctatgtccttcatgtaaagtgatcttatacaacaatcatcttccaatacacaggataatccccattttccagatgaggaaactgtgtctcagaaggattaagtagattgtccaaggtcacatagatgctaaatattta

SEQ ID NO: 45533 - DNA, 1034 bp, Homo sapiens
cagcttttctgtttgactaaacccaaggtaggatacctgagccccatggcctccaacacattaattcaggttttccagaaagctctgagtgcttttatattcacgggacaaaactttctgagcttatgcttcagtagaaatccgggcctgatgacaatgactctgtttactttcccgaaagaggcatcatgagcttcttaaaaaagaaaggaaattatcttaataggagacattttcttacaaggaaaaaaaaaaaaagtactgtggaaagaatacaagccacgaagcaaaactctagcggggatctgttacaagcttgggccagagaatgccctctttgagaagaggggagtttagggaatgcaccggtttaaccagtctggctttgctttccttttctgtgaaatggaatgatagtacttcctgtttgccacagctaattatatagattaatgaggctgttcatgtttctttgtttctaagttccgatcagacctatatattatctgttgaatttacattaagtaataaaggatataatatttgaaatgacacataaatcacagattctactttaagctcattttcaacatatttgctaaaagaggatactgtaatttagtagttttacaatatagcatggccaacatttactagttttttacattggtgtaaggacatggtttataacctgatgtgttcaaagatatgtatacttgaagagttctcttcattattcataggctataaacaattcttatttatctacttttactttccattctaaccaagtaacttttgtgagcctagtcaagacaaaaatagtcacataagtaatcatataccgtagctcctaaactagttatttttgtttgtagctactgactatttatatgcttttatttcctggtattcaaggaaaacttactaagtgaatagggaactaactactgaagttggaagccaggtttcatacccagaaatagatattccatatcctataaaatattgacataatacagaaagttctttgg

SEQ ID NO: 45534 - DNA, 1103 bp, Homo sapiens
catgataataaagtctctgtctctataatgccgatgttttctgcagtattttatgaaagcgagtgggatggaatagaatgcagtggaatagaaaatatgcaaaggtggatactcagagccataaatattgacagatggaagatgcacatagctgatttgagctatagtgtcaaataatacttttttattgcaagaaaaactttctggaggaaaaaaaacaaaacaaataaacaaacaaacaaacaaaaaaccaccccagaacaaaagcaattgtgtttattggcagaaggataaaacctttactaatctgtccagattgaaacacgttcttttctttccccttcagtgaccctgaaaaacaaaacatgagaaagatgcatttatatatatatgtgtgtgtgtgtgtgtgtctatgtgtattttgtatgtatgtgtgtgttatatgtaataacattgcttatttaatctcacacatatacagatatacaatgagttgggataagctagacaatattgtacgttaacaatcaaaccccaaatctcagtgttttagaccacaaaagttcattgctcactcatgtgaacttactttatcactttgtgttcatcgcagattaactgcacctctcctttacctcatttcattctggactgaggctgacattgtagcctatacctgtaatactacctatcttttaacagagagaaagataagaacatggcagacctcatactagatttaagagcttctgctcacatgaatcaattctttctacatgtcattttgtcaaagcaacttaatgtcagcatgggacaagtatatataatcctcttgtagaaaatatttttgaatagtaatgcaagctgctacagtatagtagcacattagagtgatacacaaaactaatactgtatctgttggagagagtattggtgggtgttgaatgtgttgtagttttcagaatgtaattgtacccagggcaactgttccatctgatactaggtgtgtacttttttttccaggtggttggggtgatgttgatagtaacagaatcttgctttgtggcattagcctcatttattctcatatactctttctcttt

SEQ ID NO: 45535 - DNA, 1050 bp, Homo sapiens
tcagtaatatttaaaatttttatttgtcattgaaattaactcatttaatatatatgttaaatcccaagataaaatatcctagaccttctacaaccagatgttatcctcctaacaaactaatttgtagttgaacatctgtttaaagcctggctaaaaattgccttaaaaatccttcttttctgatactaagacaatgtttttactcatttaatatttcagaaatgttcagaaaagcggttattcattcactagtgggacttgcaatcagtggcaccttagaatggaagaaatatagcagaaacatactgggtgatgcagcaaagaaatgtgttgaaatctattacatatgaattgttattttctccatttcgtagaaaggaaactgaagttccaaacacctgtgtagcagtgggtagagaaaagactcggattccacttttcagagaagatcatctctacttacacttaacacaagtccttaattccacaggagtaaatccggatgagccaaattggaaacaagaggcatgtggagtagatcagaaaacacttttttcacgtgtgtgtattatttttaaacttcgacatgaactaaagaataatcatgaaatgtatttcttcaaaagcctttaaaaacagataatctataggttagaccatttagagaggtaattcgtctgggataatttgtgtaactttctaacagtttttgtcaaataaaaaactgtagtaagtcgacagtgcattcatgatgtgcattcactgatgtggctcaacattggtaacagtatgtagagaagaatctgacaatttcagaaatataggcacacatatcagatgattatatcaatgcaaacctgttgctttggttatatgagggtacacttcaaaaatacacaactcaaagcttttttctttttctctgtcaaaatagacaaacccaggttaataaaaatagccagggagttcagtctcccaggaagagcagtctgaagaatgatgacatacattgtgccttgaaggctacaatcaatctttattgaaaagaat

SEQ ID NO: 45536 - DNA, 1020 bp, Homo sapiens
caacagaccctggggtctacttgagggaggaggttgggaggaggaggaagagcagaaaagatagctattgggtactgggtttaatacatgggtgatgaaataatctgtacaacaaccccccctacacgtgtttacctatgtaataaaccttcacatgtaccccaaacctaaaatattttttttaaaggaaaggaggttctatacaaaaaaagaaaaaaaaaaactttagaactctctggcaatacatgttatgcatcctgtgttagtccttgggtaccgtgaaatttccttcttttttttttagagcacctagtgccctccatcgtcatcaaccacccactgctgcggatgctgagcccccatctgttgagtgcttaccctgtgccagaaactctgtattgcctgtgcattttctcactgatcacttagactaggcttgggcaaacttttttctgcaaagggtcaggtaataaatattttaggcttttggaaccataaggtctctgtcacaattactcatctctgctgaggaggggaaaatggttccataagacaatgtgtattgtgttgaaataaaattcacacactacacggtaaaggaattagaactagaatcctggtcgttcaacttgaaattttacaatcttttcataattcctgctaatagtgtgacctcctaaactgtaaaggaaattttgtaggttaaaaaaaagatgtatttatcttctgtaagtggatagcaggacctttaggaaaagaataaaagtaatagaagaccaaagaggaagagactcttgggaagaattttttatttcacagaaatctttctcccccaatagaacaatgaattgcttgtcctaatattgtttccttacctcttaacatattgccatataacatattctgctaacagtataaagacttggctgtctttactttgctattattctttctgaatctacaaaatttttctttaaaaataatctgcatgtgttctccttcatttatttccacactttt

SEQ ID NO: 45537 - DNA, 1062 bp, Homo sapiens
tcagtacatgtgattctttaccactcttgtttttagtacaagtcagtccttgagtcaccctgaaatttgccagtcacatttatttacttgatttatatttttcactcagatctgaatgctttaggaatatacccataaagagaaaaacttaaaatatattttacatttacatttttatgcaaatatgcatagattattttgattttaattgctctttattaaaagaagagtgccttttaaaaattaagtttactataaggtaaaatcctcattcaaggtgaaagcatttgtatttgaggatctgaagaagaatacatttaggtgatgttatctaagtgcaatgtatttttgttacttgtaaaagaacagtaaataacagacatatgtatagtcattagttatcatgattgtgattgatcttttaccctagataccaagtatataaagtcagttgctttgctgtctttggaattataataggtttgggtgaatgttctgtgattgctgataattatcgtattggtgggaatgtaccatctttgaccacatcgtctgtcaaaatttcagtatgtctaccagtctcccttcacctctcactcgtccaagaagcattcccaaggtaaagcagtcttattaaaatggaaggatgtccctagtgtgttgcgtagaaaacaacaaccatgatgagtgcagggatactctggttaggtaaattttctcgtgtttacatggatcttaaatgttaaccttgcctgcagcataattccaataagacaagaaaaaggtaagtaaactatattgaaaaaagtgactcttgttttccaagctaaattctgcctctggcaagacaagtcaattatttttctagtcaatgaagatagaaaaagaataaagtaaccagttgatttctgcttctgattagaaaattttgttttaatctcagccagagatgtttcagctttgccgcagggcaattttaaatacagttgtcaagggaggacttcttgagaaaatgacactagaacaaattcttgaagggagagagccatgtgaatatagggc

SEQ ID NO: 45538 - DNA, 1038 bp, Homo sapiens
ccttctgaacagcatttttgcgcttgttaggacctaggcttcctgcttggtgtggaccctgattatgattactacactcaaccccacagcccagctctgctagagggtcccggcaatccggtattttcttttctaaagtctcctatccaggtctgagaactataggttttttttttttttttttttttttttaaggagagagagaagttagggggacagggggctatatactaggcactgtgttaggtgatctgtaatataattccaataaatgtttataccttttctggctctggcagctgggtaatcacaacattatatatgggaaaactaaggctaatgcaggtgaaataatttacccaagtaagcggagggaaatggtctgaacctctgacagctaacatccaaagtgttggcccttagctactctgattttgtgcatctatagtaactttgggtggaagagtactttttctttttttttttgtaaccctgggtgcctggaaaggtaggaaggaagtggggagacttgaagaatatgagaaaggaaagattggtaaccatatctttggagagcacattcatttcatttcagggtatctattctaatggaaatcatattttcccattgttaataataaatgatcatgaaggcagttgttattctttgagttgcttgtataatgatgcaagaacactgttaatcagtattttaattaggtttatagcattaaagttgtttttatatttctctatgtaaagtttccatgagtttcacatagttaacatcattggtttctggatatctaattcattttcagcactgataataggccatgttgtattagtttggaaatgtattatctatgatatgtattatatcctcttggcagctacagcattgtgttaaaatgaagcatcgcctgtaagccagatgtgtgcccttgtcattgcctcatttgaaatactgcattatgaagaaattgatgcaatgctcacaaatctataaggattattttgcatgtgtttgattaaaat

SEQ ID NO: 45539 - DNA, 1391 bp, Homo sapiens
cttggagagtatatgacaaggcctaatgccactaaatatcaaaatgaagacttttttgatttattgggattcatttttgaaaatgcttacaggaattcacacacacacacaaacacacacacacacacataagaacttttttaaagaaactaccaacaaaatctcaatctgaaaactgacaatggatagataatttcctattatttcaataacaatctgaggttagaaggccaaaacaaatttgagtttgcatttgcacttggcctcatccatttctacgaggaaaagaatgtaggtacaccaaattttctgtagattgaattatagttttaatatccctttaagcatatttttggctttgatatttcatttgccagtaaagagattcttttgttgccaagcaaaagaattaaatgagtttgttttagcttggaagctaacactcctgtaacttacttgcttttctaatcaaatccagtgattattaagtatcttttatatgtgaagtggtgttagacgttggctattagtaactcttccttagaagaaatatgtaattccttcaatattcagtaaaccagttcattagtacaaactcaacctggaaccttctttcaaaagtagacctgagcctttagaaggcagtagacttttagaacattgaaagactttcaaggtaattcctgaaaatggatgctgagccaagtgaggatccaagtgcttataaacttagccaagagaatagtcaaaaatctctgatttgaaaacctaagatgtagctaagccaatataagatatgacttagaaaggagaaaatcattatatggttgacttactggtataagaaaaagaggagtgatggaatgtgtataacaagcaactttaaaattaatatcccagagaagacaacaataatttctaacgactctattttgtattaaactcaaagcttctgaggcttcatctgtttctgttgcatctatggttttatatgtgttccccagaaatgactcatttgttcagaaatgtttatattcatccaattattcacctttttattgatttaatacaccattattgagtttctgctaggtacctggtactatgctaagtgctgaggttataacagcaaataaaccctgcagtgtttttgccctgatgtaattaattacataaacaagtgtctaattatatttgagatgagtgtaataaagaaaaagcattttatgatatgggactgatttatagagaatttgatctagtgtacaggaaagagacaactgccctatgaaagtgacacttaagctgaaacttgcatgtgggcaaactctctagtttgggaaagtcctggtatcttcaaggaattaagagaccaaagagaaggctggatg

SEQ ID NO: 45540 - DNA, 1008 bp, Homo sapiens
aatctggcacaagttatttaccatcattttaccttaatacttacatgtgtacaatgaaagagagaaaccaaatcttgtctttcagagttgtttttcttcttactctctttttatgatcacaactgaccatagaaagtactgtataagttttctattgctgtgaaacaaaataccacaacgttagcagtttaaaataacaccgatttatgaactcactgctctgtagttcagtccacacggtatgactggattctctgctcagggtgtctcaaggctaaagacagggggctagctgggctgtgttttcatctggagtttcaaccaggggaaaaattgcttctaagctcattcttattgttggcagaattcagtcccttgcaattgtagggctgagctacccgttccttgcttgctgtcaaccagggaccactctcagctcctaggggccacttgcttttcttgtcatgtggtcccctccaccttcaagtaaagaacttcacatcaaatctatttcatttggatcctctgcctcaaccaaccaagaatactctctgctcttaaagaattcatgttattgagtcaggatcacccaggtaatttttctgtcttaaggtccacacaacctaatcacaggaataaagtccatcataaattccagaccctggagttatgcaggtatgtacaccagaggggtgggagatcttggtgaccattttagaattctgcctatcacattttacagcaccacctgatatatacacatgcaaataccaatatatctcagatgaaatttcttaaaagcacttccattactattttgactacttatagaatggaatattctatagaatatgaaatagaatacaatattctatttcatttttttaaaatacagtctcaactcactaagtttatttcatagtccattaatgggctatgacctgaagtttgaaaaatcactggacttgatatttgaaatccttcagatacttaaacttctattattct

SEQ ID NO: 45541 - DNA, 1030 bp, Homo sapiens
acttactaggcacaacagaactcatatgcacgtgcaagaagtaaaagctatgataaaattatctggaaggggaagcgggttgtttacacaaagtaacatgatagcagatgagcaaagaggaaggtacaaggaagaatatttactagagagtttacagcatgccaaacatagagtaaaaagtgaaaaccttttagccagatttgtatacctgattaaatatctactaagggtattatttttaatgtatagagttatcaaaaacacattccttgctttctgtttctaacacttctagttctagggctcagtggctcttaacaatgagcaccaaaaccctgcttcatgctgtgttgctgcctgtgctagctgagggcagaaggtgcagtgagaaaatgtaagggacttttgggggttggtcggaaagagatgaggaatagttactgggcatgaagataattggaaaagaagaaaatattgactaaacatgtcaaatactcattcaataatgaaaagtaagaaagaccaacaatatgtgagtggttgagagaggagaggcagaaaagggaaccaggagagtggaagtgcttgaagctttttagatgagagtaagagctgacttaaccctgtgtatgtttgatcattactaatcctccttataccctagttccttcctttatttccttaatttccacatctatataaatagaatataaatacaaatgtaaatgtattatctataaatagagataaacgtaagtattacattatcacctgtggttttctcaaagctcacaactattctatggcagttcttgatggcattaagtgaggatgttaacctgttgttttacatgcatatggatggaacacaaaattaaggtggcaatgtaaagcctttagaaatattcacccttcaactgtttaagcaacccactttgcatttatctattagtcttttgtttagctgccataaaagccctattaaaatgtttttgtggtcttaatttttaagttgttgcaaattgaattg

SEQ ID NO: 45542 - DNA, 1052 bp, Homo sapiens
taattactgtctttaataggattaaaaatagaactggaataattctatggtaagttgatgtcacttattgtgacccaagtttcaattataattgttaacgatgctattgctgagtccttgtttggcttgactgccatgcagtgtttttctgatgagtgaaggagttaacaccttttggacaattttcagaattgaaagaaaattacttggtttttagtagggtttgtaattattatatccaaggttggtatcttctagaggggaactttttagaaaattaatattagactctctcccagtctattgaaaggccgtattaaatctctatcatatactcttcaatgctgtgatcatgattatattcaaacgataacccacattcttcctctttgtggtcatttgggacacaggtggcagtctcacatatgataaggaatttgaatgttagcataaaccattttagtggcaaaaaacacacaaatgctttatataaaaaaagagtcaattttaagggtatcaaatttgtctatgaagttaagctttaggtttactggcagatgcagatgtagtgactgtataatagattcatgccttagtttctaaacttacaaaatctgtttgcttagtttagtgtcagattgtcagtctgctttattgattccatcagtggtttggcttatcatatcagaaatttgagtgctgacttctggcctcaagcgatcctctggcctcagcctcccaacgtgcttagattacgggtgtgggctatgatgcccaaccctaacatttctatcttatgaaatagttgacaggtagatataatttgttactggagaagattattttttcattttgttcttttaagatccaattgttattttctgagtttattaacatagctagccttataatgagaacacagctctcacttttaccattttgcttaaagatttgcagatgtgtcgtgctcatatacttcaatgtctctgtgttttctcaggatgttacagttctgcttcttttatttcctaaaattcaataattttatctgt

SEQ ID NO: 45543 - DNA, 1034 bp, Homo sapiens
cgtccactgcaacatctacaaaataggtccttaggaagtgcagaagtctggaacagttctttcccaagccacaaccctgaaaacatggattgctgggtatgcagattctcctgggtccctttcccataaacaccgaattagacactctgaggatgcagcccagacattctgtatttttcaccaggcataatggtgatggctgatattagaatggtgaaatttatcccacctagtaagaatctaaactgaaaatggtgatgatgcaaaaaagatctgtcaaccagttaaaaaaaaaaaaaaaaaaagagggtgtgtgtttgtcaggagggatagtctttagtagtatggccaaaagcttaagcctgattttcagggctctattgttggagtgggtagttcatcaacttcctaagtaattcaaatctttttccccccaatatattaatatattggtgattccaagaaagagggtttaatttatttaatgcctgggaaaactaaaagaactacaaacagatgtgaaaggaagagaataaccacatctcacaggaagcaaaatttctgtcaaaagttactgttctttccctgtctaggttctttgtccctgaaaggtagatccgcaaactaaatccctcaataacgttgcctaaacaggactgggatcatagaatgtccaacactaacatgagttcataatggcacaacgaacttaaaatgttactattcatgttttaattatgattgcagtcttacgttgaaggtatctccgccgtccttaaacataaaaaaaaaaaaaggaaatacaagctgcaaaagttttatgtaatgcactccaccctcttttttccccaagccaacacacacccttcaaactttttgacagttattttcagacccctcctaggctcccgaactccatgcaactccagcagtctcccctgggccatttttagcctctgctctgacctggcgggaggctgggtgtccaccctttcccctgcagtcctgaaagtccggtccgagcgcggacgggg

SEQ ID NO: 45544 - DNA, 1570 bp, Homo sapiens
gaaatgggaatagcctgactcatgtgcccacatgtgtctatgtggaataatcttttaggaattacacctttcttctggaatacatgttgatggagcagccactatatggaagatctctggttttgagatagaaaagagagctaagaagtacaattttggctccaaacacttccacctggaagacatatatggttcattgggcaaagcaagttggccatgtctgacatcaataggatggtgaggtatattttatattcctcaacaggaaggaatacaggcttagtaacaataatatagtctatcaccatgactaatttagaaaccattatattagtttgacagatttgaaaactgctggtgttaactgtcacaaatatgaagttatgtagggaagcccatttcttctgtcacttacgcagtctgcaggtctttgatctcttcagaagctctatttgtatgtctctcaaatgtgttgtgcgtgcaaatcaatagtaaatctgtaggtccggactgagcctcagatcttacattcacagtaagcttctgggtgatgtcaatgcagctggtccctggaacacacttttaaatagcaaggctctatagctctttaatatcatggatcttttcacttagaagagagccaactttaaggtctagatggaggaaaaggggcagtaaaaaggaacattaatgggtatgagaccaagaggagtgtgaaatactttcaaataaagggaaagaggaacatgcagaagaagtctcttggatgtttcacagagatcagataaaaaaaaagtggaaaagcccatcaaatttgccatttaatttattcattttagggtggggattgtgaactggggaagagaagatattacaatacattgtggattctgtaggagataatggagtaaagacagtaaaagtagatttctactttcaaaaattcaactgaaaagaagcagaaagatggagtagtatctagaaaaagatagatactagatttgagggaaaattgaggggttttgttttgtttttgttttgatcgtggataaggagtcaatagtgaaatgttgaaaatacaggtttttttccctagtatctcattattgagagaattattagaaaagctacaatcagcaatctgttttttttttagtttagaagatacttttaaagtgtttgaagttttagtatctatattactgtttttgaaaatactgacttgcagctcaatgttttaaatagtcaaactttttatacatagctattatcaatattgtaatattcagttattataggagtcttttattacattaaacctgatctcatagtacgttcattgatgatttccagactttctacagcatacctttccatttctttaccaaaatgatttttttaaaggttttatactgctctgttaattctctgcttgaaagtccttcaggagttctgagtctagtaatagcaagctaggtaattcagactatcctgctgagaacaatttaaaaagctggacacaaagcaaacattttattaagggtatcagaaagctaagtggtatgggtag

SEQ ID NO: 45545 - DNA, 1049 bp, Homo sapiens
tttgcatttatctaattatgagtgagattgaacaacattattacatgtttaaggacatttttacatcctcttgtgaattgtctgattatatcttttgtgcatattttcacctgcattattttttccctagtttttaagagttctttaaatatttaggatacaaaagtagaatatgtgtatgtatgcgcacgcgtgtgtgtgtgtgtgtatctctgcatactatttttcctagagttgtaatggatgaaccataattctttctctacttttctttatggaaaattaatggcagttcataatagttttggtagttcaaagtatagttcaagttgttgcttcagaacattactttattagatgcttgccatgtgtcaggcccctagttaggcactgaggaggctttgtggaagaaaggcaatgttttggaggttacaatttagtggaagggatttaaacccaaatattaacttaacactgtgtcagatgctgtgaaggagacataaagatgctatgtgactaataacagggacttgggttagctgggtgatcaggaaggttttaggatagttttttaaagcattgcagaggtaattgtcctttttggggattttgatattattattattttttagtgcttgtttagaaccattcacccgacagctgagatgattaggtcaacataaactcttgtatggtcaaaatgccatttaagtttagatagagggagaacaatgaaatagatattttctagattatatggtcttaggttgaaccataaattttctttgaaaactatagtttttaattttggtaaattttgagggtaaagtaaatgtagcattttgccatgtttactatcttatttaattttgtgatttatttagttttttagatttcattttaataatttttatgtttaggtaggagtggtgttttattaattcagtgttgttattacatgaagtatagatgaaaaggttaacactaatacaaaatttaaagggaagcagtttcgctaatcttgatgataatgaaacattcaaggaagt

SEQ ID NO: 45546 - DNA, 1045 bp, Homo sapiens
atcaaagagattatgggcaatagttagaaataattcttacaacagttgattgtgtaaattttagttgtattttttttacctaggattatattcattaccaggctccaggataatatttctatgactttctgcatatctcaagtgcctatatttctatatttctaattattgggttttatgtctcccatgctgtataaatcccttagaaataaggatattatgttttattagatatagtttacattttcattacactaattaaaataatgtctattagtattgttattatatgtttttcccagaaattgtcagtttatattaccagcaaccactgataaattttttgaatgtccagcttagtagtggtttactatgaagctaaaaatatgttcctggctttgtcggcataaagactttcattggtaataattcgttttcacttaaaaatattgcattttgagaatttccatggaaaactattttttctttatttttcacttttttttgttcacatatggaggaagaaatatagaaggagatagaaccaaagtaatggtaaaaatcataaaaatagctaaaatgtagtattgcaacaggtataattctaagcactttaaaagtattatttatttcttatctcaaatttatgaggtaggcacttggcctgggtttctgtgtttgtccctccagacttactctgtattctctagtgtcctttgggtggtagactgcatcagtgcactctctcttgcccttttgcttctgttggtggttttctttctggagcagttgcagaagataagggggaaggaaagagagaataagatggggacatatttattctcctagctccttccctgtaaggttactccagagtgaccacattcttcagcatctcatcttatcttttgtcagccctttccacagagccatctctaaatttaggtatctgtttctcccccttacctctttagggatagaggagtcttctgttattgttcaccctgggtttttgtacaccatatgtacctttgtaaatagttcc

SEQ ID NO: 45547 - DNA, 1138 bp, Homo sapiens
gaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagtaagtgttatagagtaaatgaagttagttcatccaattgtatggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccattaaaaatgtcttttttcatatataacattttaattgccaaagttgtaatcccatcttttataaaatgtacagttaaacctaaaagtgtacttacagaattcttccacgtatcgagaagtttcatcatcatcatctaattattttcttttaaaaacctgccctcaggacaaataaaaacactattttatctgtcagttttctggtactgtttacttctgaaaattacactattttcagtcttttatttctaatatactgtgcttctgttaataaattatgggttaaatggggtataacaactaacttagctaacatttctgatattctattagaatgtttatcccagactagtccat

SEQ ID NO: 45548 - DNA, 1038 bp, Homo sapiens
aacttggaaaattgtatataatgtctcaaaataggccattaataaattgtttacttgtattttagatcattagattattgtaggaatgaggtcaaagttgtgtatctaatttccttttccatcactagtgtctttaaagaagaaaagctttataatatacaacatctgaactagtcaaacacatgccaaggaaaatcttaatttggttttctaaagaacaacctgacagaatatagccaaataaaatgtttaagttaatgccttcctgatagtagaccttttatattaatataaaacaatatattttgtgtatattttaagtcttcaagatttatcaagatattttacaaatataattttttaattctggcagcacagaatactaggtatattaatagtcacttctcctaacaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtaaggagaaaaatatgaagattttagtcatctttttagtttgtatgaatttatagctttatggtagtacaaagtataagtgatgtttccacaaaagaggaatttttttaaaggtcaggttcactatccgtgtttatttgtggttattgaatgaatctgaatagtgactttaatactatatttgtcattctgcttttgctttaaaatactagaaaacccactagcaataaaatgacttttattgagtgtcttatagaatatttagtttaggaaagattaacattatggcaaagaaggaaataattttaattttgctgttatattaattttcataaaacatcgatttcacatctgatttgttttaatttcatctcctccatggaggaggtacggcagtcatttaacacatctgtgcatagtatttgcatagcatctatacaaattactactcctttctatgt

SEQ ID NO: 45549 - DNA, 1032 bp, Homo sapiens
caatactttacattttaggacagctctgttagaaagttatttgttacaataagcttaaggaaacatatctttgtaaattggattcatttatctttattctgtcttccaatgcaagtcaataacaacaagaaacattttctatttactgcgatagtgtgaaaatgtttgtcttcccttttaatcttgtttcagaattattttttccagtacttcaactgtttaactttatgaactctattcagatcttattcatatcagtaccctaaaatatgttaaaagagttcataaactatggcaccccaaattactaaaatgtacacttgggatagcaggaaaaattccgtaatatttttaaaaattttaatttccaaatatgaacattgaagaccagtcctattgaagacagacagaaacatatatttactaagaaaaagaaaatttagccaaattttaaggtggtcaggagtaaaagttcctaatgataaatcagttcctaagtatttggataaaggatctgagaaatactattcttactgctcacgatgtgtaaaggactgaatttcctctttttgtagtgttactttgtatgccacatgataaagagtactttggtgtgggtcgggcgtggtggctcacgcctgtaatcccagcactttgggaggccgagacaggtggatcacgaggtcaggagatcgagaccatcctggctaacatggtgaaaccccgtctctactaaaaatacaaaaaattagccgggcgtggtggcgggcgcttcttgttgtagctactcgggaggctgaggcaggagaatggcgtgaacctgggaggtggagcgtgcagtgagccaagatcatgccactgcactgcagcctgggcgacagagcgagactccacctcaaaaaaaaaaaaaaggagctatgcctgaattaattgcgtcaacatggctgctattgataagaaagcatgtttttaaacaatcaaggcacaaaatgattaaggaaacctttcttcatagtgaaccaaacttatgtt

SEQ ID NO: 45550 - DNA, 1066 bp, Homo sapiens
gcagcacctgggaatttgttagaaatgcaaattctcagaccccatttgagtctgattaattagaaaccatttttggagcccagcattctggtataacaaatactccaggtgatattgatgccggctaaaacttgaaagccactgatttaggtctctaatgactagttctgtccagagatgagagccagcctcctcagaaacacatggctggaaggatacctgagcaaaatcaaggccacttcaggaaggagttgtaagggtggatattgaataggcaaccaacagaatagactatgccatgcttggtggtttttggttttgtttttaatatctcatttaaacctcattttggaacacacgtcatatttgttattttagaaaatgtagctggaagttatgacaagctttcaaaatgctgcttccaccaccaccaccaccaaattatataatattgctgatggttgttaggagagtctgtgatggaggggtggagtgtgaccacaatgcactgtatgtagaagagaactttcctggtgtgaagataatgatggtgttcctatgagggactgtgggagagattttagggtaaatgtagtggggctgaatgagaggaataggggaaatggttggtatgtgggggaggtagggtgttactgtggggtgtgctgtgccctgtgtgagtgcatgctggaatgtggaggaaggagatgggagtgggggtttggttgggatgcagtattgcgtgttagaaaggtagtgtgtgtgtgaaaaggtggcatcatgtgtgcatacaacaaagtgaagtggaaggagctgctttaccttaaaatggaagaaattttcaaatgtatcatcatgatattgatattctgattaaaactgaattctagatagttttagtttatatgtatttgtagtttatatttaatctttaaaaaattcacttctttgcttatattcaaaatatcactggttagtgaagtatatgtaggcatagtgaatataactaccttttcaagaaattagatgttagaaaatgcaatttaaaaacagactgtgtaacagg

SEQ ID NO: 45551 - DNA, 1026 bp, Homo sapiens
acacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattggagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaattaaatgttacataactatgaaaaacgagtgctaaaagaaagttttattgaaaactgtaatgaacacattttaaaaacttgataaaagtaagttgctagaaattgctactatgttaggtttaggtaaaacacccataaaaggttagaaaaagatatttaagaatattcatgtctagtttgctcttggatttctcaaatgattttaagttctcactgtttaaagaaattgaaactgaaaatcataaatacccattatggtcatggtttatttaagaactgtgatcagtaaatatatatgcaaagaaaaggccttggccctatgttaaaatattatccaattaacatacatttctgtttaatggtaaaagttaatggcatttgtgtccgattttttttca

SEQ ID NO: 45552 - DNA, 1132 bp, Homo sapiens
aaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatca

SEQ ID NO: 45553 - DNA, 1068 bp, Homo sapiens
atattaaacaacagtgttgatttcttactgcaaaatcttggctctgtcaacacacagtccccacttccaaggaagtcacaatctaatggagaaaacaaacctgtaaacacacagttttaaaaggcttgtgtcagggtatcttccgtaagctgagtcgtagataaatggatgttatttttaatgctttttaaaaaatgttttaaatattacataatttttagaaaatgctattatgaaggtatgttcattataggtttcctagatgatagtagcatatataaaatcctgagggacgagtagctgtatactaccaacagacaaggtgatttaactgagtaattggaccttaccctgtggtcattctaaagaggattgatgtaattaatttggaataataaataataactactacacaaatttgtaggaacaaagaaaacattttaaagtgctttgtaaactgttaagtactatataaaaggatgtgttactattagctagtgctaatatgattatgtccttcctctgtatgatctggcggttgcccatgtctccagctttatcttgagcccttctccctctcactttgtgagctgcctatgctggcctttgttgaataccctaaattgccatgctgcttcttaaagctggcacatgctagtccttccactgggagtgttcttccctccttgcctcactcttgcccccattaaactttatcatttatcaattccccacaaagctcacctactacaaaaaagccttacttgaccactctactacccccttccctttcctcatcccccaccaaaattgaaaaaaaaaacccaaacaataaaatgaagcaacaaaacacacctgcaatccttcgattatgtattctattctaatactattgaagcacttacccaattgtgttttgttttaaaattttgtctctcctaagatgaaagggaccaggcctgtttcttcactgtcacttccctagagcctgacacatgggggcggagctcagtaattatttgatgactaaatgaattgttaatgagattaataataaacactaacaca

SEQ ID NO: 45554 - DNA, 1047 bp, Homo sapiens
ttgaactcgggaggcggaggttgcggtgagctgagatcgcgccacttcactccagcctgggtgataagagtgaaactccgtctcaaaaaaaaaaaaatcagaaggatatgagggtgagcagggactctttaagttcctgagataggagcttgcctttcatttttgaggagcacagggatgctagggagactgagtaaattgggtgagggagagtggagattaagtcagtggcatagctggggagaaggcagatcatgaaggatcatgtaggctgtaataaagtcttggagttttattctgagtaaattgggaaggcactggaggtttttgagcagcaggagaagaactaagtgtacaagggaagaagcagggagacaacctagaatgctatggtaatattctagagaagagatgatggcttgaactagagtagtaatggcggagatagtgagaaaggtgaattctaggtatatgttttaaattgaacccaataggatttgctcataaattggatgtgtagtgttaacaaggcagctgagtggaaggatactacagagattcctagtctgaggaaccagaagaatggaattgccattctcagaagaagaacaaacaggatgaattggtagaaaatcaaaagttggattttggccctattaagattgaaagacctaattaaatattaagatgagaatgtcacatagtggatgtctagggatagtgaaagtggtttgcagggaaagagaatttgtttgggatgtgacatttttaacctgagaagttaaatgatttaggttgaggattgaagatttgtaaaagtggatatggcaaaaggataagaaaatattttattgcacctgtgatgccattagttgcatatacactgccacttttttgccatcgagagaaagaaaacactgggggcatgccaattactgaatcgttaaaatgtggggagaacaacggtcttacagtcaatgaaataccattgtcattttgtagtttagaagggcctgataggctgggatcaaagaggtgggtagcctg

SEQ ID NO: 45555 - DNA, 1058 bp, Homo sapiens
ggtaagaagttgaggttaaagaatggattttggaatttgaagatttcgaggtgcagctgctccaggttcagttaatactttctagatgttgtacaagacccatgatattcctgttggtagaggacggtggagagtatataacgtggccaaataatagagcttcttgaaaagtattttagcccctccacttcatttaatttcactcattaaatgagacccagatgaaatgaaaggcctagaatttaagtacttgcatgagatcaaagaactatttagcatttgaaccaagattaggccacagttaaagttttgtaactggaaggcagggaatttttagttgaacactgaaactttgcttcatacattcctgtctaagatgttatacattgttcaatttgaaaacacttctgtttcaacagcctcaaagagttgctgagagctaaattaattgaatgtggctggaaggatcagttgaaggcacactgtaaaggtaatcagtttcatttggaagataaactaatcccatttttctgatcaggattggtttgggggttgcttattttaaggtatattgagtattcaagcatgattttaaacaaatatggaatttaatcttgtaatggtttcctcttggtggcatatgtagacctaattcccaaatttttagaaattttctgtttctgttaagcgtgagcacttaagattttctctggcatcagaatatggaatctcatgtctttcagcaactttattgtttcttatgttttaacttaaatggaacactttagggttggcagacttatagaaattatctctttcctgtctttaacagtgaatatttgaaaaattcatctatgaaagctcttagaatgcacttaaaaaaaaagtagaagggaagcttattaaattgctgggtattgttgatgataccatttgatggattatacatgtcactaaggggagcctcctttctgtctcagcttttgatataatggaactctggatatttttaatgaatccccattgtaatggtttctacaaataaaaataaactatat

SEQ ID NO: 45556 - DNA, 1050 bp, Homo sapiens
ttcaaaaactctccttttcttcatctcttttgttcatgtttctattagccttttgatcttttccttatcagtgtgaaacaactgtatagtagaaagatcagcccttttctggaagaacatttcctcagtttttatcttttggccttgcttatggtgatttttcattcagcataaattgttactatgttttaatcaaatttatccatctgttatagcctctgtatttaaaaatggtcttctttactcctaaagaattttctcacgttttcttctcatcaacatgcagtgcatttaggcattggatagttcatttaaaatgatgaattgcaagaagacacttttctttgtcagataactttaccttttttttaattgaacatgagggttatttatgaaattcttatgttgtttaccctgagcaaaatgtcagatcttaaattctcatgtattaattggtaccttcttactcttatttttttatttttgtttttcagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtttgcttggattttgaaatgaatgggactttgtctttattactaattcaccaaatttgttgagcgcaaaagcaattaatgtagtttaagtatttagtatgtacagttctctgtgttaacagctgagaagtaagcaaccttttctgactgcatatggtgtattcctcttttgagtccccataatattttataaattgtaatgccccatcttgtactacagttgtcttattcgtattgtttataaactttgagggttaggactgggtcttactcatctttatgtgccttc

SEQ ID NO: 45557 - DNA, 1037 bp, Homo sapiens
ttcattatgggaatgttttaaagtggttaggtgaaattcggaataggtatttctgtctatactacaatagtgttgtttttatatttaaaaaaaaatcctaagaaaaatcctaaaaaaaaaaaatttttttttctgtttgagtaacattctagaatatgcaggaagtcaagagcaggtaagtcatttgctttaggacatcatctgtagacttcagttccttctgttttgtcacacgatcatacccaagagctatgatgtctaaaatgtgtgctgaggcacctcagggctttacatgaaattcacagggatgccatagaatattttaaattttgcagtgaaacatagtgatagcatctgttgaatacctcaactcaaagtagttcacatttgcaacattaaatcctgcagtatttttttatgatggtgttctttaatgtttgagataagtttttgtttacttatatttttggtgacatctcattgcaaagccaggattttaggttgtaattaaaagcgagtactgcaccaaaattaatgtagaactgaaaacaagaatgatggtctccagtcttattctaaggcataagaagctgtgcagtgttcaacaggcacacaaatttcattaataagttcagtgattgtggttatttaagaataaaataaaaatattactttttctttaaatgtgtattttttacaatggctactaagcagttaggatatacttaagttttttgggtgtaactaccttattcagtggaattgttaggtgtttctgtggcctaagggtactgtgaaaaagttacttacatactaagaggagggtatagtaaaagaggaaatggacagcaatcagctctttttttaatatatatagacatgacttagaggttacacacaacaatttttgcactgcctgctttccagagcttagtcatatggccccctagctgcaaggaaggataggaactgcagtctctggctatatgaccatttgatagctgctaaattgaacttattgctaaaagtagagtggt

SEQ ID NO: 45558 - DNA, 1062 bp, Homo sapiens
atgtggaaactaaagtaccgggaggttaaataattaggtcagtgttgtaagtttcatagtgaaggatctggccgggtgtgatggctcatgcctgtaatcccagcactttgggaggccaagacgggcagatcacttgaagtcaggagaccagcctggccaacatggcaaaacctcctctctactaaaaatacaaaaaaactagatgggtgtggtggctggagcctgtaattctagctactcaggaggctgaagcaggagaatcgctgaaacccaggaggctgagattgcagtgagccaagattgcgccactgcactgcagcctgggaaaaaaaaaaaaaattcgtagtgaaggatctgaatgacttccagagatctggctctagagtatgggctcttgaccgttaggttatgctgccccttagaaaacttatatgcttatgttttataacaaataaatgtttagctgatttattgatttgtttatggtggaagtggaagagtaagcagggcctggggccggggctggggccatagacctctgcaggctggatttttagaattcaggatccctgtcagcaaatatttaaggccagaagagggttgagaccatctgccttatagggttatttagcttaatttctgtctgtatcattataatcctaacttatgatattttaatcttctaacttcatggtctatatttcctgaaacatttttgataaattcttttgtttctacagaaactcaaacagaagaatcaacagctgaaacaaattatggatcaattacgaaatctcatctgggatataaatgccatgttggcaatgaggaactaagctgatatttaaatttcctgctttacacatgttataccattgttttttccctcaagtattttttccctgtgaagaagattatttatctgcttttattttagtcactaaaactaaagtttttatttttacattgtgatttttacattaaaatattaactttttttaatgctattttatgaaagattattgtaataaactttgatggggtttgtattttggttaatct

SEQ ID NO: 45559 - DNA, 1035 bp, Homo sapiens
aaattattctaggttctcagcttgaattttgctccttttatgaaattttcttgcctatcttagttctgtataactaaggggagtgtggctttatgaggatgattttatcatgagtaaaaatatgtaaagctcccacacggatttccttaccatttatttatttatttatttctgttcttaattacctatttctgttctgattctcttaaaagtacttaataattactaaacacgatgagcttttctcagttcttatctgctttgactttttgaagtatttcgcttttttgaccaaccgtactttgtaaaaatctttcctcctttagcttctactggcattatacaaatgcatttactgactttgatagttatcttttcttttattcctgcttcttgtcctttactggagaatgtcctttaaacgttctgaaaatggagatgccaaaacagaccaatacctaaaaactgaaggaagtttctttccatgcaaggaagggtctgctccttttgataattttgtagttcccgtgactgtacaatctgcacctttctcttctttcattagagaacctcttgtctctcggtgtcaaataacaccattggggaatgatttctaatatgtgtatgctactctagcttgttttccaaggcctagtaatactcattaattttcaagttggtataattttagtcaataccactattattgcaggaaagattttctttgatttgtacctcaaatgtatatgtaaaagagctcttgggagtattccaggggttctcatgataaattttacttcccccttgcgtgtttagggtttcttatacacacggtccttgttttgtatgatagtgttgttctttataattgattgtgcaaagcaatcctaatataatcaatgagaaaaattagaattgtcccatgacctttaatatcttttgtcaaaacattaaaaattctcttactgttataaaattttatggaaataaaaaaatagtaaaaataaaatttattttgtaccctgtaattttaaa

SEQ ID NO: 45560 - DNA, 1005 bp, Homo sapiens
cagcgcccttgaattttgaggaatacagttttaaaatcagtagcttatacagtacagattttctatttttctgtataagaaacaggagagatactgaattctattttagcagatgttgaatttcaaatgtaggtaagatatctatgtggaaatttaaatgtagagtttgaaatttagatacagatctctaggtaatagtcagggctggagatctagattttgagttttccagcagttttgtttatctattgcgtaataagccaccccgaaacttagtggcttgaaagagcaaacattttatttgcttatagtttgcagtctgagctgccctcagcagagtagttctactgatctcacgagaagtcattgatgtgggtgttttgaacttgcagatgatttggaggctgggttcagtggagctggctggctttctctctccgtttagtcttagagccttttccttgccacatggtcttctcagatgatctctcctgcaagttagctggaatttttccatggtggctcaggacaaacatatagaacttgaaactaccaagactttttaaggcttaatcccaggactagcccagtcttacttctgttacattccgttatttagagctagttacaagaatagtctaaattcaagggggaagtacctatccaaaggtgtgaataataggaagccaccaatgtaaaaagtctaccataggtgcctgtaagttaggaatgtagaatgttagttaggaatggttgaaaacaacaatacataaagaacatggctagagaagagagccaaggatagggtctttagaaatatagtcatccctcagtatccactggggattggttccaggacccctgtggataacaaaattcctagatgctcaaacccctcatataaaatggagtaggagttgtatataacttctgcacatcctcctgtatattttacatcatctctagattacttataatgcctgatacaatgtaaatgctatgtaa

SEQ ID NO: 45561 - DNA, 1128 bp, Homo sapiens
atatttgttaaataatgagtgaagtatatatttctagttagtaataactgttctccagacagataaagaaagactttgaatggactccatccatgtagtgtgaaccaaaatttgtgctccaatttttatcagtttcctaggtttcatcctttgatgaaataaaaaatatgtgtattaatttgaaccatctgatgtttttttatatatcaaaaattgttacttatcagcaatttcacatagtttgaacttaaatggacaaacaatgcccaatttgaagtatggtttaattataatagtaaatgaatgccttttaaaattggtattcaataaaatacccagaaattatgatgatacaggaaaaatgcaaaagcactgtacaaaaaaatgaaattaagtcaaccttattacatttcaaaagaaaaatgcctatatgtaaaacttttattgagaagacagatgaatagtgaaaaatggctggcttgccgtgtttacagagatattttatgaaattgtcaaaaaattgaatgatcatctgcaacctaaacaaatcatagataagtaataaaaaattgtatctcccattattgaaagcctactatgtgccatatgctgtggattcattatctttaattctcgaaacaatactgagaagtaggtttttaaaaaaacctttatattacaattgagaaaaataaggtaatcaaggaaaccaagaaccttatctaatgtcacagggtggaattagaatttctacctaattttgaatgtatctaaaggccatgcatgatttcttttgtcacatcatgtatacttttgttgaaaataatttttagaacttggtcttttcggccttcgataaacttaaacaccccttcatgctaaaactctcaataagctaggtattgatggaacatatctcaaaataataagagctatttatgacaaacccgtagccaatatcatactgaatgggcaaaacctggaaggattccctttgaaaactggcacaagacaaagatgccgtctctcaccactcctattcaacatagtattggaagttctggccaaggtaatcaggcaagagaaagaaataaagggtattcagataggaagagaggaagtcaaatt

SEQ ID NO: 45562 - DNA, 1041 bp, Homo sapiens
tcagaaaaagacatttatgcagccaataaacatatgaaaaaaagcttatcctcactggtcattagagaaatgcaaatcaaaaccacaatgagataccatcccatgccagttagaatggcgatcattaaaaagtcaggaaacaacagatgctggagaggatctggagaaataggaacacttatacactgttggtgggagtgtcaattagttcaaccattgtggaagacagtgtggcaattcttcaatgatctagaaccagaaataccatttgacccagccatcccattactgggcatatacccaaaggattataaatcattctactatacagacacatgcacatatatgcttattgctgcactattcacaatagcaaagacttggaaccaactcaaatgcccatcaatgatagactggataaagaaaatgtggcacatatacaccatggaatactacgcagccataaaaaagaatgagttcatgtcctttgcacggacatggatgaagctggaaaccgtcattctcatcaaactaacacaagaacagaaaatcaaacaccacatgttctcactcataagtgggagttgaacaatgagaacacatggacacagggaggggaacatcacatactggggcctgtcagggtatggggggctaggggagggatagcattaggagaaatacctaatgtagatggtttgatgggtgcagcaaagcaccatggcacatgtatgcctatgtaacaaacctgcacattctgtacatgtatcccagaacttaaagtataataaagaaaaaaaaaaacttggtcttttcaattttatgtcttgatatttgtggaaataatttatcctcatgtagcagaataatagtatctgacaattttataattctagatgtttgataattttagaactctaaactccaatattgccttatatttttaaaattggaattcttttgaaaagaaacatgttaaaggcactcttggagaaaatcatatctgattgttttgttgactaacaattcttctaataaaaa

SEQ ID NO: 45563 - DNA, 1037 bp, Homo sapiens
tctcccaaaattttaatttagttttgtttattctgtgtctccatctcgctactcttttttttctgctgtttttaatttactatagaagaaatcttgatatatacaaatttataaaatttgtcaaggatatgttcttcatgatcatttatcaaaatattaaattaagatttatttgagtactgtgtcctgaagggcttaaatctacacagagctttattaacttatacacatacaatgttatgaaattctgattcactgtaaaaagtatttctcttctccactacctacctactcccataaacaaataaacaaatctatctgtgactcacttttttttactgtaaatttatgctcattaaactggggacattgagactaggctgacaaagttgtaggaggtgagcaccatgaattcagaaacatgtttttttcaagaagatttgggtgtatagtatgagaaccgatttatgttcaacatagattatggtgtagaaacaaagtcaagtaacattttaaagtaaatatgaaactacaaagaaagttctcttacgttattgtgggcctttagaaccctggagctctttctctgatacaaaggaatatttggaaagaatgtgttaatggcatgggagcaaaacaatgttttttaaggcaagttaaaatattaaccactgttggcttgtttgttttttcacttatttaccctatcctggaatttaagatgccattaattgtaaaatacactgttttattaaacagctaattaaactctgctgtcatactctgacaatcatttgatcacaccaggctctcattgctttgaaacttccttcatctattccaagagatttggcagttccttctgccttaattggtattggttggtttgtgataggcagtattttgtgtatttcttagttacaaaacaaaaacagcttcattgtcttatgggtgtttttctttgttaggacccataaagcatttgcttattgttttgtaagaaaatatggaattgtggtcattcatccaacaataaa

SEQ ID NO: 45564 - DNA, 1051 bp, Homo sapiens
acactcctcagcaggcctgacatttatgcccccacagccatctcatcccccacagcctggttcactctggctggtgaaactgagcaaatacaaagctccctacacaaccagatgcacaaagctccccacatacccagacacagcacaagcacatggtgttcaccatgttaagaacagcaatagccacagaaaaagtaagcacctactatgtgctaggcactctgctaaacactttcccttcacaatgtcatttaatctgaccctgaggagtaaattgagagtggcagtgtaattccacttaaaaggtaggaaaaatgggctagcttgatggctcacgcctgtaatcccagcactttgggaggccgaggcaggtggatcgcttgagctcaggaattcaaggccagcctggacaacatggtgaaaccccatctctacaaaaaatttaaaaaactaaaaaatgaactgggcgtggtgacacacacctgtagtcccagctacttgggaggctaaggcaggaggatcgcttgagcccgggaggtcaaggctgcagtaagccatgatcacgtcactgcactccagcctgagtgagagagcaagactctgtctcaaaataataaaaaataaaaaaagataggaaacgaaagctcagaggggttaagtacttattcaaggtcacagaaagaaggtagcaaagacagaattcaaactcagctcagtctgattccagagctttctgttattgtacgtaagtcttctggaagcctggcccacatcagcctggaagaggtgtgaggagaagggacggttttagatcgtgctttgggatagtctgattgcttttctgataaggggcataggggtgcatgccttcctgcatgagtgtgtgtgcacgtgtgcgtatgagagtttagtcaaaacaggagagaattacaaatccgcctctgttatctacagctcccccaaaccacccctcctcaaaaagaggccattgtaaagcctctatcagtgtctccaagagaacattctccaggggcattgcgccctccgccct

SEQ ID NO: 45565 - DNA, 1075 bp, Homo sapiens
cccaaagtggatgcatcatttttatgttcccatcagcagagtatgagagagttctgattttgctgcatctctgtccacccttggtattgtcattagtcccattttacaggtgggggaactgaggcacagagaagggagggtcccatggctagggaggaggagcaagacacacacacatgcctggtcattggactacccagggccaggactagaggaaagcaaatgaggtacccagcgtgcaaaatttaaggtgacacccactctcaggttcctacaagtgcagggtggcacccgagagtgtgtccttaaattttgcttcctgggtacctgattcgcagcgtacctcaccccggtccaggccctgccaccacccagctcctagtgtatagggcactgtgctcactgttgtgggggtgaacacagagatggccataccgctgccccttccctggaggtactcagtgtggctggagaacccatgcatctgcagtccccacagttagcctggctggacttgcagagcctgaatcgctgctcacagggttgctgtgagaattacaggggatcatacctgtgaagcatttagcacagtgcctggcacctaggcatgccctagaagttctggctggtgtcatgttgtcattggcatatgtctgaccttacctcctgtgaggatacctctaagtccctataggttgagggacagctatgaaaggagaggccatcacccagggaccaggaagtggcctgggatgaaggaaactggacatccaggccctcttcagccccactgatcctgacctgggcatcataagtcccagccacagagcccagcactggctccagttgagcttaggggttcttctctgggctgtagacactccatgcctggctctgttatctccaaagccagagtgcattgccgtgctccccatacatgagaaaacacctgctggatgatacttggggcagccatagtgagccaagtaggggccctatcatggccttttttgtaaccagctttgtctgctggtcttcaagggttcagttcagggaagggagcactaactgatct

SEQ ID NO: 45566 - DNA, 1032 bp, Homo sapiens
actcttccagagttgacttttttttccatcttttttttttttctaacaagagggaaggaagaagtcttattggaaggaatacatgttgtgtcatctgtcaccaatctctcccctcctccatgccactgaggttctaaaataccaaatttgttcatgtttcactaaccgcctaaaaacctctcctggtcactgctttcctaggggtcagaaacccaaatgctttcaagagctttgcaggtagcataaaagagtgaaggggtcaagggtagaatagtaggaagcagtgggagtgggtcagactagagagcatatctccagtctaaagatatttagattttttaatggactctccagtccactacagactgccagttgtaatttctgacccataggatcaagtccaaattcctgaccctgacatggtggctctttgagagctgagctctacccaccaggcatgttttgctctaaagccttccacctcttccacataccccacacttcagtcatatcagactgacccctgaaccccaaatgcactgtcctctctcccctttcattctttctcttaagaaagactcctgtagttccttcttcccagaaagactatccccaagcttagcaaaacctacttttttctactctggagatatttgttctcttctctaacaggccagtgtaccatggaaataacctgttagaaatctaagctggtggattttgatctgtttgtacatctgcatccctgaaatactatgagccacttctccaccccaagggaaatcttcctgtttgtctccgtgttcccagcaccagcacagggctggcccacttcataggctcaaaattaatgtctgtggaatgactggatggttatatgaatgaggaagtggctctgtcactacagcctataggaagttctatgctcctgggttggcacaggtgcagaatgagttgctgctcgctgctgcccctggtggcaggtcattgccacagcctggaaggactgtcactggactattttgtaacagg

SEQ ID NO: 45567 - DNA, 1102 bp, Homo sapiens
tccatttatttatatatttatttattttttgagacagaggcttgctgtcacccaggctgcagtgcagtggcaccatctcggcttgctgcaacctccgcctcctgggttcaagtgattctcctgcctcagcctcccaagcagctgggaccacaggcgtgcaccactgtgcctggctaatttttgtatttttagtagaaatggggtttcaccttgttggttaggctggtttccaactcctggcctcaaatgatccacccacctcggcatcccaaagtgcccggattacagacgtaagccaccacgcccggccccatttattcagtcattcattcaacaaacattcattaagtgcttggtaaatgcctggtgtggtgctgaatgctggggaggcaaggataaggaaaacctggctcctatcttctgggagtctccagtctcctgggaggcacataggcaggtgcacaaggtggcccatgtagtgaaagaattgctaggccggaggtatgcaaaaagcagctaggacatagaataagcagtgcctgaaaagacacaagaaaggagcccagtgtctcccagtgaggtgttttacttgcattttcacacttgaacatcatcacaaccctgcaccatttcccagctgaggcaactgaggttctgggaggtcacctaactcccttggggttacctgcccatctgtagcccagccgggactcaaacccaggtctgtctcactcaaaagcctgttttctttccaacatacaatgccgtgtctggagctgaaactagaacacagggccatggattcccttgtgcacacagcggccactctgttgcctgaatacgtgcatagcataaaaccagccccagccatcccccagctgtagactcagtgtgtgttcctgcccctggaaggttacctctgaagtcccttcatctaaactctttcattctgtgacactaagaatcaggctgtcttagtttgggtcccccagatgcacaccccaaggcaaagcttcaagtgcaaatagtttatgtgagaagcaaaggaagcgctgggtgggggtgggggtggggcagcaagtgggacctggagagaaggaag

SEQ ID NO: 45568 - DNA, 1032 bp, Homo sapiens
tatcacatacggtcattacatcattcagtcctccaaggattctgggtggtagacattcttgtccccattttatagatgagaaagctgagatgaattggtgaagcctaaatgatttgcttagtcatactactgataaatttcacagagagagaagactggaaccccaatccagacccaaagttcgcactactaatctacactggctgaacagctgcactctgaatatagcctttgcaactcccagaggcaacagatcatgaaagcccacatgcataaagagccaaggcagcttcctggggtatctacttagactcaaaaaatattaagtaagccagttgctaggattggctctctactaaaaagattgtttttattctccgggaactggctggctgcatctgtttcactgttggattgctgaagggttgacacccactggccacatttaggagttcatgttgatattactgttgtgaaaaagcacatattggtcctcaccatctatatgactgtgattatttttctctcttccatttcacgcaacttttgctcacagcctacttggcataattgacacattggctcaggccaccaagactgccaacttggagccttggattagttagatcagttatgacagatgtgattatttacaagaaaatagaagtcactataattaaaccttccaaggagtacatttgggtggagaatgagaaagcacaagtttaatctggcatgatgtgtttggatttcagccctgagcaggttcttctctagctcatgaaaggaggtattggggtgtctggcaccctctgtagacactgccatctctcaattctcctgacacagctattgataaatggaaagaccaggtggtagagttagcattagttggggtacccagtagaagtgggtttagttctcagctcagccactggtccctggcatcggtttgtttttttaatcataaatggggataaaaacataatccctacctcatcctaggtctgggaaaattagcagtgataaagt

SEQ ID NO: 45569 - DNA, 1033 bp, Homo sapiens
tgctgtcttgggattgatacggagaatagtcaccagacgacggggctgagagagggatgcatttggggtggcagaatgactcctgattttatgcatttttataagctgaataagaatggaaggaaaactaaaggaagcttcaactccacgagatggttttatgggtgctttagagcctttaaaaataataagaataaaaatcagctgtctccgaatattaaaggtgtctctctggttccgaaaggtcagccaccctggcttccaaatcaaagccaacggccaggtgcccacacaggcccgtgccttgagcctcctgccaaaaggtttcttagtgtgtttttatgtctccctgacatggaagcagcagggatgtttccccagcccctaaaacctctgcacattgtgctcacccagcagagggtgatgattcaggaggagtcagaaataaagaaaggaaggagtgtgcagccctcgccatggaaagccacacagccgttcacatctgggtagcagtgaggggtgggcaatgttctcgcgaattctagattctggaggaggggtgcgctggttctgcagggaccaggagtccctctttgtgtccttggatctgctggcaactcctgggaaccagctgccaggcttcctgacttgctgcccagccctgcatggacgggaactagagttctgctgggcgctgggatgggatacaatggaggtgcctaggggcttgttgggggctgggccagctccgtgggcatctgtgcctcctctgtgagcaggctaagctatagtaagggcttatctcctttgttttaacagttggggctttggcttccatagcaatgatttgcaaatagggtaatttattggcttctctcctcctgccttgataaatctcatatcttacatcctttggagcctcatttgaaatcaaacacttaaaaaaaaaaaaaaaggagcactcatgcctttgttatcttttggacacttctcaaaagaagatccctggaccccataggatgcaggcaacaca

SEQ ID NO: 45570 - DNA, 1071 bp, Homo sapiens
tagcttgtgtacttgtgtacttataagttcacctgtgcattggctcactcgctgatctcagctccatgaggacagaggacagagcctgtcccatgcaccactgactctaagtgcctagaacaaacagggcctaggaaatgctcagtagtgatttgctgcatggagagatattgtccaatgaaccctcacccacagcccatagaactgaaattctaccgaacatgctcggggacgtgctgttctctgtcaaccctcgcaacaagttgtcagccattgtacagtgcctgttcccctcttccatcaaaatacaaagtgtcagaactggaatgtaccttagatatcatccagcccagtgcttatgtttttcggagaaagaaacagagggtccaagaggatcactggtaccaatatagggccggtcccctgggtcccccatctcttggtctgattgtcctcctgtattagttttctatggctgctgtaacaaatgaccaaaaactgatgatagaaaacaacagaaatttgttatttgacagttctggagtttgaaagtccaaagtggacctcactgagctaaaattagagtgttggcagggctgttccttctggaggctctggaggagaatcattttcttgccttttccagtttccagaggctgcccatgttctttgacttaacagcccccgtccatcttcaaagccagcagtggtcagttgagtctttctccagccgcatcattccaacattgactctcctgcctggctccttcattcataaagacccttgtgatcacattgagcctacctggttaagccaggataatctccccatctcaagatcctgaacctaatcgcatctgcagagtcctttctgccatgtgagggaacataactgcaagttctggagattggaatgtggacatcttttgagggtgatggcactattctgcctgctgcacctccagtcacaccatctgcctgttggtatatcctcttgcacatgcacattctcccctgatgacccccacaccttctgtgccccattgtcacagtacttgtcacattgcttta

SEQ ID NO: 45571 - DNA, 1053 bp, Homo sapiens
gcataggcagattgtgaagtggagccctgttggtgatgaagaagtgggtttgacactagggagagtctgaatgtgccacattgagggacggaagcatgttaagttttcaatattgtcagagctatttgaaccagagcaactccatcttgaatggaggctgggtaaaatgaggctgagacctacttgtaaggttcttgtatcagttcaaaccctgagcgtgtgccgacagacaacaggaggcggtgtggagcaacttgctgttttaatgagagcctgggtgcacacgggctgaggcctaaaatggcgtcagcaccaagtgaggacggggcaaaggatttatagtgtcctgtaaacaggaagtgtcctagtctgatgtaactgctacgttgtacccagatggcctgtttcttgatcttcaggggtacgtgtcttccagctggccttcttcctgcttctgctattttgctggcgcacactgctggcacaagtagccttgcaccttgggactgggcctgagaagggaggagttattcatccccttaagctttcaggccccggggagaatcttacattcctgtctatttggttatagaaaagggaaaagggacaactttcttaataactacttcaggcgggacatagggggtggtgtgggcacgttggaaaaagaaaaccttaatttttaggtattcttgagagatgggttggtattcaccatgtcgttgtagcaggagcatcgcctgcattgtctggaaatatgtctgtgcctgcaagacagttatgttgagaggacaaggaggtgtcgacagggagaagcatggcctcatctgctgctttatgaatgaaacaccgtgtctggattaaggaggggaggtaattactgcgtggctcagagtctggtaaggatggaggccctaagacaaaagtttggccatacatgattttaaagggactataaaaagagggtgcttttggtgttgcacagtttcatgagggcaaaagggagatgttttgtccacaactggcgggtttctagagccagcttggtgagtt

SEQ ID NO: 45572 - DNA, 1047 bp, Homo sapiens
ctgggaagatggcagctgagaagacaacgaggaggcttgcaggggttaaagaagatggttgagaggaagaggtaagggctgggaggggtggacagcagtctgctggatttaatgaggaaaaagaggtagggtcgggaagagaaaggcgatcagggtggcaagaatggagaaggatttgaacaggtaagaaagaattgcagaggttgggttgtgatttgagaataaaaaggcctggacataaggaacttctcatttcttcagttgtcagcaataattgcttaagtcagttaaaattgtaaagttgaatgtttcatttgcgggccatttggacccattatttaattcgtattgtggccagactgaattgcgaaaaagacacagcacttagggcagatatcttgcctgaggcctaaggtttttagggtttttttttatgaggcagcctagagggctgtcctttggagtggaagactgggaatttcccacaacagagggtaggctgagagaacaaggaagaggagaacatcctggacagcaagagggggacaataaaaggagcaattgtcactgctgccattttcgttcccagaacaggatctaatggcttagaggcacccccctaaggccagatgatcagcaagtgcctgacacacaccggaaccttcttggaccaacgttggatttttggaccagagaaatcaagagaggccatgtggattttcccctgttaacagggctcccgggaaaacttaccagtaggcgagatcagtgaccgatgtgcatgcacagagaggcaactggaggctgaggagcttcctttgtccggctgctgtggcttgctctccggggtggaggggtaggtccacaggggatgcagacctgagcccctccccggttttggcacctgacttaaggttcttgtatcggttcgaacccggagagcgcgcgttcgaaccaacagacaacacgaggcggtgtggagcaacatgctgttttaatgagttcctgggtgcaggcgggctgaggcctaaaatggcatcagcacca

SEQ ID NO: 45573 - DNA, 1124 bp, Homo sapiens
aggtgcctgccaccatgccagctatttttttttttttttgtatttttagtagagacagggtttcaccatgttggccaggcgggtctcgaacccctggacctcaagtgatccgcccacctcagcctcccaaggtgctggggttacaggcatgagctactgcacccagcccctagacaaaacaatttctaagtctaccttcctgcatcctactttgtggtcttatatcagcaatcttgttttatatcagagggacaaggagtagtcaaacctcattaatctggaccactttaggagcaacccaagtgagtgaaaagtcttcagcccagggtgtttcctgcaggcagttgagccttcttaccattcagtccacagactcagctcagcccagctcaccaactggtgctaacggaggagccacaggacctgtgcttagcaggtctgaccacatggctgaatgcacctgacctgtacttttaagccatttactctctttgcatgcttaggaataaataccactgaaactctaacagaagcagtgtgttttttgaatagaaaatcattcaatgggcagctttgcttctatttcaaattgccagggaatttgaattagagaaactttgtactagctgggaataagctgtttttccagagttatatgcagaaaatgagacaaaatagttcagaactaggtttcccctgagtttcctgatctgtaaaatggggaaataatacatctcacagggttatttgggagagtaaatgagataaaatgtggaagagacgtagcgtgcaaactcgctcacaaaagatggtcaagaaatgctatttcttttcccccgtaccacctcccatctatcttcacactgaaagcatagcttttttcttgcaatatgttcaagaaatgatgttacagatagattttttaaaatagcatcatacttttcaaatgactcctgttagtttttcagaggctcttcctttttattgctgatgatccttcagtgggaaatgtccacttaattcttcagcctgagttcctctgctctggtcttctgggtggaatagctccaagggtcctgacatgcatgtggacgaatgtctttgtgacacgattgagcctttta

SEQ ID NO: 45574 - DNA, 1024 bp, Homo sapiens
tgttggctcctccgtgcctttcagagcatccgcctggctcttttatgagattacagacgctttcatctcagctttggcccggatttcctccttcccagcaaggctccaaagactggcaacgaggcgagaacaagaagaggaggctcattcctggctgcatccctgctgggcagggtgacccggcctgcacatcttccagccgcatccttttgagccatcgaggctgagaagggagcacagaggaccaggttaagaggggcccttccccttggcgcctggaggaagttgcattgcatcctgggaacgctctgatcatcccctttgctttgtgcctttcacttcaatccagtggagaggggcttcggtgcctttctttttctttttctttttctttttttctacctagaggtacttttttgaggctcgagactgagaacgtaacacatctcttgcacttttgctttatgtgtatgtgtacacacacaccctcagttctttgctgtacttgctcaccgtcttgctcttcaggtttccttttctttaaaagcccaagtagtttccttcccatattgttctcagtgaaagaaaaaggagcgtctcttctctcctaaatcctaattccttccttccatccatcctatcgtttaaccttttcttccagagccaggactttgtgtctgctcctaacatccacatcccttccagatctgtctccacactccccaccccttctggcttcgtctcctgccactgtctcctgacctccatccaccccaaatccacacccttccctgacccagccttccttttcatgcctctgttcttttgctcatgcatttctcctgattttcaagacccacattcacaactgtgcctggctcaactcttatctctgtgaaaccctccagcacctctgtccccagtcccccccaccaggcagccagtgacgtcctccctgtcatccagcgcattcatcccacgcagtgttataattatgacctgcgtttctcagggctcccagcct

SEQ ID NO: 45575 - DNA, 1050 bp, Homo sapiens
ttcttcactctaaaaaggcaccgagaaaccatttcctgcccctgccagagttgggagtcctggccctgtccccatgagaccacacagcatctacattatgatctgccagaacccctgacccaccacaatgtcctccatccccaccacacccaagcccacagtggattctgcaaccatgagaatccctctccccaaaccctcatctctccccaccccatgttactttctaccatggagccctagcagtgctgcctcacacagtgatttttattgagacaaccctgtccaattatacttgtcccatcctcttgaaatcagacatagatctttgaaacctaggccaaaggatgacctgatgaagatcaggcataaggccgcagtcagaactgcatttctgtctgatgactaacatggtcttcttaagtcagggtatgtgccttcctaaggatgagttacttcccccaaaaccccttgggccttggaatttaaaaaatcactatcaagcctgtgttgccaaaattccaaatgtgccgtgacatgtctggatcctaaaacaaacagaatataggctacagaggcacacacaccaccactgtgcattcctcacccacagcagacatcaccagtcaatcacagcataggttctcctagtaaggccatcaggattcttctcaacacactgcagacctcacctctactctgaaggctttctggatcctcttgatagaaatgattccactcttttcttacctttcatagccctcaagactctgctactcttgtctgggctcatctagattgtagtaataagactaatggctaatctttactgagctctcactttgacccaggcaccattctaagtgcctcttattaaacttatttaatcctcacagtcatgtgaactaagtaccaatcccatgtgacagatgaaaaaactgagacacaggaattacactgttccaagtcagagactgtgtcccgaccgcctttgtcattccaatcgttcaacatttttattaggcacccatgtgtgccaggcactgcaat

SEQ ID NO: 45576 - DNA, 1050 bp, Homo sapiens
atggatattgaatagtcacaaagtacccccccacaaaatacttattaattatagaagaaaaaaaattatacaatgaagaagcctagcaaacactgccttaatcaaatgactaaagttaatataactagtagtggaatgaatcaaaatttgtgtgccacctgataggatgcagtgaaaagaacacggcatcatttctgtgatattcctcccaagatatataacctgaatctaatcagtgggatcatcacacaaagctaaattaaggacatctaataacaaaactgtgctgatatctctacaagggacaagatcatgcaagttgggtaaagactaaagaactcctaatctgagggggatgaaagggacatgacaaaggcatgaatctggactgatccttttgctataaagaacttattaggaaaattggcaaaatttgattggagttttaggattagatggtggtaatgtataaatgtaatttattggtgctgatggttatattgtgattatgtaggagagttttcttattatgggaaacttgatcttggtaacttaaatagttaaagaaaagatgtgacatataatttacttctctgtgattcattaggtaaaaatctgtaaatcattgtttctgccctttaccaaaaaagtaatgggcccaacttttctaccctttattcttgcttaacttacctcaccaattcctaatcttaaatcagtaccactgtctatttgctaatacttctgaaaaaaataaaaataattgttgattgatttcatgactaatgaacttcaacatcgaggactctttgcacttcatttgcttgtctacggttacttaacgtttcctattctccaccaagtgttgcaaacctttaccaatttccttgtctccttgcattggactctactgttattctgactgccaggcctcctgattcatgggaaaatagataccttcaagctttcctttctccttccccattgcagcctcaagtatattgtaagttcagcccccattaccttattcataaagttcagccctcatta

SEQ ID NO: 45577 - DNA, 1050 bp, Homo sapiens
ttggagtgcagtggtgtgactatagttcactgcagccacaaactcctggacctaggcaatcctcttgcctcagtctcctgagtagtaggcgtgtgccaccacacctggctaatttttaaaaattttttgtagagatgaggtctcgctctgttgtccaggctggtctcaaactcctgggcttaagcagtcctcctgcctcaaccccccaaaatgttgggattacatgcatgagtcactgtgcccagcctagaaatggttcttaaacatgaaaagatgcttaatctttctcatagaaagagtaatgccaattggaactacgttgaagtaccatttctcacctagattaaaggttttttaaaaatcattgataatatgcggccaagagtatgaaaaacaggcatccctttacgcgagtcataggaacgtaaatagacactttttgtgggggctaatttggcactgactttcgaaattgcaaatgcacgtattcttgactcagcaattccactttaggaatttccaagtctgtattctcatgtgaagaatgatacacactgtgtggcacatacagtggcattaagcacagcattgcttataaaagactgaaagcaaatgccctacgatagagatcatgttaaagaaatgaaggtggctgggcacagtggctcacgcctctaatcccagcactttgggaagctgaggcgggaagatcgcttgagcccaggagtttgagaccagcctgggtaatatagtgagaccctgtctctacccgcaagaaagattagccaggcatagtggcatacatacacctgtaggcccagctactcaggagactgaggcaggaggaccacttgagcctaggagtttaaggctgcagtgagccatgattatgccactgcattccagtctgggtgacagagcaaggccctgtttcgggaaaacaaaagaaaaaaaagaaatgaaggtgtatcggtacgaagctatcatatccatctgtaaaatgtaaggaagttctgcatatactgatataaactatttccaagataccat

SEQ ID NO: 45578 - DNA, 1100 bp, Homo sapiens
acaagatgaattagttgggttcttgtgtgtgtgtgtatgtgttacttatttagtggttactgtccaattaaactttatttttacttcatgatcctgtgatacattaatttggatcttccagcaaaacaagataatgtggaaactttttagatatttttaaagaagcaagctaatttattttcaaaggctaatttataatttattttggattttgaagaaaaaaaaaatccaagcagagtttgttccattgttgaagcattctttttctattgtaagaaaagccttcattttttaattttatgtcagaatttcttatgattgtgaaactcttacattttttaaataaattgtctttgttgtaaaacttgagtaaagaaaagctttaatgaatttgcaaaaaaatatatattcttaaagatagatacactttttttaaattcttgttttaattctacctcataattgctttgtcaggtaaatctcgatttaaacaccaagttttcttacagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagaggtaattatggaatagtttttctttttctgatacaatgaaatatgttataaacataagaaagttttaatgaaaaatacatttggctgagcgcggtggctcacgcctatagtcccagcactttgggaggccaaggcaggtagatcacaaggtcaggagttcgagaccagcctggccaacatggtgaaaccccgtctctactaaagatacaaaaaattagccaggcatggtggcacgcccctgtagtcccagctactcaggaagctgaggcaggagaatcacttgaacccaggaggaggaggttgcagtgagcggagatcatgccattgcactccagcctgggcgacagagtgagacttca

SEQ ID NO: 45579 - DNA, 1034 bp, Homo sapiens
aatgaaacagtttcagctgttttaagtctgtaagagtacccactccctagtatagtcaattgtactgcatcagtcttaatatttgccaagcagatagatgacaaatcgtctattttaatttgcctttttttattgttagtgaggttaagtatcttttctgttacttatcttccatgtgtagaattacacattacatatttgtatcatttgtccatctttttgtcaagttagacttaactttctgtcaggttagcttacttatttccaaaaggcaagtcaattgtcccaacaccatttgttgactattatccaagtcatttgccaactgatggtttttacatattaaattctcttacatatttgatctccttcctcgctttttctattcctaagccagtaccacactgtttgaatgacagtagctttgaagtgttttaccaactaggcctagttctcactcattagtcttccttttcagagttttcctcagtattctcaaatgtttatcattccaagtagactctaagaattgtttcacttttggaattctcacctctcccaatcctattggaatttttattaggattacactgactttatgcactaatttagagtttcaagcctagttttgataaaatactaagtattttttaagtcttttttttttttttttttttttttttttgagacagggtctcattctgtcacctgggctggagtacagtggtgcgatcccggctcactgcaacctccacctcccggattcaagcaattctcatgcctcagcctcctgagcagatgggattacaggtgcctgccacaacacccatctaatttttgtatttttagtagagacagggtttcaccatgttggtcaggctgatcttcaactcctgacttcaagtggtctgcccaccttggcctcccaaagtgctgggattacaggcacctggcctaagtctttcaaagtatttttaattcaatagtattagaaatctatcatctctttatagcatgatacttcttgttttgtt

SEQ ID NO: 45580 - DNA, 1430 bp, Homo sapiens
taccttgaaaatgactcattttccagttctgtaagctaggggcaggtgatttagatttttaaaaaatgtattttaagctaattcatttttatgtggatgagaggacatttaaaaaaatgtggtatgggtcatgatagacttttaaaaaatatataaaaaattgtggatggggccattatttcaggatttttctgtagtttaccactatcttgtattctttatccaaaataattaatagcccttttattttgagggaaatcttatgataagtttctgtatcatccaagaagggtcaatttaaaaaattttttgatgcggcacaggggtgtacttggggatgtatatgctgggattggagtctgtaggagcaaagatttcagaaaatctttgtgtttttagcataatctgtgatgggtgctttatagctagtgtcttattcttacatcgccatttgatctgatgtagttccttttatatgcagcccaacttcatttgtcagacctggtcagtatttctgcagggctagagttgactcggggtaaaattactttttttttcttctttttaaaaagtcaccttctctagtggcaacagtgttttaaaatttgaatggtgggagatgtggggtaggagtaggaggggagcccagggagcccaagaatctcagaatgaagcaatttatattacatacttggccagtgaagaataaagccaacttttaatgtgggttttagaaatttgtgttcactcgtgtattgattgataggttcaggaccagttattacttaatgctgagagccaaagcttacaaatttcataggtagtgtattaagagacttattttgaaacagaagagcaaaacctcaagctagattttagcaaaattgtgtgcttgtttgagtatgcatgtgtgtgtatttgtgttccctgagaaagagacttttatttagcagtagagacagagaaaacctttaaaagtgtgctattttgaatcctctaaatattgtcagtacaacgaccctggcattgatgctacgaagaggatggtagagtagtttctctacaatgagatctactcttaaccccttataatgttaagacagatgaaagtaagataagcacatacattctggttctaccgtgggttctggcttagcctgtgataaactaagctaaatgcaggaagaaagctcacccttgaacaacatgggtttaggggtgctgcacccctgtgcagttgaaaatccatgtataacttttgacttccccagaagttaactactaatagcctataactgttgacttccccggaagttaactactaatagcctataactgttgactggaagcctcggccataacacagttgatgaacacatattttgtatgttatatatattgttaatatatgctgtactacaataagctag

SEQ ID NO: 45581 - DNA, 1039 bp, Homo sapiens
gttgtatttatgcgtagctgaagcaatggaaatgagtatgtgggcttctttttggtctgcatttaattttctccagggtacgtactaaatccattgagtggaaggcttagaaattttacttcagtctaaagtacctcttaatggaactctcaaactgtatcataataagctagtgaactttcctgttactgacaatattcatgtagagtttgactaaatttctggctagagagattctgaattggcagatggatctaattccaattcaatcacaaggaacaaatattactaactagcaaatgttggtacttacagtaagtttgttctctacattctgttggtatgttgcatattttggcaccttaattgatggctatgtgcacagttttttgtttgaattatagagtgataaatatgtagttcattgagctaatgacatgtaatcactggtttcaacataaataaatttcaggagacttgtgaattagttaatttggacagaacttaattaaaaatattttgcttttcttagatatgcactttgcctgagaaatgcgctgttgataagatcatcgattcaggccctcaactctctggatcactagattacaatgtagtacatagtaagtggttagtagaaatggtcttttgtcaacataaaaacttgttttaaaccatcaataattactagcaattacttatcaagtaggtacaaatagtactagtttctaaggcatgttattgtttgaaatgtgaccttagtcttttgttttccagtgtggctataattagtcacatacactagaaatttatgcaactgaatgataagaaaaattttgtacttcagagtatatgcaggaaaccgagatttaaaaactttaattctttttctcttctattttactttttctttcgtcacatagcattcatttgtaagaatctttacagaaagccaggaattagtttttttaaaaaaatcactgttgtgtagtgttccatctaaaacaaggtacttttgtttcttcaggtttgtataaca

SEQ ID NO: 45582 - DNA, 1034 bp, Homo sapiens
aagataattggttttgagtttgacacagtgttaatatatgaaaagcagcagacctttgtggggatgctgaattattgaatactcaatattctttcactgaagcacgaggaaatattttggaacatcatttggacaaatgtcagttgttcaaatgaagaaaataggattggggtacagaatggtttgggacttttgggtgctctactgtcatatctgtgtttattaggctttattaggttagctttatagggtgatggtttcaaaactcaagtctctttatacaagtgtttccaaaattgacttaatagtttttccctttcaactttttctgtcaaaaggtaccattgtcttaattatctaggtctaaaatcttacctttgtctcattctttcctttttccactatgttcagttagtttccaagttctgtgaattaggctttagataagtctctcatgtccatttcttcccctttctcttcattttaaattctctgtgactgctcttcttgtctgggtcttgaactttaaaccttaaacatgtgctgttgcaaccattccctgcttagcctttctggcctctcctttctatctccagtctgtcctacatattgacaatagctaattttccttagatatcacttactttttttttttttaatttgaaaatccattttcaaatcaccttctcatgcttactagttgtttctgctctggcataatattggcatatatgtggtttgggttgccgtggtgccagttcttatccattgactctgggagatctttcattatctcccattgattgacagtattccatgagcctcttagtttgaaattctgaggaaatgtgattgattacttgccatccagtagattgggttggctcccattgagataggtacttactcctatctcatttgtctttggccaaatagttgactgccaaatattgcaggagcattttctagagaagagggctatgacttaagcagtcatttcaaagcgtatctactacagctctccttttttatgt

SEQ ID NO: 45583 - DNA, 1053 bp, Homo sapiens
tttaaaaccacttatttaagccaaggattatgcattttctttctgtcatcattactattgtctgaagtcttttccatgttaggactgatttattggcagcttctgctaactgctagaatcctaatattgtgtatgccctttaattataaggagaacctgatttggcttctggctcagatgtaaatgggagtacagagtcatttgaaatggtcattgaggaagcaactatagattcagcaacaaagcaaacctctggtatggtgctaaaactttttccaattttattagactaatttctgaggtttaacttttatgttaaggcatttgcatgccatttgtctattcttattattcatacgacttttaaataagagttttctaggaagcctttttacatacttagaaaaataattcaagtattataaaattatgacttgaaaataatcttattcctgtggtaaatgttttgattcattctctcatcttacagatatcttgcaatactcttttttgggcaaatgactactttgaacattggatgaaagctatgtaccttctcagacacatgtttataccctaaaaatgcctatcctgtttagagattaactgacccccttcaatttcttcctcccctgccaagcccactggtggatatcagtggggcaggaggaatctatgaacttcaggttaagaaacccttgtcagttatatataatatatacataagtagatatatatgataaaaaaataagtttatgtatcctttcttaggtgccacaacagaagcagattgggttcctctcgagctgtgctttggaattccactgttcagttccgaattaaaccggaaagtttgtaggaaaattgctgcacatggcctttgcagaaaagagaggtgagggtttatattcgctgtcatattttcatatcaatttttaagctgtcagcaaatagttaccatatcttacttttattccacacatgagcacagtaattgttctgtatatatttgttgattgaatagagatcgctagtttaagggttttgctgtat

SEQ ID NO: 45584 - DNA, 1044 bp, Homo sapiens
gcaagatatgaaataaacattaattttattgtacaaatgaagacattgagattcaagaagttaatggacttgcacatttcactcgccaggtcttcggagaccaaagcttgatctctttgttctgtgccagtgctttattcaacagaaatgtgttaagtgtcttttatgggctgtgtgccatgctaggtgttagtttttggttatagcgcacttcccaataactaaagcgattctccactgctgggatgggctgtctgttgtggcagcgaaggccagtgctctggacttcttgtttttcccccatccccaaggaaagaaagaatattctagacttgatttataggtaaacttttaaaatagaatatttctgttcagaatatctaattcaacgttatgaaatcaatattttggagttttacttcattcattcagttggtaaatgcttgaccctgacctatgccagattctttgctgagtgctgtggaaacagtgatgtgtaagatactaatggaacttagagaatgttgtgggagacaataatcagataaatattaagatatataagttctaaaagattttaaaaagtactttgaagaagccaactatgatgaaatctgcaggtagacctaatttcaataggtgcaggataatataagctgaagccaaaaagttggaaaagaatattccggcagagcttaggtctgtacttcctgtgtctgggaaatgtccagtgaacaaagaaacaaatgaagcccagtgtggcagaaacttcatgaaagaggggtagaagcaagaggtaaggttgaagaagagggccggagcacggtgtgcagggccttctggcatatgttagagaactagtattttacgttgagtgcaaagagaaatgattaaagacttttaaacaggggagagaggttatttctgaaggactattttataaaaataggcaaaaatggaaattttataaggatgcaataaatggaaaaatttcaaaattctgtcaatactggcctgtctgttgtggcagtgaaggccttggcc

SEQ ID NO: 45585 - DNA, 1033 bp, Homo sapiens
ggggggtgggggtgcaaactaaaaagcggaaaagcacacagcctctgacacagtgacatggctcatccaacggtctggtgggtggctcgggaagggagggaggaggatggacaggcacgcaacacctggtctgggagaaagccttcacacctccaaattccccataccccttcctctcccttgagacaaccatgtggtcattgtccagcagccaggcactcattctagaaaatgccctcagccttgtcccaccctctgtccccaagaggagccccactcttggtgtcgattctgagcttccaggttgccgcggctgtgagggctgtctgagcagcaggcagggggaccagggagagtggggccgctgtggctgccacccgggcggtcaccttctctgtggacacccaggcacccatggtggagcccgagctgacagaggtgggggagctgcactcgctcactgactggcaggtttccgaggcttcggaggaggccgagctggacgagttctgcagcaggggaggggccacacgaggggaccaacagaaaccgagccacacaccaccaaaatataataaataaaaaaaggaatggggatgggagtggggaagggcacacacagagagaaagagacagacatatacacagaagaggggaggatgagagaagcagagggttagggttacttttcccccaaagttgcatccatgcagaggctttcgagcccttgaaaagaagcgtgcgacccggccagccctaggtcactagactgtgggtccccaaggacacggatttgtgtgtcttttgctgggacccagaagcatgcctggcaccgaaatatctggtcatggcattgggacttcgtgctctcttgggtgtttcttcacgtgccacaggcccaggtccccagggaggccccgcctgtcacctctcttatgtgcataggtgttatttattgcatgagggcggaccccagctcgggcttttgctacatgtctgcctggaatggctcgacttcctggagtctcctttc

SEQ ID NO: 45586 - DNA, 1043 bp, Homo sapiens
agtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggagggtaggttgatttcaaagcgggcagatgaatgtcttatttaggagtaggattgggttcactcaaatataagttttatttgaattgcaaaaggcggcaggttagatgcttgtatacattctca

SEQ ID NO: 45587 - DNA, 1016 bp, Homo sapiens
actggtcatgcgttatctgaagcccacgtaacagtttcttcaatagtattatcttcaactactctctataatgctatctgataatatatctaaatctcttcacgcacattttttaagaatggctttttttactgtgtgtttctgactactaaactgagtagtcttcatttctgttataggaactccatgctccactgactgttgttgcagatgggcttttctccaagttcaggaaaagcctggtctccaataaagtttctgtatcatctcattttgttggctttcttatgaaggtactgtaggagtgtgttattgtaatttcaataaaagaaacttgaaatttgaaaattattaaaacattttctttttatttgttttagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctggtaagaaatagcatcttcagttcttacaaaggctgtgtctaaaataggccagagataaggatggcaggtgaaacattcatccagtcaaccagatattctggaactgaactatttaaactagcacttaaaaacagcaaaacaaactcccaaattaataaaaaaaagtttcgggccgggcacagtaggtcatgcctgtaatcccaccactttgggaggctgaggtgggcagatcacctgaggttgggagttcaagaccagcctgaccaacatggagaaaccccgtctctactaaaaatacaaaattagccgagtgtggtggtgcatgcctgtaatcccagctactcaggaggctgaggcagaagaatcgcttgaacgggaggcagaggttgtagtgagccgagatcgtgccattgcactccagcctgggcaacaagagcgaaactccgtctcaaaaaaaaaaaaaa

SEQ ID NO: 45588 - DNA, 1010 bp, Homo sapiens
cggagtttcttcatgttggtcaggctggtctcaaactcccaacctcaggtaatccgcctgccttggccttccaaaatcttggaattacaggcatgagcctccatgcccagcttgttgtcctcttttaaatagtgttggagtttgtttggtgtgcagctaagtgattgtggattaggctgatcctttctaggcttatcgttaagctttgttaggtcaagtctaatatagcctttatgttagggctaatttagccttgttacaaagcatggcccttctggagtctctcttgattgccccgagggttcagtgcgatagctctactctggctggatggaatttgagtgtctcccggtcctaggtcctacgtgactgaacctgggagttgttcactttatagctgtcagtatttgttgctcagcatcttaggactcagcatcagactcaaggggaccccagtgcagattcctagagctctttatctgcatagctccctcactctcttgcaaaccctgctggctgcctcagcctccctgaactgaagtctctgtctcctcaatccttcaagactgctgtgctaggccgagcatggtggctcctacctgtaatcccaacactttgggaggccgaagcaggaggatctcctgaggtcaggagttccaggccaacctgacgaaaccctgtctctactaaaaaacaaaaattaggcatggtggaggatgccagtagtcccagctactggggaggctgaggcaggagaattgcctgaacatgggagaagggggttgcagtgagccgagattgtgccactgtactccagcctggggaagagagtgagactctgtctcaaaaactcccttggattcctcctcccttgcgcagggaggaggccattgcaagacttttcccagttttcccttattgcagtaattacagtcctgtcccgcctttgtcctactgtcccacagctattgtttcatatattttgtttagtttttcagtcattcatggca

SEQ ID NO: 45589 - DNA, 2018 bp, Homo sapiens
gaaagacttcaggtggccaaagaggagattatgtcagtagctcaagtgaaaaagaaaataactttgactaaggtattgtaactaaggtaaaaaggatttgatttgtgtgctatgtatcttataccctcattgtaatacaggcataatagtgtaatagatgattgcttgggttcttatcccagtgccctctcttatctttgtgaccttgggcaaattctctaccctccaatttgcctcaggtttcctatttataaaaggcattattgtggggattagcgagataatattttacaaattacttagaatagtagtaagtgctcagtaattgttagctgttactagtaatttggtgtgcatttgagtttgagttgaccggtgggtgtgttggacaacagagaatggattgggagagattaaagtgcagaagagcaagtggggaatttcatggattatcccagaacagaaatactgttttccttagttttatgagattgttgactttttgggttgcctgatttcatctcaaatcagagtgaactttgataaaccaaatgataatgatcacataggtatcattttatcactttgccctgacattttcctgttgttgtattattaagttattggtaaaggagattcttgctcccaagaactagggtggtgatgtgttttattttgtttcttattggttgcagattcctaattcctataccaggtgtttgtccctgttcaactttctagcttatttgaaatgatcacctttgcctgtgttacgttagaatatatggtgtctaggcaattagactcaccactaccatgtttattcatttttctctaaatttgtcgatattctagtattaccttcttctttgacctaactgggaaatgaaatttgttacattaggagattttttttgagattaccgaagcttatttttttcaggtttttgagtttattatgtacttttctgccatcttacacagaatatactgacctaattaactggaattatttttaaatcatctttaagtagttttagtaagcgctttaggtttagttaagtaaatttgaggaatctcccttctctaaaatgttaatgtacctcaaagatgtaaactacatctttgtagttttcaaagatgtgtcatctcttctcatgcctctctgccagggcaagtctgtgaatgggcttcagaggtttggttaatgctctgcaattctacaaaaatgtatgtgcatgaggattaaaagttttaccagattcttgctaaatatttgatagcaacatttagaagtaaaggattaaagttttctctatatattgcttttctttctgtgatttcggagctatagggcagaaagattacagttactatggtcaggcagttaattgggtatttgttgagctatgctaaagtatggtgatgatgatgaatttgttacatacttaactggtgctctttttacatgtgctatttcatttgatcctaacagtaatcctgtgcagtagggactgttgctgtccccactttacacatgagaaaaattgaggcttagtgaagttacatgcattttttaaggtcacaaagttagtaaatgtttgagtagggatttgattataagcagtctgacttcatagtttctgcccttcaccattacacttcataaaaaatgtattgtgccagcgtcatggcctgtgcagtcaaatgacatttagcgacgttttgcttagataattttggttgttgttgttttttttttttttttttttttttgaggataatgttatctgatttttttttttaaatacccaaatgaggttgcatgctttttctgaaacatcctctcatggaggtcatgtatggtcatggggggaaggagctgggacctttcagggcctttgtactgaccctagactgtctactttcagttcttgtaatggcaggaaaagaaacccctgtttggctaagcaacagctctcatgtttgctcttctttgcagctggttacagtcctga

SEQ ID NO: 45590 - DNA, 1045 bp, Homo sapiens
ttgcgtctgtatgattcctctctcttttcttctttattagtcttgctagtggtctgtcaattttgttgatcttttcaaaaaacctggattcattgattttttgaagggtttttttgtgtatctccttcagttctgctctgatctgagttatttcttgccttctgctaactttagaatttgtttgctcttgcttctctagttcttctaattgtgatgttagggtgtcgattttagatctttcctgctttctcttatgggcatctagtgctataaattttcctctgcacactactttaaatgcatcccagagattctggtacgttgtatctttgttctcattggtttcaaagaacatctttatttctgccttcatttcgttatttacccagtagtcattcaggagcaagttgttcagtttccatgtagttgtgcggttttaaatgagtttcttaatcctgagttctaatttgattgcactgtggtctgagagtttgttgtgatttctcttcttttacattttctgaggagtgctttgcttccaattatgtggtcagttttagaataagtgtgatgtggtgctgagaagaatgtatattctgttgatttggggtggagagttttgtagatgtctattaggtctgcttggtgcagagctgagttcaagtcctggatatccttgttaaccttctgtcttgtttatcagtctaatattgacagtggggtgttaaagtctcccgttattattgtgtgggagtctaagtctctttgtagatctctaaggacttgctttatgaatctgggtgcgcctgtgttgggtgcatatatatttagaatggttagctcttcttgttgaattgatccctttaccattatgtaatggccttctttgtctcttgatctttgttggtttaaagtctgttttatccgagactaggattgcaacccctgcttttcttgctttccatttgcttgatagatcttcctccatccctttattttgagcctatgtgtgtctctgcacatgagatgggtctcctgaatacag

SEQ ID NO: 45591 - DNA, 1151 bp, Homo sapiens
tacctcatgtaagtggcattgtacaatatttgtgcgtttatcacttgaacccaggagttcaacaccagcttgggcaacataacgagaccctgtctctacaagaattgtgtgttggcacacacctattgtcctagttacttgggatcacttgagcctaggaggtcttggctgcagtgagccatgattgtgccactgcactccagcctgggcagtagagcaagactatatctgtctcttaaaacaaacaaacaaaaaattgtccttttgtgtctggcatatttcacttcccacagtggctttaatgttcacctatgttgtagcatgtattactatttcattctcttttaaggctgaatattccattgtatgtaccacattttgttgatccacttatctgtcaatggacatttgcgttttcaccttttggatataatgctgctgtgagcatcagtgtacatgtatctgtttgagtttctgctttcagttcttttttgtgtatatatcagaagtggaatagctgaatcaaatgatctgtgggtccgggcgcgatggctcatgcctgtaatcccagcactttggaaggccgaggcaggcagattacctgaggtcaggagttcaagaccagcctgaccaacatggagaaacccgctttctactaaaaatacaaacttagctgggtgtggtggcacatgcctgtaatcccagctacgtactgaggcaggagaattgcttgaacctgggaggcggaggttgcggtgatccgagattgcaccattgcactccagcctgggcaacaagagcgaggctgtgtgtcaaaaaaaaaaaaaaaatggtctatgggttttgggcaaatgcacaatgtcatgtgtccactatacagaatagtttcactgtctgaaaaatctcctgcttcaaccattcttcactctctcacctttgcctctgcttaggttttaatgttctttttgtagacatttaaatactgtttatactccaacctggaattttcgggtaaagacgagttagtgaaatcagtgatcaagggaaagtaagatgttctggtaaattatttatagtcccttaggctttgagattttgaaagttacttacacagttagcgtacaggtaacaaacagagctttagaatgcat

SEQ ID NO: 45592 - DNA, 1080 bp, Homo sapiens
tattatgcttgtgctaggctttctcagaatattgaaaatagcttttgaatctccactgtaattttcagggagtcctagaggtctagagatcttcataagaaaactgatcacttttttaaaaaattttatttatttatttatttatttattttttatttatttattttgagatggagtcttgctgtgtcacccaggctgaagtgcagtggcatgatctcagctcactgcaagctctgcctcccaggttcatgccattctcctgtctcagcctcccgagtagctgggactacgggcacctaccgccacacatggctaattttgtttttttgtatttttaatagagacagggtttcactgtgttagccaggatggtctgtatctcctgacctcgtgatccacctgccttggcctcccaaagtgctgggattacaggcgtgagccaccgcgcctggccctgatcactttttaaattcagagcatgagtcttcgattaggctggtttgtgtgactgtcactgtgctcagtcctgttattacagctgtgctgaggtacttagtgtggctgttttccagacttgacttgctcaaattaccatttctctatcttctccagttgcttgctgacccagccttttccactatacttagtggcagtgaccatctaaatatgaaaaaaaaaaaaaccaaaacaaaaaccgttgtactaggatagaaaataaagagacaagaagggcaagaaggctcaggtatttgtggtcattaaagcagaagtctctacgctattttaattgttactgtcatatgagcctcctgataatttgtttattcgtgtttgtacatattctgcataatatcagtatgtgcattattagtgaaacctaatttttctcctttttaaaataaaagttaattataaatagaagttctgagattttgcatgtactctgagctgcatgcatcccactttagaaacctgtactgagaaagcagactgatattttttactgaccaaaatactaaccaccatgtctactgtagcttagattattctacagataatgctgaggattctgacatacaa

SEQ ID NO: 45593 - DNA, 1034 bp, Homo sapiens
gaatgtcccagagagtctggtgtgttacatgccatatggtggtcaagtgtaaagggggtaaggcagagagtggttgtagccagtgaacctacagcaagataatcaattcatacgtgcctggctctgtgctaagctccttctcataagtagcttagctcattgaattcacgttacaatcctgtgaactatgtatgtggccactcacagacggaagtagaaactcagaaagcctgagtgattccctctaagttacaaagcttataagagacagaaccagtcctgaagtccattccttttttcactataccagattgaggtaagatgatagccttgaaaactgttagggtgttgggactattttgtatgtgttgctgtttgtttgtgtgtttatttttattcagtgctagcatatgattaatgaagatacttctagtggtagaatgaaggatgatgagtcagaaaaaaatgttgcaggaagcaagacaagatagaagaccacaacagaagtccaagcaagacatggagaacctgaactactgcagtgataatggaaatgggaaagaaaagagagatgcaagagactgggagaaataatctaagcacttagtagatcgatgaactgaaagcagtgaaggcaacctatgttacattagattcgtagtctcaacttttttttaaatcacacatccttaatagtaaaatatttttgagcatgtatcccatacaaaatttttaatattttaacctcctttccagtggattttcttgtgacccattttagagagcactggaattatttaagaataatgagggaagggattgccaggaagaaagggtggaagagaatctgagtttggtttgggtcatactgagtttaagatagctaaagaagtaccgacatttgaagatgcttcatacaaagttggaagtggtattaaagattttaggaaataaaatgacaccaagcttatgttctagatgaaattcagtcttattctcaaaatagagtctggtttccccagttctactttgtg

SEQ ID NO: 45594 - DNA, 1036 bp, Homo sapiens
gggggcagcagcatgagatactagtacaggtggacaggtcagggtttgcttactcttcactgaactctacgtagtaggtacaactgccttggatcaaaaacaatttttagagaccctgatagaggattaatgcattaaacaaaatcacaatatagattggtggttgattaaaaattctagtatctgattttctatctaatatatattattctggtttcttactggcaagcctttattttacagaatttttgagagaagaaatacttaggactgttaactgtagaataaaccttacagtcctagaaagaagcattaattatatgatatattagtaaaagatgcttatagttgttttacaggtagcagtagggtgacctaatacacagaaagtgctgtgccacataatgaggattcagtagatgtgattaaatggttgctgacatcccttcaagacaatgacttgtcttcatagctcatcagtgagttcacagtctattgttcctttttatttggccagtgtaaaatagcagttattgcaagaacaaagggattaaagcatctgaagacctttgtttgagttctgccactttagtagtgatacatctcagagatcaacctctttaatgcctgtctttgttccctggaacagagtttgtgtttccttttgtgttacaacagaactctggtcattcctaccatagcacttttgcacactatagattgcaacccacagtattttacttaaaagattctgaaaaagtggattagaaaacaccagtgtgtatcatgcataggaagaatactgtttcatgaaattttttttcacttaaacatacagttgtatatactgggttatgataaaaatatatatatatttcttgctgcaggtcatagtaaaaggaatttgggaaaacacttaactgtagcatggatgacatcatcaggtagttatcagtttataaatctgttctctctaccatgcacctcttgaaagaaggaacacattttctttatctctttctttttaacacttaag

SEQ ID NO: 45595 - DNA, 1064 bp, Homo sapiens
gttgagtatgtataagaaaacatcctcagagcagcaaagggctgaaaagagaaggaattaaaggctaaagtctgaaggcaagtgaaaattcagaaagaagtggagaactgaaactttttgcgcttaacgtagaattcagcacaatgatttggaggtggtgaggtcagggagtttctagggtgctcagaagtttctagttatagacctggtggtagctgtacgggataattattttctaaatttaaagtatgtattttgtgcacttttctatgtacatgttataatttacaacaaaggattaaatgtaaaaggacgagttgcaaaactatatatatatatatcatatgatcccatacatgtgtatttcatgtaaatgagtatgtgtgtgtgtgttatgtaaataggggtcttaatatatacattttacataataagtatataaatttatgtgtatatataaatgtgtttatgttgggaatggaaatgtttgcatatgtgtgtttcatatacttagaaaaagacctggaggtactcactaaactactgactgaggccatctctgagagacaggaagggcatggggaaggaacgagaaaggaacttagactttttgctttataccactcaaattaaatttttaaacaattgtcatcatttaatgtgttttaaaatcagatttctaaaaagatttgactaacatctctgcccactgatagaaaagtactccctctaccatgctctataccacttggtacactatctttcttttctttctttcttttttttttttctgatcttgctcctttgctagactcttaaaaggaacaagacctgtcacgtttatttttcttgtacctactaaatactggtacatagtagagggtctataaatactagtgaaaactgaatgagtaaatgtaccttaagtagaacaaagggctgtaggcactcagtagttatacatttcctctgaggctcttgttacattttttaatattcttctgtacctggcacagcagtgaacataaagttggcacagtaaatacaggttgatttgaatttaa

SEQ ID NO: 45596 - DNA, 1053 bp, Homo sapiens
gtagagcaggcagggaacgaggttatagaaactttttattccatttccatctgtctctctttcctcacaacagtcccaatagcatttcaaagggtttcaagttccatgtaagttatagaaaaaaataaagcacaagttctctgtgacatgttcagcttatctatgaatataacggaactgaaaccatatttcaataaattattaacagcaatcccttgccaagaaggatatcagcacagataacagggcaaatccattataactcttaagcaaatcctggaattttaaaaaaattgaatagtgtatcaaataagtgcactgttagctgggacttcattaaacagcattttttttcctttctttcctgttcctccccctttcccaccagcttccagccagaataattgataactaaatctcaccatgaatttgttgggaatttacccacaatagttctcaatttattttaagatttaaaataatatatttttaaatagtagattaagactttacagaaatttcagataggataatacagaaccttgaaaagacttattttttacaaacttccttaaaaattcttaattgttctaacagtcacagttttgtttatgtatacaattggagttctgcagtaagacactgtggggttattagtacatatatcaaattcatgaggctcctattcctgtatattgttacagagctgttcttgtatattgatgtttaatgatatggggccgaattgttattcaaataattacagcccattcctgattatttagatgctgattaactagtcaatgacttattccctttgacaaaatttcccaccctctggctttcctttgatgttaatgaggaagaggatccagttttcatcccatttggcaaggttggtttcatggactgagccactctggatgtaagatcagtagctactctgtagactttatggtaatggaagttaggttaggttgcatcagaacactcaaaagtcaagcctatcaccatatttgagaagaaactcacagtatttgatataccttagtg

SEQ ID NO: 45597 - DNA, 1045 bp, Homo sapiens
tccaatgagcatttcctttgagcacgaggtcagtcctcaaaaagctttgaattttatggcatttcggattttgtattttcagattaaggatactgaacctgaatttggaaatacatttattcatcagatactcatgggatgcttactatgtgccagaaaatgtgcagggcactgaaatagagtgaaaaagacattggctcacccatgaaaatgtataatgcagttgaggggagataggcaatcaaatatacaattataatacagaatacattcaataatagtggaagtacatatacttaaaagagcatgtcagatgagtatttaagtcagccttagggcatcaagaaattctccttacagttatatctgggtcgtttgttttctgaagaagaaggaatgctacgtttaaagttaagagagttacagatttatgtgtcatattgagaaatttggatttgattttaaaggaccttacattgaaggttaataagaattgatctgtaactgaaaaagataactgtaggatggaggtgggttggaggaagcagagtcagaggttgggcccatagtaagccaggtaaacagtagtggtgattttaacaaaagtactcatagtgtaagttgaaaagaagtgaatgagttgaaaatataagaattggaaatcacagaatttagtaattgaatttattccttccacaaatattgttgagctgctatgtgttaggcattctgttagatatggtggggaacaagagagacaccctgtctgtcctcaagtctagtggtgttgacttcagggcttttagagtggacaatttcagtgggtgatgatgccatttaccagaaatggaacagacaggtgtctcagaccaaagatccctagatgtgagaactgcttccttaatgccccttttgagatttcaagatgtccatgtgattgagaatcactgtgtctaatggaagtgtatctctatgtaaacaataactggggggggagtttgagaaccactgttacaggtgacagttgaagccaggaagtagatat

SEQ ID NO: 45598 - DNA, 1044 bp, Homo sapiens
ggaggatgaggcaggagaatcacttgaacctgggaggcagaggttgcagtgagcagatattgcaccactgcactccagcctgggcgacagagtgagactctgtctcaataaataaataaataaaggtaagcattgaaattggacttgccacattctctcaccataatgctgacaaatacacatttacatcaaatattaactgaaataataatttgaaatttaaaaaagaaacttatctataacacaagtcaaaggctacgtcaaaactatagttaaaaatgattcacaagttaatggcaagaacatacataacttaccaaaatgtgtaggtgggaagagggtttatcaaaattagaggaaaattgttgccttattaagctcgatagcataaacataagtgagttacacagcaatgcaaggaaaaatctaaaaaaaatactaaggatagaaaaatgaaagaataatgacaatagcagcaattaatgaattagaaaagcagaaaaacaataaaatgatcaatctaagagctggattactgaaaattgaaacaaaattaagatcaaaagaaaatatgaaggccagctctgtggctcacgcatgtaatcccagcactttgggaggcccaggcagtggatcaccagaggtcaggaatcagcctggccaacatggtgaaacctcgtctctactaaaaatacaacaactaactaggtgtggtgaggcacctgtaatcccagctactcgggaggctgaggcaggagaatggcttgaacccaggaggcagaggttgcagtgagccgagattgcgccactgcactccagcctgggcaacagagcaagactccatctcaaagaaaatatgaaattaggaataaaaagaggtatataaccatagacgtgttgggaatttttaaaaaacatatttgaaaagtaatatttttaactctgtgacaattcagttttaactctgtgacaattcaatctgcaaaatgaatcttttcttttttctttttcttttttttttgagacagagtctcactcactcta

SEQ ID NO: 45599 - DNA, 1029 bp, Homo sapiens
agaggttgcagtgagccgagattgcatcattgtactcccactggacaacaagagcaaaattctgtctcaaaaaaaaaaaaaaagatttgtttcactaatgtagcatttgttcatcattagaaaaatccataaaatggtaaccacattaagagatcaagaggaaagccattttcagtcattattactaagacaagttgtaatattactctagagtaatagagtgctagtgaacaagtggtgaactaaagtgaccactttccttgtgaaacttaagttccaatgggagaatgacagtaaacagacaactattataataagtgcatggaagattttggtgtatgttagattttcaaatctgtagagaaaagttggctcattcaataaaaattttgaaaccattgattaatgtcttaataactatatgttaaatctaaaatttatactttagatttaaatatgttacaaatgaattgaagattttaagattaaaaattgaaactaaagtgtgaaaagaaacagtccggggtgtttatattaccttatgttctgtttgaccttttcagtcatgtcagaaggaagcatgcttgggaagatttatgagctgaaggataatattgccctacttctgagacaataaagacaaaagcaattgcttcaaacttgcaagcattcagcaaagcataacatggttgcaagatgtattatatttgaagattttgcatataaagaactgaaactgcaaggggcaaaattaatatcatcaggctaaggcaggcagatcacttgaggtcagcaagatcagcctggccaacatagtaaaaccccatctctactaaaaatacaaaaattagctgggcatggtggtgcatgcctgtagtcccagctacttgggaggctgaggcaggagaattacctgaaccagggaggcggaggttgcagtgagctgagatcacaccactgcactccagcctgggcgacagagcaagactccatctcaaaaaaaaaaagtcaacatcattccttgataca

SEQ ID NO: 45600 - DNA, 1040 bp, Homo sapiens
gcacggcccttatggttctttaggactagtctctttacaaataatgagaatttcaatacagtcttgcaactgtagtagcaataagcataaggagctataagaagagagagagtgtagctagaatataaggagagaggtaaaaaatgaagttggagacagtatacaggagatagattatgaacatccttatatgacttactaaagaatctgaaaggtccaggtgcggtgactcatgcctgtaatcccagcactttgggaggccaaggcaggaggatcatttcaggtcaggagttcgagaccaccctgggcaacatgctgaacctctgtctactaaaaatacaaaacttagcggggcatggtggcaggcacctgtaaacccagctactcgggaggctaagacatgagaatcacttgaacccaggaggtggaggttgcagtgagccgagatcgcaccactgcactctggcctgggtgacagagcgagactgtgtctcaaagcaaaaaacaaaacaagacgaaaaacagaatctgaatgttatcctgaaggcaatggcatgtgttgaattgctttaaatagaagcaagttatgatcagcagtgtgttatatcctgggtagggtaaaagataggcctagctggatgcagtggtgcatacctgtagtcccagcaactcagtaggttgagatgggaggatcgcttgaggccggcaattctgggctacagtacagtatgctgatcgagtgtccacactaagttcagcatcaatatggtgacccctcaggagcagggaaccaccaggttgcctaaggaggggtgaacgggcccaggttgaaaatggagcaggtcaaaacttccgtgctgatgagtaatgagatcacacttgtgaacagccactgcacgccaaccagggcaacatagtgagacaccatctcttagaaaaaagaaaaaaaagaataaatgtaagtgggagggaaaagtggaggcagggaagtcagtataagactactctaggccaggagtggtggctcatgcctataatcc

SEQ ID NO: 45601 - DNA, 1028 bp, Homo sapiens
acagcatccaaaagggccatttgataataaaattaaaaaattaaaagttgaagagaattcagaggatgctttcttcagagaagtgcttaggatttctcagaaatctccccagaaaagaggccttaacagtagagtgatcatcctttctgaccccctgagagaataacacacaggtcggaattctcttcattgggctgcacacccctgtctctgcttagtacagctttgggaagttctgagagggacaaagggggtaaagaactgagagtggatcattaacccttcataatacatcatcccatgttctgcctcattggttccttaatttttagtgtgtgattgtgtggctcggttggggaatagttggaaggaatagttggagcttgaattttgtctcctccaaagtaaaaggaagcaacagctttatacatttatagagctggatttctttctttgttttttaagctctaatgaattctgttttgagcattctattgactaaaatattattttggatgaaactgaagcatatcatgacccaataataaccgttgcccctactgaagatcttaaactactgcataatcctgaaccatgtgccttcacaactattaaacaagaaataactaatatttattaaagtatgagtaggaattacagcttacagcttagattctgatctttgcactgattagctcttgattaattaaaaaaaatagctagcacttattaaacatttactacacgctaggcattataatagccttgcatagattatctcatttaatactttccatggccctatgaactaggtactgttattttcttctttttacaaactgaggtaaatttagtgttgtcatgtgcagtttgcacccttaactcccaacactcacttctgctgggtacatgacatattgaatgaatactatgtttgtaagagagagagaatatgcatgaatgaatgagagagagcatacccaaacagggaagcaaactgatggatttggctgtagtcaaattgttgt

SEQ ID NO: 45602 - DNA, 1030 bp, Homo sapiens
tgctggaattacaggcatgagccaccgcacctgccccaattttttttttttgagaccgagtctcactctcttgcccaagctggagtgcagtggcacaatctcagctcactcaaattctgcctcccaggatcatgtgattgtcatgcctcagcctcccagagctgggattacaggtgcgtggtaccacacccagctaatttttgtatttttagtagaaatggggttttgccatgttggccaggctggtcttgaactcctggcctcaagtcatctgcccgcctcggcctcccaaaatgctgggattacaggcatgagccaccacgccaggtcccaatttcttttttaacacatatttattggatgtctcctatgtgctaggcactgttaaaagcattggggataaatcagaggaatcagtccttgcaaaggccctggtgtgggagttggcctggcacacattccaggagtgacaaggaggttcccatggaatgagtgagggaaaggaaagtaggagatgagatcagagagctaacaaggggtggatgacacagggcttcccaggccattgaaggactttggcttttacttagaggttaatatggggtgagaattgagagaagaatgataactactgctgattattgagcttatagaagatagctggcactgtgctaagtgcttgacctgtgttatacttcttaatcagatagaacaagaagattagaacaatgatataaagcaaatggcctgtcccgagaaaggaccctgagacagaggggttggggagcgtgcaggggcagtattcaaacccagatctgagtgatttcatgatgtcatactgtcatttaatgaatatagacatgtgtttgccatcacattgctgtagcaagactaatcttagcctccacttgaccactctgcaagaccactgctcaggaactggataggaagttggtgcctgtgcctccaaacaactctgggaatccgggacaaagaatctgagcacacatcatgcaccacacacacattt

SEQ ID NO: 45603 - DNA, 1092 bp, Homo sapiens
tatacatccagaaaatatgcaaaatctagaaaccatgcagaaaaagattgataatttgaactacatcaaagcaaaaattatcagaccagaatgccagttaaatttttaaaaagttaaaaaattatttatgatatttttagatgccctcagtaaagtcaaaagacaaactatcagctaaagaggaaaattgtaatttatgtgatagaggattaatttcctgcacaaaatcttacaaatcaatgtgaaaatgacaaaccaatattctacaaaatgaaagcacatagtttcagaaaaagcagtaccaatcaccagtaagaatataagatgtttaactttacaaaagaaatgaaaataaaatagggccgggtatagtggcacacgcctgtaatcccagcacttcaggagcctgaggcaggtgcatcacttgatctcaggagtttgaggccagcctgggcaacacagtgaaaccccatatctacaaaaaatacaaaaactaaccagatgtagtgcctgtagtcccagctacttagtagggctgaggtgggaagatcacttgagcccaggaggttgagttcttggtaagccaagatcgcgccactgcacttcattccagcctgggcgacacagtgagaccctgactcaaaaagtaaaataatgtttacctatcaaattggaaaagatgtacacttctgataatattcagtgttgcaatctatatatggggaagtagccaccttaaataatttattcaacatgtaagtccacacatagacccaaaagtatgtatacagtgatgttaatggcaacatctattgtatcagccaaaaactagaagcaaaccttaagcttctgatcaagattaaataacaggtaccacattgaacttccctcctaaaataacagagaaaaaaaaagaaaacaaaatctgtgaaacaaccacggcactcaaggcattgacatcaggcatggaaaggcaatgatccttgaagacaggaaacaaaggaaatgggtcccatgcttgttccagcttactattgagagagttttcaggccatagtacagggaaggggaacctaggcagatccttgtgat

SEQ ID NO: 45604 - DNA, 1049 bp, Homo sapiens
tcaaggcaggtggatcacgaggtcaggagatcgagaccatcctggataacatggtgaaaccccatctctactaaaaatacaaaaaattagctgggtgcggtggcaggcgcctgtagtcccagctactcgggaggctgaagcaggagaatggcgtgaacccgagaggcagagcttgcagtgagccgagattgcgccactgcactccagcctgggcaaaagagtgagactccatctcaaaaaaaattaaaataaataataaaaataaaaatcaagtcatcctgtatgtgtcaataggaaatgatcccccaaataaattattagatgtaaaaatgcaaggtatttgcatatctctttgagtaaaaataggcattatatatatgtgtgtgtgtgtatttgtagatatgtatgtgtgtgtctatttacatatatgtatatatagtttgtgtatatacactgtgtgtatgtgagggatttcttgagcatatacaaaagcttacagtggttgtttctgagaattggcattgtgggattgtggaaaagagagagaggacttctgattttattcacttttgttgaattttttgaaaaccatatatgtgcatattcttttataagtttaaaaaaaagattggttaaaaagataaaaaaggcgggccaggcgcaatggctcacgcctgtaatcccagcactttgggaggccgaggcaggtggatcacctgaggtcaggagtttgagacaggcctggccaatgtggcaaaacaccatctctactaaaaacacaaaaattagccggtcgtggtggcgggcacttgtaatcccaactactcaggagactgagtcaggagaatcacttgaacccaggaggcagaggttgcagtgagctgagatctcgccactgcactccagcctgggtgacatgagcaaaactccatttcaaaaaaaaaaagagagagagagagggccaggcgaggtggctcacacctgtaatcccagcactttgggaggccgaggcaggtggatcacctgaggtcaggagttccacaccagcc

SEQ ID NO: 45605 - DNA, 1028 bp, Homo sapiens
cagagtccactgaaagagaaactcaaactttgttccctttactcattagatttttgtgttaccacctctttcacacacatgatgtgaaaaaggtggtattgtgtcatatattaagaaagaaaggtgactgggcgcggtggctcacacctgtaatcccagcactttgggaggctgaggcaggcggatcacgaggtcaagagatcgagaccatcctggccaacatggtgaaaccccgtctctactaaaaatacaaaaattagccggacttggtggcaggcgcctgtagtcccagctactcgggaggctgaggcaggagaatggcgtgaacccgggaggcggagcttgcagtgagccaagatagcgccactgcactccagcctgggtgacagagcgagactccgtctcaaaaaataaaaaataataatagtaataattttaaaaaaaggtttctcataattttgaacaagtcattagatgtctgtgactgtttcctcacctgtaaaattgttatcagtactcagggccctccctcatagggtgcttgtgaacattagataataaaaagattgtaaagcactgtgtaaatgtcaagtgctgggtaatggggaagagtaactgcaggcagggtaggaaaacttagcatgggaaagatgaaaactatagattttctcctccctgaagtttaaaaacgatctttttttttttaacaaaataaccagattctttttatacacttttctcttaatccttcagaatagcacagtttggggactgccttcaaaatcagaccacattgttagaagttatttcactgcttcagaacccaaatcccctgcaaggaatgtaagagcaacttactttctttcaaatttcagtcaacggtaaagtttcagcgtatagcatggtccacttcttgcaatcacaaatttactttgcaggggtaaaatttcggaaggagcagtggaagaagtctggtctgggtacttcttgtaaacttcagtcagatatggcctgtgcaagggcaaaca

SEQ ID NO: 45606 - DNA, 1166 bp, Homo sapiens
ggttggtctcgaactcctggcctcaagtgatcctcctgcctcagcctccagagtcactgagattacaggtgcaagccaccacgccttgctagatttctttctaatgtagttttcctggtggttctttttttttttttttttttttttttttgagacggagtctcgctctgtcgcccaggctggagtgcagtggcgcgatctcggctcactgcaagctccgcctcccgggttcacgccattctcctgcctcagcctcccaagtagctaggactacaggcgcccgccactacgcccggctattttttgtagttttagtagagacggggtttcaccattttagccgggatggtctcgatctcctgacctcgtgatccgcccgcctcggcctcccaaagtgctgggattacaggcgtgagccaccgcgcccggccttcctggtggttctgataccaccaagtttggaaccactgcgaggccatttcccagatgaagaaaataaggcccaaggagaggagtacctccaccaagatcagtggcatgctgaactcatgaatggcagaggcctgctcagagctcaggtcaccctcacagtcagtgcaggtttttttccactactccttcatgctcctgggtctgccgtggactcaggataaacagacaaagttgtctgtgtctgtactttctcatctgtactgtagagataataactcctgaccttaaagggccattgtgaggttaaattagttaaagggtgttcagttcactttgtcctttactcagagtctgttctttagacaactgaaagggtgctaaattaagccattttgcagagaggtctgagtcatctagtggcagctgtctgtgcctcactggaggtgctttgatcattgtcatctaaatgcatgcgttaagtactatctgtagcacagcgctccaggctgtgctaagtgagttacccagataatggtctctgcccttgagaacagcgctgaggcaagggacataaaggttattcacacagcaacagaacaggggatccatgaacgttgaattcagagagcctagaaggagcatggggacacccattctgcgcccctggcttagaggaccgaagtgctgcagctcaggtcacatggcacgttgagagcgggatgtgtgacccacca

SEQ ID NO: 45607 - DNA, 1022 bp, Homo sapiens
gaagtcatgtgtcttcctttgcatgtggggaggattttaaagggatggaaagtggacaaggagggggtgggtgagaggaaggaaggcttagaggcaaggactttgttctacgatgctgactcagtgatgccttcccttgggctctgcagaaataaagattttcctcatcttttagctccttccttccctcctccctccctccctctttccctccctctctcttactttcattttatttcttccttccagtcagcaggtttttgtggggtatgttttctgttaggctaacttcagacaagaccctgaaaactaagtacagatgtcatcacagatgagtgttccttactcttggaagttcaggtagccctgcctcgattggctctgaccactttgtcaggccgtggagctgagctacattttggggatttcacccacattgttgttgacaggattgttaggcttcactagatttgcaccctcgggctttgatctttttaatatcttccggattgaatacccttttgggattgttctcctgactttttttttaaacgagtatattgtgccactagaaagaagaatgtttaaatggatcaaaaataaatcttgatactctctatcaaatgcatgtaaaaaggaaaaacaagcatgtttcattaatactaagattccagggcatctggtaatgacagcgctgagtaaatcctatggggcgacatatttgattagattcggggtcagtgggtgaggggacatactccagtcattacaatctgaggacagcgctgagcactaacagatgtgacaacttataacacaggtacttcctccttcactgcactttatccaaaaatagacatcttcagaggttctttaccttttagccttaaaggatttgagaagctttagaaaacaaattatgatatcaggtctagatttattttgctattaaagtctcacattctgtacaagtattttattattgtttgtctaggtctctgaaattagaagagacagaagaa

SEQ ID NO: 45608 - DNA, 1074 bp, Homo sapiens
tcctgaatagctggtattacaggcatgcaccaccacgcccagctaattttgtatttttagtagagatggggtttctccatgttggccaggctggtctcaaactcccgagctcaggtgatctgcccgcttcggcctcccaaagtgttgggattacaggcatgagccatcgcgcccagccatggcatgctttcattagtttccttatccataaatgaatgacaatcgttgtaatcacctcattggcatatttgaaatttaaataagatacatgcaaagtacttaaagtagctggtacacagtagggctcagtaaaattatcccatcatcatcttcaaacttgagccactatcaacatcctcttcgtttttttccaccattgctctataggcatgggagacgaggacagttttaaaggagtaagatgagccaacctggagtttaggaagttactccaatagcaatgcagagatggattaaggaggcatgaggcaaaaaaaagtcagttaggatgcttttacagtggtttaagttatagaaaattagagtatagagatacaagagtgattgtggaggtacagttaacgacatttgacgactgactgaatgtaagagaaaggaagaagcagcgaggggtggctgacatttctcatctgggtgtctaatactgtcatttgctcattagcctccagagaaggcatgagagaggaacactcttattggaggattgtgatagactcagctcaggtcatcctaaatgcaaggtcccagcaatacagccccgtggaagtgtccaggaagtgcagcaagtgtgagttttgcagtcaggggaggactcagaactatcgatgtggattgggaggttatcagtatagacgagtcaacccgctcaactaccgtcacagatgcagctctggaacaaatgcattcaccagcagagagccagcaaggcaggacccgcacctcgcctgtgatctccacaaggccagagcccgacttcgttctgctcactgtgatgccttagcaccctggtgccaaccctcaaaaaacactttgttgaccaatgagaggatcaat

SEQ ID NO: 45609 - DNA, 1074 bp, Homo sapiens
cctggtgcctgctctaagcgtaaccaccatgggatgggattttaattctaacctgtataagttaggatgaggaccaattcatcaactctggactcatacgaagaggcagacagaagttagtgatgacacaattacccttttttaggactcaggctgggattggccaggaaagcagacactgaagttagagcaactcaggccttgtgacccaggaacttaagaaatgtaaaagtcatctcagaagcaacgtgggaaatggccaaatgcctgggtagcttaggaactcagaagttgggggttggtctctggccatcccatgaataggactttaaaccccaaagttcctgaagcaggcctcacaacagaccttgttgcctgctccagtgaacccagacaaggctcagcgtgacttcttgggcattcaggatgctaatacttcggacttcaccgaggttttaatctaaggatttcaaaagactttgcaagcaattaaggttataacacctctttgtactgttgttgcatgaaccagatggacagaaatatgggtcaggattggctgggatgacatgtgataccacaaatccatacatttaatctcttctaaggttggaacaaatctggggcaattgcaaccagttaaattatataaggtcagaatgagtgtgctgaaaagctggctgcttttattttcccctgtgtcatcaacatacttgtcatttgaggaagtcatccaagtaacatctcaataaccttttattcatgtcatattttctggaagtttctcctctcctccccagggagtcacagcacatgagtgaaacaggcaagtcaaatatttccctgaagttgaaaaaacagaggctcaaacgtctttcagtagctactcaggagtaagcagctcagagctgggatatgaacttgggtctttggactccatgcccaatgttgttgctctgcctacacaccaccacacaaagtctcctggtaagaataatgatgagagaaagtggttcaagacaaatacaaatactgaatttttagctccacaaatgtcttcaaatgacccagtat

SEQ ID NO: 45610 - DNA, 1030 bp, Homo sapiens
aaataatgttttaccagctatctagccatcccttaacccagtcaagttgacacataaaattaaccattacaccctccaaaatattcttattttgaaattctcgcccccagtacttcagaatgtgatcttattctttaaaaggatccttgcagatgtaatgaagttaagataagctcattagggtgggctgtaatctaatatggctggtatccttataagaaggcacgtagacacacaaagagaagatgggtgtatgacacaggacacagagattgaagcgtaacagttgcaagccaaggattgtcaaggatttccagcaagcaaccagaagctaggaagaaccaaggagggatctccccacatgagccttcagagagagagcatggccttgccaacaccttggttttggacttccagccttcagaactgcgcgataataaatttctgttggtttaaggtaaccagtttgtgatggtttgttatagcagccctaggaaactgatacagtctctctggacagcctatgtctatgcagaaatggccacagtaggcagagctgtccaagcagtgagcatatatagggctctgaccccttaccgagggcccggctgcagccctgacttatagggttcctttaagcaatgaagtcagaatgggccaagacaagaaaaattgcaagattcattatttaacactgactcctaccagggttatggggaaaataaacacatcaatggtacctagaagatctttctgggtggccaagctaatagaataagccgtattcttcatcttctctttcatggtatcattctttttctgcaacaaaactcctcccaaattgtacctagaattcctgaaaaagtggagctaactagataaatgtgaacatcagtaccccccccaaaaaaaaatcatgttacttcatttgcatgtgatattctcatttaaatttcattaccataaagtgagggttctattaccagggtaaccagtaatagaaaaggagcagtatggctttgacaaatga

SEQ ID NO: 45611 - DNA, 1042 bp, Homo sapiens
gtctaaacatttacaaaagcttttgagaatacgggcactcattgtgtctgattttagataaaactgtatacttccagctgggcacagtggctcacacctgtaatcccagcactttgggaggctgaggcttgagctcaaggagttaaagaccagcatgggcagcatagcaacactttgactctagtaaaaaaaaaaaaaaaaaaaaaaaaaaattagaagtggtatcacaggcctgtagtcccagatactctggatgctagggtggggagattgcttcagcccaggagctggaggctgcagagaaagaccctgtctcaaaacaacaacaacaaaaaaacaaagaataaagaaacaaagaaaacatggaggttttcagacaaatgactaatactatccttgtgcttataaaaatgattaatttttaagttcatgagaaaaaggagtagggaaaaggaacatttatcagtaatataagactgaaacaaaataaatggagtttaaaaggatgtgtgtgtgtatgttaatatgtttatgtttaactgaagtaaacagtaaaagaccatggtaaacagaagaggaaagccactgtgtatgacaaaaacacacatcatgctattctttgctgaccacgtggtggcactgttgacatgagacagtttagtggatttgtttagtaaaatggatttgcacgctatattgctgattttaactaaactaatcctcttaaaatacacaagtcattaaaaaatatttcctgcaaagaaacttcaggttaagataatactaataattgaagctgcagataataacaaagaaatggaagaacaagatgtctctcttcctggtttgaacactttttcagccacattgtgagaaaacaatcaatggctattggtgatatattacttagcagaatttttaaaaataatatatatccatttacttgatcccttttagttaaaagtaatatttttgataataaataaaaaatagtattttgaagaaaactcatgcttttaaaaattttgaaatgtttaaatat

SEQ ID NO: 45612 - DNA, 1031 bp, Homo sapiens
tgggcaggtgtgatgtagggaaaacagctgcccatttatttatgcttagcattccaataatggaacattccacatttatgcctagtgttccattattggaacgctaagcatgtgggagttatttatatcctactgctcaaggtcatgaccaaggtctgatttttcacacacgtctgcaattcaaaaaattgcaacctccagcataaatgggttaatggacttaacagaattaactggtggtcaatattctgccactgccctgagaataaacaataaacctttcttcttattctgaatctgtgagttttgccagggagcagaaaagatagaaccatggaatctcctggaagactctcagagtgctcgttggaatggtctacaatgactaggggaggagtcaccttgcagtagcctctagggatgtggagtggtttgcctgctctgccaggttccttttaatggcactctagctatgtgaccttggacaacttacttaatcttgtgcagcctcagctaccccatctctctgaaggcaaacttagtctctgcctcacagggtactgtgagggtccttgtgagataatccgtgtaaagtgcccagcgagatgtctcactcagcccgtgctcagacgtgtttgcagagtgttaatctctcagaaggagctgattatcaacattcttttgcctagagagaggaaagtctatttgccattttatgcagtttatatacatagatactatttgccatattatacagtaatagattttactggacaataatctcaccagataatcttggtggatgagattgcagcacgtgtgctacttatattctttagggcaggagagtttatgtggatctagagtggagtggtggtttatgactcctgtagcactcagttgattctccattgctcctgaataggtctttctttactgatgacagggtctctccatacggtgacacatggggtttgatgagggaagatagggtatgtgaagcttatgtagggacaatgagagcaggaaca

SEQ ID NO: 45613 - DNA, 1012 bp, Homo sapiens
tgacagattctagtgacaagattctagtgacagaacttaacttctgtcatatatagaacatttctaggatataacaaagtatttagcctgctgcttagcgaacactaaatttttactataaataattgtcctttctggaaggagccaaccctgtttcttctctgccggaccacatccttttcatgcttcagtgtttacacagcttttctctatccctgctgtcacaccaatcatcctctgactgactctaccattaatttggcctttgtttggttttgtttttcattcaccatgtaggatcacaaactcctggagagcgctggctgcttttttatgtttttctggcatctctctctggaccttgcatggtgcaaagcaattgcagaccactcaattcagtgccggttgaatgaatgtgttaagcctcataaggatcaatcttctgaccttgaactcattagtactgcactctaaacagctgagctaatgagttagactaaacagttaattttttttaaaataaagaaatgctttgtgagccccatttattgaatagccctatgtctcttaactaggggatatttttccaccaggagacatttggtcctgtctggagaaattttcggttgtcacagagcgggtggagttggtactagcaatttgtgtgtacaggtcagagatgttgctaaacatcctgcaatgcacgggacagccccatcaacagaaaagattatccagaccaccatgtccataccaccgaggttgagaagccctgggttagactaggttatatcaatagattgtaaagctcaaatagattttatcagtttataaatatgtagtatgaatctatgttgcagcttacttagattgcatataaacgtatgaacaatagcataaaacctgtatctgctaaatattttttgaatcaaattttcaaaaactactagaaaagctcatgtgtaaacttcattaattcagaacttgagggaaagctacttcttacagtgtg

SEQ ID NO: 45614 - DNA, 1032 bp, Homo sapiens
ttatgccaatcttgtcattgctatttgaatggtataatacagcgaaataatcctactggaaatgcctcaagcacattttgcctttgggggtcttacaaatctttggttcttcagacataaaaatgatgagtaaagagaaggatacatgatgagtgtttgctttcatgccctctatgccccatctgtccttgtacaaaaactgatcataacagttaccacattcctttcaataaattcagtgtatttcaacacatgttatctgagagccaaccgcgtgtcagtcactgagggaagagatggagaggacatgggtttcagcttcaagaaattaatggttgaagggggacaatgaaaaacagatgtcttagaactgtgcttcatgtacaattatgtctgtatgcccagaataatatgaaaactatttagggtcattatgacataccaggggcttagaagacagtgagaggaatctttaaagcactttgacattaacaaagtataaacaaaaagtcaacaagaggtgaaagataactctgaagtggatttctgaagttaggttgccttagtcagttcctgctgctgtaacaaaatgcctgagaccgggtgatttattaggacagaagtatattccttacagttctagaggttggacagtcaaagtaccagcagaaccgacatctggtgagggttgctccctgcttccaagatagtgccatgttactgtatcctcacatggcagaagggcacaaaggccgaggtagtttcctctagcccttttataagggcactcatcccacccataaaagctttgccctcatgactttatcaccacctgaaggcctcacctcttaatactatcacattggagtttaagttttaacatatgaattttgaaggacaaatgcatttaaaccatagcacaggtcatgagatgctattgataagatgtgggcattatcttataggttagaggtcataaaggcacagaacatgggccacatgcagctcatacagattttgattgatctccaa

SEQ ID NO: 45615 - DNA, 1066 bp, Homo sapiens
ctagtttttcatgttccttttcattattggtttccaatttcatcctgtagttctcagaatcaaatttaaatttaattcctttaagatttattggggtttatttggggaggggggctagaatatggttattcctggagaatatttatgtgcacatgagaaggatatataatttgatgttgatgattgcatgttctatagatgtttgttaggaccagttggtttatttgtattcttcatcttccatttatttgttggtctgctgcctggttgttctatccattattgaaaatggattgttatagtttccaagtgttattattaaattctttatttctttcttcatttctacctgtttcagtttcatgtattttggtgccctatgatgaggtataaccaatacttttaaaaaattatttaaaatttttttatggatacacaatatttatgcatatttatggtacatgtaatattttaatgcaagcatacaatgtgtaatgaacaaatcagagtaattgagatattcgtcacctcaaaaatttatcatttctggcttggcatggtggctcacggctgtaatcctagcactttgggaggcccaggagggcagatcatgaggtcaggaatttgagacaagcctgaccaatatggcgaaaccccatctctactaaaaatacaaaaattagctgggtgtggtggtgcgtgcctgtaatcccagctactcaggaggctgagggaggagaatcgtttgaacccaggaggcggaggttgcagtgagctgagattgtgccatggcactacagcctgggcgacagagggagactctgtctcaaaaaaaaaacaaaaaacaaaaaacaattgatcatttctttatgttgagaacattccacatctactcctccagttatttttgaaatatgcaataaattactgttaacttatagttaaacttatagtttaaatttataattaacttatagttaactgatgttatattatagttgccctattgtgcttccaaacactaacttttattccttttaacaatatttttacacctaggacagga

SEQ ID NO: 45616 - DNA, 1035 bp, Homo sapiens
taaagaagacttgcttccccgcccccatttgacatagtgagctcactattacctttagaatttcatagtagtagttttcaagttttagagggaagaaacaatttggccaaccactgaccttaaaatgtgaattttaatttttgcttcttacaatgagaaccattttaacttggtgtaaaccaggttctcatccgtagctgcccacagggttcatttctgatatttaaaaaatcccagaatcgtcgttccttacctgaggattatacttcattaggtttggagtgagtctttgagatgtatctatatctaattcaatatctaatcatatataatatagatatctatctataagcatatagattaatgtgaatgaattaatgcatcaatgtttatttgatcaataatcaaaataaaatacgtcttatttttctttgtagtatcttctgcctctggcacaaacactggcatgcagtaaaaattcaatacacatctgttaaattaacgagtgactttatatccttcctacaggatatattctgaggttgctttttcttctttggagtcagctttctctgggttctgtcagtattcttttatgtatctagacattctttcagtttgttgaatttgccatgttccctcccaccacaaggatgttatacttatctctcttctcacccttctatttacactttaaatttcagctcaaagaccacttacccttaggtgccttcattgacatctgctggggaacctatacccctcatggacaacttaagtacattcctcatcataccctttcttgagaccattattctttcactcaagatcctcataagtttgaaattctatagtcagaaatgtaagtatttgtttaacatatctcttcatctccccaccatacataaagcaccataaggacaggtacagggtgtatgtgtgcacattcccacttgcaccaccagaaatttgtaatgcttacacacaggaagtgctcaagaattatttgcatccaagaactatttggataatgag

SEQ ID NO: 45617 - DNA, 1045 bp, Homo sapiens
ggaaggcttaaaatcatgcattactcaatctaatacttcacgaaatttcagtaaaacctaatgataatatagaagcttgtgttgtagttttgtaatcaacagcaaaacataaaatttaaaaaaaacatacattactggggctgtatcctgctacaataataaggctgacataatagatggagaacaatatggtaacaagccaaaatgtattacttcatccacaaatagtatcgtgctatatatagacagacttgttaaaaatttaaagaaatacacaatcaattacacaatagaaaatttgctatatggtgcatggtggcatgcaactacaaatgtttctaacatgtttctcttcataggattttctgaattttcatttaatattcaagcacatcaaaaacaccttttcaggtgtgatcctatacagcaaagctgtcctcacaaacaatagttgactaaataaacacatggctttatggaagaaatgtgtaagtatagccattgttggagcagatgctctgcttaaaaagaaaaaaaataagttaaagttatagatctcaccatgcttatttactgcttaagtcatagccaatttattgcaccaaagttgaagttcaaagcataaagaatactatatataatgcaattaatgaggttgatgtccctaaaacaagagagaattagtaaatgttttacaatagttttcatgagatgggaaatgacaatagaaatctttgttacaatgcagattttattgtggaaatgatctcatggcaaagtttttaaagaggctgcagaacaataaagagagataacacattttgcttttatgaaaaagccgatgttccaaatttgctgaccttctctgtaaataagaagtgactgtcagtagccagcagatgtgtttataaaaataacccacttgatctgtccctgcaaggtaagagtggcattttcaaagtgcatgagagaactgctctcaagagaaaatcatactgtaaagacagcatttcaaaaacatttatttggaaatatttaaatgatg

SEQ ID NO: 45618 - DNA, 1045 bp, Homo sapiens
ttgtttggcttgaaacttcttaatgtttaggctaattatattgaagatgacagtggtcattgagaaaacaaaatccccaaagcaattttggaataagagccaacatttaatacttaccagacaactattctaagtattttactatattcactcatagcaactctaaaaagcaggtagtattaacagagaaaatgaggcacagtgaggttaaatagctggtccgaggctacacagctaatcagtgggagagttgggacttagacccagaggtccagttttgaagtccacacttttagccattacactacaatggaaagaaatttagaagatatacacagaaaactataggcacatagattaggggttagtagaatgctctgggcagttaaaggaactcttcttaaaggaggtaaagcttgaatgagactgttagtaagctatttttcactcattggtgaatgatgttttgtgcagtgtgtttttttccccatagaaaaataagaaagaaaagaaaattgagaactctctctataaaaatgtgtaacatatctcatattccaagagatccttttggtagtattaatttttatctgctcacagtactggcttcattatttggagttaaaaattaactcaaccagataaaaaaatcagtgctgtgtatttgtttatctttcaaatctgtgttctaattttaaaaagttatttaacagaacgaagctatcagctaagacaatggcaaagccgtaaacaaacataggttgcgtttatgcgaatggtcaggtccaaagtagatgcagaatatgccaggttcactaattttaatccctattcagcccaggactatgtaccataagattactgctagtgttttctgaaaatgatgtatcaaggcattttctgtagaaatacgaaacagtgacatacagtagggagagctggattgaggcagagtagtatagatggaagtttcctgaaagcattttggggaaacatcttttgggtatggttcttggatgaagagttgatttattagtactggaag

SEQ ID NO: 45619 - DNA, 1050 bp, Homo sapiens
tctattatcatagaaaaaataaatgagtgcatatatccatatacaaaatagaggtctgttcttcctgtatatatttatactaaaaaaactgagacttttttttacagttgtatatatacaaacatatttgtttatttatatacacatatataaatcaattttatgtacatgtgggtatacatacatccatgcatataactctgaagtgctgactctctaaagaaagcccaggtattggtcagaattcatgctcggctcaggagtatagaattaagagatacaaacctcaaaaaagagggaaccgaatcttcaaatctgagccaccttacaagaatttttaaggtaactgttttaagtgtaaacattatggcaatgtaatagtataatttgtatggcacaagatggagtcctggtggccagaactgagtatgggaatagtcagtgctaatctttgtgcaaagcacaaaggaaaattggtatacaaggcctgagagagaggtcaaggaagcaaatactataaagtcccagaaggcagttggataggacaaggggatcggaagagcaggatcaagatcagagagcagggaagatggggctagctaatctagggaatggagggagaagggatacccagaagcaggattcagggggttagagcacttacaccatgctcatggccatgcccatggacaggagaagcatatgatgggtgcacatggtggagctggtctaaagaagagggggattcatatcacagtaaaattaagtgcaatttatccacagagcagaggaggttgtgaagagcaggcataggctatttttcatgtctgaatgctctcaagacctcttagtgttgtaggtagatgacgcacaataaatattccttgatttgaattggcataaaaggtcaaatcagaaagccagaagttctttaaggtttcaaactagattctaagaagtccaaaggcatctcagaggtcatctcagggagaaaaggggaagcaatgaggtagaactctgaacctccactctacctaaacaaggcagccc

SEQ ID NO: 45620 - DNA, 1050 bp, Homo sapiens
cactatgctcctttgccacaaggctgaagttaactctgcctgtacaaaaggcagaacagcaattctggcctgccacttgcatggaagttaactcctttcaatagcaaattcaataaataattgtgcaatctggtacataaataccccggctcccttaccccttaggttaggtaattctgagatatatatgctaggaatatcgtccttaaagttctctaacagaattaagcttcatttatctgaagctgaaaatgtaatcaaaatatatcccatattgtggccgggagtggtggctcatgcctgtacccctagcactttgcgaggctgaggcagaaggatcacttgagctcaggagttcaagaacagactgggcaacacagtgagatcttgtttctacaaaaaaaaaaaatttaaatagccaggcatggtggtgcatgtctgcagtctcagctacttgggtggctaaggtgagaggatcacttgagactaggaagtagaggctgtagtgagctgtgattgtgccactgtactccagcctgggaaacagagaaagaccctgtctcaaaacatatatgtgcatatcctgtattgattttcttccattctctgtgtcacttctccatatccctatcttatattatggaataacctcccaaagaaactaattgtgcttgaatccttgtcttacaggtaaaaagcaatgagataggctgttccatgaagtagcaagtttctcagcagtagaagttttcaataatgagtagaaaaatggatttggggagattcaaaaataaaataggtaattggattgcaggacctacatttagaccatgcagtcccttctaaggctaagttgaattattacttgtttgacttgtgacagagtcattcttgcagaaaaagagatgtatgttcatgccttggattctgaaatttgtgaaaggagataatataaaaagttatctggggagggaatattttttaaaggttatttgaaggtacgagggttagcttcctcttttgttgtaacctattcttataaaaagacct

SEQ ID NO: 45621 - DNA, 1030 bp, Homo sapiens
cggcagtgctgactctttctcactcattggcaggcactagttgcagggtgtcttgcatgagagggtcagacacccagcagcaactctggagagcatcccagctacacaaagtttcaggtcagcagccaggatttgagcttcagctctcttaccatcccagagactagaggagcccctggattcaaatgacacatctcagtggacactgagaaaggtttaaaacagattggacctctcagctggcatcatggaagtaggagtcaaaagagacttgctgcaaggtcactggaggtttagaaaaggacagatgttctttgacattccctggttccttcttagagagacaaacataaacagagaaaatcagtttgtcctttgaagaagttccagatggaaacagcaaggctgtcttactctgtgaatgtttccttgatccatccccaccgctcccagcaaagcctgaatcccttggtcaccactgtcctgtaaacagccctctaatgttgcctgaagctcaattataaaaatatctagcttctccctaaactagacactcctccagggcagagagtgtgttgtatatgtgttgatattaatctgacaaggaaaaaagccaataattattaagtgcctactgtacaacaaacactttttttttttttttttgaggtgaagtctcactctgttgcccaggctggagtgcagtggcacgatctcaactcactgtaacttctgactccctggttcaagtgattctcctgcctcagcctcctgagtagctgggattacaggcacacgccaccatgcccagctaatttttatatttttagtagagacggggtttcaccatgttggccaggatggtctttatttcctgacctcatgatctgcccacctcggcctcccaaaatgctggaattataggtgtgagccactgcgcctggccaacaaacactttaaaaatacagagatatttatatattatacatacttttaaaaaattcaactaatccatataaaccatatttta

SEQ ID NO: 45622 - DNA, 1108 bp, Homo sapiens
aggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaagttgtgaatgttttgtttcgtttcttccccctcccaaccaccaccatccctgtttgttttcatcaattg

SEQ ID NO: 45623 - DNA, 1086 bp, Homo sapiens
tgggccttctgcctgcccaagatggacacgtttctctggcagctttgtcaagagatctcctggactataagacaccctgttctttcctcctgtttgtgtgagtggccctgcatttgggcagagtattggcagaatatctgggggaagtggaagactttggatagttgccggtccaggtcgtctggagaggcagtggcaggcctgctgatggctgcccctttgctatttgttttatatcaggtggcccttctggatgtgtggcctttttattttgcatttcctttcatagttggctgcagacataagattcttctttttctcttgttttgcttttttttttttttttttgagacagagtttcactcttgttgcccaggctggagtaaaatggctggatttcagctcactgcaacttccgcctcccaggttcaagcgattctcctgcctcagcctcccaagtagctaggattacaggcatgcatcaccacacccagctaattttgtatttttagtagagacggagtttctccagattggtcaggctggtcttgaactcccagcctcaggtgatccgcccgccttggcctcccaaaatgctgggaggcctcccaagttgctgggattacaggcatggaccaccatgcctggctaattttgtatttttagtagagacggagtttctccagattggtcaagctggtctcgaacatctgacctcaggtgatctgccctcctcggcctcccaaagtactgggattacaggtgccacagtacccggccttgttttgctttttattgtttcctgatgcaggtttgtgatctctttgagggatcaggaccacaccccccaccccaatttatattcccagtgtccatggtgggaccctgactgaggatgggaacagagcaacaatctggaatcatttggaccattgagtcctgtggacagtcacttcaatatcatccctagagagtctcagaaattcaaggccttttggaatgctgccaaaatgggtcctttggcaggagccccctttgtctcttctgttttctgacctcaaataatctaaggaactaataacggta

SEQ ID NO: 45624 - DNA, 1567 bp, Homo sapiens
ttgccagtgcactcctgcctgggagatagagtaagactttgtctcaaaaaacaaacaaccgcctcggtctttgtgcaaaatctataatcatttgcaagaggctgcaatcaggtatagcactggattttgtgaccaaaactaggtttcaggatttaattaaaaacaaaaacaatgtcaggtcataaaacacaagacatatacatgatgtggaaatggtcttattcattttttaattgcgaaattccgaactatctgttttttttttcctttatcttttcctttttgtgtgtgtgtggagttaggtggggggggaggtatggcatattgttttgtttatctgcctctttattatcactgactgtgaaattcttgagaacaggggcgtctaagtgcccaacacagccctggtactttgttgaatcaggtggctgtcaagagctgctgcttcagcccggcatggtggcttatgcctataatttttgcactttgagaggctgaggcaggaggattgcttgagctgagaagtttgagaccagcctgggcagcagagtgagactctgtctctgtaaaaaataataaaataaaaattaaaaaataaagaaagaactgctttgtcttcaaggaaacaagatacacagtcaacagtcattatctttttagatatgagacagcttgacatggtgtggaagtggggggcttgcctgtagggaaagtatgctgatgaaaaagaaggaaaacagacagtagcaggaggcagtggggatgtgtcagggagctgaggagtgtagatctggttacttttgggcaagttacttctctaagcttcagtttcctcatctataaaatggtttgctgtgatgacgaaagagatgatgaacagaatgtgtctggcagaggacctgggctcataagtgagcacacagtaaaaggtagctaatatcattactgttccaattattgagctttattacttcctgtggctgcatgaagtagtggtttctgaatagaaaggcaacattctagttgcctagatcttaagatggcagtgacttcactgtagttctctgcaagcatcagaaacaagccctggcttatgtaagttagaaacagatgagaaagtaaataaagctgcagaagtgggtctcaggaaggacaggaatcaaagggctgtccctcggatgtcagactgcctttgcaagttacttcaggtcactgtgcctccatttcctcagctgctgagcaggggaggagaatcacttctccctccctgggatggtgcagagcacttagcagagcacttagcacagaggaataagcccttcagtaaaacatttgagtaaagcaattattatttattattcttcagggctctttttttttctggtgcattagccctaacattgactacttggttcaagagtgatggatgcattcatttcctgagcagttgctgtatgcctggcaccgttttagctgctggcgatccagcagggagcagaagagacaaaaatccctgccctcctgaagcttctgtcctagtggatgtcacacagtagtggggcaggct

SEQ ID NO: 45625 - DNA, 1050 bp, Homo sapiens
atcagggtcaggagctagagcaccaggacaaacatgcacagagcgttaagtgccaggtccaggctggcagtggtggatggggccacaggaatggacttctaggctgttcactgttgtatccccagcatcttaaactgtgctctccatatggtagctgtgagccctatgtgggtattgagcacttgaaaggaaattgatatgtactgtgtgttaaacacacattggatttcagagacttagtgagaagagtaagatatctcattatttatttatttatttatttatttatttatttatttatttactgagacagagtctcacctgttgcccagcctggagtgcagtggcatgatctcggctcattgcaacttccgcctcccgggttcaagcgattctcctgcctcagcctcccaagtagctgggattacaggtgcccaccaccacacctggctaattttgtatttttagtagatatggggtttcactatgttggccaggctggtcttgaacttctgacctcaggtgatccatcccactcagctttccaaagtgctggaattacaggtgtgagccactgcaccaggcctatttgtttatttatatgagacacggtctcactctgtcacccaggctggaatgcagtgatgtgttcatagatcattatagcctcgacctcccaggctcaggtgatcctcccacctcagcctcctgggcagctgggaccacaggtctgtgtcaccacgcccagctaatttttttgtatttttggtaaagctggggtctccctgtgttgcccaggctggtcttgagctcctgggctccagcaatctgccttcctcagcctcctatagttctagggttacaggcgtgagccactgcaccctgccaagttatctcatgaaccaattctttgatgttaattacatattgaactgataatgttttggatatattgggttaaattattaaaattaatttcatctgttttttctaactttatggctactagaaaatctaaaattacatgtgggttgaatcatattttcgctg

SEQ ID NO: 45626 - DNA, 1023 bp, Homo sapiens
tcttggtgacagcagtgggctggcagtgcagaggttcaaggccttggactgcaagtccactaaggtggctggtggtgtgggtggaggtggaaaaggcaggtggggcgagggtgaggggcaggacatcctggagagcctgaataaccaggtataagtgatttctttttctttctttctttctttttttttttttttttttttaagacggagtctccttctgtcgcccaggctggagtgcagtggcgagatctcggctcactgcaagctccgcctcccgggttcacgccattctcctgcctcagcctcccgagtagctgggactacaggcacccgcccaccacgcccggctaagtttttgtatttttagtagagacgaggtttcaccatgttagccaggatggtttcgatctcctgacctcgtgatccgcccgccttggcctcccaaagtgctgggattacaggcgtgagccgccgcgcccagccccaggcggaaattatttcaactgggtcctgagaactgggcacttttcaaggattgtcagcaaggagcaacttcccaaatatacatctaaaaagatgacaaactcatgtggaatgtggatttaaggaggaaggtacttgacttaagaattccaggattttggtggaagaaggaaatatgggccaggcactgtggcttatgcctgtaatcccatcactttgggagatagaggtgggaggattagttgagcccatctgagaccagcctgggcaacatagtgagatcctgtctctacagtttttttttttttttgagacggaatcttgctctgtcatcaaggctggagtgcagtggtgagatctcagctcactgcaacctccgcctcctgggttcaagcgattctcctgcctcagccttccgagtagctggagttacagccttgtgccaccatgcttggctaatttttgtatttttagcagagacggggtttcaccatgttggtcaggctgatctcgaactcctgaccttgtgatctgcctgcc

SEQ ID NO: 45627 - DNA, 1135 bp, Homo sapiens
gacttagaagatatttgcaatatttataacacattacaaaacactaatatctagaatgtatgcagaattcccaaaagtcaacaacaaaaagacaaacagccttatagcaaagtgggtgaaagataggaccatgcagtgctcatagaaagcaaagtagatggctgggcaccgtggctcatgcctataatcccagcactttggaaggctgaggcgggcggatcacaaggtcaggcgttcgagaccatcctggccaacatggtaaaacctcatttctactaaaaatacaaaaattagctgggtgtggtggcgtgtgcctgtagtcccagctacttgggaggctgaggcaggagaatcgcttgaacctgggaggcataggttgcagtgaacccagatcttgccactgcatgccagcctggacacagagaacgactccgtctaaaaaattaaaaaaaaaagcaaagtggatgataaatgtgaaaagattctgaattttgctaacaaagtcaggttttggagatctaatttctagtcagtaaaattcatcctttctaggatacaatgctaagagttttgataaatgcatagaactgtgttacactgttgtgtaattaccacaatcatggcttagaacatttccatcgttcacccagattccctcctgtcccttcacagccagtctccttctccacccccagctttaaccaacccctgagttgtttgctgaccttacagtgttgcctttttcagagtgtcctataaatggattcatacagtgtgtagtctctcggatttgtcttctttcacctggcataatgcattcgggacccttccatgttgttctatgcatcaggggtttggtagtttttattgctgactgggactctgttgtatggatataccactgtttgtttatctgttctccatttgaagagcatctgggtgtttccacaagatacatgtttcatgctttacaacgtgccagaaataggatgtctgactcaagtgttgacaaggcacagggtgttcagcagctccgctagtgagtgtgtgaggtcactttagagaccaccttgccagcaggtagtgaaattggaaacatgtgcagccccgttcctaggtaagattgagaattcac

SEQ ID NO: 45628 - DNA, 1025 bp, Homo sapiens
cagatgccccccagaagcatgccctctggaaagggagaggagcaggagggggcttcaggcatgctgggcctggggggccaccccctggcctttgctaagttcctggctggtctgagccctcttctttcctctccccaggccttgcaaaggccatatctcttccttttcatgactctggaaattccatacatactttctgcattaggaagacattctctgcatgctgatctcgttaaaaaggaaaagccaaggagcatcctgcacctccctcctgtaagcgagctttgcaaatggtaaactagatcctgaaaggcaaccacttaaaagcttttaatggcttcccattattagcttgagtgcctggtgcgtcagaggctctcagtgagcgtgtattgaattgctgaatgcatggtggccctgggcgaggaatctggccctcactgtcccaaggctgagtgcctttgccctgtggaggaaagcactgccttggggtcagaaataaggattggcaggattgcctggggttagaaatagtgatcatgggatcagaggcagcaggtgaatgtggggtgtgaatatttttgaaggcttggaatgaaatgattcttccagactttagaggatttgtgtctgcagattcttctctaaggtttgtgtctcacatagtgagagaatcagccagccagggaaatgggacaggattttgtctctttccccatttcctcttctaatgaactcctacctatgctttatgactgcattaaggggtcacctcctccaggaagcattccctcatctccttacgctggttctgagtgtgtcgttcctgcttgatcccctcccagcaccatgtgtgtgagttctcacagctcacaccccatagtattactatgttgtttctacagtgggttcctgtcaggggttccaaacttagctgtttaggaggatgagtagattgtacaaccacaccaggcgggcctgatcaaatacagtaagaagtgtccggattggcaaaccagcgggtc

SEQ ID NO: 45629 - DNA, 3434 bp, Homo sapiens
cccatgcgtattcttttttttttcttttttttttgagatggtgtttcgctcttgtcacccaggatggggatggagtgcaatagcatgatctcggctaactgtaacctccacctcctgggttcaagcgattctcctgcctcagtctcctgagtagctgggattacgggcactcgccaccatgcctggctaatttttgtatttttagtagagatgaggtttcaccatgttggccaggctggtcttgaacacctgacctcaggtgatccacccgcctcggcctcccgtttgtattcttaaatagtgtattgtttcctttacttcctttagagctttacagaaattccatgctgccttcagcttcctttgccgctctgcatcatgttggtaagtctctgctgatgcctgctgctgtagcttatttttcactgtgataatctgttccattgtgtgaactgaccacagttgattgatctgttctccaaggacatgtgagttgttcgcaggtgtccccccaccccctcccgatacaaacagtgctgctgtggacatttcatacatctggttgcctatgtcagaatttccagggtatacagctaggacgcagtactgctgttggattttcctgggattgtagactctcaaatttggaatggacttctatggccaagtagttcaccttcagcaatcatctcaaaagaaatgctcttggtgtgatggttgagagcgctgttctggaataggagagacacagacctgctgggcctttgcctcattttattacttagttcattatgcaatgaacttaacatctgtctacctcagtagtttccctgtctgtgaattgagtctgttacatatatatatatctatttaaatatatatatctatttaatatatattaaataatatatatttaaatagatatatatatattacagactcaatttaacccttagggaaatatatatatatatatgtgtgtgtgtgtgtgtatatacatatatatttaaatagatatatctatttaaatatatatatatatatatacacacacacacacatatatatatatatttccctaagggttaaataagatagagacctggtatggtggctcatgcctgtaattccagcactttgggaggctgaggcaggagagtcacttgagctcaggagtgggaaaccagcctgggcaacatagttggaccctgtctctacaaaaatgaaaaataaaaaaaaaaaaattagctgggtgtggtggcatgtgcctgcagtcccagctactagaggctgagatgggagaattgcttgagcctgggaggtcgatgctgcagtgagctgcaacagagtgacaccttgtctcagaaaaaatagagagagaaagatccggcatgtgtagagattaactcggagcctggaaataataaacacagagtaagtgctccctgctgttcgccttgttcctgttggtgtttaaagatcacttacacttgcagaggcagaactgatgcccaggagaggggcagtaactagcagaagggaaacagcccgggtccagtttacttcccctcaacgtgggccaaggacgccaggcaggatcatagtccggctggattgtggctttcctcaaggtgatcttgacttgcccaggtgggatttcacccccacttccttccaggcttcccattttagacttgaaatgtaggcctgttggggcctcctccagtagatgtgtgcccttgagcttggatacccccctgccaagatacgcctttcaaaaacagataaacttatcgcaactgaatagaaggggctcccaaggggtcccaccctgctccggaagtctcagtgaggaatcaatagctgttaattcctgtgctgccccctgcctgacattccatccacacttgaggcccagattgtaagaagggagagcaggcaggtctctcttccaggagagggacccggttcatcagcaggatttattcattcatgtattacgtcaggctcagcgcctgggctttttataaatgagggctctgctggcgttctgtgttattcagatattcggtgagagaccaccagaagccacaaaaaattgctgacatctgttggaaggcaatcatgcataatggataagggtgcactctgcagttccagcagcattgatttgaattccccctctgccgcttcaaaactctgagatctcagcgagttgcttaccctctagagcctccacgtcctcatctataaaactagaaaataagtggtactcactagatccttaccttgttgtgagagtagaatgacgtgcatgtagagctttcccagagctggcatgtggtaggtgctcaataaacgctggttattctctctctctctctcactctgttgcctaggctggagtgcagtggcgtgatcatagctcacaacagcctctgtctgccaggctcaagggatactcctgcctcagcctcctgagtagctgggacttgcaggcaagtgctaccgctcctagctaatttgttttattcttagtacagatggggtcttgctatgtggtccctgctggagtgctggttgctctctaactggctgcgagccccggggtaggcacactggtactggggctatagcaaaatccgtgctcggtaaatcatcattgaaggagcaagggtgctttacagttgtagaatctcatagtacacgttactttggtttttctcttcccagctctggagtcctgggatccaagtgtgagccccatgtctgcaaaatgaggctagtcacttgaatcctcttggatcttgctttcctcatctgttagtgagcttgtagatagctctgactgtcaccaggctttgctctgagcactctgcatctgtattcaacctgtatacttaatcttcacaacagttgaggtggttgatccatagtaatttctcgttgtacaaacggagaaactgaggcagagagataagtgtcttcccaaggttaacagctaaccagtagcagggcacgctgggatttgaaagactctctatgtgtcctaactggtatgctctcctgtctagaggtgatctcttcctccagggttccaggtagattggttgagatgtgcaatgcggaagagcctcgggataagtcggctaatgacaccctcaggctacccagccctcgggagctcacagcagagcagttggggatgccttgcaaggttacctgtgccagagttcctggggtacatattaaataggtaggacccaatactactttgcattttcctggaatcctagactcttaacattggaaaggatttctttgccaagtaattcgccctcatcattaacctctaagaaatgcagaggtggaattagaaggtgcgtgtctctttcttttgcaccacagattctatcgagtctcatctggcagct

SEQ ID NO: 45630 - DNA, 1051 bp, Homo sapiens
tacacatttcctagggtgcttgggtgaagaattagcaagcagtaactgaagaccagttactggtcaggcagggaagcccaagttctggcccctgctgactgtgtgactttgggctgagcagttggcctctctgagtcttaggttttgttttttttttttcttttgtgtttttgagatagagtctcgctttgtcgcccaggctggaatgcagtggcgcgatcttggctcactgcaacctctgcctcccaggttcaagtggttctcatgcttcagcctcccgagtagctggattacagacatgcaccaccatgcctaactaatttttgtatttttagtagagttggggttttaccatgttggccaggctggtcttaaagtcctggcctcaagtgatccgcccgccttggtctcccaaagtgttgggattacagacatgagccactgcgccgagcctgagcctcagtttctgatacttgcaactgggagcatgttttgagagctagagaaagtattgttgtcttgtgtaacatgaaaaaagctgtgcggatactagctaagatcaatgaaaggttatcaaactcaatctgatggtgaaagaagatacagagatcaagcccgtccgcatttttaacgtggggacactgaggcccaggaaacttggggcttcttcaagtagtagctaggcctgtgctgtcccatatggtagccgctagccactagccgcatgtggctattgagcagtcgaaatgtgcgaaaattcaaattaaaatatgttgtatatgtaaattgcacaatggattataagactcagtttaaaaaaaagaaaaaattcataacaacttttgaaatattgattacatgttgagatgataagatttcgatatactaagttaaataaaacattaaaaatgaatttcacctttggtttctgcttagtattttttaatgtagcaactagaaaattaaaaattactgccgggtgcggtggctcacgcctgtaatcccagcactttgggaggctgaggtgggctgatcacgaggtcagaagatc

SEQ ID NO: 45631 - DNA, 1068 bp, Homo sapiens
tttaaactctcagagcttcagttgttctatctgtaaaatgagtattgcaatagtgcatgcttcatagagctgttgtaaggattaaatgaattagtgcatataaagtgcctagaatagtgtctggcccgttttaagagctcagtgagtcttggttgttgtagttgttactttagtggttgttttttagaacctgaggacacaaggatggaaagactcagtctgtctgtggcaaaccacgaaaggaaagattaaacaattcaatgcaggctgggtgcagtgggtcacacttgtaatcccagcactttgggaggccaagacgagcggatagttgagatcagaagttcttgaccagcctggccagcatggtgaaatcccatatctactaaaaatacaaaaattagccagacgtagtggcgagtgcctgtagtcccagctactcgggagactgaggcacaagaattgcttgaacctgggaggtggaggttgcagtgagctgagatcacgctactgcactccagcctgggcgacagagcaggactctgtctcagaaaagaaagaaagaaaaaataaattcaatgcagtgattattagaggggtaagtccatcgggacaaatcagggggcattcccactgaggcaggacttgagatgaatctcggaagcagaaatgctgagcttgttgggctggccagagataagaaggacattgtgggcgggagaaacagcacctacagggctgagatggatgaaagctcagttcagtctgggaactgcagaaactcagtttgcctgagcaaactgcaatgtggcaagtgggaaatgaacccaagctaaaagaggacagcagctgggtgtaaattttgtcctgtaacccatggagagccaagaaggattttgagccagggagtgacatgattggatttcatgatcagatcattctaactgctttgaggaggttgtcttggaaggaaagcaagagtctttggcaagaagatcaagagaagaaagattgctatttccaaagctcaagtagtgtatttttcattgttgttgttaaagttcaaaagtc

SEQ ID NO: 45632 - DNA, 1031 bp, Homo sapiens
acatttttaaggctctcaatgcatgttgttcagttgtttccccatttggttacaccaagttacagtcacaaaattacaccaaatattttttcctccatggagttgctttctcatgaaattgggtttctgaggccaggaagacttgggtcttgttgaggtgaaggggataattcttcagcatttgtcactatttttcactatcattttgagtttgatttaaatagcacagtttgctgcgtggaaaatgagagtagctttgaaggggcacagctttgaagggcacacagtagatgatgacatctacttcagaactctggctgctacgtggggtacgaccatgttgcattttcaggatgctttagtggaaatcaaaagcatgggatgcgaatgcaaaaccaaagggcttaggttctgcatctgacatatgtggctagctgtatgttcctagccgcgtcactcaaccttgctcagtacataccttcttcatatggcgtgcatctcttcctcagctatatgggtgtcctcgaaaatgctgagcataagaaaagtgcatttgtatcctctttatttatttattatttatttattttttgagatggggtcttactctgttgcccaagctggagtgcagtcgcacaatcatggttcattgcagcctcaaattcctgggctcaatggattctcttgtcttagcctcctcagttgctgggactacaggagtgtgccaccatgcccagcttttttttttttttttttttttgatagtagagatgaggtcttgttatgttgcccaggccagtttcgaactccttggctcaaacaattccccctcctctgcctcccaaagtgctgggattataggcatgagctaccgctacacccagcctatcctgtttacctacaacttgccagtaaccttgggcaaattgcttggcctcaggatcttggttttgttttctgtaaaatgggaataataataataataatagtccctaattcctaaggggattgggaaggttgaacaaagtgct

SEQ ID NO: 45633 - DNA, 1057 bp, Homo sapiens
gcactttagttcttcaggctggttgtatatggctggctagattcatcgtttggaatcttcagagtcagaagggacccatccaagtttgtcactcaatggatgacaaagtaaggctccagatggtgagtgtctattttggaatttcataactgtttccatttgtgtgtaaaggaggataacacacacagacttacatatacacacaagcatatttgcataggctggatttggaagggtgcacaaagaaaatggtcatagtggctgttgctaagaggccacccgggagctttctggggccaggagagaaacttagccttgactgtatgacttttttacagtcctgttggaaaattttaccatgtgtatcttttagttcttcaattaataagcaatgagttcttaaaattcaccaggtagtaaaagatctttgaaagccaatcctgcttcttaatgcaaggaaagaatccctgggagtatgcaaaatctctgttggttttgtagctgtctatctgaactcacgtgccctggatcctggccacagggctttctttttctttctttctttttctcttttttttttttttttttgagatggagttttgctcttgttgcccaggctggagtgcagtggcaccatcttggctcaccgtaatctccgcctcctgggttcgagcgattctcctgcctcagtctcccaagtagctgggattataggcatgtgccaccatgcccagctaattttgtgtttttagtagggacggggtttctccatgttggtcaggctggtctcgaacccccgacctcaggtgatctgcctgcctcaagcctccaaaagtgctgggattacaggcgtgagccaccacacccgacctagccccagggctttctaacactcacatggactgtctgctgtctcttgctggcctcccagtctgtctccagaatatgttagactgagtcctagacacttagcctctggtcccctggcagccaactgctcctctggttcaccccctggggctccctgtataggggagccatcagcctgactgagcag

SEQ ID NO: 45634 - DNA, 1985 bp, Homo sapiens
atcccagcactttgggaagctgaggtcaggagttcgagaccagcctggccaacatagtgaaatgctgtttctactaaaaatacaaaaaattagctggacgtggtggcaggtgcctgtaatcccagctactagggaggtcgaggcaggagaatcacttgaacctgggaggcagaggttgcagtgagccaagatcacgccattgcactccagcctgggcaataagagtgagactccatctcaggggaaaaaaaatgcatattgcataaaataaaaccttatatatattcacacacatgtgtatatatgagatggggtggtcctgtacatgacagctatggttttaaggccccagtgcctttaagtttgttcttgaaatggttggtagccagttcttctctccttggcttcccagaaatcctttccaacccaagagcgtcagaggtactttaagtaagcaagactttcaggtgttgcttctctggcctccctctttcacatctattctataaaaagagggtggctgctcagcccaatgtaaagaaagcgctttctgaagttgaatgagttttacatttcagctctgccagtgtggcagtatgaacttgagaaagagacatcccctctctgacacttaatttcccatctgtaaagtgagatccacaattttacctttgcgggttggcacatggactggagacaatattggtaagatgctgtgttcatttcctagggctcacattacaaattagcaatgggctcctttcaacaacagatatttattctcttgcagttctggaggctagaaatccaaattcagggtgtcaggagggccatgctccacatgaaggctccgaaaaataatctcttcttgcctcctcttggttttggtggttgctggcaatctctggcttgtggctgcagcaatctgcctccatctttacatagccttcttccctctgtgtgtctctgaattctctcttcttgtaataatgccagtcattagatccagggcccaccctgatccagcagaacctcttctttacttaactaattacctgcaaagaccctatttccaaataaggctacattctgaggttctgaatagacatgaattcttgggagcaatcaacccagtacagatgtctggcattttattgcagacaacatctgggcagatgacagcatctggtatttttatgattgtcacttaccagaggtatggatagacatttcttgaagaagataggagcaagcctgattatttgaggaacacgagggccagatagcagaagtggagggagaggtgtggttggcttggcaggtggagaggggcagggatggaagcaaggagcttgctatgtgggggtgtgggagtggggttggggaaaccatattgctttatttcaggagagagtgatgtggcctgtgtcttggtggtagcaaagaaagcggagagaaaaacgtagattttacatttatctgggcaattgtgccaataggacttgcacacggattggatatggaggtgagaaaataagggaatcaagaatgactcctacgagtcaggctgggtggttcatgcctactatagtcctagcacgttgcggggctgtgatggttaatactgagtgtcaacttgattggattgaaggatgcaaagtgttgtttccaggtgtgtctgtgagggtgttgccaaaggagattaacatttgagtcagtgggctggggaaggcagacccacccttaagctggtgggcacaatctaatcagctgccagtgaatataaagcaggcagaaaaacatgaaaatgcaagactggcctagcctcttagcctacatctttctcccatactggatgcttcctgccctcagacatcggactccaagttcttcagttttgaggcttggactggctctccttgcccctcaaacttgcagacagactattgtgggaccttgtgatcgtataagttaatatttaataa

SEQ ID NO: 45635 - DNA, 2270 bp, Homo sapiens
atggccactagtggtaggggtagaagttggggagctggaaaaggtgattacaaggagccactggtgaggcagaaaaacatgccgggagcctagagaaggaagaccttcttaaggaaggaggagagtcatcacttgcaatgttgctaagaggtcgggtagaatgagtcacacagaagtgactgttagatttggcatcaaggaggttgttgactaacttggcaagagcgcctcatgggagcaatcaagaggaagccagtgaccaatgaaggtgactgctcttgcgttctgctctctcttcattgccttttgctctttgcttaggcaaatcagtgtcttcagtaggttccttgaaggctaatgtcaccattagtatttacctacccattagctcatttgattctcaaaacaacatctttgcagaaaaggctgggcagggcaggcaggtattattcccattttacagatgagaaagccacaacttaaaaacgtcaagtgtttttttttcaggctgtttcttaaaagtaagagttatgtgtcaggcacccctcctccacccccatctcggcatacatcccagtgttttgtggtttgctacatttcttggttttcttagctagattgtgaacccagtgaagggaggatctgaatgacatctctatattcccacgcagagatagcaaatgcttgccacacttgttactttctcttgggtacccatggcaggcatcactagctgatcatgaccttctcttcctttgagcccagactcagcttagaattctacccagcattccagatagcctgtcaacctgctgacagataaggtatcatcaacaggcatttttactgtagtacttaatgtcatgcctggttcagcaagtggttttgtgactgatttagcaaataagcattctctgaaaacacagtgagtgagttctatgtcactagaggtaatcaagaagagatcaaattcatgcacatggccgggtgtggtggctcacgcctgtaatcccagcactttgggaggccaaggcgggcggatcacgaggtcaggagatagagaccatcctggctaacatggtgaaaccccatctctactaaaaatacaaaaaattagccgggcgtggtggcgggtgcctgtagtcccagctacttgggaggctgaggcaggagaatggtgtgaacccgggaggcggagcttgcagtgagctgagatcgcaccactccactccagcctgggcgacagagtgagactctgtttcaaaagaaaaaaaaaaaattcttgcacaattggataaggtaaatagaattcaggtattgggtaaaaggttatccaactctgagattatctgatattcatggagttatttaatgaacagtagtatctcttaccattctggaacaaaacaagaaacctttgagaggaatctccccccacctccccagatatataggaggggacagtgggcaacactattatggctcctttcttgttgtcttggccacttggggctctggtctcagcctttctggattgccataatctgttgggccctatggagccaaagggagtaaacagaatagtactgttctgggttgttgagggattcggtgagattccctaggtaggttttggtcaacaagcaggcatttcataatcctctctacctcctgccctgccctggggattgtgaggattgtctgcattcctctgtggaactggaatgtggctgcagtgatggtgtctgcagagatgttgaagctgctcctctctcctgccctctatcttggcctcgcccggtcctagccggggtaagtgaacatcaatcccatggacagagtcttctctgaaaactgctttatggatttttttttttttcccagacagggtcttgctctgtcgcccaggctggagtgcagtggcacaatctcactgcaacctcagcttcctgggcttaagtaatcctcccacctcagccacccgagtagttgggactacaggtgcatgctatgatgcccagctaatttttgtatctttagtagagacaaggtttcaccatgttgcccaggctggtcttgaactcctggactcaagcgatctacctgcctcagcctcccaaagtgctgggattacaagcctgccttatggatcttaatgtcttggcccgagggcattggctctgcctggctccagagggatatgaagccattcctgggggacaccattgttttctagttaatattatcagtcctgtagtccagtgattttc

SEQ ID NO: 45636 - DNA, 1042 bp, Homo sapiens
aaaggcttaaacataagacctaaaaccataaaaaccctagatgaaaacctaggcaacaccattcaggacataggcatgggcaaagacttcatgactaaaacaccaaaagcaatggcaacaaaagccagaattgacaaatgggatctaattaaactaaagggcttctgcacagcaaaagaaactactatcagagtcaacaaggaacctacagaatgggagaaaatttttgcaatctatccatctgaccaatggctaatattcagaatctacaaagaacttaaatttacaggggaaaaaacaaacaaacaaacaaacaaaaaccccatcaaaaagtgggcaaaggatgtgaacagacacttctcaaaagaagacatttatatggccaacaaacaaatgaaaaacagaaaacaaaaaacaactcatcattactggtcattagagaaatgcaatcaaaaccacaatgagataccatctcatgccagttagaatggtgatcattaaaaagtcagggaacaacagatgctggagaggatgtggagaaatagggacgcttttacactgttggtgggaatgtaaattagttcaaccattgtggaagacagtggggtgattcctcaaggatctagaaccagaaataccatttgacccagcaatccaattactgggtatatacccaaaagattataaatcattctactataaagacacatgcacatatatgtttatagcagcactttttacaatagcaaagacctggaaccaacccaaatgcccatcactgatagactggataaagaaaatgtggcacatatacaccatggaatactatgcagccataaaaaagaatgcattcatgtcctttgcagggacttggatgaagctggaaaccatcattctcagcaaattaacacaggaacgaaaaaccaaacacagcatgttctcattcagaagtgggagttgaacaatgagaacatatggacacagggaggggaacatcacacactggggcctgttgggggatggggggcaaggggagggatgg

SEQ ID NO: 45637 - DNA, 1026 bp, Homo sapiens
aaaggtgagcaaatgcttgtatacaggctgcagagggttaggtcaaggctgaaccatgtagtctaaattttggagtgactgcagtgaagcccctccatggtggaagaaaatggaatgtccttgttggagctggccagaactgggcagatccagaggctggaggtaatggcaataactctgactgctaataataaaataagaacgtaaaagagtgcttacagtgtgttacaggcactgctttaagtgcattacgtcatttagtttccacagttgtctccatgttacagaggagaggactgaggcacagagtattacaataagaaacttggcccacagtcagcgagcaagaaagcctagattcatacctgggcatatggcttcagagtccacacgcttggcgcctgcactgcaccgagaggggctgctgggccgggagtcccccacctgctctctgttttcaaactccccatttcacacccatgccaggtgtgatgaaatcctctaggtgatgggcagtggacatgagtggttctggttacagttggacttcactggcctgtcccacacctgaggatatggattctagcccatgggaccataagccaggccccctgagggtctgttatttgtctgggaagtggcagcgctctttggaatcttgttcatgactgacaaacacccccacgccccttcagccataattatcacctagtccccagagaagggccatgggtgggctgactgtagagatagacgcttgggtctctggctgggaacaccacatgcaagagaagaggccatgggctcgccttccatccagctgaagtctttctggccgggctgcaggcttcatgcaacacctttcaacctgtaaaaggaaaaaagaaggccgggggtgggcctcagctgctgccactggcattgtatcactgaagcgttttttgttgttgtttttttttttttgaataccggaaattaaggggaaattcggaaacctcataatggcttcatgaaccattgcacttg

SEQ ID NO: 45638 - DNA, 1050 bp, Homo sapiens
cactccagcctgggtgagagagtgagatcctatctcaaaaataaaaaataaaaaaaaaatgaaaaaaaaaataaaaaaaaataaataaaataattaaaaaaagagctgggacttgaagccagataataaggcaggcagagggcatacgaaacacccagatgggtcatgagcccgtgcatcagtcagggtctaatggctcagctgaggaagggaggtttaaggaagagactgtggacagaggtgttagggaaggtgtcagagaaggttaaggagccaacatggatcatgggggtggtacagtgttgccagggctggggaggattggctgcagtgtggggtacccagccgctgccatgtggagagggacctgtcactcctgctgtgaactctcccttcttctgccctctgacctcctgctggtgcctcccattggctaaacacagttgatggccagtgcactggggagctgttcttggagcccacaggcatctgcttcttggcacagagcagacaatggattgagtcgggagggaggggaactagagaatacccaagtcccaatggctggagaggagtgagcaggtaaagggggtagaaggtgaagtcagagaggccggggtccacactacacagggcctttggctttcttcggaaggagcaggaagccagtggagggtttgagcagatgtgtgcatcacggccactgccatcaggagaacgtctttctctatgctaggtgtgaacagtcaccccttcctctccctttctcaggatgagtgctgaggaggaaaaggccctttcctccaatgtcttcagaggagacgtctgcccagtccagactacgtgcctcatgccagccagcctgtaaatgacaggaaagagaaaggagcagtgtctcaaaagaggatattctggaacgtttgataatcagagcccattgtaaagtcatgttttgagttacagcatttaaatctttgttccagtggaaaacttttacaggccgtcctgggcaaggcttgaatcctgtttggatctccaaaggccttaaaa

SEQ ID NO: 45639 - DNA, 1034 bp, Homo sapiens
aatggcctaaatgaagagtgttttctcaagtccctatagaagagggagatcctcatggctttcaaggagtcatgcccaagatacaggaatggctctctggtggactggctgggacagaggggagagggtgaaagtggggaggaggaggaagtttaacagtatttgaagcatttgaaagcctagacccatcgtacgctgaaacagagaagaatggctagccaaaaatactgtgtgagtctaggaacttaagaatgctagtccttgaccccaaacatacttatatagcagactcaacattattgtcttccacctaccggatgggattatgcaagtgatatgacccagagcattctggaagccggcaggggcataaataatacattagatatgcagatgaactgcccagggtgtctctggtcttgggaagaattcttagtagacctgagataattgcagaacagagtgtcctgttttcccatccacagcctccaggcctggcgaggattttgtgttcaaaagagatttccaaggtggacatctctctgacactggcgatttttctctctcacttgaacaaaactcggcggaaaggtcactcctatttgtcttagcttctctgtcacatcccacccacactttgaaaggtctgttcttagcggggtcccaggaaggctgtgctggccctgtcagccctgagctgggtggtagtcctttatcagagatacccatgagaatcactcaccctggagcctttcccaagcacacatcgtggacccctccagggctgcacatgtgctttgtaagggctcttcaggtgactggagctttaagagctactgaactaagtggtaataaaagtgaacaaagtaaccagtctggaaatgtcagtagaatggaaagaaagaacaggtgggagagttctccattttttcacggtaagacccggttacttggcttttgttgagtccctggtgggtgtccatggtgtctttggccttatctccctactaaacaggattacctgtgtggggcac

SEQ ID NO: 45640 - DNA, 1144 bp, Homo sapiens
ggcagcagagcctttccataggggtgtggtgtgacctgaatgttgggcacgtggtcgtaactgagctttaaaagtgaatgagaggagccatgcgtgatggctcgagcctgtaatcccagcactttgggagatcaaagctgggggatcacctgaggtcaggagttcgagaccaacctgggcaacatggtgaaaccctgtctgtactaaaaatacaaaaatcagttgggtgtggtggtgggtgcctgtaatcccagctactcaggaggctgaggcaggagaatcgctccaacctgggaggcagagactgtaatgagccaagattgtgctgctctactctagcctgtctcaaaacaaaaaacaagaaacaaaaacaaaacaaaacaaaaaaacactgtctcaaaaaaaaaaagtgaataaagagagaagaaaggcggggcacgatgctttttaagtctacgagcatcttatagcattgtttacatcccagcttttcactgacccttcctttacccccgcccccatcccgtggcccttgctctgtcctgccctttctgtacggcgttttctcttcccggctcctctgcccccagccccacgtgccaacttgtttcagcctggcaaggaggcctgctggtatcccagccatttcctgccccaaggccgcccaccctcctccgatctagcatggccttgccctccgtaggcaggcctcacccctgcggcagccgggaagcagggctcctgttttgcctgtttaccctggcgcagggacaggtagatcatgtagcactgctgggatgccagctgcgtaagtctccggcagtgggcacaggcggagggcagggggcattcctctgggctgactcgagcccggcctgcctggcacaagaccccctgctcctggaggcagctcaggggcttgctcatggctgccctggctctgcgctgggccgctgagtcatcgctcagcagtgaggcctctgagtcacagtgcagccctggactggacagtgagtgccttgtgggaccctcctgggctttcctgtccctcagagcatttaaaggggtcccaaattgtcatgtgaccctctctgatgccagagagacactctaggtctttcgcgccctggtcattttacagaac

SEQ ID NO: 45641 - DNA, 1081 bp, Homo sapiens
ttcagttcaagtcagcagccgagttacaggaaagcagccagggcaatgattcagcaagtccaggcaggagtgaaccaggcaagatttcgggaggagagggctgggtcgcgtgtcctggcagggccacaggaagagcatacacatctcctgcgtcttcgtattttgtgagtgtcttgaaatgaccttgagaatctacgcaataccatgaagaagcaggagcaggaataccatttatccattggcacagggtagcatgctcagtgtgcactgaggttgtgaattcttgtcctgacccaaagatgctgatgctgtccttatacccatttcacggttgaagaaactgaaggtgtagtaggagaagatactgactcagaggcacagagttagaaagcagcatgtctgggatttgaccccagacctgtctgactcagtttactattttaaactacccgattcaagttaagtttctctcctctctctctgtctctctttctcccacgtggctgctggaatcttccctaaggaccatagctgtctgcagtgcaggaagccaactattaaggggaaacaaaagtgttcttaggagtcctgctgtcactgtggattgagccggtgaagccctgagggatttcatcgctgaggtggatggagaagcagctgggggccttggctgtaaggacccctaagggttagtgtctggagcttgggggatgggaatgggtcccggtgtgcggaaattggatggctcgctgaccccaaggggaaacccttgttgacgctgtaaagtgtcttctggccttagagaaaccctctagggttcaggttccagcttcaccctcctttagtcaggtggctttgggggggacatttctgctggccctggcagacactggactagagcagtgtttctaaagtgtagccccttctctctcccgggaagggagacaagtgggtgaggggattggaatctgcattcataacacactccccaggagagactggagagcacctttcccggtgaactcccgtcatgtcaggcctcagcagactgagcgggaacccccaccagcgaggttgctca

SEQ ID NO: 45642 - DNA, 1356 bp, Homo sapiens
agtcaccactccacaggcaatattaggggttgctgaggcagcctccaatagtgtgagcattctaattactgcagcaaactcttttaaaaaaattttaacttttctggctgggcgcgttggctcacgcctgtaatcccagcactttgggaggtcgaggtgggtggatcacttgaggtcaggagttcgagaccagcctggccaacatggtgaaaccccatctttattaaatatacaaagattagccaggcgtggtggcaggtgcctataatcccagctattcaggaggctgagacaggagaattgcttgaacccaggaggcagaggttgcagtaagctgagatcataccactgcactccagcctgaaagacagagtgagactccatctcaaaaaaaaaaaattaacttttaatttttattttttagagacagggtctcgctttttcacccaggctggattgcaatgatacgttcatagctcagttcatagttcatagcttagacctcccaagctcaagagattcttccacctcagcctcccacaggtgcacaccactatgcccagctaattttaaaatattttttgtacacatgaggtctcactatgttaccaggctggtctcaaactcctggcctcgggcaatcctggactccccagatgctggaattatgggttgagccatagcctgcagcaaactcttaaaacatgaggggaactatcttgttataaagttgcttttctttgactactggtgtggttggccagcttttcatgtttatggcttatttgtgtttgttaactggtcatttcctttggggtgttagcaatttttttctcattgatttgtaagatctgtcttgattaacttgtgaattttgcagatggtggaaccggggtgccccacagtaagtcccctttgttaggcatcctgtccctggattcgacacctccatttctatgggggacatttctttacaaatctgcatctgattgtgataccaaaccatgctttgcaagtgaatacaaggatctaccccattaatctgggcagttgctagttttatttatttatttatttatttatttatttatttatttatttatttttccgagaccgtgtcttgctctgtcacccaggctggagtgcagtggcatgatctcggctcactgcaacctccgcctcttgggttcaagcaattatcctgcttcagcctcccgagttgctgggattacaggtgtccgccactgcgccagctaattttttgcatttttagtagagatggggtttcactatgttggccaggctggtctcgaactcctgatctcatgatctttctgcctcagcctcccaaaatgc

SEQ ID NO: 45643 - DNA, 1035 bp, Homo sapiens
gacaaaggccgggctgttgggatggtaatgccctctgggctggccttgattgaaggtaaaaaatgaacttcgaggatagcccctgtggctgtgcagtctcattttttatgcagatatgttgggggatgcagagacatggtggcgggtggggtggggagaaggggactgggaaatctgagacctgaagctaagatctgagatgtcatcctttatggagcatctccggatgaaaatgtcccagaggccctaggtcactcaccctctgccccctaataaaatcactgttgctgcctcctgctgaatctgaagtatgccttcactgagggcaggacgtccatctcaactattatcaaaggaaaacataacaagaggcaacagcacagcccccggggcatgaggctccttcctctgtgatccctctgtccttgtctgccagtgtttttttccttgacttttaaaataatctttttcttattatgaaatagatatttattttgcttaacaaagaattctgtagtccttctagaagctaggtaactcttctaagtcctttgcaaatattaagtcatttaatttaatcctagagcagttctgcgaggtggtgggaagacctagagaggttagggtccaccttagcactagctctctgagctataaggcctcagggtctgtggcattccctactcactgaaaagaagggaatttaaaacatgagttccaccacccagaaatgaaacagtgttcatttccagaatccaggcatatggttgattttaccaatttcctgtcacttgaatcacagttttttttgtttgtttgtttttgtttgagatggagtctcactctattgcccaggttggagtacaatggtatgaacttggctcactacaaccccgacctcctgggttcaagcaattttcgtgcctcggcttccagagtagctggggttacgggtgcatgccaccacacccagctaatttttttgtatttttagtagagatgggttttcgccatgttggccaggctggtctccaa

SEQ ID NO: 45644 - DNA, 1845 bp, Homo sapiens
gagacagggtgtcaccatgttggccaggctggtctcgaactcctgaccttcagtgatcctcctgtctcggcttcccaaagtgttggggttacaggcacgagccactgtgcctggtggacattgggtctttttagatgtcattacttaagatgatatcatattggattagggtgggggctaaagccaatgacccatgtcctcagaggagaagagagggacataggaaagaaggatttgtagagatacagggagaaggccatgtgaccacagaggcagagattagagtgacacagctacaagccaaggagctccaaggattgcaggaagccaccagatgccagaaagaggcaaggaaggatctttcatggagccttcagagggagcacagtcccgctgacaccttgatcttggacatctagtccccagaactgtgagagagtgcatctgctgatgtaagccacccagtttgtagcaatttgttatggctgccctcagaaactaagacagtagccaacacagaaccaaataccctttggggattgagggaagtggagcgggagaatgagcggcactccctccctttacataggactacttggtaaatatttactgaatgaaggaaagctgaagtatctgtagaactggccatttcattctgcatttagagctctgggagctcttgaaatgtctagacaaacatcctcttcagctagaggaagctccttctcccacttactagctatgagatcttgggcagatggcttaacatttctgggcctcagtgaccttacttgcaaagttgtctgggtcaaggcaatgattaaatgcgatgatgcatgtaaagccccagcatgcagcctgaaaatgtgagcccttattatttatactgtttgccaaagtggtgagtagtgttgctgaatatgccgtgtgtcctattaactctgtgacggccacagtcacgtctcctttctgcctcctcctcctcctcctctctgtccagtgactagggagggcaggaagttcagagggtgaaatgctgaattaattcctgtcctcctggtctatattccagatcaccctgtgggtgggttgaaaaccatgccctgtctacctcctctgcaaggaaaaaataaagacagagagcaaatctaaaacacgcaatgcagaggaatggttactgcctgctgtgtgcctctccagggagcaccaggaggggctgtgtgggacagggacactgcgtataagtgacactcctccacattttggcctggagttagcacatacaactgcctttttgctgacgcgatgcccaggagccctctcaggggatggcaaatctcagaataaatgtgttttttactcatggaatgcaggggaatggatatgaaaacttttgtatcaaatagacattagcgaggagagggatgcttcacatcctaggtttgtgtgatgtcggcacagctgatgaggtctttgcaaattttgctgctgaggaagggatgcgctggactcccagtgtccaggggccctctgcttgtctgtccttaggcagagtccaccagaatcgggtaaagtatgtgactgcctcttagtgtagggcatgacgtcaactgtgaggagaagagatcaagatacagctctttggtggtgttttttgacccatatccaggaactgttcccacacccagagaggaatatctgcaagttctggtgccagatgttgattcaaaaacaaaacccagcgaagcatctgtacttttttttctgattgtattagaagtacagtccacaataatatattgtacatttaaaaataactggctgagcgcagtggctcacgcctgt

SEQ ID NO: 45645 - DNA, 1060 bp, Homo sapiens
ttctaacttctggaagcacaaaagtgtgtttatccttcaggagcattcttggctgctgaaaaatcatcatggctagctttcactttcacgtattgagctagtaggtggtatcaatagtagctaatatctatttcatgtttttttgtgtaggagggacccggcgtgcaatttgcatggattgtctcattttatcctcccagcaggtaaaagagctgggagggagtaaagggagttgttaatttctgagaaggaaggtgaaacttaggaatgttaaatacccctcttggtgtacacagtatgcaatggaggcagggtgcaaatgtgctatggagatttcagagcctgggcttcccagaggaggcctttgccccacagaatctttgctccatttctccactttgctgcctctatgaatcaatgattctgtgttgtccatttttcctttgcaatcttttgccatctcttcattaaaaatggtctccatcattctggccaagcacagtgactaacatacaataggtgtgcagtaaatgtctagtggatgaatacccagtgtgaacattaattgagcaccactagctgccaagcagccaagcaccctatatctgggagatgtagaatttaaggctgtgtagtcactgtcctcaagctgctcacagctttgtgtaagacactcaagggaacatgcaaagctcagggcagctcaatttggggcgagggttatggagaaaatacagtctgcatgcttttagtacatgcagttctgcatcttggggtgcagtgctagagtgaatgacacagtagaggtgacaggcttaggatttaaatttgataatgtcatgatgccatgggagcactggagaaggggcagcagtggattcagctgagagtcgcaaggggttaatgagaagattgggaaaggctgcacagaggaggagaagggctttgtaggatgagtagaggttcaccaagggtgggtaacagttagaggaacagcaggtacagaagcccagaggagaatcagtgaatgacacatccaccatgtccagagatcagggat

SEQ ID NO: 45646 - DNA, 1033 bp, Homo sapiens
tgcaggaagcctactgatctttgagttttggcctgccacctggcccttccctcgctctgcagtcttggttggcctccaggtgtgtgtgtgtgtgtgtgtgtgtgtgtgtgtgggtgtgtggccctgggctgcactgtgcctgctggagcaggtgcagttgccctttcaccatgcgtgcttctttggatgtgaccccttgggtgcctgtgtatttagagtggaggaacgtcctccactataatgatgagaagtgtcattgctagttgcactcagttttctatggtgtttgggggagaaattggggtgctggattttggttttaactctttcccaccttaaccagtgactgtggaaagttgcacatcgtccccttcctcacagctggggtctgttcttcctccgggtgttacggtttgtgagagccaggagggtacacagaggtggcctgatttctggagccatagcaagaagggagaggtgtgtgtcctctctgtctctgtctctgtctctgtctctgactctgtctgtctctgtctctgtctctctctctctctctctcttctttctccctctccctttttcacatgttgttttctgattataagaggaatacttcatcattagacatatttcgagcctccgttcctcatctatgaaataagcatagtaaaggactgaaggatttaaagggatgtggccaagtgtgcaaagtcatatgtgctcaataatttattttccttgttttcttttccatttccttcttctcctctaaggcgctccacatctccgtgatatagcgtgtactcctttcctcattttcttttctctgagacaaagggaagttcctagttctgctatttcctagttcagtgaccttggacaaggcaccctggggagccttagctgctcatatgcacaagcttctagcaactgcttccaagggaagggtggggaggaagggagaccctgagtgtttggaccccgcctgtgctcagcacagaatggagctcagtaagggcaggtcgtgggctcc

SEQ ID NO: 45647 - DNA, 1030 bp, Homo sapiens
ccatcactcgtattcttttttatctccaaggcctcatgctggaaagagattgattgctctctgagcagtaagtcctctgaaacagggtttctctggggagttctgtggcacccctgccttacctgggggacctggcaaagaggcaccctccaccccccctcaccctcagccaggtttactgaacagagttacggggttgggcctccggatctgcattggagcaagtccacaggtggtgcttaggcacactcaggtttgagagccactgacctagaggggaagactgggagaagccttttaagagaccagtactgtgacttgcaccatggagacacctggaaaacatacagtgattcacacacacgccccaaacagcagtgtgtgtgtgtgtgtgtgtgtgtgtgtgtatgtgtggtttcacacttggtttgctatgaatgctgtaatgccacccagttcccacagagctctggggactcaggttccccaagtcagggttcttttctggagtgctattctgacaggtttttatttttatttttttaattattttattttatttttattttattagtattattatatctgacaggtttttaatacagtgaatttgtatgtctcctgtgtatttattttagctgctcccttctttccccttctctccctttcctctcatctcctcccgctttcgtcctttacctttccctggatgatattagcattacccgtacactcttcccatctcctggcccctccagttctgaagggatggggactaagtgggatctgtcctctaagcaggcggaggagggaaccatgtcagctcctaggtgcccccagagcacctgctgccagttttccacaactcctgtcctccgtggcgcttgggtgacagcagagcagagccgatgtgcctgctcctggtcatgggctgttcgtgctgtcatcgctttcatttgccccatccccccaatttggacttacccagaatccttgggcaagctagatggctgccaaagtttacttagcg

SEQ ID NO: 45648 - DNA, 1050 bp, Homo sapiens
gattggcaaactttttatatcaagggttaggtgacaaatgttttcagctttgcaggccacacagctctgtactgcttgtcagttctgcctttgtatctggaaagtagccatagataatatgtaaatgagtgggtgtggctgtgtgccaataaaactttatttacaagaactggcaataggcctttaggctgtagtttgtccttggcctaaataaaggaaacatgtttgtctttcaaaggcagaaactcctcctggatcataaacattgaaaaaaaaattgttacaagatgcaatatttctgtgagacttgttaagcagtatatgcgcagtgctttcattaggattttacagaaaacttagaagatggccttcacatggctagtttccttactgttcattcagcagacatttactgagggcttactatgtcctaggctctgatatccatacatggtaaaacgtaaaggcatgtgcattttggcagggggtgctgcattgacaaggagtggtctcggtgacagttttgggaagtcagtttagaacagtattggacacactgttccatccctgaattacacacaggcctcaatgctaacttgagtgggcttttggtccagcaggcctgggctccaggggcagtcactcagcgtcctgcctcaagagtggttgtgtcatgaaatcttggccctctttgactgatagctacaattatttgaagagtgtggtttttagaacaaaactaaatctgttttgaagctctgctgttttatacctgctgtgtgatcttgctcaagtttttatttttatttttttctgtataagggattttattttatttttattatgtatgtatttattttattttaagttctggggtacatgtgcaggatgtgcaggtttgttacatggtagacgtgtgccatgtgatttgctgcatctatcaccccatcacctagatattaagcccagcatgcattagctatttttcctgatgcctttcctccccccccccgcccccgacccacaggccccaatgtgctcaagtgtttt

SEQ ID NO: 45649 - DNA, 1049 bp, Homo sapiens
acttagcccaggcccatctctttacttccagaccaactggtgtcaccataatgccttctggcaatttgaagattctggcaacctcttaccggatgcagctggcaggataatccctgtgcattagccactttcagaggtatctgggcccccaaaagagtcacgggagtcccagacatgaaggagcattagtggccatctccccaccttgctgtatcagcaaaactgctaagccctgacccatattttgggcagtgctcaccctatctcattttatcttactgtatatctcgtttgtatcattttattaggtatcttattttatctcattatatggtaatctcatttgctgggtagaccagtgaggagggctgggacaagtgactggaattgcccaaggtcacagacaagtgaggtttagagttaggactccgaagcaggtggcggagtcaccgttgagttcatcatagcgatgctggctgcctcaaagtactgttttagttaatgctcacaagcaactctgcgaagcagacgggccattcatttgtgcttcacagtgtgggaaactgagtcagagcaggttcatgtcacacagctgataaatgacaaagccagatgtgaagcctgtgagttggattccaacattcatctttgatgaagcgttcaggttggggcctggtgtgggacatgctcagaggaggacgaggaggatgatttgggggaggcctcagaaggcgttcctggtctgagtgtgctgctgtcactgccttggtttgggtccccgcttctgagcaggatcttctattggcagagggttcaatgcagtgggtgccatgaaggaagatgtctccccaacagcatcacagtctcagggactgttcacatcacattaaaagcgctgagactctggcttttggtgaaaacggctattttgtcttgttccacgggagctgggaagaggagactaaacacaggagcctccccctaacccaggggcacatggagaaggaggaaggcagcccatgctggggagcaaaagggagagaaggcga

SEQ ID NO: 45650 - DNA, 1035 bp, Homo sapiens
cgaggaaaggtctgcattgaatcacagccttggcactgttccccccttccttccctcctccgttcattcccccgaacatccttttctgtgccgacaatgacctcagcagaaaggggaaaaggacgtgggaaggctgcatgggaaactcatggaacttggtagcaaacagctctgggttcaagtccgggccctgttgctcaggagccaggcactcagttgtggtggcttctctaaccgggaacttcttctatgaaaatgggactattcgtctctactccttgcattattgtggggatcggaaataatctgggtcaatgatgtggtgcagtgactagcatcgaggggacaccctctccacacaggctggaaagacatccagaaggagtcctgggctccctcaccacgcaggggctcagcctcgccagatagttgtcatcacccatccaggcccgtttctggtctcattgcttttgttcatgtactttcctcctgggttgctcttccttttctctctgacctgtcaaaaagccccattgtaagcaacatttaaatgctacctcttccatgaagcccttttggatgcctcttagggggatgagttctttccatcctagcactgcttgctgcatggtccaggatctgtggggcctgtcttctttaccactttgctcacttcatgaatgtgggggtgtatgaagagtatgatgaaattagaggctatgttctggagtcagactgatcagtactgggattctggccataccccctccttagctgggtgactttaggcaactgactgtaccatcctgaaagtcatctgtaagccgtgctgaccccccaaccacaggacacttgtgcccgctgcaggtgctctgtcagcagtgacttctcactacctggcatcctctgaattcacgagcagtttgaagaatgagcaaatactgagcaaagctcataggattaaatacacacagacctgtgtaagttaacaccaagctaagggttaaatactttacaaaaattctcagtgcggtt

SEQ ID NO: 45651 - DNA, 1047 bp, Homo sapiens
gacccaagttccattatggacgatcaggcattcaggggaaggagggatccaaagcagagacaaaagcagccagccagctcatcccctctgcagctgataccgaggaggaggatgccagtgggaagaagcgtggccatatggctggcaggatgcctcactggtaacagtcagcccggcccctttgaagtggttttaagaccaatttggtaacttgatttggaaagtggtatcgatgactccgagggcgcaggctgctcattagctgctgtctgggcccggcaaattggtttaagtggaatgaaattggttccttccctccccgtgctcatggctgaggtccaggcccgattgtaatgggaacctctcctgggcaaaggacatagaaaagctttccggggagtctgaccctcttttttcatatgtgaattctactttcccctgggggtcaaggcaataggctgataaaacataaaaatgaacctgaagtgggtggggtgagtgtgtgtgtgggaagttggatcagaggagaatgaacaatgaacagtggccgagtgtttttcaagggccagttaaccattcccctgttgagacactgtgcttgatgcattttttttcttttctttctttcttttttattctcccatattacaaacactgctgggaggaacatccgcacatgctttcttggtcacttatgtgagagctcatccaggatttataccctgaggcgacttcactgccgtggaggctaaggaacattttctgtttcataagacgcgatcacattgccctccagaacaatcatgccagtttacactcccactgactgtacacaagagccctgttttcccccatctggtcacccacatttgataggtcagaattttgctttttgccagtctcatgggggtgatgccatttctggtagttcccctgattgccagggggatgagcagcctgccctcaactgccccatgctgaaggccctccaaaggcagcatgaatcctcacagttcccagcctgtgccctgacaacctaggaggaca

SEQ ID NO: 45652 - DNA, 1046 bp, Homo sapiens
tgaagaaagcactggtttccttccatggtgttcctctttaaaccacaccttctcaaccttgtttagggagtggggatggccttcaggagctccagaggccccccctgcccgagtctgactcctggtttctggcttcaacaatgactaacctgtaacttcacattttggtctataaagtgggtagaaatgtagcacctctgcattctccaggtttgttgtgaggacgaaggagataatgaatgtagaatttttttttttgagacggagtctcgctctgtcgcctaggctggagtgcagtggcgcgatctcgcctcactgcaacctccgcctctggggttcaagcgattctcctgcctcagcctcccaagtagctgggcctgcaggggcactcccagctaatttttatattttcagtacagacggggtttcaccatgttggccaggatggtctcaatctcttgatctcgtgatccacctgccttggcctcccaaagtgctgggattacaggcgtgagccaccgctcccggccatgaatgtagaattctgagcccagggctggctcactgggagtgggccacacatttagggggttgttgttgtacacatgatcatcggtggcactgctttgcagcctaatggtttttgacacatgtgttccttcttaatccttaagccagcaccttgagttgggtgtgatcaactcattgaattttttaacttcagctgtgacattatagatcatctagctctgctgtgaccttattttgtagatgacagggctaggggttaccatccctcttaaggcctagggcctgggtgttctcacacccaggttgcggtttttgtccttgtcttctggaggttcgtctgcattttatttttttttgttgacgatttgttgacgaggctggagtgcgggggtgctatctcggctcactgcagcctctgcctcctgggttcaagtgattctgctgtctcagcctcccgagtagctgggattacaggggcacaccactgcacctggctaatttttgtatttttagta

SEQ ID NO: 45653 - DNA, 1014 bp, Homo sapiens
aatgtcccttttgactattttttcccaattatggatcattattgcatttagtggctgtgtctcatgttccccagtcatacttgactttgattttttttttttttttttttgatatagagtctcactctgtggtccaggctgaagtacagtggcatgatcccaggtcactgcaacccccacctcccgggttcaagtgatcctcctgcctcagcctcccgagtagctggtattacaggcgtgtgccacaaagcctggctaagttttgtatttttagtagagacggggtttcaccatgttggccaggttggtctcgaactcctgacctcaagtgatccactcactttggcctttcaacgtgctgggattacaggcgagagtcaccgcacccggacgactctgacatttttgaagagtccaggtaagttgttttatagaaacactcctcagtttgggttgagactgttatttttgaaagctcatactgcaccacttgctttaattctgtaatcctcaatggtcccctatggctgctgatcacgtccgcgtctctgtagataagaaaacggagccatcgggaagtagagtggtttgtcaatagtcacattcccagcaagtggcagagctaggattcaaatccagactatctgtcctgaaacctaatttgcctaccaggcaacaggaataaggacaacaattagaccctgagaataacaaagtgtttatcaagcacccactctgagccagaggttgtgttgagcactctgcagacactgcagtacaatactcccatccatcccaccccagtccaggagcagctgttttatgttgttgttgttttgagacagagttttgctctgtcgcccaggctggagtgctgtggtacaatctcagctcactgcaacctctgcctcccaggttcaaacaattctcctgcctcagccacccaagcagttgggattacaggcatacgccaccatgcccagctaatttttgtatttttagtggagacagggg

SEQ ID NO: 45654 - DNA, 1175 bp, Homo sapiens
ccccgagtagctgggattacaggtgcctgccactgcccctggctaatttttgtagttttagcagagacagggtttcaccatcttggccaggctggttttgaactcctgacctcatgatcctcccctctcggcctcccaaagtgttgggattacaggcgtgagccaccgcgcccagccttccaggctggtttcaatcttctggcctcaaacgatcttcctgcctaagcctcccaaagagctgggattacaggtgtgagccactgtgcccggctgagtagctgctttttttttttttttaatcctcgatttacagatgaagaccagagaagctaggctgacttcccatgttgacacagcaactaactggtggggatcagctcagagctgggcagactatgcacttcccaccctgccctgcaccccatgctcggcttgctggatttgatagaatctagcaagcgtgggggccaggctctgctgactccctgtgagaagcagtgtctgtttctgtgtccttttctggggccttctccagagggaaggaacatatcccaaagctggagcttgcactcaggagcttcccaggggaaactgctccactctctgccatctacagctcttgcaggtaccatagtctacctccatgatctatttgcagtgggcgatggtgttttgatgatttccacatcatgaacccaagtgctgttgctgatttcgaagcttgttcactgtctcctgccaagtggccaagggctcctaccctagcccttggtggctgctcctggctgccatctgcccacccagttggccccactgcctgggccacgttctggtggcatccaagaactggtagcagagatggtgattagtcaatgtgtgttataccctgggtctctccatctttccaacagagacctgccttacatgtaggactgcctccccttgttcaggttacctagcccttgtgcaattcaccttctgattggagaaggaagacaatacggccctgcctctcggcctgtagagaggaatggatgatgtgaaactgtggcatgcttgatattctgctggcagagaggagaacagatgttaacacagagcacacctctgccccgaacctcctgggagccttggaggtcctgagtcagcctgtccttggcactcaggctcttcag

SEQ ID NO: 45655 - DNA, 1032 bp, Homo sapiens
ctacctagtattcttggaagaaggtgaatgaaaatgctctagtaggggagggaaacatgattaatgggtgggggcttatgagtcagaaagacccaaccatcacttctgccctgactgcctgtgtgacttcagaaatgggggatatcaaagcctatctcataggattaaacagtttaatgtgtataaaatgcctaacacagtgcttgccacataagcattgctcattaaatgtcttctcttcttgtgctcctcattcagtgtatagtaaatgtgcagtccttatcttttaaatgaatgaaacatctcattaccaaatctattcaaggtaaacattgatattaatatgtatcctttttgtgtgtttctagaatcctgttacacctgggatttaggcactttcaatctgaaaaaatacatatcctttcagcactctggacggacttgagaactgtccttacgtgacctaaagctggagtattttgagattggagaattaaggtaagcgactttatcttcctgatccttgtgaaaccaaaaatagcttttggagttgacgacctcctgcagcacagcttgggttgtggttcttgacctctcggtgtgtcttcctgtgccgctccaatgtgttcgggaagctggctccccataacctctccccgacctggttctcagagtctagtccacttattcattgtgcctaggaagctctccctctgtccctagtggagggaggagcccaccatctcctagtgaatgcgccacttgtagcagaaggtgcaggatgctccagctgtcttgtgaaaacatgtggagacagccttggggaaaagaggaaaaggtgaggtgagggttatataatcagattgaaacacctttgggacatccagaacatgagctcttcctcctttcccagccaatccgtgcttcctcctttcacctccttgaattctatgctccttccacactaaggctgagggtgcaggaggtaaagggttagaggttaagactgagtgcttcaggtagacttgggtt

SEQ ID NO: 45656 - DNA, 1029 bp, Homo sapiens
catgccgggaggcttcctggagcaggtgctgcctctcgtgactcttgaaagatgcttgtgaataaagcatactgggagctgagctgctgtttagtaattaaaaatcctttccattgtttagagctcagcacctttgtgcattcatattacgcattcattttcgtatcattgttgaatttctcacttctgctactgcaatgtatgtctacagctgacaagtcttccttgggagccctacgtagctcttttttttcttttctttcttttttttttttttttttttgagacggaatcttgctctgtcacccaggctggagtgcagtggcgcaatctcggctcactgtaagctccacctcccgggttcacgccattctcctgcctcagcctcttgagtagctgggactacaggtgcccaccaccacgcctggctacttttttttgtatttttattagagacggggtttcactgtgttagccaggatagtcttgatctcctgaccttgtgatctgcccgccttggcctcgtagctctttttgaccctcagggacagtcactgaattatgtcttgggagcccatgcttctgaggcaggcttagggagcaggagagcatacaggtgtagcagcctttccagctgatccccatgccctgctgcacctggagggctggaacaagctattctcatattggggaaaagggctgatgggacctcagtcatgtggcagagaatctgaaagccagaagcttggcaggtctgtctcggggtggggtgacggagagacatttccctagaattcagctgctgggagcagaaagacagagcaggggcaagtgctgggtttctgaggcccgcagtcctgagcatggcctcaggcagtctgttctatgacagaacctgaagaaaggcccaggcatttgcatctatgtgtgcagttctacttgtcctaaaggcacttctcacactgggagcctgcctgtctgtacctgtctagaaatcagcctggctgggacgcacaccaataggagggc

SEQ ID NO: 45657 - DNA, 1030 bp, Homo sapiens
cccctctgctgccacacccttgtgcacatcctccagacacttttaaagaataaactctattttcagaagagttttagatttacaggagaattgtgaaaacagttcaaaaagttctcatataccctgctcccagttttccctgttactaacgctttgcattagtgtggcacatttgccacaattaatggaccaatattgatacattattatttactgaagttgaaacattactttagtttttacctggtccaggatcccatctgggatcccacatcacatttagtgatcatgtcttcttagattgccctgggctgtgccgctttctcagactctcctggtttgtgatgacattgacagtcttgagttttgatgaccagttttgactggtcaggtatttcatagaacgtacctctgtgagggttgtctgattcttcttcttattagattgggattatggaggaaggccacagaggtaaagttccgcttttatgaaatcaagggtaggcaccatcagcatgacctatcactgatgttgactttgattacctggctgctgtagtggttgtcaggtttgtccactttaaagatacttttgtgtttttgttctttcttaactccctttttatattaaactcttcagaaggaagtcactgtgcatagccatcccctaagaagagggcattcctgctcttccttctccatggctagaggatctacatgaactatttagattttttctacctgggagatttaactcctctctcctatttatttatttatatatcagcatggacttgcaggtatttatttgataatttttaatttatttgagttataatccaataatatggttttattttgttgctcatggtttttcttccttggctattgggaactcttcagttacttcctgtgcccatttgacatactttcttattatgggtctttctttcttccttttctttccttctttctttctctctctctctctctctctcttccttccttcccttcctccctccctcttttc

SEQ ID NO: 45658 - DNA, 1032 bp, Homo sapiens
agtagaaacggggtttcaccatgttggccaggctggtctcgacctcctgacctcaggtgatccacccacttcagcctcccgaagtgctggggttacaggcgtgagtcaccacgcccggcccccatccacttttaacaaacttgttttctttttgcccacattgactgacaaaagaaggtaatgaacagagatgttggaaagttcacgtggggcaagaggagtgggctgagaacattggacttttccctatggtcaatgtggcctcattcaacaaaaatcaagatgagtcagatgcatgtagaaagagactccgaaatgtgtcctgcctagatgtttgcaaaccgggactctgtgttatgctcacaggcctttgaatgtgtctctccctgggcttcatgtgcccttgctggtttctggactgtcctgttctgctcctgtcctcctactgacagcctttcctgctttcctttccctcccatgccactcccactccatacaacctcttcccctgcacactgctcctagaaccccttggttagccccatcagggatgtccctgctttcctgggacccgaggcacacagaatgaggatgaaacagttgacgtatcatgtagtatcccccacctggcttccttctcagccaggcgtcccaaactcaattgtctgcagaggccaggcaggcaacaaaaataagtgatgtgggcctcctgggcagtcaggagggcttggtgcagaactggaagcaccagaggtagcaaggaaccaggagatcaggccagcacctgctctgaatggtcaggcacctccatggttgcatagcaaatcagttgttgagaaatgttttgactatggtccttgtgtaggcccagtataaagggggaaatggccagtctgtggctgctgattatggccctgaaagtctgcaggcccagaatggccagacctggttgttcaaaggaaaactggcaggtgggaagggcggagggccttgccccttcccatttgcctcctgtgcctgacagtgtcaccg

SEQ ID NO: 45659 - DNA, 2104 bp, Homo sapiens
tatttcattgtacaataagatccccttgactcttgtgaattataatgaacattagtctgtaaagcaggtccttgtaatccagccagtttgtatacagtaggtaatcaagaactatggatttactgggtttattgggtgggggagaagggagggctttattcaggtgccagcacttcttcacctttctctacatttgctcatcctggaggtggggttgagctgggtctgccttgtcccctcacttccctctctgccgagagagtcctgagcccacccattactggtagcaaagcccggggcacaatctccgttttcctatttgtaaaatggagctaacagtagtacccatctcatcagatggctgtagagatgaaatgagataatgtatttgtggcgttaggacaacagtggtcctgctacagggagaagcctgggccaggagatagactagtctccagataccactgaagtagcctttcgaataccaattacctgcctcactttgcagctgtgcagccctgaacaagttactttccctctctgattttccagtctttgttacctgtaaatgtaacaatgcctttctctatgttgttgcgaagtccacataaagtgacatgaaattgattataaaatacaacacaggctgggcacagtggctcacgcctgtaatcccagcactttgggaggtggaggagggcagatcacttgaggttgggagttcaagaccaacctgactaacatggagaaaccccgtctctactaaaaatacaaaattagccaggcatggtggcacatgactgtaatcccagctactcgggaggctgaggcaggagaatcgcttgaacctgggaggtggaggttgcagtgagcggagatcacaccattgcactccagcctgggcaacaagaacaaaactccatctcaaaaaaaaaaaaagttacaacacaaaggttggcaactatcactaataagtttgactgggaaacctcactactacatttgtattgtcttagaccaagcttgtgagatttttttgttatttgtttttgaagctcatcagctatcgttagtgttagtgtattttatgtgtggcccaagacaattcttcttcttccaatgtggcccagggaagccaaaagattggacacccctgtcttagacttttaaggagctgtgactgaaggatggagactgggccaggtggggcttggtgcaagtttaagctcttaggtcatttctaaatagcaaacctctcaaatagcatccaacagatatgccctagtcttgtcgtctttcccctgctatcttttgtacatgtaccttctgctgactgcagtgtgtcctggagccctgacttagttaaacctcagaacatccctctgcatccggatgcatccagtactctcggtttgtctggctcctgctgtactccctgcatctgcccagctgctgacacagccacatatggcttcctttgccccagctttcagcattctggtggcttgtagtgctgagtgctagcaaagaaagtgggtactctcacacactgctgctgaaaggtggagggtgatgaacaggaccaacagctctaaaagacgtttcaaggccaggtgtggtggctcacacccgcaatgccagcactttgggaggccaaggcaggcagattacttgaggtcaggagttcgaggccaagcagccaacaaggtgaaaccccatctctaccaaaaatacaaaaattagccagatgtggtagtgcgcgcctgtagtcccagctactcagggggctgaataaggagaatcacttgaacctgggaggcagaggttgcagtgagctgagattgcgccactgcactccagcctcagtgacagagtgagaccttgtctcaaataataataataataataataataataataataataataataataaaaagataagggaaatttgggcaggacttctccaagtttagagtatatgcaccctttggcccagcaatcccacttctcggagtctgtaccctagaaatagtgagggaagtttcaaaagatatttattcaacagcattagtaatgtatcagaaccttgaagacagcctag

SEQ ID NO: 45660 - DNA, 1067 bp, Homo sapiens
ttttgtaagcatggtgggtacttagtcaatgtctcaatcagatttgcttctgtttagcaagataatcttttgtgggggagtgttatggactgaactgttttccttcttccaaacgtatatgatgaaacctacccccatgtactcagtattaagaagtggacctttgggagataattcaggttaaatgagattatgagggtggggctctcgtgatgaaattagtgccctcaaaataagagacctcagagagcttactgtctctcttctctctctgctacgtgaggacacaatgagaagggagccatccacaatgcaaggagagggccctcatcagaacagaccatactagcaccttgatcttgcacttgtagtcttcagaactgtaagaaaatgaattttctattatttaagccacccagtctggtgcagtctattattgccttccaaatggagaaatacaaggaaactagggccgtcttagcttcacagagagaagatgtggagaggagttaggaggtagagactggaccttgatggtggtgatattcaattagtgaaaggctgagaagaggtcaaatatacttcttgtggccccaaagatcagaaccaaaatggaaaggtagaaacagtaggcaaacagaaagcaacttaataaaaggaaaaggaacctgagagaatgctctgtctctgacagtggttgggatctcatcactggagatatccacacagggactgtattactactgagagggggtggggctgaaaggatccaagcattgcactgtgatgcgaccccataaggtcacttagtctttgggacttgtgagctcacagtgaatcattacaaacagaaacgattccctcttatttgtggagcacattaaaatttccaaagcatttttgtgagtacattagctcccatgatttatatcaaaacattagagttgacattcaatacacatttgctgaatgagggggatgcatgaaggagctattgtggtaccttggttggcagaagaggaatacatgggcagagtcatttctagacttgctaggaaaggccaagc

SEQ ID NO: 45661 - DNA, 1063 bp, Homo sapiens
ttgtgttgtgcccctactgtgtgccagacactgtcctaagcactttacttatattaactcatccagctcacaaccaacaaaatggccctaagaggcctctgctgatatccccgttttccaaatgagaaaactgtccacggggtcggtcagtaacttgttcaacctgggaatggcagagctgggatctgaagtccgggagcctggctccgtaggcctctgtttaagccactgcatctgttgccttgtggaatgttcttagaactgtaggatactggttcccacatggccgagagtcttctctcactagttcgtgctccatggtgatggagaagcatagttctaatctgtcattctgttgctctggagcctacacagccccccatcgcatctggagggagaagcccagctccttagcacagcacctgagaaataccctttacagtctggccactggctgaacattctttcactctccatgccacactgctctgtgagtaccatctgaaggtcctctcccttttctctgtcttctaaatgttcactcttcaatatctaactcaaatatcctcttctctaacttgtccaggaagaatgagtaaggccctttcctttgttccccaggctcttagtttctccatctctaatcacgtagattacagccctttctttggttttctccaggggaccaaggagtggggctctgcctttctcatgtctgctctgccttcacggtcccccacagtgtcttcagtggatggccaacctctcatgaacaggatgtcctcttgtctgaggttctactttgttccagccatggagtcatactctctttatcttttgactatccaaaggtgttctgttggacgactgatgccttcctccaaggtactttgggctcccaagtgtgcagttgacatttgctgtgccttctccaccaggctttagtttttgatgtatgctgagcttcagtggagatttgctagccttgggctttctgtgttcttgaatctctcagagtccagaagaaaaggaaagctgacactttctaggaatgacctgtgag

SEQ ID NO: 45662 - DNA, 1039 bp, Homo sapiens
ctccttgagcatatgaggctggaatctaagccctgaggtcactcactgctctcctgggtactatccctggcctcccgtccttttccttgagcttctgtgctctgcaaggctttctcattatcctttaggctacagagaaacaaggagacgggagagccttgaaatggaccttcaagattacaatgtgtagctgacattgtcagttaagttgggcagatctgacttcgctgattaagtggatgtatgagccgatcctccccagaagctgggatcagcttccccatctgatggtgagtcagacctgctggggtttgggtcctcgctccagcatggctgcctgtgtgaccttggccactttacttaaccttgctgaatctcaatttcctgatctgtaaaggaagctaaaaatgcctctcttgaggttgtagtgaggattaaatgtgatagcataagtgaaagtgccctttgaagaaagaggaaggcgaaagcgcttattgtgtcaggagaaatgtgtggagagccccctgttgttctcaggtgtctcatccttcccagggaaaaatccccatgccaagtcagaagaggttataatttggctcttactcttttattcaggcacttctttcggctgcccagggttttcagcttaagcaaataaattacccttctccactggactctgtgttctgcagccagccatatgtttaagcttgatagagatttttatctggcttggtaatattacccagcaagggatgacatttcttatcagaggccctgaggaatcagagataggagccctttctttttcctggccgccaggcctccatgtgcagggctggcagggaggctgggaggggctggctgggtctggtagtgggcatcagctggccctcatttcttaagacagcacttctgttagctgacctacacagaagcaggtcatttcgagatgtttgcgtcttggagccactgatagaagcagggcaagggagagtgaatgaggaaggaaggcgggagtgtgatgacgcatgcccag

SEQ ID NO: 45663 - DNA, 1022 bp, Homo sapiens
aacttgagtttaactgtctcttcttccagtggccaagtccaaattctgaaagcacagttctgaccatgtccctgtccaactcaaaaacagtagctccgtgtcacccacaggcttgaagtcagacctctcagggggcattaagtccaccgcaacatcactccagcctgtgaataaagactgaatgcctccgagcctcttatgtggggaatcagttctggtaaacaggtctcacttcttgtcttttaaacactacttgctttccttgacgtctgtgctttgatcccattgttttttctcccttggatgcctgagagatccatgggctctggcttcagagagtgctgggttcagacctcagctccaacagttgctggctctgtgaccctaggaatgtcacctcaccactccaagcctctgtatccttgacattaacctgggctgatagttcctacctgcagggttcttgtgagaagaacctgtctaaaggctcctactggggcttgacttgtcagataaatgaatggggttttccctaaccttctaattgactaccccactgattattcaaactccacctgtcctcaagttccattccatcattcacttcctctgtgggtttttctgccacaaagtcatcttcctctgtttgaaagactcttagttcctcatgtatgacagcaagagtggacctcatctctttctttttgtgtctgacttcccagcacagtctcaatttcttcagggcattgactgtggtgtaagattctcagcttgagcactggaaccatttatgggacgattgagtattcaactccaagagaatgaaagagagtcacttgttctttcattgaacgaaattgattgagtgcacatgatatgttgtgtctgtgcttcacactggagttgtaaggatgcataaaatgaagattctgtcttcacatagcctatcatccagtgaggaggttgcattattgggaatctgtgccaagcctggattgcataagacataggtagctgagaac

SEQ ID NO: 45664 - DNA, 1068 bp, Homo sapiens
tctcatctcagtttccacttacactgacaaaaagtctaagagtcatttccccccaactccattttagtcaccgcgaggctcaggaaaacagaatttcagaatcttctggaagagatgtttcctttcttaaccaagctaaatggactggaggcaggcaccgctggtgtttttagaaggctggttaaccacagtgcctagcggtttggggaaaaataaatcaggtagctttctgtggcacgagacattcccttaccacatttgtccacttgagcacttttattttattttattttatttttatttttattatttttatttttttgacagagtctcactgttgcccaggttggagtacagtggtgcaatctcaactcactgcaacctccacctcctgggttccagcaattctcctgcctcagcctcctaagtagctgggattacagttgtgcgccaccatgcctagctaatttttgtatttttagtagagatggggtttcaccatgttggccaggctggtctcgaactcctgacctcgagtgatctgcccttctcggcctcccaaagtgctggattacaggcgtgaaccaccgcacccggcccacctgagcatttttagatgtagacctggtgatgggtctgaggggcagcatgttctgtctgaatggggatctcaagctcagtgatgtggctttaagcaaaaaggatggcttcaaggtctagatttccttgggagcacgttttaacctaaacctgcataactagtaactcgaagatcttttaattttattgttttttaatttaactgaccccgttctccctccttttctccctccatcccttcattcctccctcccttccttttgacacaggtcacccgatatagaatcacacacctgggagatggcaccagccagtgaggctcaaatttgaaccacacacaaatctccaggggtacttggtaaatgcagacttttgaccaatttttcggcgtggggctgagcatctactctagcaatgagctcccaggcagtactgatgccgctggtccatgcatcaacccacttcaac

SEQ ID NO: 45665 - DNA, 1044 bp, Homo sapiens
agattcacaagccccaccaagaggatcaccccaggaacgcttggaggctgaggagttcactgaggctactgcatcttgagactcaggatgaagacccagcttggggctgtcaaaggtgcgacctgccagctgagacctccaggggtcgagcccaggcccctttgccttgttcatggcttaggccagtgcttagcatatagtaaacaacttgtaaatgtttattagaggatgtatggtgggtcatcccttctgaatggcacacagtccattgtcattgtcctcagaggctccagcctcaggtgcttcttaaactgcgatgggaatgatggcagcagatgggcccagggctcagcatgagagctcacagcaggctgtgctccaccccacccaggcccccagtcttgccatgtttcctctgcctccccaggctggcctagaaactgcttccaactgaaaccagccaaatgcctgcccctaaccacacctacaactctagggttacctttagtctagatcaggggtccttaaactgtagcctttgctgggtacagtggctcacacctgtaatcccagaactttgggaggccaaggcgggtggatcacttgaggtcagaagttcgagaccagcctggccaacatggcgaaaccccatctctactaaaaatacaaaaattatccaggcatggtagcgcacatctgtaatcccacctgcttggaaggctgaggcaggagaatcacttgaacctaggaggtggaggttgcagggagctgagatagcgccactgaacctccagcctgggcgacagagtgagactacttctcaaaacaaacaaacaaacaaaaactaagcctttgggctaaatctggtgagtgttctgtgcttgtaagaactctgagttaagaataatttttatgtcactaaagggttgaagaatacaaaaagaatattcagcagagaccatctggctagcaaagcctaaaatattgaccctctggccctttacagaaaaagtgtgccagtcgcaggattaggcagtactgacc

SEQ ID NO: 45666 - DNA, 1048 bp, Homo sapiens
tttttttcagagaagggccctttctggtttcccctgctgcccatcaggatgcactcaggcagcaactgtacagtaaaaggggacacctttagcctctggtttcccagagcagagagctgtcaacaccataagctatttttgcctcacctctggtgctccggagtggcaggccagtcacaggtgtggtgcatcagactatgaagaggctgggtggccacaactctgtgctgggatgctgacctctttgaggcaaacagcatgagctggaaaaagtgtgtctatctcagagttaaaaactggtgaattcccctgttgctctttaccatctcctgggtccgtatgatctgactgccacccactttcccctttcctcactgggctccagacacactggcttccttccttcctgaagcctccatctgctgccgagctcagggctttgttagacgctcaccctgcctgtgttgcttcctgcagtgtgctgaattgtgtctcccaaaagatatgctgaagttcggacttccagaacctgtgaatgtgaccttatgtataatagaaatagggtcttcgcagatgcgatcaagttcaaataaggtcactctggatgacggtggcccctaatccactggctggtgtcctgaggacagagacacacagtggggaggccttgagaagatggaggtaaaggtgggaatgatgcatctacaagccaaggagcaccaaggattgctggcaaccaccagaaactaggaagaggcaaggaaaggctcttccctacagctttcagagggagcacagtcctgctgacaccttgatttcagactgctagtcttcagagctgtggaaaaatacttttctgttattttaagctccccaatttataatattctgttatggcagccccaggagatgaatacatttctttctcctccttcgtttcatacctctagtgccatctccttgaagagtcgttctttaactcccagtcattactaggttcccaagttctacacctttagctctgcagcctattcccacgggagattct

SEQ ID NO: 45667 - DNA, 1050 bp, Homo sapiens
tggtgagggccttcttgccacataatagcatggcagagggcatcacaaaatgagagggcaagagtgtgtcagttcaagtctctcttcctcttactataaagccaccagtctgctgagcatggtggcttacacctgtaatccaagcattttgggaagctgatgcaggaggactgcttgagtccaggagtttgagatcagcttgggcaacatagcaagaccttgtctctaaaaagaaaaattaaattaaattaaaaaaataaaagccaccagttctatcatggagcaccccctttgattagtttacccttccaaaaaccccatctataaccaacatatgaattagggggattgagtttccaacacatgaaatttggggtatatattcaaaccacagcagagccacagatgtaaggtcatggaaaggccaagggagagatgagatatgtctctctagagactcaatttaactctgtagaatagaacaaaagtgaagccatgctgagaagccattgctgttgtccactatcctcctggctaagcaaaactgatgatgaacttttgtttttctcaacacctaccatatgccttgctcatagcaggtctccctatctgaaggatgaaggggttaagtgtggtgggccaaactgaagggcctacaagaaaatttgaaagtgcatactgggcttgaacctctggttttaacttatcaagtgctgttttgaggatccgcttttagggtggagtcatcagggatgtgaagagtagacagcctgaggtcacttcttaactctaacctcaagagctcctgttgtcttcaaagggtgtctgaggcagttgatctcttacccaagcccttgttacacctatgggctttgtggtgattgaacatgggtagttgatctatcttgtaatcaacaggagaatgagaacaggtgctatcatcccctgtctgatatccctgtgatgcaatagtctgaggagtctgaggcttttgtgcaggaaaatagtatctcaggtctcctgctatgactctctctctgggcccaggga

SEQ ID NO: 45668 - DNA, 1055 bp, Homo sapiens
ggcctttaaaaaggcatctgggaaaatgtcagggtgttttttttttttttttttgacaaattggaaatgccacattcagatgacttcttaggaagaataaaatgttgttattctgagtctaggtttgaactttaaagattcatctcattttagtataaagtgttttatttaccaagaacttcagtaggctttcttgtcacctgaatggcaagttaattcagaaggaacgtatcaaaataataaaatgagaaaagttaggaaccagcattagctgagtcacaatcccctgcttaaccttatttgccagtgcgcactcagaagaactgcttcttaccaaaacatctgtctcttcagctttcagtaggaagcagtgtcctttggcttacaaagaagtggtaacagaactaagcgaagatgaatgaaacagtttgaaattggcattggtagatttagtttctttttttaagcaattaaaagcccgcagcactgtgattggcatttttgacgtttagcttgtgctacttagtatcagagacttagtatcagggacttatcagtaagtccctgatacttactgtaattgctgtatcttgctaagacctgctgtttagatatttcttaggtcataaaatgaatgcttattagattgtttcttgtgagaactaaggaccaatgtagagatcatttattaccagagtatgattattagcattttatgccaaaggaattatttctgcataccccattcagcatttttatatactgagaaataacattaataaatatctaattatttgtccttgactcggcatttttcttcatagttgttaatataattaattttttcaccaagtaatttttttatcctttgacacgtgaaaagactaatcatataattacagtgttttcatcatgctactgccctactctaacattttgagttgtttacagtgcttacagagtccaggcttaacatccatatatatgtacaaggttgtctaaagttttgaggagagacaagtatatattggcattatatgcttgtacagctactg

SEQ ID NO: 45669 - DNA, 1849 bp, Homo sapiens
gatttacaaagctctcacataaggtcctggactattatagtacatttgtcaaagatgaatgatagcttaaatttctgaaaatttaattttcgaaaacaagcaagcatgagaatggaacaaagaacactatgttgttccattaaatctgcaggacacaaattcatctattgttgacattttatggcatttacttcttcatttgcttttactctctttttcctgcatctcttcctcccttctctctctctctgtttctttctctccctatgtgtgtctctttgtgtgtgtatgtatatgtgggaatacacacatacacatgcatatttttttctaaaccacgagatacaggaagttgcatacatcatggtctattaccactaaatactttgatgtatttttccaaaaaataaatgtactttttaatataaccagagtaaaattgtcaacatcactaaatttaggattgatccagtacttgaatcagcctttcatatttcagttttatcagttgacccaataatgtactatattgacttttttccttgaatccaagattcagtctaggatcatatattgcatttagttgtaatatttctttaggtccattagtcaggaacatttccattatgacatggacatttcttatgagtaaagtccccctcccacttttttaaaaatagaaagttcttcatttggttttgtatggtgtttccttgtgattaggccgtgcgcggtggctcacacctgtaatcccagcactttgggaggctgaggcgggcggatcacgaggtcaggagatcaagaccatcctagctaacacggtgaaaccccgtctctactaagaatacaaaaaattagccgggcgaggtggcgggcacctgtagtcccagctacgcgggaggctgaggcaggagcatggcgtgaacccgggaggcagagcttgcagtgagccgagatggcgccactgcactccagtctgggcgacagcaagactccgtctcaaaaaaaaaaaaaaaaattcaagttagatattcctgactggaatactacatacgtgatatgttcttctcagattagcacatccagaggtgcacactgtaacttgctcctttttcattatattaattttgatcacttaaggcattattatattcctccactgtatagttttagttttttccattgcaaataataagcaacctctgagaagacactttcagatcatgcggatattctgcttttcatccagacttaaggttagatctagcaatcatttataattcttgtctgaattagtctttaccatgatggctgcaaaatgatggtttttaaactctagcactccttccaaacctatcagttgcctctcaatgttctattgtaagcaggggcccccttttctacctttctatgtatgtaggaatgcatgtatttgtttattggtatgaactcaatggatttatattttaatggtttataattcattactgtagttaatcattttagtgctcagattgtccctgatttggctcatgggagctccttcaagacatccccccacctccctgaaccttttttttttttttttaaagcactgccttacttgagtaagcggttccagacgaattctgtactttctgccccagccctggaatcagtcatttctccaaaggagctgcggttgtttttagtggatagtagtattagagactaagatctggatgctaatatcttggactttaatatcatatgcttttctttcttttttaaattttcttttttttttttcctgtctgtagtcaaagtacaaacagtgaagagcttccttaagaaaacagccatgagaatt

SEQ ID NO: 45670 - DNA, 1033 bp, Homo sapiens
tagagtaggagaatggtcctaaagtgtaacatgtagatcaaatatagcattgtaggaacaccaggtgaatacttcaaaaatagaggttcttttgctaatattaatatgcatgcagtttttgtcttttcataatttgggattctttcagtttgtctatacatagaaagtaatgattattattttgagtcattacctttgaaaaccaatgccagctgtagacttagaaaaaatatacagttgtatgtatacatcaaaataaatgaattacatactatggtcataagttcatagaaaacgtatacatgacctctaggttaaggacccttcttgcagacaattcatttgaaatctgtaagttttgtttaaaaattctgagataatttacatttagatagtcacaaattttgaatcttaaggtcaaagtgaatcatccagtttaattatcaagcagatttgtaccagtgcacaaacattttacttctttaacttttaaaatttccacaaaagaaagccccgtaaattcctttgaacaatgctaaatataagaaagcttccctctacccctccaaaaatgtgaaaagcatgatttagggacagagaagacttatttatttgaaaacacacctggtttcgggttgttcttgctctagtgttcttcctttttttatgttaattcgttttttatagaactctttctggtttataagctttttctgcttatcctagtttttttgaaaaacaaaagtattggaaaaaataaattaaactggaagtcataaaatatggattttaagtgctattttgccatgaactatgtgattttggagaggtatttctctgctttaatgaccttgaaatgaaagtcttacagtttagatgatctttcaggtgcagttgaattccaaactcaatttcattttatcaattttcacctattcagggatgacagatttttttttttaaatcatacttttagatgggtaaataacacaaacttgaggcagaggtaagatagacaaaaagtcataggtag

SEQ ID NO: 45671 - DNA, 1023 bp, Homo sapiens
agcctccttcatcaatttataatgagggtaaagtccaggaatctcaggcttactgtgctgtgctttatgtgtgtgtgatcgtatagtggcaagggttggaacaagagaaaagaccgttttatttgcttatctgacatttggttgaagtccagccatcacgtatcacacacatccagctccctatttgttacatcattcctgccgaatgttattatgtattatgagatttcacactgtcacatcacattagataatggtttattttttagttgggggttgatgaaagccactagctgggaaacagtttatctgttgtggtagttaactctactaaaaagaatgttttgcaattctagttttgctgagtagacagaaatggcatctgcagatgcttctgtttttaattttggttttaagtgatttcttttaagctgagggagaaaatactagttttaattttaagttttgaatatcagtagtacaatttttaaaagaaattaacggaatattgaaaagacagcttagttctgctgttcttcattaaggtcccagttttttagtatttttactgtaactgtatattttgaagaagtgttgaccactccctatcatttcttgctacagatggttagcacataagaatatacttcttattaaattagaaattggtatgcaagtattatgttatttcagtaattataattacctcaactttgagaggattgttgcagtaaagttgaaggaagagtatagatatttacttaatattcagagtgtcttgaaagtctgttttcttattgccaaaaaagttaccatgaattagaaataaatttatttctggtacatcatgattagctagggtactgaagtataagctacttatatgaaatggtgtatctacaaggccttaacatagtaacttactcataaaaggtgcccagcaaagtttactgaattttgttgggtttaaaaaggatgaatgaagacaaaagttttgggatatcttgaaataacctagttacc

SEQ ID NO: 45672 - DNA, 1050 bp, Homo sapiens
attaaatttgtaggcttttgaccctagcataatatgatggctaacttttttagcatcttacagttagacctgaaacttaatagtctagtgtgggttacttgatattggatgccctcagtattcttgaatagaaataggttgagattttgatttataacttcttgatagcaggtttttgtttgagattttttcttttgttttgtgttttttcttcaaccttttaaatgcttctgtgtatgcttcaatatataatatggaaaaagcagtaagttattttcttcctgcttttctttaagaataactgctttagtagtcttttatttctaatatattagtctggagggatttgtgtttttcaaaggtctgtatcaagtagtagattaaaaaaactaatgtgcaaagcatttttactattttgctgttaaaaaatcatgtgttttaatttggattctagataaactctcatatatgtgttctgttgaaagtaggacttcatgtagagaacgttccaaagatggtctttccacagccagagagcacattatcaaacaagaggaaaaataatcaaggcaactcgtttcaggcaaagagagctcgacttaacaagattactggtaaactacaatgattttttttttgagggggggaaatggaaggtttaattttagagtaatttatttttaatgaagtaaaatggttttgatttagtgtcatggacctgttaataacaaagacaattactttgtggttcttcaaggtcaatgtctttcaacaccgtcagctttttctgttgtaaaatgtgaaaaataccacatatcttctacctacctcacagggatgttgtgagggttgataaggacaaatgctacaaagctcagtgatttttaaattacatttgtggtagtagtagtttctagaagaattattttgtcaacttacggtgacacagtttctcagattttaaatttttttatacattcttctacttgaccagtcttacttaaggatggtgccatatatattggaaagatgactgtctgacttacattt

SEQ ID NO: 45673 - DNA, 1050 bp, Homo sapiens
tttctaaattaacatgaatatattggcatatataatcttgcctattctagtcaaatgtgtttgtatgccatgtagaaagaagatatctaaaagtgtgagagacatttccaaatatttatattatattgctagaagatgcctaaattacttaccaagttgttaaaaaacacaagtacacaatgtcataatcttaaatatcctcattatttgctcacaataagtatacaaagttgtttttgttcattttttttttttaatgaatcaggcccagacatgtttataaaactccatttgggggggatgatgatgggataaaattatttacattagtgtaaagtaaatcactaactctataatgttgtatcatctttgtccctgcctttttttcccttagagtttctagatttgcaatgtagcaaaaggaatacatatatatatatttttccttatcttttgctgtaaagagactattttcccgaaggaaaaatggcaatttacacaacgatctgcaattagagaaattaactgtagtctgtcacttgggggagctacttgaaattaatgttccattttattttcttttagttctagtagagtgtagattttacaatttttgattgactcattttgaatgagggcacaatttttgcctttgattacctttggaacatgccattccttgtggatatcttataacaacatcagagggaagaatataaatcattttttcccatttatctccttaaatattgtaagatgctcctggtatgtatctgcttcgtgaacattgaagatctttttctaggtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagagggtaatgtatattgatttcctatagaaccaaacataaaagaagataaagaaaaaact

SEQ ID NO: 45674 - DNA, 1023 bp, Homo sapiens
atttactttatcttagaaatggcacttttccccagatggttaaattagaagagtggtctttaagtgggaaatacaggatttgaagtaactttgaaattttaaagacatcttaatgttaaagaattgacattattactgtatgaggcttctagtatgttttttagtctacagttagcaccatgagggagtttcaaaattctttcttttatttaccactcaacattattttatatatcctgctggtacttatgtacccaaaactaagcattttataaatattattacttcatttaatcctcatattaaccctttacaataggatctgttatctacattttaccaacagttaactgagagagagtgagaaagagagctctccagctctcatagctagctagtggtgaaaagcagattcatttcaaatccaagcagtctgacttacaagtctgaatttttaactctaatcaccatgctatgttattaatacctgaaatactgtttatcaaactgtgtattcttctcttcaacaagtttttacttgtttttattggcatactaagttcttgtccctgttattttaatgcagttatgcaaagtaatttagattagttgttttttattattttatgaggtagtaggttaagatatgttttgattaacataattggtttacaagacataatactaacattgtgtttaatttgtgtgtatgagaagtcaccatgttgggatttaagagtgtcatctttgccagtttttagctttgttactttgagcaaatcacttcatctgtctttcatgtgtctgtaaatataaggatactgcaggcatacagagattaaaaagaaatagagttagaagtgaaaagagaattgaaagcattgcatagtaaaaaagattccttcgaggagcttgtaagtcattgaagtatatggtaagagagataagcatacataaatctctaccaggaaggtctgatatttgtggtaagagtggtacaaaataaatatttaagctagaaaa

SEQ ID NO: 45675 - DNA, 1101 bp, Homo sapiens
aggcttgcagcctgtcaccgtttatgagtgcttgataatgggaacaaaatgtgccaaactagaaaactgaaggtttggttttccatttcccgtcctggtgtttggttgcctttcaaatagaatttgttgttccttgatactgttaaatgggcagagagctttctttggcactcagcataatgatctaaacagtaataggcacactgccagaataaatgcttttcagaatttggaaaagctgttggagaagcacttctttctggttttcttctgggttttgcgaagttaataaaagatgtcattaatgtcactggacattacattaatgtataacctcagagttgctgattaacttattatagtggctaaagttgtccataggcagaaagaaaaataattaacaataatatatgcagtctttggatttgcatttgataaaacctggagtaggattacagagcatttcccagtgttgccctgggaaatggtaaatggtaaatggtcagatttttcttttttaagccttagtacgtaagaaaagagggggagggtagaatgagctcttggttaccagactggtttctggaagaaacctcatgttctctgaaataattcttgatcagttacatgctcagattgtccttatgcttctgcagacccaaatgtacctacgtgtcatctttttttcccaatctccatttacttctttgagtttttgggcgcgtgtgtatgccggggtgggtgagaggtggcattagagactggaagcttgctgtttgagatgatgatttcattgtttggacaaggggtctgatagaatggatataaaatgggctctgcagctattagctgtgaggatttgggcaagttagtctacctctgcagcactttgcacctctgaaaagttgactaacaccacctagtaggtagcagggatgttgggaggtgtgtatgaaggtcagtggcagtaaatgaagtatttgtgaagcaccttattaaactagtgcctggccagtagtaggtgcccaacaaatgttaattcctttctttttcataaggctgtttccatcagaacatctaggaaagaacgatgtacgtaaa

SEQ ID NO: 45676 - DNA, 1048 bp, Homo sapiens
aatagaaaagttacaagatattatctttaaaattgattaagaatattatagatgctaaagattatcttcataactgcaaatgatgtactttccttctatagtgtatgaagttatgagaaattttattaggaaaactgaatagttaatattagggccataaatgttttaccagagtatggtatgatttatattaatgtaccaatcaatattaaaaagtcctttttttattaaggaaagggtagatataggaaaatggtaatatatttcctaactggataaaattatggaaattttaaataaaagaacactccattgggatgttatttaaattgcttgtttctctaccgggtttacctgctcaggccattctcccatccagtcaccctcttctccttccttccaactctgtgcctactgggtagtctgtgtatttaatcccaactaggcttgttacctggcatgagtaccccacatctcaggcagaaaactggacgacttaccatggaaatgagtttctgtgctttttcttgctgtaaggtccaccgaattccttctactgaaatcagccttcagtattcaattactttttattaaagcactttctgatggtgtgttaatgagcaaccacactggagctgatgaaggggagacaaaaagcggaaaatctttggtttcttttaaaatcacttgcataggctttgagaagacaataacagaggcaaatagtgttacaaattgggtaacttctgacaagaacttgtagttgaaatgctagccagggatgaacagacaagaaatgcaactaggcacagattctctcagttacagctcagccagcacttttacatgtcccgtgcaacataaagctggagaaatgttctgcgcctgctgtagacatcaccaacgggaggaagcttgacacctgggttgccaacttattttttcctaaagtttaaacaagatccactaataagctaagacagtttagggcaaaaggaatccagtgagtatgtttatgtactttggctctctcttccctaccacactt

SEQ ID NO: 45677 - DNA, 1142 bp, Homo sapiens
gtttacatactaataagtcattatatcaatggtaactatatttctctcctagtttttcttagtagttacaaaatgtattatggttagatttttaccccaattttagtaagtaactgagttgtagttttattttttgtattctctttcattgatgtcttaaagtatgtgtacccagtgttttgacatggttaatctcccagaaattagagtaagatagtcaattccaaagtatattaaacaagatagagtgaaaatattatatgattaggagtcaggccgacctgacctttccacttcgctgtgtatgtgatctttcactaaccctcaattttcccacctacaaaaacgtagtgagagaatatacttgaacagtttagtgtggagcctggcacgtggcacttggaatttgtgattgtgttttatgtgtctgtcactgctgggcattttgctggtgctctgtaagtagtactgactgtggagggatgatcattggcaccttcgttatcaccaggtgatagattgcttccagctcacctcatatctgctcattttctgtgcagagtatcacaaacctaacttggagcacactgcaagtgtaaaggcataaatgctttgcttttttgttcgttgtttcttactctgatgcttttttgttcagtgttctgtaaaggaccaaaaagtaggcatatacattagaaagtaggaaaataatcattaaaacttgcatgtatttcctttatctatcatttataaggattgctgtaccacatgaaaatgaatttatgttgtttgtaagtttataaaatagaagtatttcatccaattgcaacctttttgaaatagtttatcaaaagtattggatatagtcttaaacattgctaaattttagagacattggaaataaaaaatacatgtaggtatatagcccaataagacatcttacatagaggaaaaaaaaaaactatccatattgtcttagccaaagtaatataattaaaacagtgtctcaattaaggctgcataaagatgtagtaaattaaagtgtgaccatgggcaagttatttaacctgtgctctagagtaaaatggggatgacaataatagtactgacctcatggggttgttgtaaagttaagcgaaatg

SEQ ID NO: 45678 - DNA, 1112 bp, Homo sapiens
ccttggaattcatttattttctcatatggcagcatatatggaacatgagctccatactggacacaacagaggcactggtcatacaaagactgataagacatggaacccggtattcaaataccgcaaaaccgaatggaggtgacagccccatgacacacaactttgctattgcctgtatctttgcatgaagaaaccatacccgtccttcagaactcagccccatgccctctcttccatgatgtcctcaccagttaaatcaggctgtgatcctccaccctctctaaagagcatgcttggtttatatttcctcattttagtattggtatcatatgacacatattggttgtaagttgccataaaagccaagcatgtgcttatcactttctgtagattattttattgaatcctcacagccataagaaggtatcatctacatttttaaaaaggaagaaatttaagcttcaggaggtgaatttcacacttatgttgctcatgtaccttataactggtagagcccggatttgaaccgattgacttcaatccagagtctttgatcttaaccatgttgttatactgtcattctttatattacagtggctcctcccttagattaaaggctctttaagagcagaagcctttaatttgtgttaccttgtatcccagagagtatctcacacaacactgagcattgtgataactgcccccttctctttctctaccccgcccctgcaccagattccttcatggagagagtctttcacttgtttaggttctgaatcttcttatactcaggtattccaagtcaagtcagtatcattatttactcagatatatttcctgaacacctgctgtgttgcagatggtaggaagacagtgattaaagacatcattgttgtccttgcaagtgccacagtctactggggaaatgggcaaagaccacgtctgtaaagctctgacagagatacatgtgctttctaggcacatggaagggagatgtgtaacccaggcaagttggtcagaggtagcagaaggggcccatggagatattaagaccaatagaagataaccacacagggcaggtactctcagagcatccatacttccgctctgcc

SEQ ID NO: 45679 - DNA, 1045 bp, Homo sapiens
cacctcagcctcccaaagtgctgggattacaggcatgagccaccactcctggcctgtttctacttcttgagggaacacttgaaacgtgcccgatgttagcatgctccccgtggtttgtggcccttgcgtcttcctcggtgctgctctctctcatctcctttctctcttcccacctccccccatcctcaaagcctgctgttttccatctcttccttgctctcttcctgagccccctccaacatgtgtctgctgcagtcagggcccctgttggcttatgctggtttcttctgggcttgtgtctgggtccccctgaggctgcacttggtgagatttgggcaacatgttcttaccagtctgttttccactggtgtccaagagtgtcatgtgctcttcatcacactgggaaaaatgcttagtttaggcttattcttcaatcattattgtgtctataaactaacgcgttgctttttcgtaccccagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcaggtgagggctgccccccactgtggtgctgtgtgtcggtcccaccattcctgcacctgcaagtcattgagcaaaactgggacttgtttcaggagagacgagtgggcttgttttagcagctgagttatttgaaatgtttagaatattcattttgccaaggtatgccttctagaaaattatttctcgtctgtattttctgccacccagtgtcaccgctaaagataacgggggctcggcatggttcggcatccttcacaggtgtaggctgtgcctgtctctgtatgtgtggattgcatgtgtataaatacatatttacacatccacacgtgtgataggaggcagggagcgcaccaggcactttctagagc

SEQ ID NO: 45680 - DNA, 1414 bp, Homo sapiens
gcagctgggctggaggtcacctgacatcccatcaggcactggggttcctgtgatggaggcacgggaggtgaccctgggtggggtagggggtcgtggttggcgtagccagcatcggtccggccagtgtcagcccctgagcctacggcggcccccacccccacacccccaccactctctgcccggcaggtgaacatggtcattgggatcctggtgttcaacaagctcgtgtccaaagacggcatcacggacaagaagctgaaggagcgggcagggtaggaccggggctacgcggctccttgcccacccggagtgcaagacccagagcccacccagccccgggggatggagaacgctccatgcccaatctgagactgcaggtccagggaccccggagcgggtgggaaacggaggcactgagtacagaggccccttaggctcagccagcccctgcctctcaccgtgcctcagtttctccatctgacctggacagggtgggtcccataaagtcctcagaagctgtgagactgattgtgcagggacaccccgcctctgcctggcttgcaggatggcagcagggtgcccccaaggctgggtgctgggggtccctggccccccactcccctaccacaaggcttgctccatggccagggggaggatgtcgcctgtccatgcagggactccctgtctttgtgggaccttcatcatggggaggatggtgcagaggacaggtggagctgatgttcctccctccggggaacccaagcccagggagtgctctcagcacagcagctggacagggtgctggagcaagacagaggcgcttgggatgtgtggctgcacccacctttgagggacagggccctgggcacagaggggaagctgcggggcgtggggagctgactagggcggacaagcccctcttggtcctcccgcccctcacctctgcctgctgttctgtgtcatccagccctggctggtgtctgcgtgggcccctcccctccgtgccagtcttgcttggatgcttggtgtctctctgtctctctctctgttcctgtctctctcttcctggctcctcctgctgtccccagtgaacagacgctttcaggaagccttccccttgggtgcctgtgggttctggtcctggttaggaaccagccgagctggtgtctgatgctgagtgcgtgccatggccctggggtctgtcactctgggtgggagtcgcggtgctttgtctcctggcctgggagatggaggctggaacaggcctctctaaggccttgccctacctgtccccggaacaccctgtcccacactgctcccaagacagtggtcacactcagaagaggtccccagggctacacatccagggtctgagcatggcagactgcctacctggtcgtaaaagcagcagtga

SEQ ID NO: 45681 - DNA, 1033 bp, Homo sapiens
caggctcagggaccctggcacagcaccccacactcccagggcagtgagggccaggctttccactggctcagaggaggcaacgacattgaggctgctggagatgcaggccaggtccagggacatcttcggcccgctgcaggtcagggcaggttctcgcaggcggactctggcccgagggcctgcagcagctctcggtggctgggagcttggtagagagaatctcagacaggagaggggtaggctgttcccctcctggggtctcttttccccttctccacccagtgggtcatgactcagcagaccagaggtggccctgtggggaggcctcctgctgaccagccctgcccttccccgagacgcccgcccccccacaggtgctgctcatctgatctggcgctggcgcagggtgggggcgtggctgccactgaggtgctcggctctccctccccaggtccaggacgctgtgaaatgccgtgtggttgaccggcaggaggagggcaacggggactcagggggctccttccagaacggccacgcccagctcatggtaggactcagggcccggggactcaggctgccctacctgcctcgtacccccgccaagtgcctccaggccctcaccgtgccccaagctcccctaggccccagcaaccctgctgagaggagctctgaacccagtgtgcagttggggaaactgaggctcgccaagtggaacccctggtccggggtttccagctgggaaggcctgagctgatgagtttggaggtctcagcggaggctggcatccaccccacactcacccccgctggcagcagtgcccgtctggctggacaccaccctctgagcatcccagccctcaactcaaggtccccatccttacacctcccaggcccaccctcagtgccctccatccccacccaggaaagtcctgctcagctgccacctaggggtccagcctagcctgcccatcccctccccctaccccgcatattcccacctgctgcctccctggcgctccctgggtgctgcccag

SEQ ID NO: 45682 - DNA, 1076 bp, Homo sapiens
tgttctgtgccaccttcatttcctcattgccagtcccagcaggggcagaagtgagtggggctttcaggctagggggacaacggggagcaagaggaaggcggggagaaggacccaccatggagcccccggccggtgctgagcttcctggaaccaagtgcaaaaaacgaacgactgcccaataaaggaagctccgccgcccatccccaagcatcagactgcgagggtctgtttctgtccccaccactgttctgtgaaccaggtcctgaggcagtgacaggcagtggctttctgagctgtggagaggccaatggaccatgctccctctggtcatttagatatttgaagagcaccttctctagagacagccctggcagaggagctgggacagccccaggtggggagtgtgtgctggtgccagttgggccccaggagggcttcctggaggaagtgacttcggggctgggctgaatgggagctggacaaaaagcaccttctgcccccttggggtctcctgtgaaccagtcccacagcctctcagaggggtgaccctaggacttggggcctcaggtggcttgggtgtatgtgggcctctctgagcccctgattccctctcattcatgcgctggctacagcgcctggtggatccacatgcagctggtggatgcgccatgagcagctggtgctgagcgcctgggagcttcctcagagcgggagggtgggcggggtgccagcgaggggcctgggcctggggggagcttggcttttattgtgccccaaggtgggtacatgcgagggaggcacatagacccctcacgtgccaggcgctcgttctgccttgtggggagcaaagtgtgaggtgtgtgggaggtcgggagccccagggtctgtgcggggtggggcggccttggggacgtgcgtcccgagagtgctgtggctgtctgggtggggcatgtgggtctgacggggaggatgacgggtcactcttgggtagggacgagggaaggggcggggctgaaaatgggcacagggtgttgctgtccagagggtggaggagaggaccaggccgggagcatggc

SEQ ID NO: 45683 - DNA, 1947 bp, Homo sapiens
tctgtcgcccaggctggagtgcagtggcgtgatctcggctcactgcaacctccgccttccgggttcacgccattctcctgcttcagcctccccactagctgggactacggcgccagccaccacgcccggctaattttttgtatttttagtagagacggggtttcaaaatcaggaatgcctttgttctccagacatcgggatatctggacactcccaagtctgggtctctttagtaaacattattaatttgttcccttaactgtgtttgaaacgcttgttccccggtgccgtaaagaaatagcacgtgaacataaatttaatttcctcagcaaggccatttttacttcctgcagaaagggtacactcgccagcagctttgccatgagagtacaccgaacaaaggagacaggctcatttataacctgatgtgtaacaatcgcttttatttaaagtgcgaacggaatatttaatccatttcagccagggatttgcatcttgatactctctcgatggctaaggtctgttttagatctcttatttttacaatagacaccctagttttattattagatgtagaagcaaccggtgtgagatctagaactgaggctactgaagaagggggagatgggggaataatgcgtatttaaaaaatacctagggggtcttttccatttatgtcaatccccataccacagaagcgactgagggcaggtctagagttagttaaggtggaggtggtgatagagaaggacagggttacactgataaggctgacagttcgaaagggtagtcctttcagtgaaatagatgaggggttttagatctgcacagacctttttcttggaagtttaactttgctcctgagcagttgaatgtgtatagtcccgtttactacaaagttggcaggctataggagcagaacattggcatcttggctgcaggtcattacgataatgagagctaggggtaaccatgtccatcagagggctgggacgtaagcatttgtgtgaaaaggctagctgttgttgatcttttacatttccgcaaggtatgacagaacaagcattcaaggcggtggtctgaggtgagttagttacagtaataacaaaggcgctagtaacaataaggaaaggaagcaatatgaaggtacaggaaaattaagctttctttaactttaacttagtaggattggtcctagtacagtcatccatgattctgagagaaagatgttttcttgactggagtgtggtcgtttttttcttggctctgcggatggcagtctcagtggttaacagcataaaatagggttcttcccaggctggctcaagttttttctttctgtcttttgatgaggacgtggttttcaggctggtgctggtgtactggaaattctaggggtggtacctagaactaaaagtcttttagttctgagggaagggaaactggaagataaattaagtatatcatttttgctgcatatcctggggcttgaggccccatggtgatgcctcccgctccattcctgctcagcgccgcccaggggacactgcggccctgcctcctcttaagctcttggccttcttggggccttcactgcccctgtgcactgtggccttggacatgaggggccttgtgacttacctggccaccttcaggccttaagaaagctaaacaccattttatatttgacagtgctttttgtatgattttataccagataagttaaattttacctttatactaatgtgctattaatgttaaacttaataaaatcttttttttttttttttgagacagagtcttgctctgtcgcccaggctggagtgcagtggcgcaatctcagctcaccgcaagctccgcctcccgggttcacgccattctcctgcctcagcctcctgagtagctgggactacaggcgcccgccaccatgcccagctaattttttgt

SEQ ID NO: 45684 - DNA, 1005 bp, Homo sapiens
cctgcgtcctcccctcccgagctccactccgcaggcgagacccccaacactgctccccgacactctccgaggcacccctcctccgtgctcacacccaaacacgtctgctcacccgtgggcttcccaccccgaacacaacgaggactgtccaggtgtcagtgacggtcaccccgacctggtcccctgtccggcctcgccaggtcagcacccgccgcgcgcacagcagggccgggtggaaggaggccgggcctggccgtggctcaggcgccacctcactggggaaactgggaggtggtctcagcccccttctgggcctcagcttccccatctatcccaaggagccggggtaggcctgggcggcgcggggacccccaccgcgggctcgccgactccgcccgccggaggcccctcccgcgtcccgcccctgcccccgccccggggccgcgcggctgcctgggaggctccgggccagccgcggtccagagcgcgcgaggttcggggagctcggccaggctgctggtacctgcgtccgcccggcggtgagtccgcgggcccccggccgggacgcccccgccacctgcgcgcacgcgctcagacccggcggcctcggctgcggtgcacgcggccccggctcagccacgcgcggcggaaggcgccctgcgggggccggggcgggagagggtgggagagagcaagaggggcgcacggggaggcgcaggagaggggctggggctgccggtgggttggtccccagagagctgagcttctcctcccatcccccgcaggcctccccgaatgtttccaaagatctggggcgggagcgggcggagactgccgccaggagcctcccggccgccccagggctgcgcagccactggagcccatcacccaactccagacgctcctggctcctctacgtgggccgggagggacagccttgaggactaggggagggggcacgggaccttgcagagctcctggccggaaagggaggattgaccgccc

SEQ ID NO: 45685 - DNA, 1021 bp, Homo sapiens
ctttggtttgtgacctccaggcaggacggccatcctctccagaatgaagatcttcttgccagtgctgctggctgcccttctgggtgtggagcgaggtgaggtgcccttggggaccccagacctttgtccagctgtgccctgctccactccctctccacccctctcccctgagcagacgccccaggggtccttccaggccgctcccagcagagggctcacccggcctggccacactgtctcactgtgtgtttgagtgtcgcttgacctgctcgacggccagggtggggtgtcactgtctttgctctgccttcagcccagggcctggtatacagtaatttctcagtaaatgtccactggggtcaggcctgggagggacactggaggcttccctgagacaggtgtgtcctccttccgcagccagctcgctgatgtgcttctcctgcttgaaccagaagagcaatctgtactgcctgaagccgaccatctgctccgaccaggacaactactgcgtgactgtgtctgctagtgccggcattggtgagtgccaggcctcagaccgtgccttcctcccctggccatctccctagcccgggccggggctcagcagaggccattgctgtctgtctgcagccgtctgtctctcccctgacagcctcatttcccatgcagggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcc

SEQ ID NO: 45686 - DNA, 1117 bp, Homo sapiens
accctgtgacgacaaagaaaaggacgggaaaggtggctctcaaggccccagggaaccgcccagagacgcctggggttccagaagctggaaaggcatggagcggtgcgggaacaagcctctgcggtggctggagatgtggggatggagactggtcatgccttcacacacttaaccagaaccctcccagctctccctcccctgcaaccaagccagcaaggcgacacggtggctggcgctggcgagaggcaagtgtgcttgactgcctttctccactcttgaggacaacacccagagtggccccgtctttgccccaccagcccaggcctaaagcttcctcatcatccgcatcccggcctgggacttaggcggacttctgccagctgtgtcacgtgcaggggactgcagccactgaccccctctcccttctgtcctgctcttctctaccccacagccccaggcagatcttcagtgcatgtcagctctcctccctccctccctgcagacccctgtgccccgcagtgccctgagaatgacgtctgagcccccagtggaggtgtcaaggctgttcggtctgtccccatcccgttctgtcctccccttgctcaccacactcccctgcctggtcttccaaactcgaaccccaggcaactccttcaggcatcagacctctgcccctgcgcccctcctgcctctctgtgatgggctggcccttcccttctgctgcctcccctccctccttcctgctccaacccctatctctctctgatgctgccccttagagaagccttcttggaccttaagcctggccactcctctaagcccctcatctccaggtgtggtctaggaagtgctctcagcctctctactccagtggctcggggtctctgaccagccctcctgccagggaagctttgaaggttcccacagggacccctagagacaagggcactgcccgtccagatggcaccctcaccccaaccccagcagcactggctggagcaggccatgcctgtgtgggtatctgaacaggcactggattccccgatctcaacaaaagaagcccatggaggccttttctaatccacagtccaagaggacaaatcaagacaacaggctg

SEQ ID NO: 45687 - DNA, 1051 bp, Homo sapiens
cgtctctccagcgagcccgcctcgggcccgagcctggggtcttgtccctgaggagcgccgtgtgggtacccctggttccctctccttccccccgccctgagcccaggccggagagccgcgggcttgagtgtccgtgtcgcagtcttcaggtccgccaggcctgcgtgaggttgatgccgcagacatgttttacggtgtggcaggactgggtgtgggcgttcccgcggctgtgcctgaaccctgcctccgctccctggggcctcgaggcctctcggtgctggaggagatgcagcgccagcatcttctgtgctgttggggataggggtggggagggaaacatgatgagcagaattagaattaagtacaagacttggacctggagaattcccagatggggagaggtggtgtggctacgctgtcctgctttttcttgaaggtacccttttcccttcgcgtctttaagaatcccagtggcgttctctgtgcttctgtcaaggctgtcttgctcccttcacacacaggctacgtcatggtccagggactctcagggtctgggcagcgcctggatgctggcctcagactcataggtagttggtgtgaagcagctcagggagctgccgagcttgtcttcgctgcctcagggtcatggaagatgacccaggagaggacacagggggctcgtcgttgtccttgggcagagccctgagcagcatgccggtagcagaagccaaatggcctgggtggggcgggggcagttgacagctggctccagttctctgaccttacgcttcttacctccctgaacttccggggcatcgtggggagcactaggaacagaagcgctccctgcctagcctgtggcgcccagtaggccccttggtgtggcgcggggcaaggaggtccagatgttagtggagctctagtccacgtctcactcggttgccctctggttctgcttttcctgtttcctgagggtgaagcttggtgtatcctgttaatttcttcaggctgtaagcaacacacagtgactctggctgggagcttgaggctg

SEQ ID NO: 45688 - DNA, 1756 bp, Homo sapiens
aggtaaatggacagtggacagccgcctcgccaaactgttagtctttacctctgaatttcatctggacatgaaccccaaagtccagttttgtaacgatataatttttttctcatgaggccatattttgagttcttaaatactaccaaccctgaacgtctcaggacaaataattcaaaaaagagatctacattttctggaaaatcagcattactagagatgtttcaaatgtagattttaccagaccattttaatcaactttattgagattcaattttcatatagtaaaacgcctatttaagtgtacaaggttttgaaaaatctatacacctgtgtaaccaccaccacctgtgtaaccaccaccgccagaaccaaaaacgtttctgtcacccaaagaagttcccttttgccttttcctagttaagcccactccagccccagataaccactttctatcctcatagattagtgttgcttggtttagagcctcatacaaatggattcatttactatgtgttcttttgcgtctgatgtctcactttggcatgtttttagactcatccaagctgttttgtgtttcagtagttctccttgctgaatagtattccattgtgtggataagccatcatttgtttattcatccatgtgttaatgggtttccagtctcggctcttaaaactatgagcatttgtgtaaaagtatgtatttgcacatgtgtttttatttctcttgggtaagtacctaggactttaattgctgtgttgtaagtgtcttagttcattcaggctgccataacaaaataccatcaactgggaggcttataaacaacagaaatttatgttttacagttctggaggctgggaagtccaagatgagggtgtcaacatttggtgtctagtgagggcctgcttccttttaagtagatgtctttttactgtgactgcacgtggtggaaagggactagcaagcttaccccattcatgagggctctccccttgtgattctgtcccctccccaagaccccacctcatatcatcttatgggttaggaatttgacatgaattgtgcaaggatgtaaacattcagtccattgcaatacgtgtttctaacttcctaagaaattgtcacacagccctctgtagtggttgaatcattttacactattactacattatgggaagattccagttgctccatatctttgctaacacttggcattgtcagtctcttaaaatttaatccactctagcctccttatgattttaatttgtatttgcccactgaataatgtatgtctatgatttcatctgcttattgcttttccgtgtcgtcttttgtgatgtgtctgttcgtgccttttgcctgtttttaagttgggatgcttattgttgactcaagttctttccatattctgcatgaaaaacatacatgtaatatatagaattctttgtctccatttgtgacaaatattgtgaatattttcatgtttggtttgcctgttcattttcttaatggtgtcttttgaatattttttattaagcctaatttatcaaagatttgggtgtggtggctcatgtctgtaatcccagcactttgggaggccaaggtaggcagatcacctgaggccagaagtttgagaccagcctggccaacgtggtgaaaccccgtctctactaaaaatacaaaaattatctgggcgggtggcacacccctgtagtccctgctactcgggaggctgaggcaggagaatcacttgaac

SEQ ID NO: 45689 - DNA, 1049 bp, Homo sapiens
cgcgctgagctcccacccgggagacgccggcagcggcgcaggcctccggttgcttgtgagaaacgacccaagccccaaatcccgaggctggcggtcgtcccctcgcccggcccctcccccaccctaaaggcggcctagagccctgggaaggccccacggcgccgcccgtccggtcctcacgcgcttctccgggcccaggctccggggctccccacagcccggggcaaaggtcacggtcttcccttgcttccccctgggttcccagaagcaggtggagttgcgcagggctgggtcccgacgctgtcgtcaagccaactgttccactgttccttgtctgtcttctctaggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactgtgagtctcaggaagggaggggtggggtggccgggagggcagggggaggtgcttgtgagtggcgctgacccagcctgtctgcttctcagcaccccagcatggaaactaccaggaggagggtcccccatcctactatgacaaccaggacttccctgccaccaactgggatgacaagagcatccgacaggccttcatccgcaaggtgggtaggggcatctccaaggcggtgggggctgtggctcccagcggatgactctgagcggctccttccccaggtgttcctagtgctgaccttgcag

SEQ ID NO: 45690 - DNA, 1045 bp, Homo sapiens
ctgggacgtcctgagtcattggcagtctcgcttggcatccattctctgaccgccgccggctttccacccacctgcccggctcatcacctctgactcctgcgggccttccagccggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtggtgaggacagggcccggggaggcggggacccgagggccctgggctcgcgccggcggccccatgcgcggtccccatcgagggccggggccgctccagctgctcgcgcccctccggctgctcgcgcccttccgctcctgccctctggaagcactgagggtatcaggcccaggcttagggctcgggtccggcgtcccgatgcaggactccgggtttaggtctcccagacccgcgcgatcgaccccgggtgcggaggttgtggcctcgggtcggcgtctgaggacccgctgacgctccggtgcccctccgtcctctctcacagcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggctttt

SEQ ID NO: 45691 - DNA, 1027 bp, Homo sapiens
gaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaagttttcttagtacagaacaaaatgaaaagtctcccatgtctacttctttctacacagacacggcaaccatccgatttctcaatcttttccccacctttcccgcctttctattccacaaagccgccattgtcatcatggcccgttctcaatgagctgttgggcacacctcccagacggggtggtggccgggcagaggggctcctcacttcccagtaggggcggccgggcagaggcactctggcctctgatttaaagtgagaggtgtgcggctcttcctctcacatgaacacatagaggtgattgtagggttttaattggactaatttcattattgttgtctttcagggagcagggagaccctagcagagggcgagaggtggggagtggctggccagtgggtcaggacacccaacattcgttgattaagcttgcagttttatatactgcagttcatagcaccccaaaacaattatagtaacatcagagatctctaatcacaaatcaccatcacagatataatattaatgaaacagtttgaaatattccaagaatgagcaaaatgtgacacagagacacacaccaagcacaggctgttgaaaaaggcgcccgtagactcactggacacagggctgccccagaccttccacttggttaaaatgcagcccctgtgacgtacagtaaagcgaagcccagtgaaacaacgtcacgcccgaaatgggcttgcttgcttgtttttattgacacatgatagatgtacatatactcggggtacctgtgataacttaatacattcatattatgtgtaga

SEQ ID NO: 45692 - DNA, 1048 bp, Homo sapiens
cggctcactgcaacctccacctcccaggtccaagcaattctcctgcctcagcctcccacgaagctgggactacaggcacccgccacctcgcccggctaattttgttgtatttttagtagagatggggtttcaccgtgttagccaggatggtctcaatctcctgacctcgtgatccgcccaccttggcctcccaaagtgttgggcgcgtcagccaccgcgcccggcctgttgtgtactcttgataggatgatgagaacagcactctacctctttgatcttcctcccaaaaacatacgtaaccccagctaatgatgaaaaaacatcaaacaaatccaaattgagagacattccacaaactgtttgacgagtcctcaaaattgtcaaggttctcaaaaactaggcaagtctgaaaggtgccagagtcagtgggactgaagaagatgtgacaactggatggattttggatgatgtcctggagcagaggaaggattgggtaaaaagctaaggaatctgattagaatgtgggtcctagttaacaatgtgtctaatgttcttgagacaactgtaccacacaaaggcaggatgttaatgatgggggacactggtgtagggcatgtattctaaagtaaaaaggtggttcttcagagtcaccggagcggtttaacaaaacattagaaacttcagaagaaaagattcctgaactaaaagcaatggaaactgtccacagtgatgtacagggagaaaaaggactgcaaaaacttagccgagcttcaaggacataatatcatgtggtctaacgtatttgaggttccagaaaacagtggggaagagaatacagaaatatgaccaaaaggctggacacggtggctcctgcccgaaatcccagcactctgggaggctgacatgggtggatcgcttgagcccaggagttcaagaccagcctgggcaacatagcaagaccctgtctctataaataatacaaaaattagccgggcgtggtagtgcctgcctgtggtcccaactactcgggaggctgaggcgggaggat

SEQ ID NO: 45693 - DNA, 1038 bp, Homo sapiens
acctcggcaaacagcttttttattcaggagagcttcaagtcaaatcagagacagccttgggagtggactcttaggtcagatgctgacagtcctctgggaatggggccctggaggagctcaagccctggcccaccccgcagcggctgccaggacgctgttcccacggggactgcagctgttggtttttaaggctgcagatggagtgggaatagggcatgtaaaatgccacaaagcctggctgggcacagaggctcacgcctgtaatcccagcactgcaggaggccaaggtgggcggattgattgaggtcaggaattcgagaccagtctgggcaacatggtgaaaccccatctctcctaaaaatacagaaatgagccgggcgtggtggcgcctatagtcagctactcgggaggctgaggcaggagaatcgcttgaactcgggaggctgaggcacgagaatcgcttgaactgggaggctgaggcacgagaatcgcttgaactgggatgcagaggctgcagtgagccatgttggtgctggtgcactccagcctgagcaagaccttgtctcagaaaaaaaaaaagttcacaaagcccactgttcttactaagattcagctgtttttcttgaataaatgctccccgtgctactgtaattctttggttaactttcagagttctggaaagttggcttggcgcttttcgccgtctctctcctgctgccttggggtcctttccgtgaccgtttccctccctgacacgtgtacatccctgtgtatttcacatctctctatgctggaaagaggttctccacttctagtgccacaccacgggggtctttctggctttttccctgtttgcatctgcagctcccttccctggcagggagaaacctgccccactgcccttcaccagtttcttcactgagtcagccaccccttcctatgcagacacccctcacccctctctggccctgcttcaggccccccttccccgccgtgtgggcttctcgctgtcccctaagccttcgatgtcccctctga

SEQ ID NO: 45694 - DNA, 1049 bp, Homo sapiens
gcggctcgcgtcgcccgccacccagcgcgttggtttctgcgcacgcagcttacagtaacgtccctggcgcgcttctgctccgcgagccctctggttaccccggcaggaacctgcttttcttcgccttagggggacgtcagacaagggccaggtcagaagaccaagctggagaaatgcaccaggccctgcgtcaccgggacgcctgccttgcacgcgactcccaggctctccacctccccgcctgcagagcccggcgagaggagggcgagggcgagggcgagggcgcaggccccttggtggtgtcttctcagcccacccactctctccacaaggagctccacgtccctcaactctcagggcctcccagtttccaacgtgggccagcctctccaggatgtcagaagtctgggccgctggatcgccgggactcaagaggcttctgtgcatttgcacggcctgtgcaaccgccctgttgttttttgttttcttttttctttttttgagacagtctcactctgtcgccaggctggagtgcagtagcgcgatctcgtctcactgcaacctccacctcctgggttcaagcgattctcctgcctcagcctcccgagtagccaggactacaggcgcgtgccaccacgcccagctaatttttctgtttttagtagagacgggctttcaccatattggccaggctggtctcgatctcctgacctcgtgatccgcccacctcggcctcccaaagtgctgggattataggcgcaagccaccgcgcctggcctgttgttattttttctaaagatgggggtctcgctattctgcccaggctggtctcgaactcctggcctcacgcaatcctcccacctcggcctctgaaggtgctgggattacaggtatgagccactgccccagacatcttgtatgttaaatgaagcaactaatcaactgtaacagccacagttgcggcccaccttggcttggtgtgcatattgcacagggcatggagtgagaacatcctggatctcaggatgccagggttcactgaggactct

SEQ ID NO: 45695 - DNA, 1046 bp, Homo sapiens
tgccatccaccccgctgcccctggatgcatctcccaccccaactacaggatctgcccccaccagccccgcccctccctggagccacagccctccctgccgggcccagctgcttcaggctcccactcaggcctctgggttcctccctcatgaggtccctcccggggctcctacaggctcccaactgcccagtagtgagccccacgttgtgaatccccagccgcaggccgactcctgggcgtctccccaggcccccaggctccccgaaggctttgcagccaggccgggtcccatgggccgtgggaccctcctcacccactcccctggtctgcctggactctccctcaccgtcttgggggtctggccggcagcccgggcctgcatcctctgcagcagccagctcaggcccggggtcagggccttggggctctcgagcagggccaggaggtggtctgcatgagaggcccagaggccagcccgagcgtcctcacaggtgccctcggggttgctgaggtacaggacggcggcggcactgaggcgggcgacgtacctggcctccaggaccgggcccgggggcagccctgacccctcaggctcgcccaggcccagggcgtcctccacagacaggcactgtgggcagagacaagtgagcaggggcgctgggcccaccagggaggggagaggcaggcctggccaggggcttccccgagggcctgtttccctttcaagtccaacaacgtccaccatcctctctcaacccctggcgcccttccgtctccccaggcccctgtcctgcttccccaactacaggggtgcacgcagaggggtccccaacagtggtcccccatccccaggggactcccctggagccactgccaatttgatggcagagggccggcagggggagttggccctggggtcctggggagaagagggactgtgtccctggaaaggcctgtctgccctcatgagcaggagggtgggctctggcctgtggggagggtcagggtgcccaggtactgccactagcctcctccgcctcctggag

SEQ ID NO: 45696 - DNA, 1033 bp, Homo sapiens
tttaattctatgcatacttggttgacagtaaactcttaaagcattgcccagaagcacggaggagacagatgatgtggtgttcctgcctgtcattcctgggctttatcctggggttactcaatgatgtccccaggggcccagagccactgaaagttgtggcttagcacagctgagcgggcctgtgggggctccctgctgctctcaggaccctcccaccccccacctccgcagctccttggctgaccccttgccttctgtacatccctgttccctcaggtgtcctgggccttgggggcactgtcatctggagggcctggcactcagctccctgaggggcagcaagggcccccagccggatgcccagggcggctgccagaactcaagggtatgacaggcttgggagcctagcggggcagggagggcggctggaagaagtgcagcttctctgtgctttagggtctgcgaggcattatgctgacctgatccccactgcaggaaatatccgtgtgctgtgtcggctgaggccagggacatcttctagccttgtgagtgtggagcctggcccagggggcaccgtcaccacctgctaccgggggcgccatcgtcgattccgcctagactgggtcttccctccagacgccagccaggaggaggtgacagcctgcctttgcagccatcctgaccctttttcagagttccctgaagagcaggagaggctccagtttccccttcccagtctgggtgtccacctggaggagagagggtggctgggctctagccaggaaggaaagggaaccgagggggctgggaagcagggcaggcagcccagcttggtgcctcctcctcccaggcttcactgcctgcccactcccctttgctggggtccagggtttgcccagctatgagggcccctcattgctttatggccccaaggcaggcggtgggtggtgggggccgtgggtgaggaggcaaccttctagtcttagtgtgctctctctgccttgcctggatcccactctccttccccaccctt

SEQ ID NO: 45697 - DNA, 1088 bp, Homo sapiens
tggatgccctctcttgggaatgtccccagtcctggtcagctgtctctctcctttgcaattttgtctgcctcccctcagcctaaaagtgtgcagaaccctcaattctgttaagtcaccctgtggagttcctgtcttctgttttccccaggcagggtgcctgagctgtattccccagcacacccactcccgcagccctccagtgtggctgcaggcggtggtgcagccttccagactgctgcccagttgcctgatgtcagagcccctccacacatgagcctgctccctactgccaacaccgtggcccagacagagacgctttccgaggaagaggtacctgtgaggcgcaggacttgcagactggccaggggctgcagggcctctcggctgatggtgcccagctggttcctgctgaggtccagcagtgctagggaggacagccccgctagagcctggtcctccagcagctcaatgctgttttcttgcaggtgaagctcctgcagtcgctgaagtaaggacagcagatcgtgaggaaaaagggcgccgaggttgggggcatgtctctcttcttaccaagctagactgggttgccttttctaactattccagccctacagggcgaggggccataatggagtatcccgcccctttagaccccaggcgctcaccggcaggtgcaagaaggtgaaatccagcagccgcgccagctggttgcccgccaggtagagcacgcgcagctgggccaggcctacgaaggcgccgctgcgcaagccgcgcagccggttgctagtgagcgccagctccagcaggcgcggctgcgcgcggaaggcgccggcctccagggcgcgcaggctgttgttgtgcaggtagagccggcgcagagcggcgagtggcgccagggctcccggctctaggcgggcgatgttgttgtcctgcaggaacagtgtctgcaggccggggaaagaggaggcgcttaccccgttgcgggggtcttcctctccctgggggcaccccgtcctcccgcagctccacacggtgcccacctgcgtccctggcgggattcccagcgggacgacgcgcaaccgcagggc

SEQ ID NO: 45698 - DNA, 1046 bp, Homo sapiens
tggtggtccttcatctaaaattagcaccctcctccccttgacattttctgtctcagcaacagcttgatctgttgtcatcatatcactgctccattatttttagctcagtgctgtttaatctgattgaaggtttacttcctaattccgaagatagaactaaaagcaggtttttttcccctctaaccaggtagcccctccctgaggacatgcactccctagacatgagcaaacacaaagcagcagtaacttaccgctcctagtccaagtcctaccctagtcctgggttgcagttcttaccagagtggagggtggtatgtgttgaggggtcggggatcaagtcttctggcagcctcataccctgagatactctggttgccttgttggggtgaggacaacacgtgtggccatcgcagtggcccaggtgggtcctgccacagactgccctggacagacagtgagtgggggctgggtgggggtggtgtggccctgctcttccatgcgtttgcagtctgtgccctctgtgcaggggtgattcacgaatctgtctgatccacccccatcgcccttcgtaccctaacatgtcaaaagggctctgctgccaaatgtcacttcatagcattgtgaccaagcagccctcctgcctctaaacgcactctttatttttatttgagagagaacctcactctgtcgcccaggctggagtgcagcggggcacacttggctcactgcaacctctgtctactcaagcagttctcctgcctcagcctcccaagtagctgggattacaggtgcgtaccagcacactcggctaatttttgtatttttcgtagagaagggtttcaccatgttggccaggctggtcacgaactcctgacttcaaatgatccgccctcatcggcctcctaaagtgctggaattacaggcatgagtcactgtgcctggcctctaaacacatgctttttgttaactgatgcctaaagggaaacatctctttacaaagtggcagctacttagacggctccagctctacagaaatggatagcccc

SEQ ID NO: 45699 - DNA, 1033 bp, Homo sapiens
aaaaaagactatctccttttcctgttgacatgtggagccaccattttcatctatgaaatgggatgtttctgaaccctgttctcttccctgaatctctcttgtgggccagcttcctgcttttggtttgttttggtttttttttgtttgtttgttcatttgtgtttttggcttttttttgaaataaagtctcaccctgtcacctgggctggagtacagtggtgcgatctcggctcactgcaacctctgcctcccaggttcaagcaattcttgtgcctcagcctcctgagtagctgggattacagctactcaggcatgtgccaccacacccggccaattttttgtatttttactagagatggggtttcgccatgttggccaggctggtctggaactcctgacctcaggttatccacccaccttggtctcccaaagtgctgggattacaggtgtgagccaccgtacctggccagtttggctttgttttttattttggggtggtttttgttttttgctttaattttgtagtgtttcttaatactacaagaatactaaaagaattaaactcacccgtttaattcttttttttctgggacggagtttcgctcttgttgcccaggctcgagtgcaatggcgcgatctcagttcactgcaacctccggctgttgggttcaagtgattcgccgcctcagcctcctgagtagctgggattacaggcatgtgccactacacccggctaatttttatattttaagtagagatgaggtttcaccatgttggccaggctggtctcgaactaacctcaggtgatccgtctgcctcgacctcccaaagtgctgggattacaggcttgagccaccatgcccggctgcatactaattttagaataagttgagttcctaaaagccactggaatttttattgggagtgctttgaaactgttttctgtcaatgtaaaagttttgatttttttgctttgtgaatgtatttttagctgattattgctgtagtacaaaaatgctgttggttctggagg

SEQ ID NO: 45700 - DNA, 1141 bp, Homo sapiens
tgccccacaccagtgcctgtaggatggacctctctgctcacagaacccagccctgccccagcaatgaacattcattgctatcgaatgagtgaacaaggtaaaaagtatgaaaccacttttgagaactgtcaaaggctctgccttctcttgcacgtttccacctggggcctcacagtgctcagtgcaactatcctgggagccttgagccctggcccccgcatttgtagtcttatcatttctctgagcacagggcctaaggaacgtctttgttcctgtttatttcagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgg

SEQ ID NO: 45701 - DNA, 1035 bp, Homo sapiens
ggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctatagccttaacttacttattttatatggaatcgtttatactgacaaacatgtagaatgttggtaaaggttcagaattgctctcaagaatatccaacttcaggccgagtgtggtggcttatgcctgtcatcccagcactttgggaggccaaggcgggcacatcacgaggtcaggaggttgagaccatcctgggtaacaggtgaaac

SEQ ID NO: 45702 - DNA, 1037 bp, Homo sapiens
tagttgatttggcagcaagcctgtgtcatcctcaattgctgtctccccagcactgcatacttttttttctttttttttttttttgaggagctttgctcttcttgcccaggctggagtgtgacggtgtgatcttggctcactgcaacctctgcctcctgggatcaagcgattctcctgcctcagcctcccgagtagctgggattacaggtgtgcaccacaatgcccggctaattttgtatttttagtagagatggggtttctccatgttggtcaggctggtcttgaactcctggcctcaggttatccacccaccctggcctcccaaagtgctggtattacttatatacttttaatacttcaactggcatatcagatctgtcttcaaaataaatctcaagtatttcacgttttctttatcctcactgctgctcattctacttaatgactgttcttaccctgcctactgtgttagccagactgccccttcatgtatgttggatcactgtcttctgattcagtgacttcactgtacctaggatatgatatgaaggctgatgtacaaggccctgcctaggcctgcacatgtttatgctcctgacggcctctctgatgttgtctccctctgctcctggggtaactggacttaattcaaggtcttcaaccttgctcttccttttgcctggattattcttcctccagatcttagcataactggcttccaggaaagtaaacatcagctttgtgtgagaaagctctgccctatcattcatcaggccgaggtaacagatttaggaaacagatttcctgcatggtcactgcagatttaaagtgtcataatgaccccattgagtgtctgttttcccactgagaatccttgtttattaaaatcatggacaaccactttgctgttagaaatcatcagtaggaaggaaatgtctgatctcaaaaagattccttgatttacaacccagatgcagagcttcaagtaagggggtttagaactctgcatctcaaggaaacagaagcctggttcactt

SEQ ID NO: 45703 - DNA, 1019 bp, Homo sapiens
tggagaagtagaaagtgtctgcattctgcaggaacttatattgtataaaatatattgtatattgtataaaaagaatttctctttattctaagtgcaatgtgaagccaatgaagtgctttaaacaggtgatgtgatttgattgaatttattacttcacttaacaaatattcattacatgcccactgtttgtcagatattgctgtagcccctggtgatacagtagggaataaaacaggcaaaaatccctgtcctcttgcagcttataatggactgcaatgtttaatatgtcagaggaggtccatggaggagtgacttctaagcaagaatctgaaaaaaatgaggatatctaaggagggaacaaatggttcaaaagccctataattgcaagcaggcatgatgaagcaattgcagttgtcctgactctcaacaccgtggaactcaaaggagatggaaagattccttctatccctcatatattttctctctttctgtctatatatatagaatatgagacatttccctaaccattatgtgtaattacaattacatatatatatgtaattgtaattacacataatgattagggaaatgtctcatattcttctactcagaaataagcaatatagcaattactgttttttacattttacagttacagtttcagagaaagtttgatatttatctaaaatttttcaatgtatgaactttttcatttgacaaaccataattgtacatattcttgggatacagagtgatattttctttacatgtatagaatgtgtagtgatcaaatcagggtaatttccactaatttaaaatgccacctttatgttattgtaatttatatatatgctgtatatatacacacacacacatatatatacatgtccacatacactgtgtgtgtgcacatgtacacacatgcatatgtgtatataatgcccagtataagcaatgtgcacaaataaaattagctaacagagatagtatagagtgagaggagaggcagattaatcttt

SEQ ID NO: 45704 - DNA, 1023 bp, Homo sapiens
tcacccaggctggagtgcaatggcgccatctctgctcattgcaacgtctgcctcccatgttcaagatattcttttgcgtcagcttcccgataagctgtaattacaggcacctaccaccacacccggctaattttctgtatttttagtagagatggggtttcaccatgttggccaggctagtcttgaactcctgacctcaggtgatccattcgcctcagcatcccagtgtgctgggattacaggcgtgaaccactgcatccggccgactctcagttttcacagccttaacagatgtaaagagcagagatgactccaagctgggtctgcccagcgtttcctcctaaacgtgtgcagatcctgtgttcctggcaggagcatcctggcgtggtgccgcgctctcctcactgcagcccacttggaggagcacccgtccatcccaccaccactggcgatctcacttggaaatggcaaatattcatttacaatcacaaatttcatcctgtcaagcttcggatttcactttgccagtggttttcactggccttagaaccgtggactccagacaccgagttctcctgcctgctgtcctctcccatccagtctgctacagctgcctgcagtcccactcatggggacatggactcccaggtgtcttggggattttatgtgggttccctcaacccattcacccagtgctgaccgtagttttttaaggctttttctagataagtccttcaagtcacagcaattacgatatctaaaagtagaaaagttaatgttgattttctaaagacaaaaaaataattcattattagattgtctgtgagacgaccgtcaatttttttttttttttttttttgaggatagaatctccctatgttacccaggctggagtgcagtggcatgatcttggctcaccagagtctccacctctcgggttccagcgattctcctgtctcagtctcctgagtagctgggactacaggcacctgccaccatggctggctattttttgcaatttta

SEQ ID NO: 45705 - DNA, 1058 bp, Homo sapiens
ccatttaagggatcggcagatataagccaagaagaaaaactgaaaaggaagagccaaaaaggtagagggagaagtaggaagtcaggagaaaaatgtatttcaggaaagaaatggtcgacagagacgaaaatgttataaaaatgccaagcatggcaagagttgaaaatatacgttgaatttagctacagaaaggtagctgaattactcaagcaaaagtggtttctgtaatgtattactttaatttcacgtcccgaacagacttgagtattttataatatagaatatttatatcgtagagaaaaatgtagaatatttacatcatggagaataaatgagagatgaacatctccaaacaccacctcccaactatatttagtataattaacaaaaaacaagctattaaatgggcacttatacaatcctagaagatacagaaaaaaaaggaaggaaattacatagacttcaacaatattcctggatcaaccacaaatgcttaattcttgactggtgtaggaaatgatgaagtaattattctttacacgaagaaaatctcaaaccttgctaaactgacttatagtcagaacatgtctttttcagtcacataatgattaatttaaattcttgctttagaaaatactttattccttaaatttcagcacaattttgataaactttgtctcacagaactgcttcacaactactgaacatcctaaaatgcaaaactcaatgcccatgttcagtcgacctaaagttatctaaaactgtctctaatagcatacagctgattttatgattttcaagaacattcccaccaaaggcagcaaagaccatgaagtagcagatgactgaagtggcaccttgagtctcataaaacacattcaacagaaaatggctgctaggaacatctctgataattatcaaattatctctcaatatcaacttgaaactgtggattcagaaatctatattaaaaaaaaaaatcaagtggataatcctgaaaaatattgctaacagaccaaatacaggattacttcaacgacaaacatttgagcaccaac

SEQ ID NO: 45706 - DNA, 1048 bp, Homo sapiens
atgaaaacacagtattaagcctctctatttacatcagtgtgatgagggaagtccaggaagacagagagaaaaccctgtagtcccaattgcccatggaaatttagtatgggaaaaagaggtatctcaacacagcagggaaggggcttttcagttagtagtgctgctgcagtaactggacagctactgcacaaagacacaaacagatttgttcctcacgtcatgctccaagataaattccaaatggagcataagttctcttctctctcctgaggcataattcatatacagcagaatagacttttaagtacagttcagggagtcctgacctgtgtacctcccgtaacacatacccaataaagacaccatagaaagctccatatagctattaagtcaatcaccagggaggctctccactctgcctctccttgggaactaagaggtaagccaccattgcgagccctgtgctgacgcaggccccagacacgactgacagcacagtcagactacgtgatgcctctggcttgcctattaattttcttaatgatgacttaaaaagacttttaaaggtgattttagacttgcacaagagtttcagaggcagaacacacagtgtccccaagtttccacccaccttcatgcagccatagaacaaggatcaacaccagaagaggaactctggcatggtactcccagctcaaccacaggctttgttgttttgccaggccacccaccagagcccgtctgctgctgggcccagtccaggatccacactgtacttagctgacacactaccatggccccccatgccagaagagtttgtagtctcctctcatcaccttgaagagtaccggtcaattattttgtagaatgtccgtcaaattaggtttgtctgctgttttctcctgattcagcttagggaaaaccaccacagatgatgtgccattcacacagcaccacaccacaggtacctgctgccaatatgatgccacctttgagttcttggttggggcagtgtctgccaggtttctccactgtaaagtactgttcc

SEQ ID NO: 45707 - DNA, 1041 bp, Homo sapiens
gcaagctcattaaattagaaagaaaattattggcttatctgatgcctaagtgagtaagtcacaatcctgctaattttggaagcatacatctaaaatgaactgtgattagctaaccatgaaaaagtaaaatagcttttttaagttgtgtgattagttatttttcctaatatatccatttgtatgcaaaagcaactttaaaaaagtaaacggcagtaacagaacactgggaactggaaggatgacctgtatttctgatgttatcacattatttacacaattgtttttgacagtatgtgtactgggtaaagataaaagaaaaatcccatctccttgcaccaaatttctaattaagatttagagtattaaaaatacagtgatcatcttacccttttgaacgattttatccaaaatgttgaagtaattcttctgtgccacgccactcaatgaagttaactgggattttgcaattagctgcaacagcttaaaggaaagacggaaaaaagctgagcgatatatatatttaatatggaattacaaaccacagtgatataacacacatgcatgaagatttctaacatgccatcctaaattaagtcactgtatcagtccgagtccaagtataggaaacagtcactacccatgcaaacctgaagagaccttcatacaagggagctgaggcagccgcagcctacagctctgtcttctagtcttgcaggctattcatttagttagtggaagcatatctcctcccggagcccaggctgcaagagtctgaaatggagcttttagctttccagcctctgtagcaaaagggcacaccagaaagaggctagaatgaatggttgggcactaacaagtattttcacaacctaagcccatactcgcagttgtttgctgaacagacaatcagaaaatcaaacagcccttccatgtagaaattaaaaaggaaacacaacaccaaaactcattgttaaataccattttgtatttaaaaactcattattaaatagcaaataaattgcactaaaatacaaaattgta

SEQ ID NO: 45708 - DNA, 1022 bp, Homo sapiens
agtcactgaagtctccctcaattcttccttccctcgcacccacttcaaagtcaccagtctactcttttgctcaagtatccccaagttcattcttcccatttcactgtcactgctcatgaatgcaatgagggtttacttccctccaacctggctggtccctgcctggcactgaaggggacctctaaacaaggacctttcaatgacccttggcagagagcagcaaaggctctgcaatgcccacaaagccctgagtctggtcctaatcccctgcaccttcctccaagcagtccacacatttggcataacacactttattagcccctggatgcggaagttcccataccttctcacaggagtcaattctgcaacttctgggaatttcgttagccagtttactttttgttggtggcttgaagtcagtcatagtgggaagctgacaaaggctacaaatcaaacctcttgcccctggagagccagttgttaagcactgaccaggaggccatcacctggatactctcccctcattctttgttttctttttctttttctttttttgagatggagtctccctctgtcacccaggctggagtgcagtggtgtgatctcagttcactgcaacctctgcttcctgggttcaagcaattctcctgcctcagcctcccaagtagctgggaccacaggcacgtcccaccacgcccggctaattttttgtatttttagtagagatgggatttcaccgtgttagccagcatggtctctatctcttgaccttgtgatctgcccacctcggcctcccaaagtgctgggactactggcgtgagccatcgcgcccggcccattctttaagctccacctaaaacatcacatcacttgtgaaccaatgtaatgtcaacagccctgtgtgcatatctgttataacaccccactgagttctgtgacacatcatgtgctcatctccctgggtccctcggaggccccatgctaaaggctacgcctgctgatccatgtgtcccacctcatga

SEQ ID NO: 45709 - DNA, 1066 bp, Homo sapiens
ttttctcaggtatctagtttttactttgaggatgcttccttatctaagctttctcataaaagctatttctaatatgctttttttttcagggccttaatgttagttactgaggcctgaagaacagatcattattttctgatgctgtgtttttatgattcagttaagaaaatgtgtacaaatgagatgcacctgcaggtgctaattgcaacttaactattctaggatgtgggtgcagaacagacatttaacttatttaaagcaactcttttaagaatggcaatgaccacagaaatggccaaaagacatccttaagtatgtttagggtctagatgtataaacacctgccaggcactctcattaacgccttttgggaacagctcgggcctgcacgtgatagggagtgtcccagggcaaactgggaggcagagggctcatcccaggcaaccttcatttacctcttttcctaggatctaaatcctccacacaaaattctatccaccccctcccccatgcccaatgctgacttaaaattcaatctactgttctcctactcaaattaatactggaattcttttgcttctcccgaacaagtccacttgagagagttttccccaaggcatccataacctctgctcggctaaatctcacaggcttttctttgtcctattaatctctctgtccatggccttgagagtccagctccccccaggttctggggcacctcattctatccctcaacattggggttggtgccctgaggccctgcccaggctgatcccgttgcctcctgtcctctccatatgcatctgtctaggccctagctccacatacctctcagacacactccgtgaggcccatgttcaggccagccccttcctgtggcagcccccatcccatcggggtcatcttctgatgtcttccctgttgcccttgtgcacttccttgcccataactcttattttcctgaggcaggatcctcatggatcctcttgtatccactccagcctagtcctcaaacaagaacagaggctcttctgaaagctgcaattccatgtgctttgctggc

SEQ ID NO: 45710 - DNA, 1042 bp, Homo sapiens
gaataccaagcagctgttaaacagacttaaatactccaatccagaataatgtccataatgtattattaaattaaaataagctacacacatcatatgtgataacagacttatatctagaatagataaagaacacttacaactcaataataaaaagacaaataacccagtttaaaaaatggtcaaaggacatgcaaagacatttatctaaataagtctcagaaatggacgataacctcatgaaaagatgctctagaatccagtcatcagggaaatggaatgagacccacttcctgcccactagaatggctttaatcaaaaagtgaaataatgagaagcactggggaggggtggagaatcaagagacctcacacactgctgggggaatgtgaaatggtgcagccactttgcaaacagtctggcaattcctcaaaaagttaaacagaatccaccatatgactcagccattctactcctaggtttataaccaagagaaatgaaaacatgcatctacacacaaactcgaacatgttcatggcagcattatttgtaaaagccacaaacttttatcaaacaaactaaatgtcaatcaactgatgaatggataaacaaaaagtggatatacatagagggggatattattcagtcttgaatgaagctctgatttattctacaacatggagccgtaaggacatcatgcaaagggtaagaagccagtcacaagatgagaaatgccatagattcctcttacattacacatccagaacagggaaacacagagacagaaagtcgattaggggttgcttggggctaggaatggcagctgaagggcatgttttgttttgttttgtttttcctgaggtgatgctgatgttttagctgtgtcccccgccaaatcttgaattgtagttcccataattcccatgtgccgtgggagggacccggtgggaggtaactgaatcatgggggcaagtctttcccatgctgtttttgtgatagtgaataagtctcacaagatctgatgattttataaagggcagttccc

SEQ ID NO: 45711 - DNA, 1047 bp, Homo sapiens
gtattttttgagacagggtctcacactgttgcccagtcaggagtacagtggcacaaacacagctcactgcagcctccacctctgcctgctgagtaactgggactacacgtgtgccaccatgcctggcttttttcctttttctttttttttttttttttttttttgtagcgacgaggtcttgctatattgcctaggctggtcttgaactcctgggctcgctcaagcaatctctggcctcgacctccccaagtgctgggattacaggtgtgagggactgcacctggccgccatttaagtatttagaaattaatgtcccagcatggtttttcagagttgcaaagatattttcacttacttactgataaaggggtagagttttagcttttgataaaggggtagagttttagctttcataagaagtgaggctattgatccctttgacgttacttctgtttagagttttaggaaaatatttttaaaaatttagataatttattttcaagaaagctgaacaaatctggatggtgtgggggtgatgggaaataccatttgagttttgagaagtgatttttttttttattctttggaaactagtgtttacagaaatctcttctccctagagactttaaaacgtgctattaagacagaaggatatggtaagaatttttattctgtaagaatcttcaaagctcagcatgaagatacacatctttcccatgggaatccaggctagagaaatgcaagaaggcggttccctctagagtctcctttcctgggagatgcagctccagatgggtgggtttctgggcaggaggggagaggagggtggtgtttattcaactgtttatttgggatcatgttatgcgtcttcaaaaagcgatataagagaaaatattggaaagatatttcaaaataagaattaccttgaagtaattcccataattaatgggtaacatttttgtgtatgtattttggctttttattgtaaaaataatgtattttcattgtagaaagttttttttaaaaagtaacgagtacaaaaaagta

SEQ ID NO: 45712 - DNA, 1072 bp, Homo sapiens
ggaggccctgtgaggaggggcgaggggcttcagggctggaactgccgaacagccagtggaggggccaaacctggggagcgtggggcaactcgtgtgggaggtgttctcgggcaggctcacctgcagcgtctttaagcatgcgctttcatagaatcctcttgcagatcctggggcacctgtgccgccaagagtcctgctcacctggctggctccttggtgccctgacccatggctcttctcacctgtgtgccacccccaagaggcttcttctttcttctgaaacaggccctcatctgtgaaccactgtccattgtggtcccctcctgttcattttgttcattttctgctcttctcttgcttgtttctcccttgacgccataaagtcaatttctcggtctaaatcctggttctcaaccctagagaggatcaatgtccccatatcaacaggaagtagagccagtgacatttctacctcacccagagtgaggaccaggttggttgtgtgaggtgaagcagagctcttgcggggggctagtgtcatacccctaaccccgccttccattaaggccaaagctgggccctgcggggctttgtcccatggccagacgttttcatcagaattaggtgctgttttcttcattgtgtggagagtggatttgatggaagaaggtcatgtaattgggggaggggggagccaagtctctagacagagtaggaaaactagtggggtattgagttttggagacatttctagggcaacaaggtatctttaggaatttggtccatggcagccttgggcagatgtttaaaaaaacagacttgtacctggaattcgcttttaaagtctgccagctgcccagggtcataggttcatttgcccaggctcctgcatattctaattttatccactgaggcccaggacacatggagtctctgctcagtctctatccttagaaggaagcttcaagccgggctgtcagagccgacggtaaacacatgatgaatgtccccgccgccctgaaccgtcttcctgagattctgtgtgcctgcccactcttccttgcagagtctg

SEQ ID NO: 45713 - DNA, 1189 bp, Homo sapiens
gctcagagtagtccaaaggttgtttaaacagcgctgaatgactgagagagcttgctgcttatttttttccttccagtagaaaaacagttatagcccagctgatgaggtagaaatgcactgagcaggtctcagccccagcggaaacagagtagccctcgtcatccaggtgctgtgttgcttggtaaaagtgtgtctgcctcgggctgcgacctgccacgtgaactctctgacccagcaccagccagaatcaacatttggggattcagactgcagcaacaagtgattcccctcttggcctgcagttctgtaatcccaaaattgtttctaattgtggatatgagacatcaaaatgagggctgaatcagatgaaattatgctcagttcagcctcagatttaagtgatttattgttttctagttcttcagacctaatagagctgctgtggtggctctgtcagtggttggcagtggccatcagccctcaccctgccattgggggccttgtgcgttggcatctggttgttgctagcagccctgagggggatggggcaggccaccgccacctctcactggctgctgggctcaggactggtctgctgttagggaagctgcaagtccagccagttgactgcacctatttaagaaaaagcactactctgttacctgagaacctttgagattcctgttgtgaaggaacaatcatatggaaatgaaaacttaagcttttagctaataacagaaaagtgaactagcttttgtcagttgttcaaaagtgtaaaattctactgaaagaagacagctcaatatttcaaacgctggagctgtgttatttggtaaccaagtagagacggcgcccggcagtaatctgcggctgctcagtgtggccctttcactgaggccttggtccacagcaccagccccgagaggggtcccagctgccgaccttcaggctttcttttctgtttataaagtgagggtattctcagagagctttgaggagaaaatagtgaagcttgaaggttgttggtgaagctgtgaaatattgaacacttcctaatcttagattaggttttctgcatcttagatgagtcttgaatagctataaccaaaggctcttgtttatttaaacactttaattatagagagctaaaggcaggaggcacagggtttgggtgggtgaggggctttgc

SEQ ID NO: 45714 - DNA, 1077 bp, Homo sapiens
tgaatagatttcccttgtttcttaatctagaccctggattctcatagatctgatttgctcaaaatcttgagtaccaccttcctattgccttgaggttctctcttgtgtgataatacttctttcttgtcagaactagttctttgcttatgtattgccaagtggtgtcctaaaatgtggcttttacacacttcattaacaacatatagtgactaatttttccttaattttaatatttgaaacttttcatatagacttgtgttagttttctaaacaattttttaaaattttaaagaattttatgtttgtaaaatggataaagcttgaggccctaagacctgggtcaccaacacctaactctttcatctcctatagaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctggtgagcatccgacggcagagtaaaggccacctgacagatagcccggaggaggcggagtgaggggggctgcgtggcaagtgtgccccgacatggtggccttttatgagtataccatgtagttgttgagtcttttccgcgttagaaagaatagagagtctactttttgcctatatttgatatttggacctctgtttctttatttaatgaactctcacacacactgtgactccttggtgaacacgtgcagggattgtacatttgattgccttattgcagaaatattcacctatcagtccatgttttgcagaaactggagatgtgaatttatgatgctctcccataatacagcagtaatgatttgcagtttctcacaaaatgattttcatgctgctctgtgttgtagttctgtttcagaactt

SEQ ID NO: 45715 - DNA, 1051 bp, Homo sapiens
cccttagtccctggttagttttcagggtcatctctgccctttgccccttcctgaggctgtgttacaccctggagacccccagacattgcacctggcaatcactgggtcacctcaaagggttgattgaattgtattcattatccttgtctcggatcagtgtcatgctgcagcctcaggtcagctttcaggattgctttatttttgtattatatttttaacaacgcaaagtattctaaagctggctctaccccgtgagagacccttcccagccctagcaatgtgatgatgaaccctgggaaatgttaatcagtgaatatgaagggccttcgacacacgccggattttcagatggttttctccattcttcttagtaatggatttcgttgtatccaagatggtattaattatatcttgatgtcagaaatgaaaaaattgtacaaaatcatttgtttacagtcaacaaaattatttcttctcagaaatctacacttgtagaagttagggcaagggtcactgtctccatggagatgctgacgcttaaaggtagtggcacagttgttccaggggaccttggagaagacccccttctaggggacctcttgtaacaaccttctcaaaggtcagtctcctatgtgttttgttgttgttgctgttgtttgttttttgagatggggtcttgctctgttgcccagcctggagtgcagtggtgagatcacagttctctgcagccttgacctcctgggtctcaagtgatcctcccacctcagcttcctgagtatctgaaactacaggtttgcaccaccatacctggctaagtttttgtattttttgtagcaacggggtctcactttgttccccaggctggtgttgaactcctgggctcaagtaatcctcctgccttggcttcctaaagtgctgggatttcaggtatgcgccaccatgcccagcccaatctcccaagttttaaggagacctaattcttatttgtgagggaagcttcgtctgattttaagcatcactttcataagctttttgaggcaaaatattgact

SEQ ID NO: 45716 - DNA, 1045 bp, Homo sapiens
tggttttataagggagtcttcccccttcactcatttgctctctgtcttgaatgctgccatattagatatgcctttgccttttgccttccaccatttttgtaagtttcctgaggccttcccagccatgtggaactgagtcaattaaactgcttttctttataaattacccagtcttgggcagttctttatagcaatgtgaaaatgaactaatacacatattatctgtagcagtctgtcttcaagttcacttaattttttcttctctaaattaaaatgtactgtaaaacccctctagtgaatattttatttcatgtattatacttttcatttctagaaattccagttggttctttttgataatttctgtctctttactggcattctctctttgatgcaacattgccgtcgtaccttcctttacatctttatcatactttcctttagctttgttaacatatttataatggttctttgaagtcttcttctgttaaatccacagatctggcagtttgtgttgcctgctgttgttttctgatgtatgggtcttcctttttctttggctgcctcaaaactttctgttgaaacaggacactttatatattttatttttattttttaactttaagttaaatagtacaggtgaaagtttgttatataggtaaacttgtgtcatgggagtttgttgtacagattattttgtcacccaggtattaagcctagtgcccactggttagaaactggacattttggatgatacattgtagccactctgggtactgactgttccccctttcccattgttgctgttgttatttgcctctttatttgcttagtgattggctggattattttagagaagtcaattctccaccctgcccccagtggtgtaatttagctcctgatgtggcttctggtggggcacggcactgttgggtgtggcccctcttacctgggatgatggaggtgtggcaggctttcttcctctgtccgtgaccgcatgcagctgctaaattccagtaattgctgctgattgctgtatggttta

SEQ ID NO: 45717 - DNA, 1037 bp, Homo sapiens
aaggattatttgatttcttcctttctagtttgaatgtcttttatttttttctggtgtctgattgctctagctaggacttccagtactacgttgaataacagtggtaaaagtgggcatccttgtcatgttccagatctgagaggaaaggatttcatttttcccttcagtatgaaaaatagaggagaagggaataagtccaaagctattctacaaggctagtattgccctcatataaaaccagactaagacataccaaaaagagaaaaccacaggccaatatgatgaacatagatgtaaaaattctcaattaaatactggcaaaccaaattctacaacatactaaaaagataattatgatctttttatcccagggatgtgaggatggttcagtatatgcaaatcaaccaacgtgatacatcatatcaacacaatgaaggacaaaacccatatgataatttcgattgatgctgaaaaagcacttgataaaattcaacatctcttcataataagaacgctcaaaaaactgtatagaaggaacataactccacataataatagccatatgcaacagattcatagctagtatcatactgacaacccagtggtgcattttaaagaactagagtctgggcatggtggctcacatctgtaattctagcactttgataggctgagatgggcagatcactggaggccagtagttcaagaccagcctggccaacctagcgaaaccctgtctctactaaaaatacaaaaataagctgggcatggctacaacaaatactgcagaaattcaaaggctcactaaaggctactcactaaaggcacaataaaggcatattgtgcaactatatgccaataaattggaaaatctagaagaaatacatacaacctgtgaagtttgaaccatgaagaaatccaaaacctgaacagaccaataacaataagatcaaagccagaataaaaagacttccagcagagaaaagcccaggacccaatggcttcactgctgaattccacctaacatttaaagaaat

SEQ ID NO: 45718 - DNA, 1110 bp, Homo sapiens
ggttgaaataatatgtggtgtgattcaatgttttcttgtaactactcacatctccttttagctattctttgccagatatttggctgtggttaatactaagcttgtggactgaagatgattaatatttcaaaataaagttttatagtgatatttttaaaaaatgaagttttgtccccacagtataactcagacatttgtttgatgtggaaagaagttgtgccaagaaattttagagaaaagacagtctgtaactgtgattaaagatggcatccttacgccttttcatttttgtcgtagataaaaagtgtccgtatgtgtggtttcttctgacaccaaccaattcttcagtaccagctgggtgtcctacaattcagtttccttctgacattcccttcccagaattagcacagatcctatggattaaggagtcattcccgcaagactgcacccacttcagatgccagataccaacgggtgcccaattcaccataagtctcttatgccactccacataaaatgtctgatgtcagcacaatggtggagtggaaagtcccggaccttgttcccccacggactctgactgacaacaatatacagtccaaaaggatgtatgagaattacagaaaccagtttagaagtcacagtaccccaggcaagctcaaagccaagaacagctgcattgaagtaggagaaaaaaaaagccatttaatttcacctgcctttccctgaaggtggcacagcttggcatgattggtagtaaacacccaactctctgctgggtagaaagtgaagaaaggaagtccaccattctgaattttggggggtcacctgatggactggtttctgtctctcctgactcagtgctgactgggaactggcatactttggatgcctgggggcttcagagaaaaaagagttaactggctttttgcagcatcagagactcagcagtgctgcggatggaggtcgggacagctcagcacagtcaggagagagcgtgtggttcttggcttatcccttgggcaggaatgggaagagtggaaagtgcatttaacattctggcttttcagggggactgcccaagagactgattcctgttttgcctgactc

SEQ ID NO: 45719 - DNA, 2455 bp, Homo sapiens
tagggcttaaggtggcatgacttagaatgtctaaaagctgctattcttattagagttaggctgtgggtttcactttgtgagtcagtcactgtcttgaaaactgaacgtcactgaatgtggagcccagcttgctcagccagggctggtgggttccacccctacactcacacctgcctcgggtgggcccacccctacgctgagacctgcctcgggtgggcccacccctacactgagacctgcctcgggtgggcccacccctacgctgagacctgcctcgggtgggcccacccctacgctcagacctgcctctggtgggcacttgtccatatggtgggaggccctgcagtctgtcttctgcttttttaagatcacctgttgggaggaatgggcgacttggctttacgtctgcctttggggagtggatgtacatgtggggctcatcagccttgtcttaggagttaaaagccaaagactgaagctcaagaggattttacctgttatttcagagtgagtcaagatgcagtccacggaccagggacacttcctttttctttcctgtctgctcagggcagggaggtcgttttatgttcgttttatctgatccttcaccccacgttagctggggttctgtcttggtgctgtatataaccaggcgaaccacagtttctgctttgggagttctgtgggggttgctgtgagggaagactgcctcctctcaccttggctttgtctagaaatggttggaccatgagctagggtggtgcagctgctcccaaagacttgggaaccaggcgagtgtgtggacagcccgcagaccagtttgaatctaaggagaggccttgggggctgtgggtgtggcttttttcaagatattaataaatgtatattaaaaccatgatgtagctttctaatctttcagatggaagtacaatattctgtacaaaaatgttatagactaaatggcagatattctagttctagtgtttgaaagataacgagtccttttatcaaggctgctgttgtgggcagagaatggaatgctttttactcagaatgcgttgtgtcgtttttagtcagagcgtgtcttggtttggaggatagaatcctggataatgatactggtgcctgccatgtgctgggcattggagtgagtgctttacagctattgcagcttctcacaatagcccaaaaagtagttacagttcatattcattatttgtggattccatatttgcaatttcagcttcttgctaaaatttatttgtaatccgcaaatcagtactcacagtgccttcaaagtcgtccacaacttgcagagcagcaaacactcatcatcacccagcgagctccttcccagctgaggcatgtgtctttcctgcagtctattgagaactaccttttttttacatgtttgtgcttgcgtatgatttcactgtttttcacagcccccaagtatagtgctaaagcactggctagtgttcccaagcacaagaaagctgtggcactccctacggagggagcacctgtgttagagatggctcaggcatgagttacagggctggtggctgagagttcggtgtgaatgaatcaacagcaggtattaaagcaggcatctttaaacaaatacatgtaaaacaaggtcacacattgttgatgaaaagttgttattcagaggctcgcgggaaccctagccttgtgtttcccttaacagcaataatttagtatttgctaattgactgtggcaactttgtacaacataactactgtgaataatgagattaaactgtattttatattcgatgatcttagagaagttaaataactcgtgtaaagttacaaccttgtaaataatttgtgttagtagccaccagtaggaatttgaatccaagtttctctgggtttatattctttgttgaattctcttaccttataggttatgacaaatttctgataccatttttcttcattttccaatttttaaaaatattaaataactagggcttcaacaatcagtgccttttgaaagcactgataaaattgtgttttggctcaattttcaatacagtaaacatgacagtgtacttttaatttttgtcatgcttgagttttgtattaaagagtttcttgtattaaagagtcttactatgggagataaacagttctcggtaaattagcaagtgagaagcgctagaacattgcgaggaaagagaaccggtgtacatctgcctaccctatactttatatacttcccttttttcttcgtgatcgggggagggggatagaaaatgaagcagttgaactgacacaggagggctgtacagggaagaactgggaaaatcccattaaggagtggaggcttcatttcttagctgaatgttgaagaattctgagtaaccccttggttgtattttgcaaagactacctgtttaaggaggaggggttgggggcaagatgc

SEQ ID NO: 45720 - DNA, 1045 bp, Homo sapiens
ggtccacgccgggtgctcgcgtcccgggtggagctggcggagaaggcctgaatcatcgcgcatccggacggcctcctcgcggacactaagcagctttggacgaccgtagctcaatgttaagtgggctaaatgtttgtttgcataacaagtattttcttaaattcttgatttttctgaaggaagccggcagaagtcctttgtactgaaaactgaaaggcctttacctgacgagtgtagagatatgtttggtatgtctagaattttgtaattgaaagggctcccaggtgggccctgtgtgccttagacgtgccctcccccaccccctccccccccctccctttttccattgcagtgctctttttcatgtacaatgaaatttaggtcagaaatccagcattctggatcataaaatatctctttctgttaaacgtgtggcaacttcctcctgatgctgttaaggccgaatggaatataaggatttgtacctgtcttccgaggacttggaaatagtttctgagcagaagagtttctcttagggtctggagttgtttcttcttgatagagattttctatgaacgttaaattccattcctaactcatggaaaatggagccgattatgttaagcgcttaaatatggttactatctgaacttgtctgagaaatttcttttaggtagcgttagtgcttacgtgccttttttttttttaatttcagaatgttatagttactctaaacagctctcttcttgaatgtaatgatgagaatttatatgtggctacagagttaactgcagaagctacaaataactaatattggtcaaagatgagccatattattgtttctggatagagccttgagaattttaaactgagtcttcctatgttctcccatttttcctaatgaatcctgaaacccacttttttttcttaagtttttattttttattttgagacagggtcttgccccgtttactaggctggagtgcagtggcgcaatctcggctcactacggcctcaacctgcctgggctcaagctattctcctc

SEQ ID NO: 45721 - DNA, 1039 bp, Homo sapiens
tcccaaagtgctgggattacaggtgtgagccaccacgcctggcccactttttgttttgtatatgtccttattattcctccattttcttttattgctttttcatattaagtggctattttataatgtaatattttttattccttaaatgacatttttactgtattgtttattttcttagtggttgctctggagcttacaatgtacatcttaacatcaaattttattttagatttatactagcctaataccagtgaaatacagaaacatactcctgtggaatgagttcaattccatagacttcatacaacatagtttcattccatagacttcttttttgtgctgttgtttaatatattgtccctgtatatgttacaaacccaacaatatattgttataattactactgtatataatcttaagtcttttaaggaagttgagagaagaaaggagagcaagtatatgtttataaagtttgttatattaatctccttatttaccatttctgattctcttttcttcccccggtggatactggttactatctgatgtcattgctttctctccagtacagctttgttccacctggcttctttgtgctgctattttcaaatgtattacgtttctatatgttataatacaaataatgtaattatatacatattcttttatgtaagcattttaaaaataagttgagaagaaagaagaaatatgttatactgtcttttacaattatctacagaatccccttgtgtgagataggtctcaccgggcccccctcgtgcgcggtgggtctcaccggggcctccttgtgcgcgatgggtcacgtgccctttctgttctcaaggctttctctttatttggctttcaacattttaacacggggctgggaggtgggcaacacaggtggccagagccccagactgggcactgggggagtagggcccccattttcttttccacatctgtagagagcagagcttccattttctcgatgggcttggagggagggctgaggctgaaatgccacagactctcactg

SEQ ID NO: 45722 - DNA, 1048 bp, Homo sapiens
acgcatggcactgtgcttagagctggagtgagccgcaagcaaacctgctgttgaaggtgcccgcccgacggggccgccctgagcatgggtgtgcagacgtatcctcgagaccctgttcagtgttttgggtgtacgcccaggagacgaattgctggatgctgtggcaattctatgtttacttgtttgaggagcttccatggtagctgcaccatttcacattcccgccaacagtgcacgagggttccaagcgctccacgacgctcgctcgttgcctttgtgttttgtttctatagcagccatcccaacgggtgaggtgagcaccgcttcgtggatttatcagctacttgtgtgtcttctttggataaatgttgattcaagtcctttggccatttttgaatcagggttttttttgtttgttttttttttttttttttgagttttaggagttctctatagattctggtttttaaccccttactagatgcatgatttgtaaatattttccccattgtgtgctctgccgttttactcttaatgtcatttgatggacgaaatgtttttgtttccacgcagtcccgctgtctgctttttctgttgtcgcctgggcctttggtgtcaccttcaagaagtcactgccaaatccaacatcgtggcagttttccctgtgtttccttatgagaggtttaggtctcacatttaggtctttgatgtactttgcactgatttttgtcagctgtaaagtaggggccaatttcattcctttgcgtgtggatgtcctgtttcccagcaccatcggtggaagcggctgtcttttcccattgaggagtcctgccatcctggcacctgtgccaaagcccattcgaccttgagtttgagggtttatttctgggtcctcgcctctgttcccttggtccatacaccacctttatatcaggacggtgatgctttcattcctgtggcttggcagtaaaattttgaatcaggaaatgtgagtctccagcttcgttctttttaggattgttttgggtaatcaggaacccttgagatt

SEQ ID NO: 45723 - DNA, 1026 bp, Homo sapiens
gccggggcgcagggattcagccgccttagagcgcgccagacattagccccaggctgagtgttttccacagagaatgctattaacaggatcccagcttttgcctctctgagagatggcatgaaggagcccacagcctcgttgcaccaggtggccctggcaaggtgcagctttgggctgtttctgccgaggcggaggccttctcgccctggttgaacggctcgcaggatgaggaatcaccgcacctgccgcgtaagagccgcttgcaagttaaatggggtgaacctttgaaggacctgctgcgttttggatccagagttggttgaacacaaactttggtgagccaaccgtccctgctgtggggtgcagcacgcatgtggaccacagactcacggacacacacacacacgctgggggagcgtcggccccactcgatggtgacaagtgtgctcacaccccgttgctagagcctccagggaccctgcttgggaagccagtcatgacaggtgagcgtgagggtgcagggacgggttgctgggagtccctggacacatcccgcagggtcctctggcaggtcggggccgggccggctggccactacgtccaggtcgaccacagctgtgccgcctgcgggctgtgatctgggctcccaagaccacccatgtatgagggaggacaggtggggactgggtggggcgttggtgcaggtgaacgccctagacagcccctctcacagccagccttagctgtcactattgttagtggtgatgagccctgcggggactttggagggaagctcaggctggtcccaacggcccgggcttggcgtttatccgttatacccggataaacccgtgtggggggctccatcacagacttagacgcctgttttctctatggacctgacgcaactcaagggaaactcataagctcggatgtgtatttcctggctctttcctgaggctgaggggcctgtcctcggggggtttcctgaacagaggtcaccatgaaatggtcacagggagaggc

SEQ ID NO: 45724 - DNA, 1052 bp, Homo sapiens
atggtgctgttttcaccttttggctgttagaataatgttactctgtacatgggtgtacaagcacctgttgagttccagctttcagtttgggggtttatgcccagaagtggaagggctggatcatacggtaattaaatctgggtttcattttctgaggaatttctaccccgtcttccacaatggctgtaccgtttttcattcccagcaacagcacatgagtgtgctcattcctcctcatcctctccagcacttatttctcgtttgtaaaaatatatgataatcatcctgatggttatgaagcagcacctcgtggttttgatttgcatttccttgctgattagtggtgccggacatctttttgcgtgcgtgttgacctttgtctatcttcttaggagaatttccattccggtcccgtgcctacttttgggttgttttgtttatcacagtttttataaaccagttctacatcagatgagctgtgtgcccctggtctctccaagtagcttaaattctctgagcctgaggcatctcctaggaatgaagacaccctgtaagctcaacaccattattcatgcctaagacaactacaccaattccccagcttttgaatgaccataggaattatcagcagaacaggacactttggaaagtgaatgaggtgggattaataattatgcggaaacagcaggtgtgagccagaaccatcccaggcaagctcgtggtcactttatgtgatatcaactccactccgttcctatctagatttccccactgtccccagcacatctttccaaccagcagccaacaacggtcgggctctgcatttggttgcgagcctgtgttgtctcatttatctctgtccactgcttccctaaaggtggtgactctgacggggccaggccccagtcttgctcttgtagaacagcttctccctccatcacgtaacctttcctcctgctggctgcatttcctgccaccggaagtaaggtcttcaggcgtcggattcagagggcacgtgggtgcagggtgagttcagggaaggcgtcgatggg

SEQ ID NO: 45725 - DNA, 1029 bp, Homo sapiens
tttggggaaggggagagtcccgaagcctcaccttaccccacaggtgacttgcagatttcgaaggggaggagcagctttgcaggggggatccagctgctggcactgagcacccagacgggaggcttgtaggggaaaacagaaaaagaaggaaccgggggagtttagaagatgctgtggggatgaggggcatgtccctcgaggaccgtgccagcagcgaggccattcggagaagacctgggaatggctgtggtcacaggcagttcagacctggcgggcaggtctacagcctgatttggggaagtcttgaggccatgagtctgcaggcacagagacagccctgcagcagcatctgcggaggctgaagagggagcccctggtgtccacctgggcagggggagggacctgttgcgattgggtgtaactgcgagaacagcatagtggatgggcggtctctgcacctgcgtgtgtggagggaaaagtaagacaggaaaggatgtgtcatgaaaaacgtggtcgtgagttaaaaatgaggcacatacaacaatagaaattctgcaggaatgtatttaaataatacactgtctaccgtgtgtgactgtgcatgagagaggagtggaatggaagtggggcacagaggaaggaaagaaggaaggaaggaaggaaggaaggaaggaaggaaggaaggaaggaatgcagaggacagaatgaatacagataaggagtgagcaagccagagaaaaggccacacatgcccccagaatgatcccccgtgatgaaggttgctgcgtgatccactcggcccctgggtcccagcaactgaccacagcaaagaagaaaagaggagctcctgcaagggcaggtgctggtgcaccatcgtccagaacacgaaacgcacacgtaggtaagaacgtaagtctatgtgagagacgggcaaacaaaaacgagtgagactcctattacatacgctcctgggtgtgctgacgtacagaaatcctctctgcaggcttaattactatctgccgtgttgga

SEQ ID NO: 45726 - DNA, 1013 bp, Homo sapiens
tcttcctcttctgggagtggctggggttgaaggcagtgctcgtgttcatggccctttcactacgtctgatttgtcgcagatccaacagcatctgggatcttcctctgaaaatccctctcattatcgcaaggaattcctgcacattactgagtcctttaatttaacatggcatgacatttatatcattctaatctccaccctcactcctgatgaaaagggcgcccctggcgttcagctgaaacccacgcagatgaactccataatcaagcccctgtacaaaatccagtggccaatgatgcatttccccacagagacccatactagatttaccatcagggagacaatggcgccagtctggactgacggagcaggagcatcatcatcttagacaagcatcgcccctgtgagttctacttgattcaaaactgcctaaatccagccccaaaacatcagcctaatggctaatgtcagtgtgaccttaaatcacaaatgaaacctctgaccagagacatgccaaccccgagataacctcccttccgaccagagacactccagtcctgcaataagactctcctccacacagaaacattcctagcctgcaataagctccccttcccggaactcttaaatacccttagtctccaagagaaaaggctcctgaccgaaatcgggcagaagcccctctcaggtttattctccaaaataaacctgtcttagactgttgagctgcttttcgtgtttctttcttcttcaactcttgcagtatctatcaccattattgttacagtttcatattccacattgcaaccaacctttaagaaactacagtttgttgagttttgctgttgtataaaaaaatccatatttatttgagaaagctattaacttactcccctcttccccaatctattaaacatttgctaagtaatagtaaaattgtttgctcttaaaaattattttgcactaaaatgcattatttaggttaacatataaggagtgtattgtttatctta

SEQ ID NO: 45727 - DNA, 1571 bp, Homo sapiens
cacgttgtatttgtttaatgcagacttggcctatacgagtttttgaaattaagggttttttccgtaaaactagcttaggagtttaatgagtcactgtgtctctcacctctgtaggatgagcacagagatcacatttgagaagcaggtgtgggtgttttctgctggtcacgtctcctctgcctctcctctggctcagcagttacttttcctcagtcatgggggctgcattcagctgcgatgccagcattagggccaagctctcccgcttctgtgacgttttattacacgtactctttatcagtagtagctgccattccctgagtgttcctcccaccgtgcactgagaagggctgaggatttccgaacatcaacctcctctaattctctgtatgggaattagatttttatcatcctgactgttggggctttctagagctcaggcaacttgcccctgggcgggatggagcctgcctggggggagtgtgaatgaggcttctgttgtctgtggcttggctctctgtggttggaaacttcagaagcagtagattccaggtgcaacatttggtgcccggacaagttgtaaaacctgaccttggggagggccttcactggcagccagtgtccacccgtgagcccggtgagcacagacgttagagccagggccggcgggctcagaggttggagccggggaccagtgggctcagaggtcggagccggggaccagtgggctcagaggtcggagccatgtccctgccgtgaagctctgagggttggtggtgacatcaggggcgattgtggcatcgcgattgtggtgtcttggctgcctttggccggcgctgccactgccctggtttcatgacgtaggcaccacatggtcctgtgttgtctcacttacggctccacttctggcttttttctacttgctcacccttgagataaacttctatttcattttcatttcggtttatatgtgggttttcttccaggtctgatgttaagcctataatattgcaatgtgatgttttgaagttaaggtgtaatagagccagtgaaccaagggttcacaccccagtgaaatacaaatattcagaattgagccactgtgttgccatactgattatgtaatgtgtgattaacaagtataatgtgtcactttcaacatcagtttcatgccaaagttgcattttattagattatttgggagttcactttgggcccaaaggctcgtgtctacataataataacttatgatttttctttttgtctttgttttattttttgttttgtgttttttgctttctagaccatgccagagtaatctcagctttctttagttactggatcacacatatccttcctgagaagagcagtgactaaaatggaatatctctttaagaacagctcctctttaacaaaaaaacttaaaagacaaatgtgagatgggcttagagttagttctctgggaacttgaaagacatttatgccatattatttattcacgtgtttgttcctggtgggcaagatgccatctgaggcttcagatgagaaattggggtaaaatggaaattttt

SEQ ID NO: 45728 - DNA, 1057 bp, Homo sapiens
ctactaaaaatacaaaaaattagccagtcatggtggtgcacacctgtagtcccagctactcgagaggctgaggcaggagaatcacttgaaccctggaggcagaggttgctgtgagccgagatcatgtcactgcactccagcctgggcaacagagcaagactccgtctcaaaaacaaaacaaaacaaaacaaaacacggtatcatttatattaccacccccccataataaaatattttagtgtagatctaacaaatgtgtacaacatctatatgaagaagctatagaactctgatgaaagaaatcaaagaagactaaaaattgaacagatattccatgttcatggataggaagactcgatattatagagatactcattcttcctaacttgatatacacattcaatacaatcctgattaatatcccagcaagttattttgtggatattgataaactgattctaaagtttagatggagacgcaaaagactgagaatagccaacagaatattaaaggagaaaaacaaaataaaggactggcattacatgacttcaagagttacttaccagaaatctacagtaatcaagacagcgtatttttggcaaaagagtagacacatagattaatgggacagaatagagagtacagaaatagacccacataaataccactgacttatctttgatacaggagcaaacaaaggctattcagtgaatgatcttttcaacaaatggggctggcacaactagacatccacatgcataaaaatatagacacagaccttaaacctttcacaaaaaaatcttactaaaaatggatctggactgggcgcggtggatcacacctataatcccagcactttgggaggccaagatgggcggatcacgaggtcaggagatcgacaccatcctggctaacatggtgaaaccctgtctctaataaaaatacaaaaaatcagctgggcatggtggcgggcgcctgtagtcccagccactcggtaggctgaggcagaagaattgcttgaacccaggagcagaggttgcagtgagctgagatgttg

SEQ ID NO: 45729 - DNA, 1049 bp, Homo sapiens
gggtctcagaaactgaagttaacctccgtcatcatcacttgccttggagaatgtgtcttttgggcctcgggcatctgtctgcaggtctgcagagggcctgcagcaggtgggcagggcaggcatcgctctccacacaagctctgccaaggcccctgtggactccccagccaaggccaggtcagggtgctgcctttttggggtcatttacttgtgtgctctgaagatggcgattggactgaaactggggcttgggccagccttcctgtcctctgaggaagacaggcgccttccccaccatacaccatgcccccagtcactgtggtggcccccttggccccgttggcttgtgcccactcagggacaggcttctgaggttcttgtcccgtggtctttggcagacgtctgtcccatgacagccccatgttaagctcttggtggctgcaggatcatctgccatgagagtcccatcagctctggtccctgcagtgcaactccgctcacctgtgagactgtgagaggaccccgctgagagacacgggaagagaccacctgggtgcagcacatcccactgagagacacgggaatagaccacctgtctgcggcacatcctactgagagacacgagaagagaccacctgggtggaccacatcccactgagagatgcgggaagaggccacctgggtgcagcacatcccactgagagatgtgggaagagaccacctggatgtaacacatcccactgagagacacgggaatagaccacctgggtgcggcacatcccaccgagagacacgggaatagaccacctgggtgtaagacatcccaccaagagacacgagaatagaccggctgtgcgcagcacatccaactgagagacgtgggaagagaacacctgggtggagtacatcccaccgagagatgcaggaagaggtcacctctgtgcagcacatcccaccgagagacacgggaatagaccacctatgtacagcacatcctactgagagacgtgggatgagaacatctgggtgcagcacatcccaccgagaga

SEQ ID NO: 45730 - DNA, 1126 bp, Homo sapiens
tttaaaactgataatcatgtttttccctttgaaatgaaaagataatggcaaactatagttataaaacaattgcttaaaaagaaaaaatttctcagtgaggcagaatgtggagaaaaatatggtctcaagtcttccttttcagggacacactgcacgtgggcttccccctctccttcaggaccagggaattgtcacctgatcagctcacaggttaaaaatgacctaagagtttttaagcagtcacatgctaggctctaaaatggacattcacgtatgttaatgagcaccagaaataccttgttcatgaccctctcctggaagcagggctggcaggctgtgaattcagtgtcgaggttcttaggagcagacctgacggtcagctgcctgcaaagctgtgcctgccttcttggtggggggcttcttgctactgcaggttttctccttgttttaaaccacaacacactcttctcttacattccttcaaatgtttgcactcttctaagcctggaataaatgctcttctctatgcaagaaattattatagcatctgtaatgtacctaatcaacttaaaaaaaaaacctttctccattcaccaaattaaagtgaatgaaagctgttaattgttttagtcattcactaatcaccttccctcgaaacagcctttttttcctattggatatgtgacagaatggtcaagtaaatttacgttgtttaaggacattgtggttggaaggatagattaataaatcccaaaagtttataaaatgtaggtgggaaagaaaatattagttttctgtgtgtcttcctcaagatcacctgaagagcccatcggctgagtggcacttaggctctgagaggcactgaagggaggatttagctggaataaaacttcccagcatttgtgacctgatggagcaggaaactggagtgtgtgtcttcttcagagcatttcccttctgcgtggcttgcaacgagtgaagttaggggaaggtgccgcaggaggaggggatggagcttggcgtgtccccttgcagggatgtctgttttcccaaggtccagctcagggtcatggggtggttgcaggtgggggttgggcgctgttgttgatggtgggagaggaggcag

SEQ ID NO: 45731 - DNA, 1046 bp, Homo sapiens
cggtggcaggaagcatccgcataccaaatagcagttgacgctgggtgctggcgctcacctctgccaatccctcacctctgcttcacacctgtcagtcttgtgtgtgcaggaactcaagaaacttctatgaattgggagcagctgtgtatacaaaaaatctgtcatagagtctgaacaattgaattccaaatctgatctaatcctcatgagttaagaaaaagtcagtcgggcggggtggctcacgcctgtgattccagcactttgagaggccgaggtgtgtggatcatttgaggtcaggagtttgacatcaccctgaccaacatggtgaaaccctgtctctactaaaaatataaaaattagccaggtgtggtggagggaccctgtaatcccagctactcaggaggctgaggtaggagaatcgcttgaacctgggaggtggagggtgcagtgagctgagattgcaccactgcactcttgcctggactgcagggccttgttttttttcaaaaaaaaaaaaaaaaaaaaaaaaaaaaaaaaaaaaaaaaaaaaaaaaaaaaaaaaaagccacttgatctgagccctagtttacatataaattcttactcctgtgtttgcttggatgatcaaacaacaataagaaatgccaacatacgtggattactttttctgtgctggtccctgggaagatcgctaatactttcagtcctgtcaataatcctgtaaggtggacacagttaccatcccgcttcacagataaggtcatggaaaaacataggcaaagaatgtatacaagatcccacagacagtaaatagcagaggcttcaaatgtagataattgcgggctcccaaacccacactctaaaccactgcagtataatagcctctcattacaaatgaaataatgtagttgaaagtattttgcaaactataaaatgtcagccacatacatcacgatggtaccttatttctattttatacttcatagcgtgttgctgaacacagggacagtacagaatgaagcttggcgattagatacgtattgttca

SEQ ID NO: 45732 - DNA, 1028 bp, Homo sapiens
cataccatggctgaacatggaggtgggaagagatgcacagtagcgtaccgtgacatggtatttccactgtgcagacccagtgcatgcaaataacctcaagaagagatagtagtaaaatagttacacatatttgaatattatttgtttaaatgtttgtaattataagcttatataatgtaattcttaataatggctcacagaactcctgaaaatttattgcctcttgtgaggcaatactcacaggctctagcactgccctgggttatcagtaatgaacctacactacatttagcctattatttcagttagctgcattaggggcttaaaacaacaacttatggtttctcaagattctgtgatttgactgggctcagctggatggtcgttctgctggacatggtgccagtgggagtcacaacgctgttgccttcatctggaagctcagctgggactgggacacccacctggcttcacacagacatctgcacttcagctgggggctggctgagtctcttccctccagcaggacagccaaacttcttacctgatgactctaggcttcaagtgagggagtgtggaagctgtgaggtctctcaggagctggtcctgtaaaaggcatgtgtgcactgcatcatatcctataggttggagcaagtctcagggccaaccagatacaaatgaaagggaaatagattccacctcttgatggggagagtggcaagtgtgtgcagcaattagaggaattgttggcagtcatctttgaagacaacctaccacccttatctatgtagtttatcttctgtcttccacattagcatataaaccacatgagggcaaggagttttatctgttttgttcactgctgtgtccctgacacccaggactgtgcttggcacacagaagacactaagtataatattagatgaatatatcagtgtcaaactattttcttaattctctggtttcttctagttcttgcccatatatatgtatatagttggataattgctccagataattgcttttaa

SEQ ID NO: 45733 - DNA, 1037 bp, Homo sapiens
aagcagtcctcctgcctcaccctcccaaagtgctaggattataggcatgagccaccacacccagcctcttctttttaaatagaaaccctattttattctgaaagcgggttgctttcttttttttttttttttttttttagaaaaaattggcccagccccagggaataaattgtgacttgtctaaacagggttggcaaactatagaccaagggccaaatctggccctctgactgtttgtataaattaagttttactggaataaaaccaggtccattcatttatgccttgtctacatatgttttaaactacgatggcaccactgcgtcactgcaacagaggttattcagaccaaaagcctaaaatattaccgtttgcttctttatggaaaaagttagccattccctagtctaaggtttagattctgagcttatcattttagcctacccccacataccagtgagtggctcaaaacaagtctatgattccattgtgactgttctactgagggaaatcccccttcttctcatgcagagctgatgagggaaagttgtattaataggacatatgctcaggttttctgaaaaatactattatctagaaatgcataggaatatgctggtgcctgaatgtaccatctgggggcctggagactgactcacactgcctccagagctggcgctcacacttactactgagaggcctgaggaaacacctgcctacccaccaccagaacctgcacacgtcacctggagaactagagatcagcctgccacacacacaacccaggagcccagtggcgcacccgcccacctggcccagtgctgccactgccagcaaccaaagaagccacctggaggcccagggattggcccatgcagacaggctatcatcagtgcccacatacactgcacatggtcactagtattgacacacctgttctaccaccactaccactgatgctgaaggacaagacttccaggcatccccatcctcagcaaagcctcaccacagcctccaataacaactgcagtctggct

SEQ ID NO: 45734 - DNA, 1001 bp, Homo sapiens
cccctagggatgggtttgggggtttttgagatatggaagaggcttaaagtcaattgttatggcaaatatggtttggaatttatttgcgatgcttaaaaatattgctgaacagaagtgaagtctttcctagagttggacggtgagattatttagtggaactacgagatccctgttgtgattctttccagtatcattcagcagcccttggtcagttgcgaggcaagtcatcaatggggtatggagattttccaggtgggtgtggttgaaggcagggaagaacgcgtttaggagcacattacaagaggaaggtatctgttaagtccaggctgagcaggaatgtatagcaagaaggaaacatgaggttgtgaagagaagtttagagggatgaggagtcaggagaggtgaacagttgcaggacgtagctagagtggcgatgttagatcttggggccagagagctttacaatgagtatgaagatcaaagggcattagaatcaagctataaagagccactgtttgatgttggtatgtaagtatgctgcaggtggatgtctgcacattgatggtgagaacgtggtcaccctggccctgctgggtctttgctaaagagactctgctctgttcttggggccgttttcatcacctgataagagcagtggttcccaaattgtgttctttggaccatctgtataaaatattcataggtcaaggataaaatggaaaaacagagaaaatgtcacagaaatgtgcccattggtgaaagaccaccagctgtcctttttggaggatttttctttattctaaaaatgtatatattctattctattaaaacatttttgtatttgcatttttttctcttttatgaaatgccatggggtagaaatttgtaatgtatccaattctcctgtctccatgcattgcagtgtggtgggggaagggatgtggctagtactggccaagaggctgggggcagaagtgcagtgttagacttctagcccgaag

SEQ ID NO: 45735 - DNA, 1214 bp, Homo sapiens
caggagaatcacttgaacccgggaggcggaagttgcagtgagctgagattgcaccactggaggccagcctgggtggaaagaacgagactctggaaaaaaaaaataaagtctgtcactgtggtctcataataaaaggacactccatttcctatctggcccctgctccttaatgttagcctcctcctgtggggaggagggggtgactttcagcgcaggttcaaacattcccagggctggctctgatctcactaaagcccatcgtcatgaatgaatgcttcccttgcaggttattctaagtattgtaaagagtgcacgtggagtgtcctcatgatgcctggaatggtagtgaatatttataggtttcttttagtgccttttttttttagtgttttctatacttccatgtttctacaacccttaggaacatcagaatcatgtgtgtgtgggtgcttattaaataaaccagttcctgaagctcactcccagtgactgccagcctgatgattagggtctcagctaggacctaggtttgcaaaatctcccagctgatcccatgcagacagcctggctctggctctggcgctgggagctgggttgggaactagtctttggtgctattctgctgatacttcaagttgggctctttgactctgtcttgtattgtcatcacttgtattcaggtctgttcttcccctggattgtaaactccttgatgtctgggtcatctcagctcatgagctgagctttcagtgggtgctcagtggaacaggtgctgaatggagtccggctctagggaggccagcgtgtgttggtaagtgagagacaaaaatcattttaaaaagaaactttttgcccttcagttgtgtttgccatgagttaatgtgatttactctagtggaagccagtgcagcttaagtggaggtcttgccctgaaatggagccaggttatggatcagcagagctgccaaaagcgttttgggggaaatgtttctgtgtcaccctcagttgattgaactcaagttttcactcccgtttaacaccacgtgggggccattctgacttcttcagagtgggtatgatcagatcttctgtaaaagtgtacatgagggggctgggcacggtggctcacacctgtaatcttagcactagggaggctgaggtaggtggatcacttgaggctgagagtttgagaaaagcctggactgcatgatgaa

SEQ ID NO: 45736 - DNA, 1038 bp, Homo sapiens
acagtctggggtccgttccacagtggacacaaagaggctactttccagtccttgatccacactcgatcacctggggagaaagggtgaactggggagaataaactaacagggcatctctcatttacccaggctgagattgtctgtgtaatttttcctaaagcctgtagctgtcgctgtaactcaatttcacctaactctcagggagtgcctggaagtccccgcaatataggagggggcctatgatataatatttcataaggggaatatcctgttcttttagaagtggtacatctaattttaaataataccatagggagagcctgtatccattttaatcctgtttcctgacatactttccctaaactatttttgatagttcaattcattcgctccacctttccagaactctgaggccaggaggcagcatgcagtttccgtgtgatccccaatacctttgccgccttctgtactaagtcagccacaaacgccggcccattatctgaactgatccataagggcagtccaaatctaggaataagatctcgaagaagcacatgagttacttcatgagctttctcagttcgtgttggataagcttccacctacccagggtaggtacgcccaagaactagtaaatacttgttacctctacactttggcatctctgtgaagtccatctggagctcttcaaagggggctgttccataagtttgtatgccgggtggaacggctggaccctgcctcgcattatgctgtcggcaggtaacacaccactgcgtcaacgtttcggcaagggctgacaaatgcgagatgtagaaataccagcctaacaacttttcaagtgattcctaacctagatgggtggtttcacgcacagccagtacaactgcagctcctagcagctgtggcacagctactctcccatccggtaaccgaattcatccttcctccatcacttgtcctctctctgcctggagaaagtccttttcttctttagaataagtaggtaccagatcaggtgcttgagggagcaggggg

SEQ ID NO: 45737 - DNA, 1059 bp, Homo sapiens
tggtttggatctgtgtccccacctaaatctcatgttgaattataatcccgaatattggagatggggtctggtgggaggtgattcgaccatgggagcgaatttccccctttggtgctgttctcatgatagggttctcatgagatatggttgttcaaaagagtgtgtggcacctccctcactctcttcctcctactcttgccatgtgaagtgctgactccccatttgccttctgccatgtttttaaatttcatgaggcctacccagaagcccaccatacgccaacatcttgcttcctgcacagcctgtggaaccatgaggcaattaaacctcttttctttatacattacccagtcccaggtatttctttatagcaatagagaactaactaatacactcagtatactggagactgcagaagtcctctgtttgcctgtttatccatccattgatctattcatccatccatccatgcacccatccatccatccatccatccatccatccatccatccatccatccatttaacgagcactttctatgtacatggtgctgttttgagcagtttataaataataactcattgaatctttctaataactgcatgaggtatgtattgtcattatccacattttatagatgggaagctgaaacagagagagattaagggccttttccaaaacacacagccagtaagcattgagtcaggacccgaacccaggccgtgaagcaccagtgttcatgctcttaaccaccacatcattggccatccttggtgactctgaaatccgtctaggaagttattcaactgctagcatcattgttcttcccagtagctcctgagggccctgggatactgtgcttgcctataggcaaggcagctggtaggagaggcccttttgtggaatgcagttactctcttgttagttcccactttttctcttttcatctccttttcttcccatctgctcctcttgtgtgaacagatgtgagtttcctccttgactttccaggccatgagttggaacacgttgttcttaggtgatcattttagagatgaa

SEQ ID NO: 45738 - DNA, 1025 bp, Homo sapiens
taacacttttagtctgctgtgtttccagatcatttatatagggctttgttgaatggttgctgtggtctgcttgagtcccatctgccccaaatcctaattatgaacacctccttggcagcccttgcttcggtgggctctggggactctggctcagtcgttgatatctagataaagatccctggagtcagtctgttaaaaggaaggtgagcagagcagtgacagatgctgtctttgtctagtgtgggccttcctgccataaccatgaaaattttctccacggtgacgcagaggaggatttaggcgctggagccggcgcccaggcagttctgctgttcttggttgcacatttgttctcacatccttcgttgcttcacctctgcccttctccccctgcccccatccccgggcagtgctgtctttgtaaaatgagcccatttttagtgcacatctccctaacacgtttttctctctcctcctacaggggagttgctgagtcagcccagaccggaaggagtggcagagatcatttgccccaagaacggcagcgagcgagtaaatgttgccttggtttacccacccacgccgactgtgatcagcccctgttccaagtgagttctcaaagtccctctggccccgggacctggctcctgatcccagctccatagatatgaccacaaaaatccaggttaaactgcatctgcacaaaccttgcaaagtcctcctgaacagacataattcttctggatgacatcagcatcatgatttatgcagcaaaacaggaacttttatttcctcttttttgtgatttttttttttttttttactttagctaataaagtcagaacattttttaacagcctttttgagatgtcattcacataccacagttcacttacctaagtgtacagttcattggttttcagtttatttgcaggtatatggaaccaaaaagaacattttttttgttgttgttttttgagatggagtctcgctctgtcacccaggctggagtgcagtggtgcgat

SEQ ID NO: 45739 - DNA, 1079 bp, Homo sapiens
tttctttgaagggctagatagtaattatttctcgcttcgcaggctatagcctgtgtggcaaccacctacctgtgccactgtagtagcatcggttagcagaattgcactaccttggaaagcagtcgtagataatatgtaaatgactggctgtggttaagttccaataaaactttatttacaagaacaggcagcgggccatgttttgccaacttttgttctaaataatcacaagaggccatgaaaagtttaatttccatacatgagaactgggtctgaatattgactcttctacgtagtataatgggtgtcccaaatactcttacccagtaaaggatcttttaaaattttaagttgaaaccatattcagtggcaggaatcctgaggaagtgagagagaaaagctttataaatattaataagtgctgaaaattaagttgttgaaaaaattgttcacataaaagatcattatatagcaagtttggaatttagtttcaattttcatttccttgtagaaacatcttcatcgtgaggaaaatgagggaattaatgaacatttgtttcctgagtgtgagctgtgataccttgtagtcactgagatggcggctgcatgatgggtatctcgtaactctgctccgggatgcccaccatctagaaagatgctcaagacccgtgggacaggatagtgtttaggaatgtgtgttttaaacttttcttgcagtatttaatttctaaataaactttattaaggtataatttatatacagtaaaaatgcacctatttttttaagtgtgtgatagattctatgggttttgacatgcattcactcccaatcaagatagagagcattcactcccattaccccaaatgtaccctcactcccctaatgctcaccctcgaacaaccactcatctgctttctgtccatgggaattaggttgccctattagagagcttcctatacattcagtcatttagtatgtactttttttgtgtctggtttagaggtttgcaaacttccttggttcacagtgcctttagaatccataattttttatggtgttgaaagttaaaagggatacc

SEQ ID NO: 45740 - DNA, 1047 bp, Homo sapiens
gaagaatctttatgtgtgtgtgtatgtgtgtgcatatgtaagaagtaacatccgctggagctggtattgtgcagaaaatatgttgagaaatataaaacagatatctggcttgtgttcctctatatagtcttttttgactgagaatgctttatccttgttgttacggatattttcactttgtttatttctattttggtctgaatcatgagtgtagttgatccttgaacaacatagatttgaactgcttgggtccacctcgacgccacctgtgcatacggagggctggctcatctcatatgcaggtcccgagggccaacttcaggactttatgcatagattttggtgtgctggggatgggggccctagaacccaaccccccatatatataccgagggaggactgtctatttttgttttttacctgtgaggccatcgccacaatgaagagagtatcccccaaaaggcatatttttaatatagttgtaattatagcattgcataatcgttttcagtaacataggtctcatctgttgctctaggtcttagtaaaataaatcactcttgttgaacccttcctaggctccaaaactggatgggccatttaatataattttaaatattaaatttaaattttctttcatttattagaattttcaaagggtaataatgttatatatttagattttgatgacatggagacatctgagacttgcttagttttaaaaaagcaaaatttatgtcatacagctcttgtaaggactgaataaaataatgcatataaaaatgcctaagacaatgcttggcatgtagtgggcacttactaaacaatttccttccttcccttgctggcttcttaactactccctgccttgtataccccctgtgctccgtcccaatttctgttcagatactagacagatggctgttgctttgggataggtcaaaggctgtcaggcgtggaggcaggcaaatgacccagatcagtgaacaccagtcattgtctcagagcattttgttttgttcagctcagctatttgaatcatcttgg

SEQ ID NO: 45741 - DNA, 1031 bp, Homo sapiens
tcgggttactgctggtgggcttgcagggacattgtgagtttggagcctgtttcacccatcttaggaaggtatgggtcaggcgtgatggctcacacctgtaatcacatcactttgggaggctgaggaggtggatcacttgaggtcaggagttcgagaacaggttggccaatgcggtgaaccctcatctctactaaaaatacaaaaattagccaggtgtggtggtgtgtgcctgtaatcccagctacttgggaggctgaggcaggagaatcacttgaacccaagaggcggaggttgcagtgagctgagattgcgccgctatactccaacctgggcgacaaaacaagactccatctgggggaaaaaaaaaaaaaacaaaaaaggaagggatgtcctgccctagaccgacagcccccagcacccagcctattgcaaatggtttctttcacttttgcaaatctgaacaagcatgcttgggagaagggcgaggaggcagggaaactggagtcatgttaagactactctctggaggtttctgttgtgcgtgtgccattctgccttttgggtgatgtggcttaatgagtcaagccctgatgactgatgctgcttttcttcctcatcttcctcctcctcttcctcctattgagtgaaagtcacataatatgaaaaagccattttaaagtaaactattccctgtcatttagtacattcccagtgttgtgcacctgccacatctcagccaagcacctttggaggggtggggcagatacattggtgtcattcttcctggggccaagtgactgggaattcttttgccaggctttgtagcaactttctttccaaggtgtaacttaagagtaggggttttggggctaggcctggagatgccatgttgattggagatcttggacacggttgtggggatcctcttagtgtggatgagaggacagaaaggagggcatccaagcctcctggtctgttctagggtgtatgtgatttaatgaggggtgacatacacgagctccgtaaagaac

SEQ ID NO: 45742 - DNA, 1055 bp, Homo sapiens
aagcaacccaaatcagtagacagaatgagttatgtggctttctttagctttactgtctttcatttactcagtaacttgatgcctttttgtatctcatgccaaatgtcttctgtccctcagtttcttgcacacggagtgtacctctccgacaacacagcatatttgacttgttttgttggtgtttggttgcgtcatgatatatctttgattaggttgttcacttgctgcttctgagccagagacacacccgagacttagtagcttctgcagagcctctcagatgtttgctgaatgatagtttggtctttttgtgagaaataactttttttttgggggggtgggggcagggtctcactctgtcaccgaggttggaatgcattggggcaataatggcttactgcagcctcgacctcttgggctcaggtgatgatcctcctacttcagcctcctgagtagctgggactccagaaacaccctaccatgcctggctaatttttgtgttgttttgtagagacagggtttcgctgtgttgctcaggctggtctcaaagtctgcctgcctcagccttccaaagtgctgggattataggcttgagccaccatgccctgcctgagaactatctctttttctttgttattcacacactcagtgaaaatcccaggtagtattgtaatgattatctggctttgtttagcttcccaactccctccccctcacagtgttcctccagcattcccattgtgcgtctatgactggtcttacccttgaatgggtccttcattttgaccactgaagcaaagcaaaattcttgccttattatatctaagttttagaattactggaatttgagcatgacctagttgtttggattgaattagtcattgtttttaattttacaaaggtttttcaatatctctttggttaagctttattaatattgatgcttcttggcttttctttttatgaataggcctctgaactccctgggactttgttttatgtaaaaatcaaaaccttaatcaggcactaggataaacaaatactgtgcagaatag

SEQ ID NO: 45743 - DNA, 1069 bp, Homo sapiens
gtgtttaagtagagcatacattaaaaatagattcattgaatccctagattattaaaatatatattaattcagcagaaaccctttgaatctattggcagcctttgccttttcatgtttttttgtttgtttgtttgtttttgagatggagtcttgctctgttgcccaggctggagtgcagtggagtgatcttgactcactgcaacctctgcctcctggattcaagcgattctcctgcctcagcctcccaagtagctggaattagaggcatgcgccaccacacctggctaatttttgtatttttagtagaggcgggggtttcgccaggttggccaggctggtcttgaactcctgacctcagatgatccacccacctcagtctcgcaaagtgctgggattataagcgtgagccactaggcttggccacctttgtctttttaagaagtcattttgcttctggggacattaaaaattgtttacttttatgttttataaaagcgttaagttgtcctataaactataacaattttatatgcaacgctgaaaaagttggactttgaattttcttaactttgggatgttacagtaaaagtaaatagtaaattactgtctctcttgattttatacagaaaaaatgtataaagttgcactaatatcttttaaagtatttttatgtgaaaagcctattttggccttgtcctgttggattttctggcctgagctgccctactgtagttgaccacgggaagtataatggtaaatttctcttttcttattttggtttatacaagaaaagtaatgggcagcgtgcagtggctcagggctgtaatccctttgctttgggaggctgaggcaggaggatcacttgggtcaaggagttcgagaccagcctgagtaatgtagccagactccgtgtctacaaaaaaaaataaaaaataaaaatcagctaagcgtgcacacttgtggtcccagctagttggggggctgaggtgggacaatcacttgagcatgggagtttgaggttgcagtgaactatgattgtgccattgcactctgaccctgtctcttaaaa

SEQ ID NO: 45744 - DNA, 1132 bp, Homo sapiens
ataagaaggagctctgagaggccagggcgtctgcacatgccccgtgtcgggggcaccaggctggagtccagaggatggtgggaaaggccaccccaagcagaggggccaggagcagtgaaggccggaagtgagaggggcacagcatggctgcgtgcacagggccacacccagctgtccaggaggcaaaactggattctgcggactgagctgggggacccagggcttgtggtcagtttggacagggtggttcatgacagccctatgtgccatgtgaaagagttgacttcatcacggaacaccaggacctccaaggatagcgtacataggattatcaaattccttggggttaagaacctggtggagaggtactgaggccagacgtgagaggttggggccatcccagagggaagtcggtggccgcatggaggacagcagaggctgcccattgagggatcccagagggtgagcaggcatgaggccatcatttttgatcagcaagctggactctgggcctgtgtgtgtgcgacagtgtgtgagcttcatcagatgactcatcacaccttctctgaacttgccagaaggtgccctgctcctcctccagcctggcctggcctgacggagcatggggtggggtcacctgcatcctgcagctgtgggtggctgtgtctgcctcattggcgaaggccagcctctgagcccttctgttcagccccagcagccgtacacaaaacccagatctgaaaagagaagtctgccaggctcagtagtgtgaatgtgctcagcagccgtgcctgggtgtcctggcggcttatcatcctggccgatgccccactgtggccatgggctgtgacctgctcctaagaggtcatacaaaccaagtgtagaccttgtcctgggtcaacagggaaggagtccctgggctgaattctaactttcggcccccagacactcttggctggttctgggtttcagcaaagcttgttggaagccggcttatgagacacactttcttggcctcggaccacactccctgggcctcgggttgagaagttcctggtgactcagaaagtggagggattaagtctcagggagaagccgctggctgccgggcggacagatctgtgcctgcaag

SEQ ID NO: 45745 - DNA, 1050 bp, Homo sapiens
gctccagtaaccacattttatcttactctctatttctattccatcttatcagtgagatcatgcaatgtttttctttcctgtctggtttatttcacttaccatagtgtcatctaggttcatccatgtcgtggcaaatggctggatctcctcctttttaaaggctgagtaatattccactgtatacatacatacacaccacagtttctttatccattcacctgtggacagacacttaggatgtttccatgtcttggctattatgcaaactgctgcggtgaacatgggactgcaggcatcttcacaaggtgatttgatttgctttgggtatatttccagaagaggggttgctgggctatacagtaattgtatttttaattcctttgggaacctccacactgtttttctttgagggtatgccaatctgcattcccatcagcagtgtacagggttcctgtttctccacactcttgccaacacttattatctcttatctttttgataataactctcctaatgggtgtgggatgatatctcatgatggttctgatttacatttccttgatggttagtgatgttgagcatcttttggtcatgtgtatgtcatcttttgagaaatacctgtccagcatctttgcccattttttaatcaggttatgtattttcttgctactgagttgcttgagttctttttaagtttcagatattaactttatatcagatacatggtctacaagtatttttccctaatttgtaggttgccttttcattgtgttgattgtttcctctgctgtgcagaagctttttagtttgatgtagtcctgtttacatatttttgctttggtagcctgagcttttggtgtgatatccacattattgccaaaagcagtgtcaaggaacttttctcctgtgttttcttctgggagtttaatggttttaggtcttatgtttaggtctttaatccattttgagttgatttttgtatatgttgtaagataaggtccaatttcatttttttacatgagaaacccagtttttccagcaccatttatt

SEQ ID NO: 45746 - DNA, 1031 bp, Homo sapiens
gtttgagaacttttgttctagaggaaaaaacagcttcaaccccagcttattgttcaaactgtcccagtgggattgctataataagaactaattgtaattagtacaacaaatgtttgtataagtgagtgctatcctattgcttgaagctacctgaaagtgttttttatagtaatttaaataaacattttcctgtgccttaggagttctttgtaattcaaactgtttataattaagtcatttggataatttatcaccgaagcatgattggatggagtctaagaatcttatcttttcgtagactggttctaaagtaaagtattaaaataagattctgatgggttaacttgctacgccaatccttccatagaataatgcaagaagcagcttaaacttagcttgaagttagtaggatttccttaatagctgtaagtgtagtttagaatatctcttgatgcttatctgtctttaaattgtaatcttatataattccattggaactactttgtaacaaccagaaatttctgtttaaaacacaatcttgaactagcttaaaacgttatgggaattttctaaaaagaagtttttttccttggtaagatttaaatgatacgctctttatgtttattagggatcagagtgctggtaggtttttctgtttctgaaggttctgttaattcttttctgaagccacctgagcctctaggaagttcactcagagtttgcatgtcttcgaacagcgggcagtctctgccaaagagcacgaggctgaaatgctttagtctttgatttgtcatctgttgttctttgacaagtttatcttttctgcatcaaaaaggcttgctttaagcaaagtactagcattaatgacatccccccttcagtcacctctgtcccctaactttagtccaggctcctttaattcacgttctgactcttaaaatcacatggaggttttaaattttacctgactggttttgaagcattttgtgggcctgaactccaaatagctttttaacaagtgcttaaactta

SEQ ID NO: 45747 - DNA, 1020 bp, Homo sapiens
tttcctcatctccatcctgcctctcactgcgctctgcgttggtctgaatttgctgattactgtctgctgcctggcatgctgtcctttcaacagtgtgtgtcttcctcttctgcccatatgacagaggccatggctttgtactttcataggccctggctcagggtcgttagtagttgctcactaggtaactaggtaactatatgagttcgttggtatagttaaaatgatagctaatttgaacttctttaatactcatgggaatcaagggtagttttacattgcaggttgatttccttgcttcttaattgatagccctatgaaagaattaagtttctccttcctactaaaatccagacacattatccactatactaagagttatacaaaattcactttcatagtaaatctgttttcaacagaaaaagagtatttttcagtctaataaagaacctactatttatggttcagccttagtaccacggaagtagaacaagcagaccttgtgtgctcctgacataatgcagtataaatctgaactcttcctgccaaaaagctgaacctaaatctaatcaaatctctagaagtatttttcattcacagaaaatataagttatagagatgcaatcttagaaggaaacaaacaaaaatccagaatgtgggacagagctcgaaacaattgacccaatttctacaataagtcagtggaatgaaaaaaatatgggattgtgggaaagaatagggtgtggtaactagaaaaaccctaaaagatacaagtatcatgcgctagtgtaggctttatttaagagctgatttgaaccataaaaagacgtccatgagctggtgaggaaactgatgatagatcgcattagatgccaagaaattattgtctgtttgattagatgtgctaatggcactgtgattgtgtaaggaaatttccgtactttttagtggtttttactgcagcattcaggatgaaatgacttgatgtctgggattcaccttaaaatatttcagcaaaga

SEQ ID NO: 45748 - DNA, 1071 bp, Homo sapiens
aaaaaagaagacttggtttattgattcctggcatttttccagactgacagaaatctttatttctagggtggtggtttgtttcttaatagtaataatttttagggagtccagaattaccagtggttagaagtctcattagatgattccctgtgcagattgggactgaattcctgggtcttttagcccctgtctgcccctgcaccctcagcagatggaagcagcaggctgggaaaggatacctggctttggtgcctgcgcggactatgctgagtcacgggataggcagtggtcactagggaggagccgctctgacatccggccgtgccggctgctccttcacaaggggctgctggaaagagccatggtcagacaggctggcttctggttgtacctctgccctcagtgctcaccgtgagacctggactacgccactcttccttgttcaccaaggacatggcctctggcttatcccagcctcctctccaacccctcttccttgactctctcagtcgtctccgtgtcctcaggaagaactagaattccagtcccgcgcctcttgaactccatctcctttgctctgcccaacagctgcccccaccccacgatcacaccctgagcctttgtatcaactccacgtccctcccataccttgagataacccccatctccccagccccgtggggctcacgtgccttctgtactggcgtttccacatccctgcacgttgatcctctcttctgcctgctgctcacccaccacccccagcctttgccctcccggacaccctctatgaaaatgtacagttgaacagatcagggagggaaatgttacttgtgggcttttgtagaactttaagagaatttatgtgtttggtgcagaaagctcttagttgtaagagatcagaggtttctgatcctctggcagatttctgtttgagaatttattgggtgttgggtgccttgaggttttcaacactgtgtggtgttacttgactctttggtagctaagtcatgttaaagtgagacatccacctgtgtttgaggagcttcaaaagcagttccctaatgctag

SEQ ID NO: 45749 - DNA, 1053 bp, Homo sapiens
gcagaagtgggctgtggatcctcagaacactgcctggagtaatgacgattccaagtttggccagcggatgctagagaagatggggtggtctaaaggaaaggtattttggagaaaagcggaaaaaaatctgagctatgaaaagagattagaaattaggggaaaacttccttcttaggagactggaagaaacttatgctttggatcagtaagtgattttgatcccaaatcaaaaattgttgtgaccttatgatgataaattaggattggacataagtgtcaactttctatcatttaagctgccatgcttagcatctttcatagacattgcaactaggctacacgctttttccctttccatttattcttgactccagtagagcctctgctgatacctctacacttaaatggttcttgttgaggtctttagcgatctctaagtgccaaatcagtgggccgcttgttttgttctcacattacttaactcctcagcagtgctggatgtaattgactactctctccttgaaatacttctgtcttggcctccacagtgctattgtctcttctgctcttcttttcacctcacttgccactcctaaatttgttgctgtctcttctttctatagacttttgattattagggctccttgaggctcaacctcaggccccttttttgcactttgctgcagtgatctcattcattcccttgccacactttgaattagctaaagtctgggaactgtcatttttctatattgagtccagttctgtcctctgagctctagatttgtaaattcaatagcctacttgatatttccacttgagtaagcatttcaagggtatcatttctattataaaactcttgattcccccaaatatatttttcccaggttttccccatttttcatacatggcaccgtctgccacttacacaagccagaaacctgacagtcatgcttgattcctccgccctcttgcctcccgcagcccagtcgtcgtttttctccagcctcccgcagccccagtcgtcattcttctccagcctcccgcacccca

SEQ ID NO: 45750 - DNA, 1085 bp, Homo sapiens
atgattatggtcaatgtgaacatcccaacccagccccgtgttagccaagggaagagggtttggatttaggatgtgaaatgagctaatgtctcattaacctatatttttgaggggtaaggaagaacaatgaaaataaggaacagcagaatctaaacctataaactgcccttactaaatctcctgtgagaacagcttttttctaaaaaatctcagtggtccatccatccacccagtgaccctacctgttgttcagccatcccaactttcctggacgtcttccattccagaggcatctgatttctccaggaagtcccttttagcagagcccgtttcaggaaaccgtcaactttttaatccaagcaggtgttcataatgtttgttatgaattccttttattgtacctctctctgcttttatctcaattgagccaccagaagccaaagcgtgttttcctcatgcgaaatagtagaccaggaacgtcttgcggtgtcattcttctaaaaaatggctgttggcctcctgacctcaccttcccctttatacgagcctggaggcacctggcttagctggtgcgttttcctttgggaggactctttgaggtttgtcccccaaagcttacaaagatatagtctagaatgtgtttttatttgaatttttgtggttttatttgaattttcaaaataaactctgtaatttgctactgaggcccttgattctttgttatccctgagaagggcccagtgagtccctactcctttccccagcttccagttcctaacagtctctttctaattaaatagatcctttttttattccaattagattatggtgctgtttctcaaagagaccaagtccctgagttgaagatctttaaagggctttattcctttaaaaaggtgccattccagccctttccagctctcacctccccactcccttataagtgacaccgcctttccccaccaggccctgactcaggctccagagaagactgaccatgaccctgtgccacgccaggggcccaggcaggacctttagtgacctttcctggaggtgggtactctgtgaagaggtgagcagctata

SEQ ID NO: 45751 - DNA, 1033 bp, Homo sapiens
atccctagtgatcctgctcctcttccaggtggactccacctcatccccctcctcatggctcacaaacaccagggagctcacagtgcctggtgtggaatgtttgggactaaatccaggaagcctgagcattgttgtttgcattcagttggcccaagaaactaggataagagtggggaaaattcagggacgattaatgaaatacagcgtcacatggaaaatgatgcctgctttccagaggtcaccctgagccctaccccttcagttatgttctggaggagatccgtggaactggagccctcccaggtgcactttgagttgtctgtttgggttgtcctgagaactttagtgtctcctatctgtcttgttttgtttttgttctccatgaccttgagagatgactttcagataaatggattattttcctaaggatataggggggatgagaagtcggagttagaacaaattaagaaatttaagcttcacggggtcagttctgaggcagtttttgcagacagtgactgtgactcagcagcgagaaggagcagtcccggaaggaccctgtgctgggctagggagaaggcaggctgaggttgggggtgaccatgccagggcctgggaactggcatctgctcctgtcctcactgctcttgggctggccgtcgccttccatgagccccaatgtcccaatctctaaaatgcaggcataaacttggtaacctctgtgattgatccaagccagaaaggtatgaaaaaagtgagccaggcaaatacatttgataaagtgtcttgaatgatgaatagataccttcagatttgggaacagaaaccactctaggaccctaagtcaacaaatgcaaataccaacatcaaactagcaggctgaagacggtgattttcacttccatgtgaaccggttaaaaacaatagaaatgagagaagaggccgggtgcagtggctcacgcctgtaatcccagcactttgggatgccaaggcgggaggatcacctgaggtcagaagtttgagaccagcctgg

SEQ ID NO: 45752 - DNA, 1050 bp, Homo sapiens
gggcccggatgaacccccaagcagtcggggtcggaaggcactcagggtgttccagccagaggcgattggcactcgcaacagaaatatttaacaacaggtccgagatactgatgcattcaactgaatgtcacttctggggctagggtccagtgggattgatcggaggtggagggaaagagctgtggcaaggagatgagactaaaaaatccatttttggaaatcaacaataaatttgaccccaagaaaaatttcctttattgtatatgacacctactgcaacaagcaacacacattatctgaatgggtgagttcctcattcccacagtgggctccatggtggcccaagatctgagcaagaggacgaggtggtgggtggccagcgtcccctgcctcctttgtgtgcagagcccacatccgtcctctctttgggactttagtgtccccattggcaagaggggatatttccatggtcctgagaaaatggtacaaaaagtgaaggtagttaggaccgctgggcagggccaaaccactgattggcctcaggtaagttgctcaacttctctgggcctaagtttcttcccctagaggaagggttggtctcctttagttttcatgttctgtgatccctctggaatattgatccctactcaactccaaagtgtatggaggctgctcgtaattttatttttttatttcaaattaaattaaattaaattaaattaattaattacttttcgagatggagtctcgctctgtcacccaggctggagtgcagtggtgcgatcttggctcactgcaagctccgcctcctgggttcacgccattctcctgcctcagcctcccgagtagccgggactacaggtgcccgccaccacacctggctaattttttgtatttttagtagaggtggagtttcgccgtgttagccaggatgatcttgatctcctgacctcgtgatccgcccacctcggcctcccaaagtgctgggattacaggcgtgagccaccgtgcccggcgctgcttgtaattttaaaacacacaagaacagga

SEQ ID NO: 45753 - DNA, 1045 bp, Homo sapiens
gggacctacattttgttagcaaattgcctttcctttcccccagggaagactttgagctgagactaaacctgggaaggtgctgctgaaaagctgttgggggaacctgcctgcacctcctggcctccaggagggaacccataggaaaggggaggctccaaccttactggaagtgtttgcagggcctgttgtgtaattagtgtccttggggagcccgcagggggttttcctgcctttacggaaggatcattcacaggccagcacaggttaatagttttcctttagaaactttccttttgtggttggtcctgtgcctgcttttgaaaatctggtcatttttaaaacagtttttccagaaggggcgctaagggccgctacactcctttggagtcttttcttcctcacacttaataaagattgagattacatagggaggatgaatgcttaggggctctgaaaatatggattatgcaaatgagctatttaaggacctttaaaaatgctgacccggtaccagagtatttactggctgttaaaaaatgtggattgtctaaatgggcatttggggacctttaaacacagattatgatggatctagagagcctaacaaatcccttctggcccgttaggcctgtctgccgtgcgagtaaaggcacgtttggacaaagctgactttttaacgcagtgactgggaatggatttgggtctgtcctgcgggcctggatgttggtggcttcacagggaccctcccatgaggggctccggtacaggtgggctggaaggcagggccgtggtcaggatgactcaagaggtcccaggacttcacacagcaaattccttctgtgtaaggaaccctgctgaagtaggttttgacttttgtttaattcattctgccaaacatgggtggggaattggtataaacatgaaggtgctggtttccaaaccagctaggggaggccctcccatccccgctaattctaggagcactcaattaatggatggggacattcccaccagcaacacagatccggggccagatctaggcact

SEQ ID NO: 45754 - DNA, 1029 bp, Homo sapiens
tgggaggagctatgaatattcatgaagggggaatgcatgcacgcatagtaagcaaacatgcactttatgttccatgttcatttttggttggagacttaacatttaaatgcattacagttaggttctgtacgttaaaaggtgaggcaaggacatgaaggccctcagtgctcagcctctgtaaaccagccagaaccagtccacggtcagtggtcttatcaggagaaagttactgaaatcagtctcttgtccaatcaaagctgtagttacagctggtggaacaggggttcggttagtcactgtctggtggagctgcaagtggtttactattgcttatcttgaggcaagtgttgtttagctgctggagaaaaagaagaaccctgtgacagttagagcttagttgattctttaagtgtaggtgtgcctgacttcaccattgcctgcacggccttaggtcctgtttataattgggtatcttatcaccacagagtctgttctgtcagtcttatgatctctgctttggcattaatgctggtcagttgtttctagtgtttaaatgaaaacgggagtatgtataatgaggtgcatccaacctcctgtcctgtcatgggcgggaacttagtttttaagatttctctggggttcccttggccaagaggtgggtgggaccattcagtggtttgggaggcttaggattttatttttagttctcaggtgggaacaccttttcattcagtagagatttcctggactgactctgcccaggggaagtgcaagacccagtgcctgccctccaggggctctgcagctgctggggcagagactgaggctcaggggacgtaaaacaaactcctcaaggtcaaacgtgaaggagggacttccagagagtcctgggtaggtaaaggaggaagaggtcagggtcggctccctgaaggagcaggaagaggaggctgggtggcccaggaggagatggacgatttcctagacttgcagccatccagccgcttagctccaagcatgtgagctgagttc

SEQ ID NO: 45755 - DNA, 1031 bp, Homo sapiens
gctgttctagggacctcacagatgtggaatcatgtggaatttgtctttttgtgactggtttctttttcatggaaaatgggccaatgacatatttgaaatgtagtttatatttgcattaaagcagtaaatgtacacagtagtggaatcaccatcctactcgtgaagcccatgaaagccacatggtatccctgatgaaaaattgaaaaataaaatattcttaacatatcttttgtgttacaactggtttcatgaactctgcttcccctcccagctttattgaggtgtagttgacaaaaggaaactatgtattaatggtgtactgtgtgatgttttgatacactgtgtatacattgtgaaatgattcccgcaagtaagctaattagtgtagcttcccctcgcatagttatttttttcttgctgtgagaatatttaagatctattctcttagtaaatttcaggtagacaatatgttattaactatagtcaccatgctgtgcgttagagctccagaactctttcatcctgccgaattgaaactttgtgccctttgaccaacacccgccccccatttcccttctccccagcccctggcactcaccgtcctcctctctgcttctatgagtttgagttgtttagattccacacataagcgagatcatgtagtatttgtctttctgtgcctggtttatttcacttagcataatgtcctccaggttcatccatgttgttgcaaatcacaggatttaaatatcttttaaggatgaataagactctattaaacatttatctatgtatctatatctttatctgtctcagattttctttgtctattcatccatggatggccacttaagttgattccttatcttggctattgtgaataagcggctggcttatttcacttagcactacatcttcaaggtttatcatgttgtagcatgtgtcagaatttccttattttttataactgaaaaatattctgctgtatgtaataaccacattttctctatccattcatccaccggtgaaca

SEQ ID NO: 45756 - DNA, 1070 bp, Homo sapiens
ccccactgaaggagtcaggaagagcattgtggaggaggtgaggtttgacaggtgggcattgaaggtgaggacaggaacagatggtgacgtcagaccaagcttggacacagtcgccaatggagcctgggtccttccttcattccacccaacacagggactcctgctgaacaaaactacacccgcccagcctctgtgaccgtgggaactcatgggaatgcctcacatgtgtgaaatgagggcaaaacacttacctcagcgtgttgtcgtgaggatgagccacgacgatgcacttgacaagggcagaacactgggactactggacaaatgtcacttctcgtccatttgttcattcattcattcgaaaggtggtttttgagcctctcctttgtgtcaggccctgtttgtttcaaagcagtgaacaaaacagacaaaaagccctctcatgcaagcttacattctagtgggggagggagacagagaataccagaaataaataaggtatctagtgagttagacagtgacaagtgtgacaaagacacataaagcaggcagtgtggagtaggggggctccttatagagtaattgatgttattccttattctttagtttgggtgacaaataggatccatgaagagagggagagtcataggaaaatgttttgtgcttcgattgggtcggggcatcaagaacggcttttgagtaaggatgtgatttgggctgtgcttcaagatggtgacatggctgcaccttgtacgcagattggacaggcagccaaggacaaggcgtcagacgtgggctggtgggcaccaacgtgggggtagaatccaccttgcctgtgggtttcttagcctggactgggagaagtgagactagagacctgaagggtgagactagaggcctgaaaggggccaagagagctgcatcctcccagctgatcccctggctggagcctgagcagacgggaggagcaggaaggcagatgcacccaagactgcaagacatggaaaagggctcaggctccctctcccattgaagaaaaggtagtggggtcacacagggtatgagcaccc

SEQ ID NO: 45757 - DNA, 1028 bp, Homo sapiens
caacctgtgattgaactacgtgcagtgcaggtatcaggatttagtgacatcttttaattctctattattgatgaaaagttttggtctggaaaggaaaactggctttgggattgattttcatcagtttaattcatcttcagtattgatcagtgcatatgttacagcgaaagactaaatctgggctgtttcaaaggaacagggaatgttattaccagagtgtccaggtttggggcattgtcccaggactgttgacaccttaggcatgtctcactctgccttgtatgccagtccttcatatacaggtcttcttctcctccaaagactgtgaggtctttggaggcaggatgcatctctgaaataaactgacccccaaagacccaatgtagttcctagcacataggtgaccctctgccagtgtttgcttaagtgcggtctccagagttcatcaaagcccttaattattatgcatcaggagggatcccaatactcaactcataaaaggacacatggattccacagggactcggattttgggaaaggtgacgatatcaatcagacaagctaatgaatgattgcctttctcaggaaaagatagacaggaccctaagtctgaaatgtgctaatcacagggtcctttagcatgtgggggcaactttttgtttgtttttgagatggagtctcgctctgtcgctgaggctggagtacagaggcgcgatcttggctcactgcaccctccgcctcccaggttgaagcaattctcctgcctcagcctcattagtagctgggattacaggcacccgccaccacgcccggctaatttttgtatttttagtagagatggggtttcaccatgttggccaggctggtctcaaacccctgacctcaagtgatccacccgccttggtctccaaagtgctgggattataggcttgagctaccttgcctggcctagcatgtgggggcaactttggcaggcagcctcaggcacagttcagacactctggccacacctgttttgccctctgacc

SEQ ID NO: 45758 - DNA, 1072 bp, Homo sapiens
cacagcagtcatctgggaagttggtggaaatgcagattcctgggtcccacctgcagacattctgacccagtagattttcagcattctcagactccctgagtgacgcaaggtagggcatctgcaggcccttgctccggcggcagtggcttcgagctggggtatgaggaggaaggggagagactggtggaaccagaccgttgctgtcccagggccatgctgacggtctgaaattggactcttcagaggagaggcctgtgggaggcctgcccgatgctgaccaaggcagggcagaagggaagcctcatgggagaccatcctatggcgggcattctttcctgggcaccccagtgaataatctcccgctctggccccctcctcgtccagcagtgcccactccccattctcctgcctctggccaagatcacttaggagattggtatgaggattaatgcagcccacgcatgcacaagcacagacatgcacacacacacacatgcacatacatacacacacacacacacacctctttcacctctgacaagcatacacttggcactctccgtgggctaggtcccctgcaggaggatgtgggcttcttgagagcagcaaccgcaccccatggcatgtggcaaccagagcaggcactccaaggaccctgtgagtgagagcacgtgcttcgcctgttgccacagttagagagacaatgaggctcccacctagcatgggggccgcagaggaggatctgagagggtgatgggaggaagtctgtgtgatgcccacagagatctgtgccaactgctcttgggtgacaagaaggggaggtagtgcctgggaggccagggagtgctgcagaggagaccctggaaggaggaggcggaggaggaagccaaggggacgaaggaaggctggcaaaggctggatggagggatgagctggggggtgggaaactgcaggtgcacctggatgcaggtggttgcggggcatttaccctggggatggtggtgcaccttggatgctgttcttcagcagatttctttttgtaggagtaaggcactgttttcttaggagctga

SEQ ID NO: 45759 - DNA, 1885 bp, Homo sapiens
agttcctgaatgaccagcggagggcaggtgccagcctgtggcaaaataggaaagaaaaggacaggatggggacttcaccatttttttcagccttaaattgttccttaaaccttcatgtccttttctctaatgtatgttcttgtttggtaaaataaaaaagtttgtaaccctgagttctctaaagatatacattcttttttactggtttgtgaagtcagaaggatgagagctgctatttcttggaaccgtgcaataaatattagcatattcagtctcagttctgcctagaggacctatttgcttttctttatctcgtaacccataactcacaggacattaaccagggtgtccaagaacagtctgggaaagttttgataattacttcagcattgctgtgtgatgggagacattgttttaaaaaccgaatgtggtagaggttaaaaggacagccgtcaccatcctgtttcaaccaacgcttgactgagaactctttctggaaatctctcgaacagacttccaaaagttatatgtgaaaaagcactgaaacctcacataacgcaaagatccactgcaatacaggcatttaggaaatcatttacactaccttgctgatcacttttcacacttgatcttagccaaaaggccaagaagcgatgtggataacttttcaacctgtaaaatagccaccaatctgcaaaaaaactaattgaacactaataaatgaccaaaattgatgcaatggttataactggtattatttttatttctgatcatctacaatatcaagtttaagactgactgtatatgtcacagttttgtgtgattaactacttttattaattgtctttaaagaactgcacaaaagcgccctgaaggaagagaaaccaaggatgaatccatgagggattcgggctgtgtggcgattgccttcattttcccagtggaaggacattttccagagaaatttatgctgaatacccatttttatatctcgcccgattgagtgccaatcactgtgccaagggctgtatatatactgtgtcaaggagaaaatttccaagaaagatactgagatttcttccttggcctatttaaaattggggttgatactcttcctcaatggatgccggcaggcaggaagttcagaggaagtcagtgatctccagtcagattcacagttctccaaagtgtgtccttttatttcccaggatcttgcaaaactcgtgctgaattgctcattagggaaagcttgccatacgctacattaagtgtttcccttagagacgttttcttaggaggcccgacattgaattattaaaccctgggctatgattagtgaggcagacacctgctttctgtattctgtgggacttgaaagcaagaatgaaattactgaataaaatgaaattggtacgagggatattttggacttcatttgcagtattactccgcatctcctcccaagggtacgacagctgtcagcaatggcttttaaattccgcaacagtggaaggcattactttgccattaaaattttgaattgaatttattttgaacattcccaattttgcagcagagaaaagatgctaaatcaatacttattgaaatgattttgcctaaaatatgacatgatcaaaaattgtgtcgatttgcagttttgtattttgaagagaaagcacaagtttttgactgggtaccttgacacagaagcagggagtttatctcagtctccctccaaagcaagctccatttttagtcaaatagtatctcagaagttctcccttaggaattaggattttctttactacttgaatggttctcagtgaccctttacagccccattttgaccttagaaacccacatcacagaatggattagcatgcca

SEQ ID NO: 45760 - DNA, 1111 bp, Homo sapiens
acaaacaaacaaaaacaaaaaaacaacattaagtaggtttttaaaagtcacgttaaattttaatctgaacctctattggctgtttagtcattttcttattatgacaggcttttagaaacttttattctgtgatgctttcgtcagtagaggtgtttcctcttagccagttctagccacaatattgactgggcccaggcatttgctacactcagaaggaattaaccaggcaggagaaaacttggtccctactggaatgaatagtttaaaggccatcttagatgctgaaaactctgagcacaaatgaaagcgacccaagaaggaaaaacttcagagcctaagaataaaaaatggtggtagggttgggggataaactcgcccagagctgacttaaagtgctgtcagggaaggaagtgcctttcctggggaggatgagatggtccatgccgggtctggagctgtgggcgttctgatgttggatagcccaccctagcaggctgcagtgtcttaagggtagtggcatgagatctttggaagtatcgatacatttcctaacagtgagtttgagtttgttctggtatgttctgaatggatatgtggctcaaagattaacttagctaaaaataagtatattagatattagggaaatattgttaataaaggtcttctgtccctgttggataactttagaaaataatgtagacaactgaacgtagtggagatgatggcatgaatacagtcagggtttgatgcttgcttcctagaaacttcctagaaatagaacacatctagacatagggaaataaggttccaaagaaaaccttacacttttattcagattttatgttggcctcagttgtactagaaaagcgtttcagtatgtgtctcttggggaatctgcaccttcttggtcactgcacttcatagcccggcatatcactgagaattcagaaatctgactctttacccagggacgaatacatcgttatgagttcaggtgcactaaatacataggaacacccagagaaaatgagcccgaaacaatggttctttttattttggaagtttcagacaaactctttggaaaattgaagaaatctatggatccttttcc

SEQ ID NO: 45761 - DNA, 1115 bp, Homo sapiens
acggtttagcattacactgacctttcttgccctggcacatacacacacacacacacacacacacacacacacacacacacacacacatatgtgatctaagtagctgacttcattaaaatattgttaaatttaactctattaaaaataaatgtttggccaggtgcggtggctcacgcctgtcatcccagcactttgggaggccaaggcgggtggatcatctgaggtcaggagttcaagaccagcccagccaacatggtgaaaccctgtgtctactaaaaatacaagaattagcaggcatggtggtgggcacctgtaatctcagctacttgggaggctgaggcaggagaatcgcttgaacccaggaggcagaggctgcaatgagctgagatccatgccactgcactctagcctgggtgacagagtgagactctgtctcaaataaataagtaaataaatcagtgttttataatctcaggaaatgaatcaaatatgactttagctttgtagaaccaacttggatttcagttgttacgatacccagcggctaacaggataagacgggcaccactccattcaaaataggattgtgattctctgtgtagaaatgtgtacattttcatttttctgtgataaaaatggcttctaatattttatattttagtgtcatgttagagatttcattccatgctcatttgttcattcacatgtatttttatttttagctctaagcgaaagacatgaggcctcagcctgaaatgaggttgttttgaggtcatctgatttctgactagaaggtgagcgatcgcctcgtcctgaaaccacttcagcccgcatggtaaatggcaaagccagcgagagggaggccttcatgtgtttccgtgtctgtgctgccccagttccttcctcttcaagattaaaaacattttaaagttgtaaaccaaaggtattaaacaacatactgacatatcgtacctaaattagctcaaatgttttacaaaagggcttacatcataaatgctaattaaaccttttagagctgttttaacatggctttttaaagtgagctcttgtgagctacctaatcagcaacaaaatatttattatatgaaaaaacc

SEQ ID NO: 45762 - DNA, 1024 bp, Homo sapiens
caggaggtggaggttgcagtgagccaagattgtgtcactgcattccagcctgcataacagagcaagactcttgtctcaaaaaaagagagaaaagtcaagtaagagttgagctgtgggtagccgacaggttctctgtgttgacacaggacaaatttgggatacatagatgagcatgtttaagacttagagtggaaaaagggtatctatgaattagttacgttttctctgaagcttcctatgaactgaaaagaacagtgccctccgacatacatgggaaaggaggacgggtttcactgcttgcacataagaccagcatacagttttccatgtttaaaatttgaatgcagcaaaatctaaaacttaagaatcatcttacgaacatccgtgggaaatgtactttcaaagcttattgatttgcttaaaacccagatatgactcccaatagttcttgtcttctttattctaagtatttaagcataaactgcagtatattactttaaagtattttctgagacctatgaacttcagagtcaaaacatttcacttggtagtatttgtcaagatattaaatttagttagactccatgaaaaattatagaagataagccaactcagaaatgtatttattcttctggttttaacccatttatgctggaggttgcagatttttttgtgaaaaatcaggccttggtgatgatcttgagcagtaggacacaaataactcccacaagcttagcgttgcagtaatgggaccctaggcagaaatgggttaagatgaacatggagcttaatttgaatcaggtgcatatattttgacatttttttggtaacgtatcatattcccacacaattaaaaaatgtcattggtatatgtagaaccagcagagaaatgcaaaacattgaacgataatgttagtgtagactatatgtgataatttatgaataatatttaatgggcatagatgaatggtgtaaaacattctgtaacatatttgtcttcattacagtatagctagggccaatt

SEQ ID NO: 45763 - DNA, 1025 bp, Homo sapiens
gacatttctggatgttattttggcttaaggaatgaagatagagatgctgccttaagtttcccaaatggccagccgctgtctccacgccgtcattcagacattctgttttcttcctgtggaatccttcagtttgggattttctgactgataaatgtgttgtgtttagggtgcaagctgcatatgtgaagttgcaggactcccacagaaattaagaatgctgttggtttttgctgggttaggagacaagaggcgtatgtgtcagacaggaaatcttagaatctgtcaggttctgggagcagaaagaaaacttctaagaggggactgcagtgttcaggttgcagtttcacccctagtgtatcatgggggttaaccctttctgcaaaaaagattcagtctaaactaaggaaacagtttttcatgaaaatatctttgacgttgaatgttcttaaataaatagcatttgtttttatagaagtttgactctatagttagtctaaatttgtaactaactcactagaattcatcaatcctattaaatgggagacagtgtaatattactgaagtggtggatggagttttatgagtagtaaaagttaagactaagtatatagttagtaagctgaaatatacctctgaggattcagcctccttattttatcatcaaaggcctaaagtggaagtagtgaaagttttggagttaggacagtgtcgcagttgttgtcgactgtaacctgcattacaaaacatcaagtggttgaaggaaaaagggggaaatggcagctgtgactgtggcatggatgaggttgtgagatgtaagggggacatctgagttcgggaggcgaatgaaacctctcagctgcttttagttcttgccaacgaatggtagcaaataggcctggtgtagtggctcctgcctgtaatcccagcactttgggaggctgagacaggtggatcacctgtggtcaggagtgcgagaccagcctggccaacatggagaaaccccgtctctactaaaaatgcaaaaa

SEQ ID NO: 45764 - DNA, 1062 bp, Homo sapiens
tacacacatacacacaaccagccacaaaatagtgttatttccttaaatgccaaacactgtctagttctagaagtgaaaaggaccttcttgtcttttcagaagtgtgtgttttgagtatgtaatgagattacctttctgtggctttggagaattaatttcagcgctttattgtcagatcttctctgtaagaaatgtgatagggatttcccattcaatctggaactaagaattcagattgacacttgagctttgtacctcagatagcgtttttcctcatctcctgttatatatcaagcagctgagattggtttttaaaaaagtgaagattgaattgtcttcacacatttattgtgaacttgcagaaaatggaaaggattatgctttaaagacagttggcttggctggatagaaaagatccctctgtcctgtttccctgtcctccttcccacatcgatttaaaaaattagatgcaaatgcaaaatccttaaattatagatttatgataaatttaaattctggtagaatcaaggttttataacatttaaagtgtctgacactaagtgtatataatcttttaagaaacgtcttcttaacagcgcatggtattctgtgactgttcgtgtaccatgaatattcttattgggttctagagttagttactgactcttgaagatgggcatctaatggtcctcctgtggaagtggagagcagctctccactgtttgataacatttaaagccaagggtgaaccactcaagaaacatttggtggttataatatttttttgttgttgttaagtaccatcaataaaactgaaaaatctcttaagtacctgactcctgcagtgatacaactgcagtgataaaacttttagctttttacatcaggggtattaggtattttctcacagaaatagccttttgaggtgaaattcacataacatacaattaaccattgtaaaatgaacaattcagtggcgtgtaagagtatgtttacaatgttgagcaaccatcacctctgtctagttgcaaaatgttttcatcactccaaaagaaactcctt

SEQ ID NO: 45765 - DNA, 1050 bp, Homo sapiens
aagcgataagctttttataaatgtgcgtttaggtttcaattcctcgtacccacaccctctcccttgtatgcttgtatttaaagccaactatattcatatatttgctttgcagtacaacttgaaactcactgtctcctcactataacattagatgtcaaatgaattactttttgccatttttcttacaagatttttgatctcaaaaatgtgtaaatttatttttaactcttcttttttacttgtatctttttagtctaaattgaaaagcaacttttgtctttagagcatttatttctggcatctccattggaagatttttttttttttcacacatcatacaaagcattacaggtgaaaagaaatgtaagtaataaaaaaagtcttccaagaaaaaaaatgtgcgtgtgtgtgtgtgtgtgtgcgtgcgtgtgtgtgtatgaatgaagggacagagccagtatgaagaaagtaaaagttgaagattaggccattgccaggtatgacatagaactttaagtaacaaagttgaccagacgcggtggctcgtacgtgtcatcccagcactttgggagatcgaggtgggtggatcacttgaggccaggagttcaaaaccagcctggccaacatagtgaaaccccgtctctactaaaaatacaaaaattagcctggcgtggtggtgggcgcctgtaatcccagctactcgggaggctgagcaggagaattggttgagcctgggaggcggaggttgcagtgagcgatccgagattgcaccaccacactccagcctgggtgacagagcaagattccgtctgggggaaaaaaaaagaaaaagaaaaagaaagaaagtaagttatttaggtttggttaagaggaaactagtacagactgtagaatagtgttgtttagacagtagctctgtaagtaccacctgtgactgtgatgcattcactttgatcttgaggataacttgtctcaaagacaactgattacttgattttatgagatcaggcttttcaaagtatgggcctggcatacctgggagcttgttag

SEQ ID NO: 45766 - DNA, 1051 bp, Homo sapiens
tttttgagacagagtttcgcttttgttgcccgggctggagtgcaatggcgcaatcttggctcaccacaacctccgccccccgggttcaagcgattctcctgcctcaaccttctgagtagctgggattgcgggcacccgccaccacacccagctaatttttagtagagacagggtcttgccatgttggtcaggctggtcttgaactgacctcaggtgatctgcccaccttggcctcccagagtgctgggattacaggcgtgagccgccgcgccaggccaggaatttttgaaagacataaacattcagtccctagtaatggaggaaaccagcatgtaagtcctatacgtaaagtcccataaagcttttcatccttttttattgcctcgcagatacttccggtggtgggatgcactagtttttatgttctaagaaagaaaaaaaatggcaataatttataaggtgccatctattgtaagaaatatctcaattccatagataaaagaatgcctcttagaattgttgaaacactggtaactttgagttatataaacaatatattaatctattcctttaaaatgttatcagcctttttaagtggtttttgcattttgggagaaatattttctgcttttaaaaatgtacttttctgtatttttatcttgtttagtcttccttccttccttccttttattcttttttaattatttagatcttgaatttatatgaaatttttttctgtatggtggttttttcacttttttctccttttccttctttaatttttttctccttttatttgaaattctacctcagaaattacacatgtacatgttttcagacattttttcatgaattcacccattttctgttcctctgttcataccacactattttagttaatgtgattttagaatatagtttaatatctgataacagcaagaattagaaaaaggcctaaatgaccgataatagatcaactatttaaactatagtaaaagtcatctttctttgggtcttccagtcctaattgttacaatgatatttaaagata

SEQ ID NO: 45767 - DNA, 1032 bp, Homo sapiens
attgaagattctagagttgcggtgcagttcagaaagcctgaggtttaaggggaaatggtaaagagaaagaggaccggagcaggattcgattcagagccaactggttttcttctttcctatttcaggggagtagcttcttcagcagactctccgctgcttgtgctccacattgcattgctcacaccatggcatggtgtttccattcattgtctcctgagttcatttggtgtagaagagctggttctaaagagaacttctccctgctgtctttttcttccagaacactggggtgatgggtataccgcagcagttgcctggccgtctcctaggttagtgtagcagagattctattctcagataagacttccgtgtcggctgaagatgtaagggactgtccacgtttgagggagaatttcttctcactattctagctagaatatgtgaatgaagaaagatttctattatcctggactcctttgtattttttataattgttttctttttctcacttatgctctgatatgtattggtttcttgaataaattaaaacttaaagcactgctttagtagacatttctggaattcctgtctcccgctttcctcaccacatacagctcttctccactgcctacagctgtatgttttagcatgatgatggatggatggactggagctagagcaaggttaaccacatatgctctggtttcagaaacatcagagagggaggtggtgacatttataagtattcatcttttatttacaaatttcacgcacatttgtagtctactgtaagcaacatagtgtcttctaccatctttttcctcttaagggtcaacactactattctatttcatatttaccatttttttcttttaaaagaattcatgtggtgggtcattgtagaaaatttagagaatatgcaaatattgaaaaagaaaaagaaatgatgcaacctgtaaccacactgtgtgtaggtgttctctgtgtgggtatcttagtttgggcttttataacagaaatatcattgcctgg

SEQ ID NO: 45768 - DNA, 1038 bp, Homo sapiens
tgtggttgataggcttagataggtggtatgttctctcagtgtatagcttcagatcgtttttcattcggaaaacgtttcttggattgtagtcttcagtatttgtcctgttccattgcttcattgttgcttttatagtcagagactcctgttatctgtttcaggtattctttgcctgtctttagtattcatttcttctcttgcattctttttatctcttctttttttttttaattaaaaaattttcttcttcgagccgcctgtttctcttaaagcatttttgtgtttacgtgttcttgtcttccatataatctttatgtataaaacgagtttctcctttatttgtacttcctagagatttgcccgctttttgaactttaaaaaggaaatcattctggcttaccttcgttcatggcttgtatcattttcacatactttagctcagtttgaattgtattttcttcagtgtgctttccttgtctgtggggattttgctgcttaaatctttctctcgtagtaagtttgtgtggggtctgacctcagtgctttcggtgcttgtttgtatgtgacgctagttttcctcaactcatggaaggagacttgggagatacactgccctgttacagccccttcggctgtggcttttgtacaggtttcctgcttcccctctcccagttttacctgccttttctttgtccctgtccctgttttgctcctttttgaatccagtcccagcactttctcctcagtgtgaggccttggcttggagcgggagccctggagcatctgttttccgagttccaggaggtgaggctcatctagtccctcggactgcactccctgtctctgtggagtggccagatccctcctagtagcagctgctggcaagaaatgggtctgctgtgcttttcagtgagtgcctcaggctgttggggtgttctgccttcccgagagcccatgcctcctctagtggctggtgcaggggcagtgactgctggggcctggtcactgcctccctacctgcgtgtgccttgctgtcca

SEQ ID NO: 45769 - DNA, 1086 bp, Homo sapiens
aattgaccataaatatgtatttccgagcttgattctgttccattgtcctttttgtgtatctcgatgcccacaccacactgtctttattactaggtttttcattataaagtcttgaagtcatgtaagtcctcaaacgttattcttcctttccaaaatcattttgactattgtgggtcgtttgcatttttatctgaatttggaatcagtttgttaatttctacaaaaacagtgtgctaggattttgatcgtgttgagttagcagatcagttttggaagaattgaaatcatgacaatattaaaccttctgacccatgaatatggcgtatctctccatttatttagatctttaatttctcttagcaattatgttgtagttctcagtgtaaagttcctgtgcaccttttgtcagatttctctctgtttcattgttgatgctattaatgtcattgtcctattaatttctatttttgttagtttatttttatagaaatacagttgatgtttttatctttgcatatcctgcaatcttgctaagtcttagttgcagaaacttttttttggtagcggctatgggaatttctgtgtagatgatcatgtcatctacaaataagttttataacaatgtactttgatgtggatgtcttcatcttttgttctggttcttggccttttcagcaaagaaaattattatctttagttgtgggagacttagagacgtttctggtgcagactgagtcctccttatctgaaacatttggaaccagaagtgtttttggattttgcattttttggattttgggagtatttgcatcatgcttaccagttgagcatgatgtagatatctgaaaatctaatccaaaaatctgaaatccaaaatgctccagtgagcatttcctttgagtatcatgtcgttgctcaaaatgttttggattttggagcattttaggttttgcattttcagattagagatactcaggtagtttgtttccttcctccctccctcccttctttctctccctttctcccttctttcccttcctccctcccttctccctttctccatccctcccttctctcccttccttc

SEQ ID NO: 45770 - DNA, 1038 bp, Homo sapiens
acgtgccaccacacccagctaatttttgtatttttagtagagatggggtttcaccatgttggccaggattgtctcgatctcttgatctgcctgcctcagcctcccaaagtgctgggattacaggcgtgagccaccgcgcctggccgccatccatatatcttctttagtgaagtgtccgttgagatttcatgcacatgttttgagttgtttggcttcttattattgatttttgaggaatctttattctaggtacaagttcttttttaaatgattgacacataaaaagctgtacctatttaatttatacaacttgataagtttggggataagttcatgcccttggaaccattaacaccatcaagagcataaacatatccattaccaccccaagtttcctttcaccccctttatttatttattattattattattattaattttgtggtaagaacacctaacatgagatctaccttcttagcaaattttaagtataccacacagtattgttagcttcaggctgtattttttccctttgaccatcacctccccattttcctcttccccagcttgtggcaactaccattctactctgtttctgtgagtctgactattttagattccacatataagtgagattatgtggtatttgtttttctgtgtctggcttgtttcatttaacataatgccctccaggtctgtgtatgtagtcacaaatggcaggatttccttcctttttaagaacaaatgttttttcattgtgtgtgtttaccacactttctttatttgttcatctgacaatggacattgagattatttccatatcattctcataataatatcttgtaatgagtgggagtttttcattttgatgaagcccattttgttagtgttttttttttttttttgacagggtctcactctacacaggcaggagtgcagtggcatgatattgactcactgcagcctctctctcctaggctcaggtgatccccccaactcagctttccacatagctgggaatacaggcacatgccacca

SEQ ID NO: 45771 - DNA, 1079 bp, Homo sapiens
ctctctcttgacccagtaaattggtttatttgggtcaattgggagtagttatctgaaggaaccattaagattgagttcagttcttcacgtagcttttcttctgctttggtggtggttatttttatataggctcagtttcttcattggattaaactgtgaatgttggcacctataataataattcactgggtaatgtggaataatctaattgtattctaattgtaattcaaaaattaataattccttcaaatagcaagattttgttagtattactctgtgatcatagtcagaaacaaaccaaaccgtggcattctgtgagctagtgcagatctgtgggctacagcttgggccattttaaagccccagtaatccagtaatatttttgctgaactatggaaagtaaaaccagtatgcttaggactgcataggaaacttctcatcattcagaattttgattggataattatatttgtttatatcagtggctgaaaggaatgaccagaaaagaaacactctgtccacaagctagttgaggatcaacatgtcatttcttggcatggcgctttagttctctgggttacttagttctgttcacttgttatacaaaagcaaacagatgagtgaaataaagcaaactgggtgttattgatattagaatgagaatctttgttcaaaatttgtatttattaggacaaacgttcagggaaagttcttcaggggcaagacatctcatcctgataggaacagattatgcttatgtggtgaggtgatttaattttcctttctcccttcttctttccttccttcagactcttcctccatcttacccatgatttattatgtatctagatttttaaaaatcccactcagtatattcgcttagctttaaaaatgcgttcaaccttgactggcgtagataaggccagcaacatgcccagatgttttctggaatcagagggctgagggtcttctgaatgtttcaggaagggcaactgtagagaagcaaagagcccttaaatacttcagagaagtttgggtaatacacttccccacagcctgtatctcacagctgatagcac

SEQ ID NO: 45772 - DNA, 1034 bp, Homo sapiens
cggaatgttgccaaccaaggaatctcttctgatttttggtgtctagagtttttattagagcttcctgagatagcatgtttgattgattgattgcccacaaagttgaactccgtcaccatgtctactggtatcgtgtgagccagagctcccaccctaaatcacatgattggtccttctcatatggccaaccctaccctaagatccagtgtggccaacccccaccctaaacaaggacacttctattagttatgacacagattacctcccactagccgagggcaaaggccagatgtctcttctcggcaaggccagcttctttcctacccacctaggcttttaaaaggattgcagtgagttttatgttgggaatggtcttgaagggcaggggtggaaacggagagaccaattaggaagaatacttgcagtagtccagagggaatattcgtttcacccctggtaatggtggtagggatgataagtggttggagtctggaaatatttgggaggaaaggagcatgaggatctgttgatgggttggatgcaaatatgcaagaaagagagaggaaggagtccaagatacctcttaaggcttttggcttgagcagatcaaagaatggagatctcattactgagatattcaaaagtcagttgtccatcctaagaattagaggattactgctgctaccaccaattaagaggaaatcacagaaaccagcccaatactggttggtatattgcaactcatttaaagaaaattattccttgtatttcagatatttgaaaaaagaaatctgttatggcttataatccccatgtcaggagttcaaatgagcaaaagaccggtttatatgatgttattacttttatattgactttatcaaagtttataaactgtattgagatatttttaattatttccaaaaagcagtagtagtagagtttttggggctaaagttatccaacctattgatactgctcacattttcagaaatgcttgttctgtatgttatacatgctacatgcacgagtaattc

SEQ ID NO: 45773 - DNA, 1027 bp, Homo sapiens
actggggagtatttacctacgtcatttagaattcttctgtaagcaagattttgtctttccccttcccaccccaaaatagatattttgatttaccactgtgcagtcactttgtagtattttgatgacaattgaatagataatgggtgtctactatatgttagatactgtgctaattttgggggcaataatttttaacttctttggggtcacatgcctctttgacaaactgatatttgctgtagactttttctccaaaaacattaagatacacaaaatactgcctgcaattttaggtgtttcacagatctttgaaactcttatgatttcagttaatgtaatgtctgccctccaggaattcagcccagctgaagaggcaggcaggtggggagatagaataggatgtgttgcatgctctcagacatagttttacattggatgagatggtagggaaagctgcagaggggagatgttatttgaatttcgccttgatgagtgaggaagagttaaatcaacaaaagttggaaaagcattcagaacagagggagaaaaaccgacaaaggcctatgcaaagaagcatgatgcacttcagaattggtgcagattctgaccttgccacagtaaaaggtgaagagggaagggactggatgtaaaattagagaggcaggagaaggcatagagtggaaagagaattggataaagtcaaaatctttacaagaccttgttttgttgcaagtcaggagagacttgaatgtgtttaaataaaaggaaagcactagtagagaaggaaagcaggtaattgaaatagctcctgcaaaggtggaagggttgagttcacacagaataggcgcctccttcattgcatcaggagagaaggaggacatgatctaaatttgcactaaattgcttgtgtggattgtatttagaatgatcagctttatcctgaaaatgcaagagagccattgatgacagaagatcatgtttgcatttcgagtaagatcactttgactgcagtggaatggagtgggac

SEQ ID NO: 45774 - DNA, 2001 bp, Homo sapiens
ttgccattattagttcagtggttcttggtcagtagttttcagactggtctgcatcagaatgacttggaggacttatcaaaacacagattgccaggccccacctgaagagtttctgctctagtttggattggggactgacaatttgtgtttttcacaagttcctgattgaagctgatgctgctgatgtagggaatggggatgggtccagcctgcctgaaagcacatggcaagctgatggccatacagaagcagcgtctgttagcagaaagtgaggcggggcagctgtgaggacagcagctgttcttttctctcgcgatctaggtcagtatttgccatagctgtcgtaacagactgcattgtggtcattacttgggggttgtatagactatgttattagtaaagtaagttttgagaatgacttacttaaattatatgcagcagtggatcaagtaagttgaagataatgtttgttattctctgatgacatgctttctagagggtgaaggacaagggtcattgagaccccaaagaattgggtacccctctgggaatatatggtggatgttagtaacagctgatgtgtattaactcattgaaacggccaactaaattcatgagctagtactgttaatgtccacctgtctcaaggaggaaactgtggcttaaagaaggtaagtaatttgcctaatgtcatacagcttgtaaatggtagaaccaggtttcagaaccatgcagtttggcctcacaagccacacttttaatcacgtgtcctactgagtgccggcaagcgggtcctcagttgcaggaagggtaagactgagaggttcattttatgttcttggcttgtatgcagtatggtgggattagtgttctggtaattattccctttctcctaggcttatctctgcctatatttttgcatttgatgtacttgaacctaagcgtagaacttaaaaaattgtgttagctgtgtctgtccgtttcgtcatctttgcatttagaagcctgccattcctgtctgtgcacatgctggagggatatacgattgtataaatagaattgagcacagagacctgtgtttaaacgttttgttttgtttttttgctattgatggaggtggattcttttcataagagggattgtgttggtcagggtctcaatggcgactaatgaagtaaacacaaaggtttttagttgctccataattgttgggaaagctaaagaaactcaaggcgaagtttctaggcacagctcctgaagcagagtgaaaatccggttgtctgatttcttgccaggccctgcctagcactttcagctgtagccatcctgaacaactggtcatgttctcttgcttgtagtctttgtggatgctgttttctttctctggtacactcagtcttcctcttttcttggcgagtgcttctcatccttcaggccctattctaagtgttacttttaaatttttcctggtccttccataataatctcgctcagaccgttagatgcttctgctctctgcttccattgcacactgtatttcccctgtcattatggctgacgattgattattgcctttccccactcctcactgagtcccggtgcctggcacaacaccatgcttgaatgtagcaagttgggtggttcagaattgaaaagtcactgattacacgtttgaagcttcatcatcaagaaatagataccaatcaccaacttttaagttgtaatttataattttcataattgcaattgactcaacagatttttgctttggtttgagtgtaacaccctttataacatatctaatgccgcttgatggagattggataactggcctgtttgctaataattctttgaagtttggaaactgggaatctcagagatttgtaactagataaaagagactctaagaaataaacattttggccaggcatggtggctcacgcctgtaatcccagcactttcggaggccaagatggaaggattgcttgagaccgggagatt

SEQ ID NO: 45775 - DNA, 1025 bp, Homo sapiens
ttaactcttggattatagtttctttgctaattcttttgaaaacatttggcttccttttacaattaggtgggtccctgtgtaagcaaataaaaagctttctatcttggtcatatcactttatttctctgggtcagtttttttacatataaaatatgatgaagttggattgctttctagatgtagaactctgtgaagtgggacgagatgagaaaaggtcctctggtgggccttcctcttttctttttctttctcattttgctcagttccttgtattcactacaacctgggtaagtaagtaaaatttatctttagaaaggcaagctaacccttctttcatttccgtctttttcagtgaagccaaccagaattttgagttgcaggtacctgatgatatacttcagtaaatattttataattttacaaatatattaaatattaaaataccaataataagaaagtttctgtgatagcttccaaagtgattgactgactaatcagtaagatttactaaggacttaaaatgctcccaacatagtaaagaactataggagccactgaaagtgtttacagtatatgagaaagatgaaaacatctgaaagaaagaactgccaggcactaaatcatgctctgctgagtgagtgtgccccagcatggggatgatgtgtgcattgtggtcattgttagcacctactgagtttagttgtagttcagttgtagtttgtgagatgcaagttatgggtgagtgaaaagagttaaagacaatctaggtttttagggacatcatgagcaaaggcactagacgggaattaggctggttcaggtgaggagaggagaggaatgaagagagggtatggatagctttgtgatatggacactgagtaggcacttgaaggagtagaagacttaccaaggtaggtactggtggtggcaagataactctagaccccattcagaggagtttagattggagggagggagatactcggaagcgtttgtgttggttccttgaattccatcctatatct

SEQ ID NO: 45776 - DNA, 1053 bp, Homo sapiens
ctgaggcaggagaatcgcttgaacctaggaggcagaggttgcagtgagccaaggtcacgccatggcactccagcctgagcgacaagagtgaaactccatctcaaaaataaataaataaataaatattagattaaataaacattaaattaaatgcactaaatattagatttttgaaaaatcttttgtgatgtcttagtccatcacggctgctataacaaaatcccaccatagactaggttgtctataagcaacggccctttatctctcacagttcttgggggtttggttttaatgcatgaatttagctgggaaacaaactttcagaccatagcagatgccttgtgatcttcatgacaccttgaggccacattttgggatttttcccccactgtgaacacgcatcctgaaatgacccaaagcagcgataaatatgatttggtttatatacaactttatagtaacatcttcactggaaaatgaaggatagttcaatggtctttttcctcttcagtgaatagtatggctggccaacatggcaaaaccccgtctctgcaaaaaatacaaaaattagctgggcatggtggcatgcgcctgtaaatcccagctactcgggaggctgaggcaggagatttgcttgaatccaggaggtggaggttgcagtgagctgagatcacacaactgcactccagtctgggtgacagagtgagactccatctcaaaaaaaaaaaaaacccaaaaaactatatatatatatatacatgaatgtatccatcaaacagtggtcattgcacgtggctttttcagaacttatggttccttcatgtaacgtgagatatagtataggacacagtatatgcaggagaagacaagttctaccattgtacgtgagctagaaatgatcatctcaacaagaatttcaggctctttgatgcaagaatgtatggtgtctttctggtgttccttggccacttctgtctttgatgaatcattttgatactggattgggattcactgttaatttttcaggagtacagtctaagagttaatacactg

SEQ ID NO: 45777 - DNA, 1048 bp, Homo sapiens
gttttcttatctgtgcctgcagcctgatttttcaggctgtttctctttttaaaggagttttgccaaggacctaccctaactacctaactttctctatcaatactttgtatgacttcagtctttttaaattcattgagacttgctttgtggacaaacatagtctcttctggagagtattccatgtaaactttagaagaatgtgtgttctgctttgtttgaaaaaatgttctgtatatgtctgttagatctagttggtttatgtgttgtacaaattctctgtttccctatttatcttttgtcaagttcttctatctgttattgaataggatgtattgaagtctattattctagagctttctacgtctcactttagttgtgtcagtgcttgcttcctatattttgggactctatgtttggtgcatttatgtttataattattatatctccgattgaatttattctttaatcaaatatagtatccttctcaacttcaacaacatattgatattaagcatatttaagaaagttgctttgtaaagtctttgtgtagtaagtacaatgtctggccttctcagggacatgttctgtcagttaatttcgttcctttgaatgggctatactttttccttatatgccttaggattttgttgctgttgaaaatggggtgtttgaaaattacagtgttgtgtctctggaaatcagagtctcctctttcaccgaggtttgctttttttgttgtttttggttttatgtatctcttttttttgtcaagtgacttttcccaactatttttgtagggattatattccttgtcttgtgtggtcactgaagtctctgtttcttagttaatcttctggtactgttttttttgtgtgtggttttttttttttttttttttttaagagatggggtcttactctgtcacccaggcttggcaggagccactgtgcctagcctggtagtgttttgacagagatttccttgaatgccaggagctaaaacaaataaacaaacaaaaatactttttccagtttttgcaggttggctc

SEQ ID NO: 45778 - DNA, 1021 bp, Homo sapiens
attgtagtcacttctcattttccctttcccagcccctgggaactgctaacctgtagtctgtgtctgtagagttgcctagtctggacatttcattaatgagtcatagaatgtggtcttttgtgattaacttcttttactttcacataatgttacaaggttcatccatggtatagcctgaatcaatacttcactcctttttatgactgactaatattccattggatggatctaccacattttgttcatccttttagtatttgagttgggaacatttggttgttcccagtatttgacttttatgaacataataaggctgctagaattcctgtaacaaggctttgtgtggatgtgagtcttaatttttgttggatatatacctaggagtggagctgctgggtcttatgataattctgtgtttaactttttgaggagctgcaaagggcagcaatttagcactctgatttattctttttttcagtacaagacattatctaataaccagaaacttgttcaacttagatctaacgtcagatccagctaggagttgcagacttccattttcaagtctctccaagagaaattttgttatgtatgtctatgagatcacaatgactgtcccatctctctctctcttttccccacttttttatattaaaaatttattgtaaaatatacgaacacaaaatataccattttaatcatttaaatttttattgtgttaaaatatatatagtgtaaaatttatcatttttaccatttttgcacttgatcttagccaaaaggcaaagaaacagtttaatcattttaaagtgtacagttcactggcatgaggtagattcacagtgttgtgcaattatcaccactgtccatttccagaactttttcttcatccctagcagaaactctgtacccgttaaatactaacttcccattttctcctttctccagcctctgataaactgtatgctaatttctctctgactttgcctgttttaagtgcctcatgtaagtggaattgtat

SEQ ID NO: 45779 - DNA, 1065 bp, Homo sapiens
ttggttcatgattttgcaggttgtacaagaagcacggccctggcgtctgtttccagtgagggcctcaggctgcttccactcatggcagaaggctaagagggcttgtgtgtgcagagatcacacggcaagaaggaaagcaggagagagccagaagggctaggctccttttaacaaccagctcccgtggggactaagagtaagaattaactccctatacccaagggaatgaatctattcatgaggcatctgcccccatgacccaaacacctcctgtcaggccccagtactggagatgaaatttcaacatgagatttggaggggaaaaatatccaaactctatagcatggagtaatggcattgagagctgcaactcttaatctctggtaattagtggttaagtagacgacaggatatttttccttgggcatgttttgaactctgtgtgtgtgtgtgcagtcgcacatgcgtgggtgtgcacttaatgataaaagcagcaccatttgtaatggcagttcatgttacagagtgcctcatatacaggtcggctgtgtggtggaccacacttcagcagatcctttctttcttagcagttctgtccttctacccaaccaggcagttgacatttgtgaaaacacagagtttaggatttcaagaacaaagtatataaagatggtgaaacattttctcagttctttttcatgatttctaaactaggaagagtcaagaattcaagattgctaatctaaattctgatgttggagtagtcatttgtgaagggtgatagaacagagtatcattcttagttacaacagcaaaggttaattacctagttacctagttcctctgtaaattatttaaagctcagaatattctccaacattacaaagacttaaaaagcaaaggagaattttgagaatgtactccatgcacagatgctattgttgcgccccctgagattttgcttcagtacttgagatgtgtatcagaatgttgaagggcagcaatgatgtgtaacagttttattaagatataattaacgtactacaaaatttacccacttagatt

SEQ ID NO: 45780 - DNA, 1864 bp, Homo sapiens
aggagtgagtgacttactgcttgagaggaagggtttggaatctccacgtgtgttcctaatgcaatttgaggttccctctcattttcattcactgagaggtgataatcggcagctgtagtcattttgttttgtcagagccttagccagtgtgttgcatggattaatagaattaatagaaattaatcgagttggacctgatcagtggtggttttattttttaaagcaaatgtacaaaggaaatacatgatgttgtcaacaagtcagagaaaaatacagatatgcatagaataaattgtgaaagtactcccctcatcccaaagcacccgagggtaaccccatcagcagtaagttgtcatgttcttccctctttttttcccactgtgtcccgtctaataactaggtgtccaagtgatctgtgagcagaattctttattctagtagtgacttgtgggtgggtacatactggcagtcacacactggttctcttgaggcggcagtggcatcagggaactggtgggtgggttgtgagcagaagaaaacccttaaacaggaccactggccaaaaaggcttgctgtccaggtgtaattggaatcacagtaacaactgctccctcacagtgggagtttcccatgtacaggacacccaacgctgtgcatgtgtgtcactcactgaactctcatggtgaccccatcttacagatgtggaaacccaagcacacagaagtcagcagcttgtccagcatcctgccgcgtaataaagagattccagtttagtcagtctggctccagaatcatgttctgacgatgctgtgccatcttgtaggagcagaactctgttctctgggagctgttatatatatatatgtatatgtatatatatatgtatatatatttgtgtgtgtgtgtgtgtgtgtatatatatatatatattttttttaaggcggagtctcgctttgttgcccaggctggagtgcagtggcacgatctcagctcactgcaagctctgcctcctgggttcacgccattctcctgcctcagcctcctgagtagctgggaatacaggcgcccgccaccacgcccggctaattttttttttttttgtattttttagtggagacggggtttcaccgtgttagccaggatggtctcgatctcctgacctcgtgatccacccgcctcagcctcccaaagtgctgggattacaggcgtgagccaccgcgcccggccggaagctgttatatttttaactcatacctttttggcccccaaatcaggtaaatggaaattatagatctgttaatggcttaaataccggataatagattttatacaattgattgaatgtataacttgaaacagtgtcgccgctgccagcctgcctgcaagaatctttcttgtggttttgctttgtaaaagtaaatgttttccccgtgaatcttctgtagtgttttattcttggtgtttttctttggggcctgcatgctttctggcctttgctcctgctgagtaggcagacatatctggagaaaaccatggagtaaaggaaaagctttggaatttaaaattgatttatgtggaagctttttctgtggttgaaaaaaagtaaagaaaaaccctcctttctacattaccaattcccggcaacagtaagccaaacctgttgtatttgggagcaggcctgggtgcatggaaactgctcagaacagggaggtcaatgccattatgataatccagtgacttccatgggaagccatcattgagaaagggtacttgtgcagatctaaaatttggaacaaaacaccctgaagatggccaaactgatataacgttatgtaccttggtggagtgtcttggtctgtttgtg

SEQ ID NO: 45781 - DNA, 1029 bp, Homo sapiens
aacccttaagttcagcgtgactttcaccatttttaagcacgtgcagcaaaagttcacctgtgtccagccccactgtttggcctgggcacacctaccgactctaccattgtaacatcagaatgataccatttctgtaaagtgacatctttcagttacctggtggcttttcatatatgcaacctcgatggcctgggtaatgtcacaagtgtttgtaaagtgaacatgaagatttaaacctcttgatttcatgattgtgtagggttttctgggtcaagtgagtagtgaaccgttttcacagatcacctcaggccgcttaggggaagagcaacaaattctttcagtttcctctcccctgtgattttataaagtaaattttcatgtacctgtcctagaaagaggaaaagggaacctagtaattctaaattactgtggaactttagttaaatactgtcttgtccagaaggcagacttggggcatttgaaaaggtgaaggggtccgttgatcatccgttctcttgtgcttctctggtgctgtggatgagataatgagaagccctctagtatgtgctcccgagactccaggtgagagctagacttggaaagtgcgaagggcagggcatctgtcctgtaactgagcgtgacctctgggtggttggtaagtaaccagaggaagacacttggtgctctttgtaacagtcgcagccgctttgttccttgcctcacaggaaagaacagaatgtctaattataataatcttctaataattacaatattttgtattcattttcttttaaaaatctgtttgagtaactactagccttcagaagatgctggaaaatagtatttaggcagcagctggcagctcccagtgttggagtcgatgcggtgctcggctcgtaaagatttcattagctggacatacactctgatttccttcttgctgcacaagtacattctgttgagcagctgttttggaaagggaggtacaataaacacttctgcacttgttttaaatacgtgggttttgtt

SEQ ID NO: 45782 - DNA, 1050 bp, Homo sapiens
tggcaggggcatcttgctgccagggtgccagactttgcccagcgtccagctacctaaaagtcaccaggaagacagccagaggaggtctcctgcttggatttggtggctttgcggggtgggggttttctttgaggaagatactgcagatctagggagatgccctaactgctgatggggcctaagagtcctcgaggctgtggcaccatgacacccagagtggctggggccgacttcatctgcctcccaccctgtacttgagtagtcttaaaattttgggggatgaggaatgctgtggagcagtatcttaatatttaggaaaagaatttgatgtaaaatctggcttgacataatttctttaaaaatatatacaaacgttgcataaaggaatattttaataaaaacaccagttaaccagtatatttgaaaccattttttcccaagtattggtgtcatgcttaagttttcttttaggtgactttatttttgacatagtacacgtaacagatcttcatttaccatttattatatgagacataccacttgactcagctaaacctccgtttctgattctataaattggaaataagagtaaccattttactcatcttagaaatggttataaagatcaaaacaaaggatttatgcatatgttggccaattcgaggagataatttcctagggttattacagttgtgagatttttccggtttcaaaatgggataatttgtaaaggtgttttaaagatgctaagcacaggtcagtgatgatcatgtcattttggaaacattcattatacaagctgggaaccttgtaaaatgagtttcacaaggtcatttgctttacacccacagagtagtgtatattgcagctgatcacattcttaggggtcagaaattaatattaatttgtcaggcttcaaatgtaaatcagcatttccctgtttttcttttgagaagaccaaagttgctaacctgtattcttgttcttggattatgctgtttgtaataaaaaaagatggatcatgatgaatgctgattagcaccttgggga

SEQ ID NO: 45783 - DNA, 1030 bp, Homo sapiens
cctatagtgtttcaaggttaagtgacatttcttacctttcttatgctttgttggcccttgtctacaataaagaactgaagtggagctatttttgtccacttttacattctgcctccaaaacctagccatagggtgggatgctataatttcttgatgcagcattggtatttgaacaacacacatgaagcaggaatggttttacattttggttcatttgaaatatggttatagtgaggttttaaataaatcatctgagctacagtaaacaaaaaaagagcaacactagccagttgtcaaggaaaagactgatgggtagaataaacagactgctttctgcagtctaaacaatctgttttcatggtttttttctctttctttttgaagggtgattgggagaacttccaaattaagtagaagttagttaaatatgagaggcagtaaatccacaatgcgtatgttagtgattattacagcctgttttctcaatagctctaataacaacaatgtcagtgactgaacacagtagaacagtattgtttgtcgtggggtggtatggctggtggtggcttcgacatcctcagggctcaacacctcagcattcagtcagagaaaggaaagaaagtatagagaaagtataactgtttcttaaaaactctagcttgggccaggcgtggtgtctcatgcctgtaatctcaccactttgcaaggccaaggtgggaagatcacttgagtccaggagtttgagaccaacctgggcaatgtaggcagaccctgtctctacaaaaattaaaaatagatgagctggatgtggtgtggcacacctgtggttcccagctagttgggaggctgagatgggaagactacttgagcccaggaggttgaggctgcaggggcctgtgattgtgccactgcagcctggataacggagcaagactctctctctgtctctcaaagccctggtttgaagtgaagtgaaacacatcacttccactcacatgccattgtgaagaactagccgtggaccatacct

SEQ ID NO: 45784 - DNA, 1680 bp, Homo sapiens
aggaaaggaaactatattgaatattctgtttatatatatagtctcacttaattttcacaagcattttgtgcccattttacagatgaagaagtgagcttaaagtgataaagtaacctatggcactggtggaggaaacttttgaagccagagctcacagagctgtgggcgggacagaattagtttgctttacctctgggacgttgttgtctggcttattgaagatggaggaatgatattcttcaacctctggggcctcttggtatataagctgaggttctttgagacctctgatgtctagtctaatgtgttaatattaaactctgcagagcttagggtaggcttgtaagtcttgtagttgattgtaactgctgatgaatcaaacagctgagtaatattaatacctctgggtctgtgtcttaggacacagttttcagtacctcactccattctctttctcagggtagatgcaccttacaaccccgtgacttccacattacacaaaggaatatgtaggtttggcataccccacaggtcccatgtaaatactgcactcaaatatgttggttctctgttgacctgttggaaacattgagaacagcagttgtatcccaaggatataaagaagctgttttcttttcttttcttttattttcctttcttttcttttcctttcctttcttttcttttcttttttcttttttcttttctctttctttctttctttcttttctttctttctttctttcttttctttcttttctttctttctttttttttgggacagtttcactcttgttgcccaggctggagtgcggtggcgcgatctcggctcactgcaacctctgcctcctgagttcaagtgattcttctgcctcagcctcccacgtagctgggattacaggcatgagccaccatacccgtctaatttttgtacttttagtagagaaagtgtttcaccatgttggtcaggctggtctcgaactgctgacctcaggtgatctgccctccttggcctcccaaagtgctgggattacaggcgtgagccactgcacccgtccaaagcagctgttttcaaaccttggctgtgcatcagaatcacttgaggagccagatatttgagatctaccataagagactgtaatccaagagatctgggatgggcccaagaatctatatatttaaaaaatctaggttttcagaaagttccctaagcagtacacagacagggatgagaagcatagttgtacaggctgatttctgccaatatctatgagttagttatcaaggagaaggagcatatgttagaattgcttgggaatttgttttttgtttttggtaaactttttatcactaggcatcttagatttagaggggcggaatggataaaagaaggtcctcaggtgattctaatggattaccagtatttaaacaatctgaatggaccttttagctggagtggcttggcaaaaagtctgtattaaccaaagagttgctgttgccatatattatgcctggatttagaatgcaggaaagacatttaacattaaaattatgacatataattgaggattcctttgatccaaaagcttctttctttggaagtttgaagtatttcaaggtcattattatgaacacagatgatccccattggtgctcagaagtgccaggttagaggcattt

SEQ ID NO: 45785 - DNA, 1062 bp, Homo sapiens
ttgttgtttgagatgtgttctttaactttgaaaagttagtgtttgtaaaaaaaaaatttttttagtgataccatcaggtcacttgagctcttttaggaaataattctgttaagtgaatttttttgtttgtttagattaaggtataagttctcttttgacactagtcgaatttttaggaaagatggaatttgctgagagaattcagtggctattgttacagtgacattaatatagttctacataaaattctacatgagatttttcatttctgtatttctaatgtgggtagatcttggtatattgtattattttaatatagctcaaaacatactacagcaccctatggtattttacagatttctaacaaaaaatttcttctcattgacctcttttacttttgaaatattaaacaagtggtttaaaaaataatttttgttttgaatggagtgtttttgtcttcttagtttaaatgaggaagcaatttctgttttatcttggtcactgatttagagcatggactgtgctcatcattcatttctaggaagaaattagagtattcatttcacagagagctacatattgttttcttcaccaccctcttggaggaaaggtagggttgataattacggtttgccctggccacatgctttcactcatgggtaggtgagctaaaacattcatatcaccatgatgcttccttttctttccgtcttaaatagacaggacaaatgaggaaaggcagcagatttgaggaagatgccaaacccatggcttgggaagcttgccagtgaagttgagcaggcagggcaatctagaactcaggcccctccagagggcaggtgcctgactttctcacttcagctgtgtttcttcaagtgtggcagagactcctgtgttaggagagcccacggggccattaacatgcggattccaggccttactacagactccaggatcagagcctcagggagttgggccagggagtgtgtatttttgctcaatttttattattgaagctttgaagcacacagggaaatagagcagtataatgaacacctgtta

SEQ ID NO: 45786 - DNA, 1037 bp, Homo sapiens
ttgcagcacttaaatagaaaggccgaggcactgctggacctgctgaagaagactccctggggaggacacaagaagtcatagttttagaagaaccacaagtgatcacgtgggaaccccacgcttgagaactggatttcaggcttattccacttggagaggaatattagatttgtgttcttaataaatatgatggcagaattgggaaaggaatgatcgggtaccattaagtttggcccctggataataccataacaaaatgactttaccttggaagcatgagtgtctaaaagtacctcaggtgtactcaagggtatgcactaatggtactccatgttttctgttttttttggttgttgttgttgttttttttgttttgttttgttttgtttgctttttgagctcaagtattaatctcattctgaaagaattcgcaaattcaaaacagtgttcaataaatgtagcccacttctctttgccttttatgggatacaaataatgtttatgttgcgtgtgaaaggtataataattctgtttaattctgaagtgattctattaaataggcttgaggaaacataactgggattatgagtggtgttgggataagtgatctgtaatgtccctctaatgctaagattttgtggtttaagaatggtaatattcaatatttagatacctacaaatgaggagattcgtttgtgtggggccagggtaccattatagacacattaatagattgtatacttgcatttgtgggctgtgtgggtgtgtgggtagagagagagtgtactttatatgcttattaatgggtggcaatctaattgtaaaaatagcttttttttttttttcattttatccataaacttaatggaattctggtttaaaagaaactcagtgggaggccgaggtggcggatcatgaggtcaggagatcgcgaccatcctggctaacatggtgaaaccccatctctactaaaaaatacaaaaaaaaattagccgggcgtggtggcgggcgcctgtagtcccagctactcaggaggc

SEQ ID NO: 45787 - DNA, 1032 bp, Homo sapiens
ttttaacataccagtagaattcagcagcatgtactggtaggcttctgctgaacaagccgaagtgtgggcagtaaaaatgttggtgtcaggttaaaattcctgagagaactgtttctaatggaatctgtcctggacacttactagtagtaagctttgagacagaatgaaattggagtagaataaaatcccacctccattcacctaaatgttaattgtttcttggcaaagtggaagtccagattttagggcaaactgaaaagtacatttaaaatgtcaatttagcttttgtagttgtatgtagggtagtattttttttttttctgatcttaactttcctctgcattgatataaagtgcctgtgactttactgtctagttttttttttacatcttttttcaagattagaatatatctctaaatatttcctaaagttaacttattaaaagacatgctaattttagtaagttatttcttctaacatagctatacttcaaaagcagtatttactgaggaaggattttattaaaaaaattttttttcccagttagatggttttgcttgaaatactgcaggaacatggtctgctgttttaatacctgctagccatgttgtttgcgttgaaatcattcatatgtaaaagctttagaggaattcttgttttaatctttcggcaaacaattgcttgtcaatgtgtttgaacatacatcatctctgtttttattgaagatcttttggggttatagttgttgccttaaacatatttgctgtggaaactttgctatttcttatggtcacataacataaaggttaagatctaatatttctatcatttggtttgggccgcatctctaagaaaagatgtcagtgaagttgtacattgtcaaaactgattccattaacccgtgaatacttgtctctttacattttttaatgtaaaattatttggttatagcttggacagagcacaacaccgatttaataaaacttagtttccctcgatattaaagtggggcacttctctgcatcttgcca

SEQ ID NO: 45788 - DNA, 1109 bp, Homo sapiens
acaccctactggctggttgccaactcctggaacactgactggggtgacaatggtgagtggctgcccccttcctgccaagaacagtgaattgtgagccacaccccgtggccatctcggctttctctgttctacccaccgcacagccttaaaccctggacctacggccaggctgtgagctcctcctaagtgccaggcagtcaggagttcccttttgctgtgagggcagactctgagcagcttcagagccaacgcctgcaacagttcccacagcatcgcgccagatcctgtgatgggaagggtgaccgggcagggggcttgcccgtggaggtgtgccccacggctccagaagccttgtggtgttgaggactgtgctagtgggccaacagcaggagtggccagggatgagtgacttaaggtcttttaaggatgagtctgactatattggttgacccttgtcacactttaaaagcaccttactttttattcccaggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctca

SEQ ID NO: 45789 - DNA, 1068 bp, Homo sapiens
tgcccgcctcgcctcccaaagtgttgggattacaggtgtgagtcactgtgcccagccatgtgtttagacttttaactaatctcttttttagtttcaagccttatcgtccgcctctgtagaccactcctgtgcctgtttcctgatccttccaagggccattgtattccctgtctgctgcccctcttttggattcttctgcacatttttttgttcatgcattcattcatttattgtttgattaatgacagggtcttgctttgtctcccaggctggtgtgcagtggtgcgaccacggctcacggcagcctcagccacccagatgtaagcgatctggttcccacctcagcctcccgagtagtaagtagctgggaccacaggcggtgcccaggtttttttttttttttttttttttttcgttggtagagacagggtctcactgttgccaggactgctctgaaactcctggtttcaagtgatccccttgcctcctcccacttaggccttccaaatgctgggattacaaggcatgagtcacctccaggcctttttgtacttttaaaactctgcatcagtgtataaacaatgttattaaagtttatatgacttcagttacactacatggatcctttttcactcacggttgtgagatttatttctgttgctacatccagttctagtccatttgtgttaagtgcccagtgtgtttatctactgagggacagttatgttatttcgtgttcactattatcccatgctacaataaatatcctgtgtctcccagatacttagaagagtttctgcagggcacatgtgggagagtttgtttctgggtcatgaggtgtgttcatcttccatcttgctagatgctggcaaagggttctccagtgtggttgcatcaatttactcgcccagcagtgtgcagagttcctgttcctcacatttaccaacactagatagtaccagactttgatttttgccaatctgatgggtttgaagtggtacccctgttttaatttcatgaccagaaattcaaatttaatctttgctgtaggacaacagtaacccactt

SEQ ID NO: 45790 - DNA, 1052 bp, Homo sapiens
cccacactgccccagggagtgccccattccctctggagctgtgtgaacaaggctctggccttctctccaggaataccaaagggagcacagagaccagagggcaaaggaggaacggcaaaaatggagtgcctaaatcacctgcacaccttccgtcctcagccctccggtgtgactttggatgacttatgagctctaaatctcagctcctcctcctatttgaggaaacaatgcttatccccaaggattgttatgaagcttaaatgacacatgtgcaaagcacagggcctgaaacaaactagatgcttactaattgatacttttgtttctttatctatgaaaggataaaaaaatacttcccaatggggctgtgcaagatggatcacacctgtaatcccagcatttgggaggccagggtgggaggaccacttgaacctaggagttcaagaccagcctaggcaacatagcaagaccctgtctcaaaaaaaatttttttaatttaaaaataatttaaaaatttttcaaaaagctttctgatgaacactactgctgaccattccatgcaattctgagtagtgttattccctctagagcatcccaaaatgccaaaattcattcatttattcattcattcaggtattcttcttacaaacatataattctcgcctactatgtaagtagacaccctccaaaaagcctggaggtctgtcctctttgagtttacagcatagtagagatgataaactaaaaaataaataaaaataaacaagctaataattacaaaaatggcaattgtttggaaggaagagtgcagggaaagatttatatatgtacatgtgcgaacgtgtgtacatacatacacacatgtaatgtgctgcacaacatacgtaccacactcagatcaaggtatcagatgttcccaccaccccagaaaagtccctcatgccattctcaggcattaaccctaccagagacaactactactctaaattctgtgaccatcagtgaattttgtctgtggctgaacttggtgttaatggaatcacactgtgtgc

SEQ ID NO: 45791 - DNA, 1084 bp, Homo sapiens
ttcagtggtcatcagtatatcccactttaagaatccactgatagtcactaaatggaacactctaaaggaatgaattttatagtaaattctatctcaataaaaatataaaacaccaacattcatggaggaaaggtgtaattctgtataattatataaatgatggaatcttgaaatacattttaaaacgtgctctgaggtaatatgcgcctcagaaacgataaataagtcaattgataatctaaatctcaggtataaaccacagtttaatatgtatttattataaagtattggtggattttaaaattaatttgggaaagttagattgattattggtgttggtaaaaaaaaatttcatcgtatggattatttaccatatggttgtttataacagactttaatgatccattgtgtttcttttatatcagttgtaatgtctcctgttttatttctgattttatttatttggcattctctcttttgttcttggttagtctagctagcagtttataaagtctgtttatctcttccaaaagtcaactttttgtttcattaattctttgcattttttaaatctcgaattcgctgagttctgctctgatttttattatttctttccttctccttagtttggatttcattttttcttgattttcttgttccttgaggtgcatagtagcttgttcataatcttactatgttcttgcagtaggcatttattgctataaaattctctattagcactgtctttgttgtattccataggttttggtatgttgtgtttccgtttgcatttatttcaagaacatttgttattttcttcttaattttctcattgactcaatggttgttcagaagcatgttgtttaatttccatgttatctgtatagtttccaaagttcctcctagtattcatttctagttctattctatttttgtctagaatatacttgatataatgttgatttttcaaaatttgttgaaacttgttttgtgtcttaacatatggtctagcctggagaatgttctatctgatgaggagaagaatgtgtactccactgctattggatgaaatgttctgtaaatg

SEQ ID NO: 45792 - DNA, 1113 bp, Homo sapiens
ggcgtggcggtgcacacctgtgatcccagctacttgggaggctgaggtaggaaaatgggttgaacccgggaggcagaggtagcagtgagctgagatcgcaccactgcacttcagcctgggtgacagaacaagattccatctcaaaaaaaaaaaaaaaaaaaaaaccacacacacacacacaaaccaaaaatactgatgcccatgtttcatccccaagagattctttaataattgatctgggctgcagagcccgggcattgggggttttaaaatctccccaggtgattctgatgtgcagctgtggttgagaatctccttctggaatgaacttgttcatgttttacttgtgttgttttctagcctgccaatgtctttctgtttccgttcacatctttgggttgtaatttttacaatgcagtcttaacaaccagctgcctcaaaatgcactgggatctctcgtaaccaggtagctccccatctctaactctgacctgctaagacagaatcttgtgcgtgtggcccaggactgtacatattgaaacaggcaatgacctgggaactatttctgaacacccctaggtttcccgtgtttgccctttcctttcacatttggacccctttgtgtgctgaccactgggctgtttcacatggacataacataaaaaagacaggccaggtgcattggctcatgcctgtaatcccagcactttggaaggccgaggtaggcgaatcgcttgaggccaggagttcaagatctgcctggccaacatgagtaaaccccgtctctaccaaaaatatgaaattagctgggtgcggtgatgcacacctttgatcccagctactcaggaggctgaggctggagaatcccttgagcccaggaggcagagactgcagtgagccgagatcgcaccactacaccccagcctgggtgagagtgagactcttaaaaaacaaacaacaacaaaaaaaaaaaaacaaagagacagagatgatccttcctttatggagctctcagtaaaacaagaaagctcatgatgtcctgtcatttgtcagaaatatatttggtatatgtagctggggtcacatgcttgacatgcctattgaaagcttctg

SEQ ID NO: 45793 - DNA, 1046 bp, Homo sapiens
tagattgattccatatcttggctattgcaaatagtgctgcagtaaatatgggggtatgggtatcccgttgatacactgatatctttttttggatatatacccatgagtgggattgctggatcatatggtagatttgttcttagttttttgagaaatctctgtactttttttcataatggctgtaccaatttacattcccaccaacaatatacaataatttccttttcttcacatgcttgccagcatttgttgtgctttgtctttttaatacccattctaacaagtgtgagatgatatctcattgtggttttgatttgcatttccgtgatgattagtgatgttgaatattttttcataaacttggtgatttgtatattttcttttgagaaatgtctgtttattttttgatagtttcttttgctgtgtagaagctctttcatttaattagatcccatttgccaatttttgcttttgtggcaattgcgtttggcatcttcaccatgaactctttgcccatcactatgtaccagatggtattgcctaggttgtcttcagcgtttttatagttatgagttttacatttaagtctgcaggccatcttgagttaatttttgtgtgtggtgtaagggaggggtgttgtcttttcactctgttgattgttttaattgatatacagaaggaatttaatttaatataatcccatttgtctatttttgttgcttgtactttttaagcgttagccatacaatctttgttctcaagcgtttctcctgtgtttatttctagtagttttatagttgtggctgttacatttaagtctttaactgattttgagtttatttttctaagtgatgagagataagggtctagttttattcttctgtgtttggatatctagttttgctggcaccatttaatgaagagggtgtcatttattcaatgcatgttcttgacagctttcttgaaaatcagttagctgtaaatatgtggattcatttctggattctttagtctgtttcctttgtttttgtgtctgttttaatacc

SEQ ID NO: 45794 - DNA, 1108 bp, Homo sapiens
aagaaacaacaatgaaagagcaaaattacgctgatgtggtggtgtatgcctgtaatcctagctactcaggaggctgaggcatgagaatcacttgaacccgggagacagaggttgcagtgagccaagattgcaccattgcactccagcctgggcaacagagtgagactctctccaaaaggaagaaaaaaaaaaaaagtatccgggcttggtggcatgcgcctgtagtctcagctactctgaaggctgagacgggaggatggattgagaccaggggtaatttgaagctgcagtgaactacgattgtgacagtgcactccagcctggactgcagagcaggaccctgtctcttgtacatacacacacacacacacacacacacacacacacacatacatacatacccaggttctacctctggtgattctgactcagtagggtggggtatcccctagggatcctgctgtccagcctggtctgggatccacttttcattgggaactgagacactggctgtgagcctttctgtcctgagatgtagaggtcatggcgatgcaggttcaagcttaaggagacctgactgtgcgttaggtattgtgctgaacatcatctcttactctcacagcaacatccttagaaggttaatgatgtatccgtgctctacagatgaggaactgagctttcagaggagattagcttgtttaaaactattcttcctattggaaactttgtaccctttgaccagtgtctcctatcccctccctttccttcaccccagcccctgataaccactgtcctactctctatttctgtgagttcaacttctttagattccacatacaataaaatcatgcagtatctgtctttctgtgcctggcttatttcacttaacacaatgtctttcaagttcatctatgttgttgaaaatgacaggatttctttcttttttaagggttaatagtattcctttgtgtgtatatagtacatttgctttatcctttcatccactcatggacacttaggttgattctatatcttgggtattgtgaatagagctgcagtgaacataggaatttagggatcccttcgacatattgattttgattttttt

SEQ ID NO: 45795 - DNA, 1056 bp, Homo sapiens
ctgcctcagcctcccgagtagctgggattataggaacctgccaccatgcctggctaatttttgtatttttttagtacagacagggtttcaccatgttggccaggctggtctcacactcttggcctcaggtgatccacctgcctcggtctcccaaagtgctgggattacaggcatgagccaccgcaccaggccaattttctctatcttcgattctagccatgcttatgggtatgaagtggtatctaattgtggttttgatttctgtttccctgatgatgaatttcattgagcatcttttcatgtgcttattgaccacttgtatgtcttccttggagatgcgcagtattttcatattcaaaaatgaaagcacaggtccacacaaaattttgtacatgaataattacagtagcatcactcctaataacccaaagagagaattaatccaaatgcccatcaccagatgaagagatacacctattgttgtctacccacatggtggaatattatttgatcacaaaaaggaggatagtacatacgctacagcgtggatgaaccttcaaaacagatgaaagatcacattctacatgatttcattcagatggaaatctacagaaataggaagtcgattagtggttgcttaggggtggtaggggcatgggaggatggggctgttagctaaagggtatgaggtttctttttgaggtcatgaaatgttctaaaattgactggtaatgtttgtgtatatctctgaatatattgaaaaccattgaaatgtaaaaaatgcaaagaaaaaacagcccaagttgcaattttattcaacgcttgattggctttaaaaatagattccaggctgggcatggtggctcacacctgaaatcccagtgctttgggaggctgtggtgggaggattgcttgaagccaggagttccaggccagccttggcaacatggcaagaccctgtctgtacaaaaaaagaaaaaataaataacagctgggtgcagtggtccacacttgtaatcccagcactttgggaggcagaggcgggcagatcacctg

SEQ ID NO: 45796 - DNA, 2280 bp, Homo sapiens
ttttttgggaaatgggatcaagagggtttttgtttgcttgtttgtttgagacagggtctgtcgcccaggctgaagtgcagtggcgtgaccttggctcactgcagccttgaccttctgggctcaggtgatcctcccacctcagcctcctgagtagctgggactgcagatgcacaccaccatgcctgactaatttgtctattttttgtagagatgaggtttcaccatgttgcctaggctggtctcaaactgctgggctcaagcagtcctccatccacctcggcctcccaaactgctgagattacaggcatgagctgctgtgcctggccaaggttttttttttattattattacaaaaacttttcaataaacataaaagtagagacaccagtttaatgagctatcatatacccatcacatagatttaaaaactattaacatttgcaatatttacttcatttgtttttctgaagtatttacaaaatagttgacagtagttatgtaattgcatcctgatattcatccctacgtaatttactttccctctaaaaacatgagggcactttttatatgatcattgtcatacctaatcaaattaccagtaattccttaatatcctctaagatcaactttacattcagatgtcttgtcctcaaaatgtcatttgtgattatttttttctttgaccaaagatagtaagatctcaagatttaatgacagagattccatgttagccctgatgtctaagctctgtggtccattgtggctttacttgaaagtctgaggctaggcgtggtggctcacatctgtaatcccagcactttgggaggccaaggtaggcggatcatgaggtcaagagatcaagaccatcctgaccaacatggtgaaaccctgtctctattaaaaatacgaaaattagtcaggtgtggtggcgggtgcctatagtcccagctattcgggaggctgaggcaggagaatcacttgaacccgggaggcagaagttgcagtgagctgagattgcaccactggacgccagcctgggtggcaagaacaagactctggaaaaaaaaaaagtctctcactgtggtctcataataaaaggacactccatttcccatctggtccctgctccttaatgttagccccctcctgtggggaggaaggggtgactttcagcgcgggttcaaatattcccagggctggctctgatcccaataaagcccatcgtcatgaatgaatgcttcccttgcaggatattctaagtattgtaaatagtgcacgtggagtgtcctcatgatgcctgggattgtagtgaatatttataggtttcttttagtgccttttttttttaagtgttttctatagttccatgtttctacaacccttaggaacatcagaatcatgtgtgtgtgggtgcttattaaataaaagagttcctggagctcactcccagtgactgccagtctgatgattaggggcttagctaggacctaggtttgcaaaagctcccagctgatctcatgcagccagcctggctctggctctggcgctgggagctgggttgggaactagtctttggtgctattctgctgatacttcaagttgggctctttgactccgtcttgtattgtcatcacttgtattcaggtctgttcttcccctggattgtaaactccttgatgtctgggtcatctcagctcatgagctgagctttcagtgggtgctcagtggaacaggtgctgaatggagtccggctctagggaggccagggtgtgttggtaagtgagagactaaaatccttttaaaaagaatctttttgcccttcagttgtgtttgccatgagttaatgtgatttactctagtggaagccagtgcagcttaagtggaggtcttgccctgaaatggagccaggttatggatcagcagagctgccaaaagcgttttgggggaaatgtttctgtgtcaccctcagttgattgaactcaagttttcactcccgtttaacaccatgtgggggccattctgacttctgcggagtgggtatgatcagatcttctgtaaaagtgtaagtgagggggctgggcatggtggctcacacctgtaatcttagcacttgggaggctgaggtaggtggatcacttgaggccaagagtttgagacaagcctggacgacatgatgaaacctcatctctactaaaaatacaaaaattagccaggcgtgatggtgcatgcctgtaatgccagctactcagaagcccgaggcaggagaatcacttgaacctg

SEQ ID NO: 45797 - DNA, 1050 bp, Homo sapiens
gttcgagaccagcctggtcaacatggcaaaactgtctctactaaaaatacagaaattagccaggtgtgatggcacacacctgcaatcccagctacttgggaggctgaggcaggagaatcgtttgcacctgggagacagaggttgcagtcagccgagattgaaccactgtacttcagccagcctgggtgacagagcgagactctgtttcaaaaataaataaataaataaaatagaattctgaattttatttttaataattatttttgtaaagagaatgtcttgttttttggagttgttgaatttattgaattggcaaaaattatgtacaagagggtatacaacatgatgtgattgaggtatgtatacattatgaaatggctaaatcaagctaaataacatatcacctcccagacttactttttggggtgagaacacttaaacaatctactctcttagtgatttccaagtgtatgatatgttgttattaactataggtaccttgttgtcccatggatctcctgaacttattcttcttctctaaaaatgacattctgtgtcctttggcatctgcccacttccccaccctggcaaccatcattctactctgcttctgtgaattcaacttttttcttctctttttttttttcttttttttgagaaaatctccttctattgcccaggctgtagtgcagggttgtgatcatggctcactgcagccttgacgtcccaagttcaatcaatccttccacctcagcctcctgagtatctgggagtacaggcatgcactaccatgctccactaatttttgtattttttgtagagatggggtattgctatgttatgcaggctggtctcgaactcctgggctcaagcaatctgctggtctcagcctcccaaagtgctgtgattacaggcgtgagccaccatgcctggccgagttcaacttttttagattccacatgtaagtgagatcatgtggtatttgtcgttctgtgcctggcttatttcacttaacataatatcctccaggctcatccatgttgtctcaaa

SEQ ID NO: 45798 - DNA, 1068 bp, Homo sapiens
gtggttggttttccatccttttgcttggcaggtttctgctgatagcttcaacctcaagagtcccattatacagacactaatagcacctcctatgtgtcagtctgtagtgcctactatgtgccaggcattggagataatataatgatgaacaagataaacatgacatttggaaaagagagtctacttcccactctcagcccaccccaaagagaggccagaattgggcttccaaagatctcagatgcccttgcatcacctccctgaagagggcgggtgaagctttggtgtctgcagagaatttgtctggacaatcccccaggtttggaagaatgggaaggagctgccatctgtgtttaaggtgagaattgggggagtggctggatatcagcagaagccaagatgaagagaaggtttttgtgagttcctatgcatagtggagacctgttctagtgagggtccctggggctgagcctgtgggtcagtggaatgatgctgtgaggagggtcttgctatagcagatggcccaaagaatgttgatggattgtgagcagctggaagaatggagagttcaggggatgtagttcctacctggctttccaacagtgtgtaagcccagaattcttacataagcccatggagaagggaaaggaatgctggtaacgacaagattgaattctccacctgccaggcatccagggactcagagcagatttaagtgaagttacagaaataggaatgtgacatttcctacatccgggtgtgctggagcaaatgtattccctctctggtttgtggggaaggagaatgctaacagacaagactctaggttttcactcttaaacctggtgcctagagatgcattttctactggatgcagacagaagctccatatagacatatccatcgctgtatctctcatgccttctgttctccctaattttccctttttaacccacagaggaagaaagttccagcatcacttctggcctctcaagagtgagtttggtggccaggttgggttattcatgcctgtaatctcatactgaaggggtggcctgcccctccaca

SEQ ID NO: 45799 - DNA, 1033 bp, Homo sapiens
gaaaaggctgggcgcggtggctcatgcctgtaatcttagcactttgggaggccaaggcgggtggatcatttgaggtcaggagttcaagaccagcctggccaacaaggtgaaaccccatctctactaaaaatataaaaattagccaggcagtagtggttcttgcctgtaatcccagctacatgggaggctgaggcaggagaattgcttaagcctggaaggcagagatttggtaagctgagatcgtaccactgcactccaatgtggatgaagattgtttaaccaccaccaaaatgggttctgagtccaactattaatatgaagatgacatccattgtggtcttgtacattttgttgcctttccgggatgaaggacattggtgaccatttgtttcctctggagcggtcgattgatcatgaacttcctggtccagatagttgctgtgtcattcatcatggtggttgatcctcaggtagttagggaggaaaataaacaagaagttatgtatttaaaaccacgtttcaattttagacctgattaattgactaaataaagggcattagcacttctacttcctacagtccctccctttacctctggaaactagtgatttctaggttgttttatgttgttaaggttggccacctttcctttctgttctgcaatcatagtcctatttttaaatggattcacctctcatcactagccttttgtcatggtcattcaattcacaagttgcttattttttaatttcttggctgactaaattttattatgaagacttttctttaaagagctcagaaatactgtattctttaagttcttgaacttgtgatggtgtttattgcctattttgattgggcaataatttagctggctataaaattcttggattatactctatttcccttagaaattataggcacccatccactcacatttcattgtgctttcttttttttttttttttttttttttttgagatggagtcttgctctgtcacccaggcttgagtgcagtggtgtgatcttggct

SEQ ID NO: 45800 - DNA, 1079 bp, Homo sapiens
aatgcttatctttgtaccccgacagtcttagattaagaggactttgtaccaccctgacgttacaggcggccatgagtccagccacccctgaaatgtacacacgtctgggctggggttgcagcaggtgagtcccaattttgcagatctttggtatcaggagcacaacccaggattttgagtggggtttcctcatcactgtggctgggcactgggctagtgtgctttctgatttttgtatggggaagagaaaggagggaggaaatggcaacttgttgccctgttctaacattttcctaagatgggtctccaggtaagggcttgggatctcaccttgcacagcttacaaaacccagtgaggccggctgtcttggcgctgccactctgagtgatggagcccctaaatgactaggaagggagataaaagaatggtttctgcaagctcaagaactggcgttattgaaattaacatttcccccaagttttacaatgtctaggcacgcatatttaagtgtctgcctcaaaagctcatgctaataacgagatggtgcatttcatttcctttttttgttctctgagcaacatgcagcttcctgcacagccctccttgcaggcaactgcactgaggtgacagtcctcctggctgccagcaaagatccccaggacctctgagagccctgtattctgggggcagcctttcccccttctatttggccccagctggaagggggcagattacccacatcacagcacaggtctcccgccttagcttctgtagggagtctggctccctctgaccctctagacctcactagctgaggatcagagccccggggcaggagccagggccagggggcattggggggtggtttgagagtgcagctctggaggggggcagggcgggccaaggaaaagctgctcaggggagactgcaaagagatggcagagttaggacaagagggccaggcatggtggctcacacctgtaatcccagcactttgggaggccgaggtgggcggatggcctgaggccaggagtttgagactagcctggcctacatggtgaaaacctgtctctactaa

SEQ ID NO: 45801 - DNA, 1045 bp, Homo sapiens
tttgatttagaggcctaaaagggaaatcagtcccacgtgggtagataacaaaacactctccaccttgggctcatggagtggaatttgaatatgaagccaaaactcctatctctgcctgcttcactaattacataaatttccttgctacattctgcagctgtttgtatgaatacagcgctggttcccagagtggtccatctcaacgcaaaggttcaggggctcagggcactcatccctgggctgcaacccagactccagtgttagttgtatgtctgttgggtgtaccaggggaccctggatttgtttctctctgtcataaaatgaagctaaacaaactacctaacctgtcttatgatgcagaggtgtcaaagaaaaataagacagaggaaaaaaagaggagagatgtgtggcgggcggggggggggggggagggtggtggttgtgaacattaactctagcaataaagattactgaggaaccttaatgaaaagcactggaagaaaagcagggctagatctggagggaagtatctgtccctccctttaaaatgttccagatttcactatgggaaagcttcacagatatcacaagatactgtttgacccgaggaagaacaagcacatattactggatgcatttcctcttctcttacctgtctcagaacctctcgccagccttgtctaacaagattcacctttgttttcataggcgtcacaaagttagggtcaaggtacaattgaataatcatgaattttccccaaatacacaaatgatttcaacacaaccgtttctaaattaaaatcaactgtagttactccaagtagagcaaatgcattgtaaaatactgtttcttttgtttattatgtagaaagatgaacaagtttcactgaatatggctcccataaataagtgtacacttaacaaaagtcagacacacaattaacccctcttgatgatatggggtgattgggcggggaccccagagatacactatggttaaaaacatgggcttttatatgacacacagatgaaccaataaaaatgt

SEQ ID NO: 45802 - DNA, 1030 bp, Homo sapiens
tattgtacagttgggtccatacagcagacatggctaagatacataaaagatgagactgcattattgaagaggcatcaaacagggaaaaggaagctgctatgtggtttctttcgccggaaatgaaagcctctcaagtttcatatttaattcacgcaaaaagccaactcattagtgttttttaaagtagcatatatattcaaatggtatatctttggatttaaaaccaattattttctaacatcttttcaagattctgtaatttatgggttctctgaaactctgatgagtcctgattaacttgggaagacattattctttaatctgtatgtagaaatatagaggcttctgttgttatttctatatattccaaagatataaagtgtattataggtgacaatagtgcccacagaggtgtataatgcacaactgtgcacctctatacagtgggcccaggtatatgtacacgtctgtgtagtcattttgctttcctgagctacatacagccaaaaatgtctgaagaaaattctgttttctcagagcctataaattccttatctgtgtatatttaatgttgatattatcatgcagaatttttattaagtctttcactgtatctttgagcgagactaaaatgaagagcagtccattaatatctgtcttcaactcccactacattcaacatctctttttgaaatgtgaggattccaaaagaaaattaagccatttaaaaatctatacatagcaaatagaaagtgatacaaataaaaaatttaaacggcgcccttcagtaaagcaaatttggatgagatcaaatgaaaagagtgaaagcttaagctagaaacaaacatttagtcaaacggaaaacatttctggacttctgcttttcagacctgtctgcctcccaagctgttatatggtgatattgaaaatgctttacatatcacagagataactgaaggattaaaggcatgtttgaagttcttggaactattctaagaaagccactcgagaaagcacaagcaccgtcaat

SEQ ID NO: 45803 - DNA, 1046 bp, Homo sapiens
gggaaagcaggctccaggacttgctaagattaaggtgtttgcattcaattgctattttcggttaaaacaggtgagatgatttactaagtcttttcagtttagtatgatatggtaaggaaacagaaaaaggaataaaatcaattgtaaatattccacatttttgatagctgttttccctttaatctgaattttgtgtcatatgtccatgtgcatacacctatgcacatatctaaacaccacacatacaatcacacacacacacacacacataatatgtatttttctagaggagaaccaccacttacacaagaagccatgttaaagcaagtcctctcacaatgaacgaggacatccaatgacaatttttaaaaaggcattgttactctctgacatctgtgcaagaagcaaagaaaattaccaagaacagcttcttccttcaaatctcattttagatctatgtctattaatttatctacaaaatttgcatgactattcttatttttaactgatttcacttcttatgctaatgaattccatatgagctttcttacttgatattaatggctcaactttagttcttacaccagtccaggagttaacccaaattctgtgtatgttattgcaagttttggggacttgatcatacgatggcttctcatttcccttaatccactggattactgtttgtgaacctattctagcttcattataatgtattttaaggtacatgatactttaacagtgaacacagaagggtaggattagctttcttgtttgggttcttgataaaacttaatgttttctataaataagttctgagccaatttaatagacatgtggctataggtcaagacactcttcttcctccctttcctgtgtcattactatttggtcagagaccttaagagggcacgtgtaatggaacagttctttggagcatgacgtaaatcttttgctcatttttccacatgatgatctttcaaatatttgaaagcaagcaagagagatatcctcttaaactccaggttatatatccattattgcaa

SEQ ID NO: 45804 - DNA, 1052 bp, Homo sapiens
gggccaggtggcttatacctgtaatcccagcacttttggagaccaaggtggaaggatcacttgaagccatgagttcaagacacctgggcaacatagcaagactccgtcattacaaataatttaaaaattaggcagctacggtggcatgcacctgtagccccaaatactcgggaagctgaggtgggagggttacttgagcccaggtgtttgaggctgcgcgcctgtagtcccagctactcgggagactgaggcaggagaatggcgtgaacctgggaggcggagcttgcagtgagccgagatcgcgccactgcactccaacctggacaacagtatgagcctctctctaaaacaaacagagtcaggcaagttagtgcatcatccttaatgaactggccattctcctctttataagacaaaaagacttgtcattccaaagtgctataaggttgtatttttaatcatattttttaaaatgacatactgacttgttttcaaagtttaaaagtactaaagcctaaaatatgccactatttaagatagagtgatctcaactgatttagaaatcagaatgaactaaaattggaagttatactttaaatatttcaatttacacatagattaccctcagagtttagcacatatgggctgtagaactgaaacacattgtcctaagtcattgttgattccacagaatttcagccaacaacagaaacactcttaataaaaacaaattatcaacttctagacaatcaaaatcaccaagacatagtgaaaagacatggcatattattgcttggtgaaatcctggttggtgatttttgaaagccctgataccataatgtaacccttctctcttggttctttctttctttatgtgctcaggtaatgagcacatctaggcaattgcacacacacacacacacacacacacacacacacacacacacactcctcaggaatcacatgacttcaaagaacttttctttataaaagattgaagattcctgagttataggttgctggtgtaaaagtcataatataacatctgattg

SEQ ID NO: 45805 - DNA, 1049 bp, Homo sapiens
tttgaaaacgcgaggtcacctggactgcccctgaagggaagacctgctatgtgacccaggagcagcccggcgcggacccaggtgagtcattgggttgcacaggaagcgagacgcctccggatagctgtgctgcagctcgcgcgccccgcgagggtgtcgccggcgcagggtaagtctttccagatgtggccgccgcgcgcgcttggccgcgggccaggaggccgcctgcagttggcgcttcccggggccgcagtgccagccgcaatgccggcctcctgaaggcaggcgacagcctgcggccgggagcacagcgcggggcggagtaccgaggcatggtcgcggcgcccgggctgcgctgaaggcgtctgcgagcggatgggggaccccaaggcccacgtgatggcgcgccccctgcgagcccctctccggaggtcctttagcgatcacatcagggactccacggccagagccctggatgtcatttggaaaaacactagagacagacggctggcaggtgagaggcagagggggattggagaccgggggtgaggggtattaaaaagaaaacaatttactgcgaagacgcagtgataagcttggttcatgaatgatctcatcagctggttgaagtttcattcttgtcatggcagtgtgttcggtctccctttctctagtatttaaccttgatggagtgttgagatttttgtgtgtttgttttgtgtaacgccgctctggttactggtctgattatttctagataaggaattatgagagttgtggggttttttaaccttcaaaagagaagcaaggtccttgtgactgtcaggaaatcggtagtgatgaacaactgctgcaaaagccctgagatcctcggggctgtctcgggtcagctttggagctgaagctgatcaggtgtgaggtgccctggcgtgtgtgcaggagaggggcctggcaggtctgtgtgtcagtggagtgatgggcgctgcccagtgaaagcctgctggtatttcctctggcagcctggagctactctcggttccaagacggtg

SEQ ID NO: 45806 - DNA, 1034 bp, Homo sapiens
aaaaccatagtgaagcatttagcatactcttaatgattattcataatggctttgttttgtaaaaattaagtgaaaactacaaatggatggtgggaagtttaagaaaatatgaaaaaaatggtgttatactagcttttcagttttataattattactggattgatagactatgagtgtacttgataaatattaccctatatgtggtctgcttccttcccatatctaggagagtatttacctgtcatatgccctaaaacatgatgaaaatacattttcccaattaggatcttgttttctattaaatgatactttttccgcattcaacaaatacattagtaattcacattctctgtttcttccccccaatctttataagattcacctttacatactaaagtttatttttattttggtcagcgtctaagtttataatttgtgaatttaggccttgtaagatttttcttcttgacaagcaattttttattttttctagggtggattacaggaggtggcagaacagttagagctggaacggataggaccacaacatcaggcaggatctgattcattgctcacaggaatggcctttttcaaaatgagagaagtatgaagacatcactgcctttttctcagttggttgttaggttgagaacattaaaaatcttgtggccaaagattttgggcaacaagtacctactaagtaaagatataattagagataccatatgagtcacatccaccacacttaaaagtattcaaaaataagtcatcttgaaatgtagttcagaaggaactgggagaacatgttcatcatagaaccaacaattttaaaacataaactacctgagaagtcatgtaggtccaaccatattatttctcaggtgagaaaacaggctaataacttccatgattaaacacattactagtgggagaactccagagttcttttctgactcccattggtgctcctcctacaaggcaaggaatctttatattaggtttattctagcatgaccccttttaaggtttaaact

SEQ ID NO: 45807 - DNA, 1065 bp, Homo sapiens
cgatgaggcaagctgtctttgtagtctaagtaagaaagatcttcacatacgtagatgtaaagaaagacaggaatattaatctgatgtttctttgtaaagcaggtatggggtgaagccatatgctgcaagtagacaggtgaagggtgttattggaaacttaagagaaaaaggtctaaactacttgtatacctataccttggcaaatggccaagaatgatgtgcacctggagaagaatctgttttttatccctttcattgcttatagttgctaaggcatgcctcagtgtgagcactgggacctgatgaatgagattctaattttttgaggtacatatttttagcataggaaagctgtggtttcactggaaaaaaaaaaaaaaaaagaaactacttcattgggtttattctgttacccttcctaaaggattttccaggggagactgacttttacgtgattgttgtggtttccttctcttttaaaatatttccattgttttgtaatttttcagacatttagaaataaattgatttctaaaggactaaccataacgatactttttggcccaagtgaagtgaaccccatggtttagatttgtcaagtgtttaataggaattccttttgccaagaggtagaaaccagtattcttacaatttaaaaagtaaataaaaaaacactttttcacgtattctcaaaaatgtatctgtattttggtaacttttttgttttaatatttcagatacagatatattttggaaacttttaatatttcagatacacatatttgtggttggaaatatatttgaggttggagatggctttctttttggcttaagtgaaatcttgaagaattggtttatatttagatttcctggcttgattttataaggcagtcttttaggaataggattgttggcagaagaaattattgctattacagtacagtcctttatacagtgttgcttattggaggcatttgcaaggctcatttgtgaaaggaggcatctccttctttaagatgaagtgtagtttaactcatccgcatgagacattttccactgggtctc

SEQ ID NO: 45808 - DNA, 1023 bp, Homo sapiens
atgctaacaatagctgttgagctaaaaaaaaaaaaaatctcaaaatgttttaagaaagttgacaaatttgtattgggctacattcacagccatgccgggccacatgtggcccactggctgcaggttggacaagcttgatttacactgatgttaggagatgtttaaggagaaggatacagtgaaaaacattaggtagaagaagtcatttggaagataaacgagtaatgcctaatatagagagagcaccgtgaagagaatcttggaaatttggaagaaagatcaaaattgactttttaatggggtggctagaatgagtgtcagttacagtgctagacactagggatttagtactgaggaaagttggtcgtggtctttataactcagtgttttgtaactcttctgttttctctctattgcctaagtctaagaattacaattgtaacgtatgggaattctctccaaactgaatttggagttgatacatccatgaaaattgaagtggagtactgatgagctgtgaagaagagaagcattctgtggaaataatgtcactgataaagaggattaaaacaaatttttaacaaattctcacttttaggctgggcgtggtggctcacgcctgtaatcccagcactttgggaggccgaggcgggcggatcacaaggtcaggagatcgagaacatcctggctaacacggtgaaaccctgtatctactaaaaatacaaaaaaaattagctgggtgtggtggtgagcacctgtagtcccagctactcgggaggctgaggcgggagaatggcgtgaacccaggaggtggagcttgcagtgagccgagatgccactgactccagtctgggcgacagagtgagactccgtctcaaaaaagaaaaatcacttttggtgattgcagtaattcaataggatagtagaaattacagggcaccttgggtttggtggtaacagaaaggatgctgatgcttcatttaaggaaagtggcagtgtaaagaaggagatagagagtgccat

SEQ ID NO: 45809 - DNA, 1046 bp, Homo sapiens
tgcctactactttacttccaacagtatgacaggaagcttttaacttgttggcattattttatgttttgaatgttgaagatagctaataatctaatagctaaaattatcaaattatgagcaaattcatttcattagcactaatggtacaaggagcagataatactttgaatgggacatgagacatgcctgtcatcttctttcctgcaccccagtccctgttttagggaacctctcatgctcccttctcataatccactccctcagcccagtcgactgggcagaggatcacatgacaccaattcattttgaattaggtagtaatctaataattgaatgttgaagatagctaatgttgacgacagctaagaatttaacaaccaaaaaaacaaaaaaacgctcttgcttggaagacagccttcgcctacaagcttctagaatgtaaaaaacactgatcctttatatcaattatctaactttaaatatctatgtttaaaaaaatggacgtaaattctgctactgttaagcaggaagattaacagatacaagcttcaaggcacagttacacagcattgaagaataatggagcagaaatcaatgccttactaacactataaccataagtaagtcactaacatctctgaacttcaatttcctctcatgaaaaatgggaatgataaaatccacctcatctgccttaacaggagtgtgtgtatgtgtgtgtgtatgtctcacagatgtttcataaagtttactaacaaaatactatttttaaaatgtgattatttcagacaaattaggtaaatattttggactgtattaaaaggcaagaaactattaagcagacttttttggatttttctttaaatacaacagaaatatcagaacagaacagaaactgtttctcaatttttaaaaatgtattctataatccctgtacgttattctttctttcaacaagtggtaaaacaagtcattgaggagtctatttcaactattaggactagatttatcagctgtattacagaatgatacagatactaccattt

SEQ ID NO: 45810 - DNA, 1050 bp, Homo sapiens
gagtatttgcttcttattggaggagctcttgtgtaatggggccccttagggtgaggccttcgttgcacttcctgctgaaagctgctggtcactaacagcaaaagatgttttagttggatatgctggcttagactgtgatgggaaaagccagaggagcttttaacatgcctgttttaagagtgggtagaaaatcaggtgagggatatgaccttcctagagtgggcaaatattttctctctgttcagattctgtaaatattaaagatttgtctaaaatataagaagcttctgcataacaaaggaaattgaagaaaagacttggaagccatatacctgataaaggattaatacccaaaatatgtcaggaactcaaacaactctataggaaaaaaaacaagtactctgattaagaaaaggacaagggacctcaagagacattactcaaaagaagacatagatggctaacagatacatgaacaaacgctcaacctcaataatcattagggagatgcaaattaaaaccacagtgaggtatcgcctcacaactgttagaatgacctttaccaaaaagatggaagacaacaaagctttggcaagggtggggaggaaagagaatgcttatgcactgttggtgggaatgtaaattagtacaagccattatggaaaacagatggaggttccacaacaaacaaaaaatagaattatcgtatgattccacaatcccacttttgagtgcttactggaaagattgaaatcggtaagttaaagaaacgtctgctctcacattttcgttgcagcactattcacagtagccacgttgtggaatcaacttaagtatccatcattggatgaagagataaagaaaacatggtatatacaaataatggaatgctattcagccttaaaaaggaagacattgtgttatttgtgacaacatggatggaattagagagcattatgctgagtgaaaaaagccaaacataacaaataccatatgttctcacttacatgtgggatctatgacagttaaactcatagaagcagagagtag

SEQ ID NO: 45811 - DNA, 1050 bp, Homo sapiens
gtggaggttgcagtgagccaagatcgcaccaccgcactccagcctgggtgacagtgagaccctgtctcaaaaaataaataaataaataaataaataaataaaataaaaatagttggagaaaaaaaatcatgggtaaagttaaacaattttaaaaactcccttaaccttttagttcccattcccattacagaagtatatatactgtgtttatacacacacacacacacacacacgcgcgcgcacacatgcatatgtatataaaatagatacagatacacattgtatacatatacattatgtatgttttttatatacatgatatacctatacattgtatgtctatgtatttttatatatgtataatatataggtatttgtgtgtgtgtgtgtatatatattttttgttattgctaaccttttctaaatggctttagagccttcgattatgggtgaaaatggttaagagaatcttgcaactaccatgcttttgttgcaagtctacttagtaactataagtttcccactgtagtggcagacatatttcattacatatcagacattcttatatctcatgaatctgagaactaatgtcacactctgtttcgcagaagacacactaaagttattttagtttttttctaattcttggtttatccttgcttagttagacggtattctgcacagacagccaaagtgaacaacagtattgatggtagtaattaagcttcttcctaaaagggtctattgggtggctttctaggtaaacttgaacagggctgaggtcaccctccccaaacctctaattcttcaaaatgcctccacatcttttttttttttttttgcaagtggaatttaacctaaagtagcacctgaacaaaggtgaattttgaatggcactagcagtaaagttgacttggaacaaaaaaacatagatgcattgagcaaattcactgtgtgggtgatggggaggaggtcagatgcagcacacgtctgagccatctgatgtggctattctctgcaagatgctctatgctgttgatgctactcagt

SEQ ID NO: 45812 - DNA, 1048 bp, Homo sapiens
tcacaaggtcaggagattgagaccatcctggctaacacggtgaaaccctgtctctactaaaaatacaaaaaaaattagtcaggcgtggtggcgggcgcctgtagtcccagctactcaggaggctgaggcaggagaatcacttgaacccgagaggtggagcttgcagtgagccgagatcacgccactgcactccagccttggcgacagaccgaggttccgtctcaaaaaaaaaattctacgatgaacatatgaggttttgttttttaaaaacaaacattgtacatgaattaaaagcattactgcttttaatttaaactcttattttgcttattgcaaaataaaaggcaatgtcactgttctttgagagcttatcatcttacaggtgggtggaagttgattgtttttctaattgctttgtgttaattttttgataattacaatttatcttcgtactgaggaagaggatagtgtggaaaaattgggccttaagttgaagtttctacaactggaatagagaattgaacttactacattaaagactgtgaggagtaaaatgaagaaaatgttgcaattaatgctgtgttagggaaagtaaggagataaatataaagattaatattccatattaggctaaggaagattggttggatagagatgcttgaatctccacacaagtcacttggtttaaattttaatcttcttcctcattctttatgatcattaacaacaacaaacaataacagataaattgaaggcattttgtagcatctaagcaccccatacagattatgctagattcttgtctagaatcatgacatcattgttttctaaatcactgatttaaaaaaacacatttctatgcagaccagtggaatttctgtttgtttgaatatactgtgatattacaacatactgacttatgaaacattctgtatcatcctcttttgttatttaagccttagtatagactttacacatcgtttatttttctttgtgtcattatgaaaactcggctcattttgtaggctttctataaaattattctaac

SEQ ID NO: 45813 - DNA, 1025 bp, Homo sapiens
gtgtggggaaattatctcagaattctttttctttttttttttttgaggcagagtcttgctctgtcgcccaggctggagtgcagtggcgcgatgtctgctcactgcaagctctgcctccctggttcacgccgttctcctgccttagcctcccgcgtagctgggactacagacgcctgccaccatgcccggctaattttttgtatttttactagagatggggtttcaccgtgttagccaggatggtctcgatcttctgacctcgtgatccgcccgcctcggcctccgaaagtgctgggattacaggcgtgagtcactgcgcccagctatctcagaattcgtaaccttttgtaggctcttaaagctaggaagacagccatgcagaatgatctaagttctaaagatccccaggatgctgagtgtgaatatatgtggttactaaagcctttatagggtaaaaatgcagaagaaactctgctgtacacatttaggcttttatttccttttaagtttctggtacatcctaatatctggggaaaaaagatagctaatattctatggaatggctttgtttaaaaattagttaaccattatcagaaaactggctcaattggtagctctgtgtttaacagtttaagaaacctccaggctgttttccaaagtggctggaccactttatatcctcaccaggagtgtatgaagaatcctgtttctccacagccttgtcaacacttggctttgtctgtcttttttattatagctatccctactgggtatgaagtgatacctcattgttgtttcaatttgcattctgacagccagtgacattgagtgtcatttcgtgtgcttactggccatttgtatatcttctttggagaagtgtctattcaaatcatttgccagttttaaactgggtcatttttattgttgaattgtaggagttcttgtatagtctgatattagacccttgtcagagttatcatttgcaaatattttctcccaattcttgggtgtgttttcactttctt

SEQ ID NO: 45814 - DNA, 1032 bp, Homo sapiens
ccacctgggcaacagagtgagaccctgtctttacaaaacattaaaaaattagctgggcaagtggcacacacttgtggtccttgctactcaggaggctgaggtgggaggatcactgaacccaagtggttgagggttcagtgagctataattgtaccactgcacttcaggctaggtgacagggcaagaccctgtctctgaaatgtgaataaaatttaattttaatgtgtcgctaatagatgtttctatatttttatgtaattaaattagtttccttaaagtgtgtatcaggatctcttttcataaaaatagtattagtcactaacatgttttgagtgcctgtgtgcgccaagcacagtgctaagccctcttttaaatgcataatctcatttaattcccacaactcctagtagggatactgtgataatcgccattctacagatgaggaatttgagggtctgaaagcttcagtaacgtgtccaaagttacacagtggggtaattggtggagacgggaaatgggccgggtgttctggccccacagtctgtgctcttaaccctggtcctttacgtgcatgcagaagtcttgacacactcctgtcttctttcatggacatatgtgaattcttcattaaaccacatatgtgtgaaggagaatgtggggaaggctggtttgtgctaagaactcttctaagtgctggaatgaagtgcacagaagagacccgttccttccattagggagcttaaattctaataaggggattaagaaaataaatacatttttggattcatgatgatgaatccaaaaataaaagagaaagagccaaacatggtggctcacgcctataatcccagcactttgggtggccaaggcagatggatcacttgaggtcagaagttcgagaccagcctggccaagatggtgaaaccccatctctactaaacatacaaaaattagctgggtttggtggccggtgcctgtggtctcagctacttgggaggctgaggcaggagaatctcttgaacctgggaggtg

SEQ ID NO: 45815 - DNA, 1050 bp, Homo sapiens
ccacagaaaagttaaataatttgtccaatgttaaacagctggaaagtggcagaggtgggattcagaccagccagtgatgctgttaaccaacacattattaatctcaatactattagtatggccatgagttttgtttgtttgatttattaatttatttatttatttatttatgagatggagtttcactcttgttgcccaggctggagtgcaattgacgcaatcgtggctcaccacaacctccccttccctggttcaagcaattctcctgcctcagcctcccgagtagctgggattacaggcatgaaccaccacacctggctaattttgcatttttaatagagatagggtttctccatgttggtcaggctggtctccaactcccgacctcaggtgatccacccgcctcggcctcccaaagtgctgggattacaggagtgagccaccgcgcctggcctgagttttatttttaataataaagtctaatttgtttttttgtttgtttgttttctgtttgtttgtttttttgagacattttcactctgtcgtccaggccggagtgcactgactccaccatagatcactgcagccttgaattcctggactcaagaaatcctcctgtctcagcgtcccatgtacctggtatcacagatgtgtgtcagcatgcccagctgatttttatatatttttgtagagatgggggggtctcactttgttgcccaggctggtcttgaactcctgggcttaagtgatcctcccacctaggcctcccacagtaccgagatgacaggcatgaaccaccacaccaggctaacgtttaatttttttaaaaattaaaattcttgttgcccagctgaatggtttagaaactgtggcacttttcttttcaggccttggtttaaagcttgatgttaactctgatgtgaatgattttatgtggctattgaaaattaatgctgcttcaggaaaaatagctaatgcatgccgggcttaatacctaggtgatggtttggtaggtgaagtcaaccaccatggcccatgtttacctatgta

SEQ ID NO: 45816 - DNA, 1045 bp, Homo sapiens
ttttctgcctgtaaagcctcagaaaagtctgtgatgtttcattggcagagagtccaaggaaaattctttagtttggaagaataaaaaagtcgttacactcagccctattactgctgcaaggctgaactgtctttgaataatcatagtccccagagaggcttcattgtacggtctggtgtttgtatttcctgtagtctggttgcagtttctgcattgctccatgaaaaagacagtctctgaggtgcaaccaaaggcattaaaaaattttgtttggacagataactcgaataagacatctcttgcttaagttgatagcagttggttttgatattctgaggaatataggtaagttagcttggtatggttgatttggggcatttaaattaaaaccactcaagtttcaaaagggatttttttttgaagctgctctttaaatcttagatgctttccacctgcttatattttgtttgtggtatttatcatactttattagattacccctacttcaggctaaattctagaacgtttgaaaatgctaagatgattatgcagaaaagtgagtatccccttatgtactttttgtaaaggataataatcaaatgcagggctctgctttgggttaaaatatcaagtacaaaaactctcattaagcaacatgtaaaaatgttgtatattattacaaatgactgtggttattttatggttacaccaacaattgtatggagtgcggcaggaaattattatgtattatatactttatatgtcatctgaagtgtctagaaccttgcttatttctcacttttgcattgtgattctgactgtagtgcttcccccccaaccccccccgtgtgtgtgtgtgtgtgtgtgtgtgtgtgtgtgtgtgtgtgtgtgtaagcaaagagtgtggcagtgggtcagagagagaagaaaactgaaactgcttgagtgcttatgatttaaaatgatctgagcattttaatttggctttcatgtcgtcttcacagcaagagatgaggattgagggaaacacaactttgttatttct

SEQ ID NO: 45817 - DNA, 1062 bp, Homo sapiens
ttatttacttgtacatttttgtcttcctggctgaactggaggctctttggaggctctttgaaggctgggaccatcttgttcagcattgtgtccccatcacctagcaaagaagctgcatgtgatagaggacctaggaatgtttgttgcatgaataaaagttcttgttataggtggggcgcagtggatcacacctgtaatcccagcactttgggaggccgaggcaggtggatcacttgaggccaggagttcaagaccagcctggccaacatggtgaaaccccgtttctacaaaaaatacaaaaattagccggacatggtggtgcacacttataatcccagctactcaggcagctgaggcccgagaatcacttgaagccgggaggcggaggttgcagtgagccaagattgcaccactgtactccagcctgggtgatagagcaagcctctgtgtcaaaaaaaaaaaaagttcttcttgttataaaaaggtcactctgtaacagggataaggaagctgacagagtggtgtgagaaatgcccccattctgtagccacggaacttctcggagactgttctgcatgctattgtatacattcctctctttgtagccagttggaactcaatcgtaaaaattacacagggatcatttcattcttgaaagtctcttaatatggtggctcatgcctgtaatcccaatactttgggaggccgaggcaggcagatcacctgagattaggagttcaaaaccagcctggccaatatggtgatacttcatctccactaaaaatacagaattagccgggcatggtggtgcgcacctgtaatcccagctacctgagaggctgaggctggagaatcacttcaatgtgggaggtggaggttgcagtgagccgagatggcgacattgcactctagcctgggcaacaagagtgaaattccatctcaaaaaaaaaaaaaaaaacagttgtaagaaaattagcagggtttagattgccaactaaaacatcttacactgatgtaacagcagggagtaggagtattctcaactgtaaatgtggattcagt

SEQ ID NO: 45818 - DNA, 1031 bp, Homo sapiens
caggctggagtgcaatggcttcatctcggctcatggcaacctctgcctcccgggttcaagcagttctcctacctcagcctcccgagtagctgggactacaggtgtgtgccatcatgtctggctaattttttgtatttttattagaggtggggcttcaccatgttagccaggatggtcttgatttcctgatcttgtgatccacctgcctcaacctcccaaagtgctgggattacaggtgtgagccaccgtgcccagttgaaactttttttaaaagtagaaatcttgaattctgtttccttattgtaagctactgagcggcaggtaattagtggaggaaatggaggtaatcccagatggaaactgaagtaggaggtgaggccagtgtcagaactgggaagagacgaatgccctcacaaaaccacagtttcagctgaatatcagtcatgatttttagccctaaaagtcatcagttctctatttccaaattgtcttctaaggaatatatagggttaggactgtataaataggccctggttggaggttggctatcgttgggctgctgctgtgagttaaatgtgtatatacagtcaccttctgttaaagaactcttgctagcagaaagcctaacataggtaatcattttcaagaaaagggtgcaggaagtcgatgtttaataaaggttgggaggtataaggtgaggtgccaacttgcgtaactacacacacataaagacattttccatttggtgttggcgtgattcaaatggaaaattatttccttttcaccaagtggactttggagagagaggacaactctgaagtttctaaacaaggaaatgttcatggtcatttaacactttggggtaaagattttatatttcagctgtaaactctgccctgcccacgcgatctacccccacgtccctcaaacagtctgagctaccttttaggtagtttttaaaaactaactgcatataatttaaaaactaaaagtggccgggggcagtggctgacacctgtaatcccagcact

SEQ ID NO: 45819 - DNA, 1058 bp, Homo sapiens
tactaaaaatacaaaagtagctggtgtggtggtgggtgcttatatccccgctacgtgggaggctgaggcaggagaatcacttgaacccgggaggcggaggttgcagtgagccgagatcgcatcactgccctctagcctgggtgacagagtaagactctgtctaaaaaggaataaaaggaatattcttgtatacacattagctacataaataaaagtaagaaaaacacacattttaccctcattctaacctagaagctttattgctaggacacagtgtgaactcatctaaagggaagaacagactaggaatggatcagtctttcaggtaagatgtattggaagaggtttttaaaccattaaatgaccttattcttttaaatgcataaatgtgtaccttataagtaaattgtgtcttaagcatgatgcagaagaaaagaaaattagtatttaaatttgaggactaatcaaatataattattctgatcttctactgttaactaaaacatttaaggacattttgtgtcctaaaatgacattgaaaagggaatcttgggaaagactcatacttatcaggagactaggaagaagaggcgtaacatacattcttgtgtaaataatgtttgtgacagtgttcattaagtcttgactgttgggtagttagcttatcttttatgctttttgtacattggaaacatggtaatatttaactcaggtgttatttacacatataccaatctggatgaaaagaatcaatatttcttcaccttatttcagataagcagttcataggaggtattcagcagtgttcagtgacaaataagaaatttattttccttaatgtttattttgtagatttttgcatgattgttagctatgaatgatacgaagttgaaactgcatgtcctcgtaaaacatagctcccttggctagctttacggaatgaaaatagaagccagcatagatatgagcagtttctgagatgacattgaaacatagacctacccccttcccctgacctctgtgtcaaggtggttgagtcatatttcccagaattctga

SEQ ID NO: 45820 - DNA, 1077 bp, Homo sapiens
taaggatgaaattggagttcaggatctgcgtgcttaggggcacttaaaaatggcctcagactttctctggaagaaggcaggccccggagggaggtgaccacttagcagcggatacagtggtgactgtggcctcctgagaaggaggatgagcgatcccacccacaggaaatgaaggactagatgggatggtatgaactcagctagcttgaaatctggccccgaaaagcctactttgaccagggagactttatacctggttttggatggtccagtataaccaggagttgaatttgacttgtaatttcttctaactttttattttattttattttattttattttttgagacgggatattgctgtgtcacccaggctggaatacagtagcatgatcatagcttactgcagccttcacgtcccaggctcaagctatcctcccgcctcagcctcctgagtatctgggactacagtcatgtgccgccatgcctggctaatttttgtattttttgtagagacaaggttttgccatgttgcccaggctggatttgaactgctgggctcaagcaaatcctcccacttcagcctcccagagtgctaggattagaggcatgagccaccgccctcagcctaaaaatttattttgagatggagtctcactctgtggcccaggttggagtgcagtggtgcgtgcgatctcagctcactgcaacccccacctctcaggttcaagtgattctcctgcctcagcctcctgagtagctgggattacaggtgtgcgccaccatgcctggctaatttttgtatttttagtggagacagggtttcaccatgttggccaacttggtctcgaattcctgacctcaagtgattgcctacgtcagcctcccaaatgctgggattacaagcgtgagccgctgtgtctggcctaaaagtccggcctaaaaatttatttctaaaccaagttttgtagatgattgccctgatgatggttatttatttattttcttagagaaaaatccctcagtaatctttgaatttactcttggatatggggcaattttccatgatgacattaatc

SEQ ID NO: 45821 - DNA, 1030 bp, Homo sapiens
gttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcagcagtcatgcacgctgattgggtgtgtacatctgtgttggtttggaggaggggggttattatcaagaaatacaagctgaacatcgtatctgaattaaataacaagggttatgtaagtgggttattaaatatgactaaacggtcacaatcttactcttacatgactgataccacctcttaaccagatactatcaacccaatttgcaggtgtttaaaggcagtttttcccccagataggtggtgcttccacaaaactttagtgattccaagattactttagtgaaacgaggaattataagaggatttacattaaaataggatttaattaatgaaaaaaaaactttactcagattttctacctcttacataaatgaagtcaggtcaacttgatgtatttttttgttaa

SEQ ID NO: 45822 - DNA, 1072 bp, Homo sapiens
ggaaggaaatggtaagaacggtatatgccagtggctagagggtgaattcgtgcagagagataaggagtgcttgttatgatgtttttgtggtgtgggtcaggttaggtcatccaagtggaattactctcgttcctgccttctctggagaatgatggaaaaataaggcaggaaaaacaatctgagaatctggtctctgtataggggcccaatattcagtattacatagaatctttttataactacatgatgtaaaaatgctttaaaaaataattcctatcacttattatgatagcagtatctagaaaaaattatatgtccaagaactagatttcaaagcatgcttttattatatttgtttatattatattatatattttttattgttattatgttaaatgcttttattaatatatttgttttccagcctggcctacttggcaactttcctggcccttttgaagaggaaatgaagggtattgccgctgttactgatatacctttaggtaaagttcacttagaagctttaaaaaaaaaagtaattaaattcttttacaagtttccattgaggtgtgatatacatacagcacaggtgctgtatgtcttagatatacagcacaggtgcacaggtcttagatatacagctcagtgaagcttcagaaatgcatgcatgcatgtagccatgactcagatcaagatacggaagagcccagcactccacgatgctccatcatgcccctttgcagaaaatactgcctcctccagtaaacactattctgatgtcactatagattagttttgcctcttcgtgaactttgtataaatagaactgaacaatatgaactgtcctgtgtgatttcttgtatttcattatgggtggtgtgctattgtatcaacagggtatttgggtggttttcagatttgtgatattaacaataaaggaattataaatattgtagtacattttgggggtgtctgggtactcattttctggatatatacctaggaagtgaactgttgtgttatagagtaattgtgtgtttagccttatagattctgccaaacagttttccaa

SEQ ID NO: 45823 - DNA, 1033 bp, Homo sapiens
atacacgtgtatacatggacataacttgtatgtttctttccttgccttcattttttcgctagctttctttttatctcactagcctgctttcctacacaaaaagcctcggctttgctcttatccttctcttctctcaactctatcaatggatcttgagatttaggagataactgtggtatttatgtacctttgaatgacaaacagacgttctgttcctttgagatcatccttttcaattaagtgcgtagatttgggcagcatccatgggcagatatgagggaagaaaaagataacctgtttggccagcatgactagtcaaatcaatgctgaagataaaggaactgatagccagatcacccctgagtccatctgagtcccattcagcatttctttcccactgctcacgggatgcctagcacttgctctcttatttgtatatgtgtgtgttgtgtcacttggactagtttccatgccacctaggtagccatgtgggttcaggtgatgttgctgatattatgaatggcatggacattgcaaacactaagtctcaaaaatgatgaaatgatatttcttgtttgcagtgaagtaggaaaataaattgtgatgactactgttgattgaataccaatgctgctaagtgttttttttatttttgcatttttcatatagtgtcttccctgctgttataaggtggatactcttttattcttatggggaaatggaggcgcacaagttaaatactgaaatgttttagaaaactgtttaacgagaggtaaaatgtgcaattatggctaagctttagtcattaaaataatttggtttattagattaaccagttctctcaaattctaattagtgcaggtttgatggtagagaggtttgtggggtctcatcatccccacttcattgtaatcccttcattgtccgttgtgttgtgttcatcccctctcatcgcgtctctgagatccatgaacctacccaggactctaggctgaaaaagaatcaggaatttatggcgggtatagaggcatga

SEQ ID NO: 45824 - DNA, 1051 bp, Homo sapiens
cataattcatttctttataaagcaatcagactgcgtttgtctttgccaacagaatcggataagtaggaacctggcgcatctggcctgaggctagatggtgatggtcttgaatagtttaggtaggttattgaaagtggaagcaagatgtgcattgtcttcttttatacctgtaaggagaaattctttaaaatcatggtgggatatgatttagccattaaaattgatataatgttcagcagataaaagtagaatccagaatagtatatacagtttttcctgtaataggaaaatacacagaacatgtatgtggacacgattaaaggccttaaaataaaattgctccattgtgggtagggaattaatttgcttgacggtagttggttttatgggaattgggagagactttgatactttgatactgtcagggcccttcattgaaagaccaccaggaacacaccataagctgaacaaattgggtttagtgttctttgaggcaaaggagaccacacaccatgagcgacggacggtaggttatagaaaaaaacccattacagaatttgaacttcggttgcatgatttggggtaagactgaggaaccgggctttgctgtagatagaatgctgttagaaggtggggcaattctgactgagtaaagaaggaacagccattctgtttagcacgagaaggggatgtttggtgttttgtgcgttgcaggtgcccttgtttttgtctgttcttagagaaaatcttcaagtggcattgctttgtcttggtgtgtcatgtctcagaataatcttatccgacgtaggtatctgtgggattgttgatgtccaggaggaaaacagagcttacctggctgtgagtgtcagatcggcttgtaataatattgagagatagctgtgggactcagagcagtttcaggtgttggaggctgttttttcttctttctcaatagctttatttattctagcaaaagtattttgatagctattttcagaagaagaattaacaacctctcaatggatataatagttcttatctagaacagcga

SEQ ID NO: 45825 - DNA, 1034 bp, Homo sapiens
aactcaactcatttcgggccgcttttctcagagggcaaagatgggtcagggtgggatgttacattagtgttgagactctttggatccgtttcgtgggtaccgaggacgcctgggtacgcgggacaggctgcacccgcctgctagaggcgccccatcgaggcgccacgggtgaagctcccggccccacctacggggcggggctccggctcggtccgactattgcccgcggtgggggagggggatggatcacgccacgcgccaaaggcgatcgcgactctccttctgcaggtagcctggaaggctctctctctttctctacgccacccttttcgtggcactgaaaagccccgtcctctcctcccagtcccgcctcctccgagcgttccccctactgcctggaatggtgcggtcccaggtcgcgggtcacgcggcggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccggtgagtgagcttgagccgaggcgcagagaggggcgtgcaggtgcgggcgcggatggaggcgcaggtgtggcggcgcgagcgggtacaaggaacacctcgtgctgggcagcttctttacgggggtctgtggtttcgtgcacaggggtgtgggtgcagagcgggctggcgaaccccgtcctcggtagattcggtgctacctgcaactagaactcctttaaaggaaatcctagtctctgcaggatacctgggtgtgattcgcacattcttagatttgagtgagtgtacttgaataaccagttccaggcccttgcattttgaagtgtttaaataaaatgttccggtggacctgtgtgcattactcaatcaaggacagactgcctgatggtcaggtgctttctcccgaagaagttcaggagttcagcccaggatactgcagggcc

SEQ ID NO: 45826 - DNA, 1044 bp, Homo sapiens
gagggcccaacctgccctctcagtcagactgtgccctaaccatctgcaatgctgtgcccaccctaaattacttctttggttcatcagctcttccctcaccctcgatcccaccccttgctgctgccaattacaagcatgattgccctgcccactccccagcctcttatgtttgcaccctttacagtttcatctatatacaaaaagtgcccacatcataagtgtacagctccatacatttttatggactgaacatgtccacgtaaccagtatccaaaatgagaagcagaatattgccagcatcccttaactccccccctggtatttccttctattccctcacttccaaaggtaactactatcctgacttcaaatactatagattagttttgcccatttcaaacttcataatgggaaatcacacagtgaatacttttctgtgtctggtttcattttctttttttcttttttttgagacaggttctcactctgtcattcaggctggaaagctgtgatgcgatcttggctcgctgcaatcttgacttgctgagctaagcgatcctcccgcctcaccctccgaagtagctgggatcacaggggcatgccactgcacctggctaatttttaaaaatatttttgtagagtcggggtcttgctttgttgcccaggctggtctcaaactcctgggcttacgcgatccctcccaccttggtctcccaaagtgttgggattacaggcatgagccaccacacctgatcaggcttcctttgcttaatattatgttgttcagactcagccatgttgatgtatatagttgcagattgttcatcctttttacttcacgatatccctttgtttaaagatgcatgatgggtttacccactttcttgttgctgggcatttccagtttgggttttttgtaagtagtgctgctatgagcattcttatacatgttttttggtgaacctgtatatgcatttttgttgggtgcatgcctaggagtcaaatttctagggccatgtggcccaggcctgttcagttttaata

SEQ ID NO: 45827 - DNA, 1077 bp, Homo sapiens
atgtgaagaaggatgtgtttgcttccccttcggccatgactgtaagtttcctgaggcctcctcagacaggtggaactgtgaatcaagtaaacctctttcctttagaaattacccagtatcaggtatgtctttattagcaacatgagaacagactaatacacacagccaccactttgggatttactcatttctctgggtatctccgtgaacccaaaaagtatctgggacaggtctcaatcaatttagaaagtttattttgccaagattaaggacacccccatgacacagcctcaagaggtcctgatgacatgtgttcaaggtggtcggtgcagagcttgggtttatacattctagagagacatgagacatcaatcaatatgtataagatgtacactggtttggtccagaaagtcaagacaactcgaagcaggggcttctggtcataggtagataaaagacaaacagttgcattcttttgagtctttggtcatcctttctctgaatacacaatttacatgtgagaggagtatagaataatagtcacttatgccttagactgcctcagtgaatctgcatttttccatgaacaatagggtagaggaagcaatcagatatgcatttgtcttaggtgagtagagggatgattttgagttctgtcctttgtcctgcacctgtgaaaataagctatcaatttacattgccaaactgaaattcaaaagaactgttttaggggaattactttgtggacaaattgtgagggaggtatgtagcttatctttgtagctatcttatttcggaataaaatgggaggcaggtttgcctgatgcaattccaagcctgactttggcttagtgatttggtggtcccaagatttattttcctttcatattcccatgtttacctgaagtatgcatgctaattaatttgtttttctcctcttaatgtcttttttgttgtagggacccattccaactgagaactttaaaggtagagagaaaattatattttcctcctctacagtattaatgtcttattggaatgtgttgtgatcggagaagattgtttatattatatcta

SEQ ID NO: 45828 - DNA, 1022 bp, Homo sapiens
agttgtcagccagtggagcagttcaagtgtgcttgggcaacctcaggtggaaatactgagaactgagtgaggctttgggtaagtggttggattattatgatgatagacaatattattacaaatattttctgagcctggcactgtgctgaacacttagcatgaatttttggcataatctttttgcgtaagtctgatgcagctctattatttacaccattttacagagaggaaaagcctgcatcaggcccccttcttcagacatgctgcagcatttgaacacacctcaacatcttctgttttgaactacagaagtcagagctctgacccaccaactttgtcagcttcagattgaagaagcaatgattccactcacgggaataggatgtatgggtgtcatccaggaagaactggcaataaaaatagtcactttcactctgcattggaatcccatggatttaaaaatccaaatacttgggtctcacccaagaaattctgattaaattggcctgaactgtggctggggtgagctctgtcacccagagtggggtgcagtggtgacatcatagatcatagctcacacagccttgaactcctggactcaagaaatcctcccatctcagcctcccaagtagctgggaccacaggtgcatgccaccacacccagataattttcaaaattttttttagagatggcatctcactatgttgcccaggctggtcttgtactcctgaactcgagcgatccttccaccttgagctcccaaagcgctgggatgacgtgggagcctccacatcttgcttctctggaaatgttaaaagatccccaggtcattctaacatgcgcagccaggattgaaaaccacttccctagagtttggcaactcagcctgctcctgctgcatctctgggagcttgtgggaaaagaacaatcttacgccccttcccagacctagtgagtcagatagatgctgcgttttaacttgctctcccggtgatgtgtacgcacattcaattgtgagaag

SEQ ID NO: 45829 - DNA, 1041 bp, Homo sapiens
gtgcattttaattgacattaaaatgattccattcctgttggttctgatgatccatcatggttgacatttgggtagtaacttcatatccacttcgttacagagtgagtcatccgctagccaagtgctttgacaagcctttgctatcacaaagcttcagagtttctctctcagtttctgtcatgggctttgtgtctgtccctgccagtctctgcttctctcttgaaagtatttttgtaaggcttgtgatgttattcttgttccagttctggttgttacaaaactgaactgccctagagatgattgatggaatggttaagagcgacgggtgtaggtggctcgttagtgcatggcagtgaattacttagagttcacctcttgattattgtagtctgcagatcaggctctcaagaatctctatgtgattttatctttagggtctagaaagcagctgttcaaacctgaatttatttacctttaccctgtctttagaagtgaaaaatcagttcgttatctaaaacgtacatttactatcacagatcaggaactgtgtccttggtgcagaatcatctttattctctggcttactcggaagagagattttgttccacctgcctataaggggtttttgtttgtttgtgttttgttttgggggcttgtttttttgtttgttttttgacacagattctcactgtttcacccaggctggaacacagtggtgcgatcacagttcactgcagctttgacctcctaggctcaaccaataggttttgtaaaagtttaattggaattaaactttttggtttttacaaaaccagtaggttttgtaaaagtttactgggtcgcatcaggggagggcttggttcaggcacagaaggaagccactgaggattcaaggcctcccagactgtgatgacagcaatcagtctggagctgatgtgcccaagactgtggcacccggagcaggtccatctctggcctggtctcctgtcactcatcctgctttcttgtgagctcatggcgtttttatttccttttgtgaaa

SEQ ID NO: 45830 - DNA, 1033 bp, Homo sapiens
ctagcaaaggtgttcctgttaagtaaatgaaatctcacaagtaggtggtaaaacctaggcatgatgagagcgagaatagatggtgaatgtttctttcagacccttaaagatgtcagacactgagttaatctttcctagatccagacgagggaaggcctcggagaatgcctggccaccatcaatacagattctctccacagatgcaaatctcccccacaaaagatagctttgcagagctacttctgtttgcagggcctctgaaaggccatctcaaaaatatgtcaaagaaatgtattgtagggtcgggtattttggttttcctcagtgaagagcacttgaacgcactggacatctgataaatggaagaaacgtggtctgagttgggaaaagctaagaggccatcgtggagcagcatcacctcaggtgcagtctgtagcagaccgttttctggctcctgcgcgtgagtggtaagccagagccctcgccctgtaatgagggccaggaacacctatcagtaggcaaagcttgaagtcacttttggagctcctaggttggggaaaagcaagtgaggctgttatattccttggagaacagattctgtctggaggctgctcatcagccactttgagttatttttattgaccttcagctgtttttgcccggaggcattttaaagatgcccgtgggccttgggctgttttacaattacaatagcttatttgaattgctagttgtagaaatgcgtgcacagcagggtcttcgctctgtccttccctggcttctggggtgcttcagaggttgaggaaacctgatttgctgtcacttgacaagcccacttgtctgattcagcagttacctgcccttctcagatagactgcgatgatttaaccttacatttattttaacaccctgctcttaaaaggtatgtaaaaaggtctagaaactgctctagatattatgaaaaaaatcatagtatgcttgattttcttgatcaatgttcacacctttcacataaacgaacttatcaaatgtt

SEQ ID NO: 45831 - DNA, 1042 bp, Homo sapiens
gcctttgagaaggtggacaggtgagatgtaggagagcatagtataattagttttgggaaattgaaggagcctaattggatggcttctgatttttctgtgaagtgtgaggcatgattatcttgatcaatgatggtgtttggagtttgagaagaatagagcatgcttatatagttagaataatctttgcagagtgaaatagcaatttgatatacttgaacagagtaagataaggtgacatgtttgctcagaattatctttggggtgaagagatggatagtaccactgtttctatctgtagctggatcctttttcttaatgtgttagcatattctattagcttacatggagagaaacattgcagtggggtggctttgacatggacttagcaatgctgaacaaatttcttaatgttcccaagttctttaagagtgcatccaccatatcttctgtgcaccttatatactagattactagactacttaattttatcccacaacattgtatcagaactcactcatatagttgtgacagcaagtgaatccatcttagcaaaagggcacacctgaagatggattgtcaccaggacgtactctccatttctatctctgcatgattttttgtgtcagcattattctttggaatgaggtcctttatacatggttattagcagtgctatagatcacgtgtttaattttgacaccaaagaggattgttcttcttccctaacttctcatttagtctgttctaggacaggattctgacttgtatcactgagaggatggaatattgtgattgacagcccccacttgcttgcaatgacagtaagaatgagatactggtctcagagaatgggagttcttggcacacaaagcaatagatacccatttgtttctttccagtgtgcagacacacccttcttcatacattgaataatacttttgccaaacattgcagttttccttttacaaccacaaatataccatctctctgtaacatgcctgcccaactgcagcttctgtctccaaggctaagatttgttgat

SEQ ID NO: 45832 - DNA, 1014 bp, Homo sapiens
gttctcattgtcattgctctctgtttcactgtactcaaattcctaacatggcagatactgtgtcacgctggactcttggtaaaataataatgctaatgttagtactagcataacaaacttacaagacaatctatacgaagaataactaaggttaaatctatatatgtatagtggttatgtaaaggatattattggtttgattgttctatttatattcagcaaagacaccctgactgtaagaaaagaaacagaaatgccatagttatgaaaaattgaccattaacttgaaggaaatattgaactaaagagttgagaccacttaattttgttagctattgattattagagttttctacagtaaagtatttttaaattaaaaaattgttagctaaaaatgatattgaacatgaattaatcttctggattttggtatttaaaggaaaaagattttcagtggttagaattaaggaagactcttgctatggtgtcagcatgtccccagagttcatgtgctagaaacttaatccccaatgcagtgttaggaggtaacacctaattagagactgttaggtcataagggaaaagggctctgccctaattaatggattaatgttatcaagggagtgggttagttatcgtgagagtagttttgttttaaaagcaactgtgatccccaactcgctctcttgcgctttcttgaccttctgccttactaggagaagggcagcaaagcacaagagagcaggtgggggttagagaagaccccagcaaggaggccctcatcagatgcaggccccttacttgactttgaacttccagcctccaatactgtaagaaataaatctctgttcattttaaattatgcagtttgtggaattctttcacagcaacccaaaacagactacgacagaagattggtaccgagaattagggctgttgctataacaataagctgaaaatgtggaaggggccttggaattgggtaatccacagaagctgggacagttatgaagt

SEQ ID NO: 45833 - DNA, 1026 bp, Homo sapiens
cagctcactgcaacctcaacctcctgggctcaggtgatcctcccaccccagcctctcaagtagtcaggaccacaggtgctcatcatcatgcccggctaattttttgtattatttgtagagatgggtttttcactgttttgcccaggttggtcttgaactcttggactcatgtgatccgcccgccttggcctcccaaagtgctgggattacaggagtgagccactgcacccatcctgaattttctttaaaagaaagttgaatgacgtgagagccgatagagaagggaaacttgtatatttaaagtagttcctttatttgacagctggtcattgagctccggctcttcaccaggttctgttttggcctctgagatgcaggtaatttcaaacagctatgagtgccctgaagtcacagaagtaggggttttggtggcaaatgaatgactagggtggagctgggctgctgtttaaggaaggatggtcacagaaggtccttttggaaaaagatactgagctgactgctgaatgaggagaagccagcttagtagtgaatcaggatggggcaacagagttccagacaggatgacagcagatggagggtcattcgggaaagcttcagaaaggaggcaagcttgccttccatgcatgggctgagtggaagctaaagtgccacgcactcacctggaatgaagagtcaggcctgactgacaaagataagaagagtgagaagcggttgggattaagtttaggtcagtaggatgaggcctgagcatcaagggcccctggatgctgaggtctgtacagctttttcaggtacctcttgagacatactcagatatgtcgcagggatcatctgctgtgagactgctagcagcattgtaggagttctcttcactctgtccacgtagaaatacgtgttctgcaacagagagtaaaaggcaggagcagaagaaaactttctctccctgacttgcagaaaagctcatggcaggtttaaaaaggacagggcaatgcagacagctatagt

SEQ ID NO: 45834 - DNA, 1033 bp, Homo sapiens
tttgaattaactgagtgttacaaccgccattctgttctgaaaataggctgaggctgagttcctcttgacacctcatgcctctcttccctccccagtccttcttggtatcctgctaattgtacctctagacaattggtatttataattcatttccactttagcttttctccagagttcatacctcagtcttcacctccttctactaatggttctgtgagattttcttagcaaagagggaagtgtctgcctgggtgccgtttgatactctcctgttgatttcacttgggatctgaaagcctttcagttcattgatactctgaagatattcatcattataattatggcaacagaatttcttgttctctctacctcctacccccgactgaatgtgagctgctcaaagttaggggcctgatggtatcagcgttgtgtgtccccagcatctggtacctagtagacacagcaaagaagtgtattgagttcatttctctggtactcttttgagaggttgagtttttctgatgaccattaactaggtcccttgttagaagccttttagggtttatctaccaaacggtgtccttagagaaagcatcagaaggtgaagcaccagtttccagccttccgcttaattagtttgcttcattaaatgtctcctgctattttgatttgttatggaagtcaccttcactttctgctaaagcttttgtggaaagttattttgtacctttaaacagctgcttctctccaggaagcctgcttttattttatagcaagccggctcggctgtctctgtacaggctggctcatgtctataaatggtcaaggcctcagagccagatggggcaggacagggtcatccaacacgtctttgaagtgattatttcatattgaatctagttgtgaaccccatatgtacctaacaccatgattgtgggtgataagaaataatgtaggatgaagaaaataagacttgttcagaaaacaattggaaaactatgttgtttcaatgttaggatgtgatacattgcag

SEQ ID NO: 45835 - DNA, 1084 bp, Homo sapiens
acaggatggtggcattgcgtcaggttcactcaaatgttgtgaatcttagtcctgcatcctttctactctactgtttgcttacccctagacggaaggaaagaaagaaaaaaccaaaggaaagaaaaagactgaaaaaaaaggaagttgcagtattctacgtattggtcttcagtgtgatggtgtgaaacccattggtgtttgagttgagaggtctcgaggcttggcttctgttcctggttttcccccagtatgtctgctaagagaccatgttgtgcttatgcttattcttagctccggaagcacattgttgattttctcaaatattgttttcaggttattagaagtggagcagaaaggtttaagcatgggagatagcctctcacgagtgttcacactatttcagcagtatgttatatctttaagagcttgatccttaagaaacaaccgtactctagaaagtacatcatttttcctattactaataatgtatagataactcattaataggaatctgtaaaatattcttatttttggccaccgatatgataaattcttggactttatgtaccttttaaagtacatctaattaagtgattaggaggtctgtttttaaagggaaacagggaaagttgctgcattattgtctgggtttggtttttatattgtatattatctttaatgttaatacaacagtcccaaaagatggttgctaatttcaggttctgtttctctaattcttggcctaggaaaatgaaaataaggtttgactgaaataagattctgttcaaatgtccttgcaaatgaggaagcctcacattaccaattttttcccaggaattttattgttgattaactgctgatggggtagaatttatagttgagaataatttcaaaaagttaatcagttgccaatgggcttagtaaagaaaggaaaatataggagcggaatctgcagcttgatttttgtggtttttttttttgggtggggatctcattattgtttgtacaatgtgtgttactgcgaaaaaccctaatgaactttggcttaaatactggtaataactaaaactgctcattctcccag

SEQ ID NO: 45836 - DNA, 1033 bp, Homo sapiens
atcagatggttgtaaatgtgtagtcttatttctgagttctctttctgttccattggtctatgtgtctgttttttgtaccagtaccatactgttttggttactgtagacttgtagtatagtttgaattcaggtagtgggatttctccaggtttgttctttttgcttaggattgtcttggctgtacagactctttttcggttccatatgaattttaaaatgatgttttctaattctgtgaagaatgccaatggtagtttgattggaataacattgaatgtataaattattttgggcagtatggccgttttcatgatactgatccttactatccatgagcatagaacgttttttcatttgtttgcatcatctgatttccttgggcagaggtttgtcgttctccttgaagaggtcgttcacttcccttgtttgccatattcctaggtattttattctctttgtagcaattgtgaatgggagttcattcatgatttggctctctgcttgtctgttgttggtgtataggaatgcttatcatttttgcacattgattttgtatcctgagacattgctgaagtgacttatcaggtaaagaagcttttcagctgagataatggtgttttctagatataggtttatatcatctgcaaacaaagacaatttgacttctcttcctatttgaataccctttatttctttctcttgcctgatttccttggccagaatgtctaatactgtgttgaatacgagtggtgaaagagggcatccttgtcttgtgccggttttcaaggggtgtgcttcctgcttttgcccattcagtatgatactggctgtgggtttgtcatgaatggcttttattgttttgaggtacgttccttcaatacctagtttattcagaatttttaacatgaagggatattgaattttatcaaaggtctttttggtatctatcgagataatcccgtggtttttgtctggagttctgtgtatgtgatgaattacattaactgatttgcatatgttgaacccgccttgc

SEQ ID NO: 45837 - DNA, 1113 bp, Homo sapiens
ttttaattgatctggaaagagaacagtattttttcagatgctccccaggtgattccaatggacaactaaaccacaaaagcagatgactttgaagtccttttcacattttaatattctacaattctgagatttttttatgtcatctagtccaggctcacactcagcataatcatctctctatatttgaaaagcagcattttgtttttaatgttagcattcatttggaaagaatgctcattgccatcagaaagctttgatttaaaagatttttctgatcatcagccaaatttacctttggaaaaacaaataataagtctaattactgatttaattgatgacgattctgatatttgaagattacttctatgattcagcaaagttacctcttcttaggtgaaacctttccaatttttttcatctcttgtttttgtgcaccattatttccgtatctcaacatgctattctgctctggggtaatctgcccttatctctataaaatatttccctggagttgaactacagccccattgatgatcaaaggagggaacttggggattttgggtgattattcccttctcaaactcttactgaatgtaggattaataaatagactctagttttagtaaacagtttagtaaatggtgtttactaacacatactcgtctataaatatgtatactaataaacacagttgatgataaaattcccagcatttaaaaattttcatggtgtgccaggcattattctagtgtttaaatatattaacacatttgattctttcagtaacccttgagggtaggtaccattattttactttttagatataaagaagaaacagactaaggagcagagtagttaagtgtcttgccttcaatttcacagtaagtggcagagctagagtgttgattggataatatagggcatcttattccagagtttgtaagtatggaagttggaggttatagaaattacgtgagatatataaggtttatgcttatacttaaataggtaaactgtagcataggagatgtgctcaagtttgttggaattctacgttgttttaagaaagttgaaatttgtcagaagctactttccataaaaacaatttatagt

SEQ ID NO: 45838 - DNA, 1050 bp, Homo sapiens
gagtagttgggattacaggcatccgccaccacgccctcctaatttttgtatttttagtagagacagggtttcaccatattggtcaggctgatccggaactcctgacctcaggtaatccacccacctcggcttcccaaagtggtgggattacaggcgtgagccaccgcacctggcctaaattgaaattattttaaagaaacaattgttttctcagtttggccatgaattagaagaatggagttcaaggaagtgatgttcctcagatagaggggcagtagcaagaagtgatttgctaatgaggtaaagagaaaatgttgcaaccttaaagggcactaggtctccaaatggtacatctggagttgttttgaagagaggcagtcaaatctgtgtcgtcagtagcctctcagaatggctgcattacagcactgcaaagtaatggatgtacttagtgagtcatcaaaaatgttacattttgtttacttggtttgattaaggagacagggagtgtgaaatagattggaaagattgccagtaaaactatcttataaagattttttggcatttaaagaaattaccttcaatcagaaaatgcgctaatgtaggataattcatttctctatctaaaaccattcttgaactctgttccctgtcaatgttggatttttactgttatttaaaacattttatttgcttgttttaattgttttaacatttactcttcccttaaactttccatagatagcagcatagtttttgtgctaaattgttgtttttgcagaaacgccagaagccacattatccagatcttgcaaggaagtattttctggataatgcaggtacatgaactttcctcttcacaacataccatcttgtcagagggagttcacacattcttttcttttgtgtggatttttttttttttggagttggagtctcgctctgtcccctaggctggagtacagtggcatgatctcggctcactgcaacttccacctcctgggttcgagtgattctcctgccttaacctcctgagtagctgggactaaggcg

SEQ ID NO: 45839 - DNA, 1065 bp, Homo sapiens
tggcaaaaaagaaattggaacaacttcacagggtgatcttgtaaggatcgtttcagtctaagtgctgggcattttcttaacgtcattttgaatccaaatcgcatttctaaagtgttaactctcttagctctcaccttgtatttactggtttagacaaagaagtgtatacttaataatgaaaccagagaatgttcagatttaaatccaagaaaattgcttttgtcattgcagcattttcaaaagattattcccaaaggactacacaagaggaagaagcagacctcagtcagaaaaaggtctgaactttttataaaggaaaagcctgaactgaattctcaaaaatacttgatctgagttatattcggagtatgtagttgaaaataggaacttatgggtggtatttaagtgtagctaaaaaaagagcatcaactgttgcctagagtaggtgagttctttccaagagaaggtcatggaaacctggtagcaacagtatccatggaggaagagggcttggatgcctgtcctgtgtaagtcggagagccttttaagagaaaagctaggtttgcaagctttttaagagaaaagctttaaaggttctggcttaaaatatggaatattgctgcttttttcagtaaagtaaatcaagctgagttaggtgatgaaaggtgcgtggcgtgtttccgcttctgccctccccgtggaggtctggcagcctgctttcgctttcgatcacgtgctcatcatgggcagaataatgatgctgcttttggtgtggttcagaccatgaatgaaaaatggtgacgataatgagggtaatatttgaagtaactgaagatccacaaatcatgttcatgtgttttcttaaaaaaaaaaaaaaattaccaaaaagaagtctgttacaatgttttaacagaacagatgctgcttaagagtacaaacagatttttaacccccaaaaaaagaaaaaaggaaaaaagtttgagtggtggtggttgtaatcattaagggtactgtaatggaatattaatgattcccagtgggaatttatattgaaatttattttca

SEQ ID NO: 45840 - DNA, 1030 bp, Homo sapiens
agaaacaaaaagtttcttgaaacaaatcaaaatgggaacacaacatatcaaaatatgtgggatacagcaaaagccatgataaaaggatgtttaatagcaacaaatacttacatgaagaaagtagaaagattttaaagaacctattgatgcacctcaaggaactagaaaagcaagaacaaaccagatacaaaattaacagcaggaaataataaagtcagagcagaactaaattagaggtgaaaaaaaggctatacagaggatcagtgaaatgaagagttgggttttttttttgagagaataaacaacattcataaattgctggatagactaaccaagattaaaaaagaagacacaaataaaatcccaaccaaaaaaggagacagtaaaacttatatcccacaaaaatagaagattgttagagactatcgtgaacaactgtctgaacaaattggaacctacgggaaacagattcattcctggacatgaggaaactaccaatatttggccatgaagaaatagaacacctgaacagatcaataatgagtaatgaaactgattcagtaataaaatgtcttctaacagagaaaagcttgagcccaggagatttttactgctgaatgctacaaacttacaaagaagatctaacatcagttctcctcaaactattccgaaaaattggagaggagggattttttcctagcttgttccatgaggccagaattaccttgatgccagaaccagataaggatacaataagaaaacactataggccagtattcctgacgaacttagatgcaaaattcctcagcaaaataccagcacaccaaatctaacaaatcaataaaaagatcattcacgatgatcaagtgggttttattccagggatggtaggatggtttattatatgtaaatcaataaacatgatacgtcacaaaaaggtcaaaaattatatttttaatataattatatatttttgcatctcaaatgcaaaaaaagggtttcataaaattcaacatcccttcataataaa

SEQ ID NO: 45841 - DNA, 1050 bp, Homo sapiens
ctcttgtttccaatcctgttgcttactttaatgccagtcctgctacagcaatcaagttaaaaattgtttggttagtccttgtaatttgacagtgagttaggtgtgtttatcttttcaaattttaggggaagtgctttccatgaaatatcaatagaagtctgatatttcagtattctaaaactttttggtcccaggatagctttatactcttaaaatttttgagaagccccaaaatcttttgtttacatattaatatttatctggaactgaaactgataagatttttaaattgcattaaatcattaaaaacccattaagtgaataacacatttatgaataatagtcatactttcctaagtgagaaatatattaaagaatagcacttaaaattgttgctagtctttttatatttggcttagtaaaagatggctagattctcatatctgtttgtgtttatagtcggttgcagtgtatcagaagtcatgcatcttctagaaaactctactgtatatttgagagaatgaaaaaaatgtttttagtgttactataaaaatagggttgacctcatggacatctggaacagtatctctgaaacgctttgagaaccactgtgctgtggtactatttttagttcctttttttctttttaccactctgattcctttttcaaaggcaggatattataggacaggtgggagaagtcccagtgacatatcagatattcctaaatgttgagcttttagcacttaaatgagctctgtgattagggtttgtgagagagcacattgaatatccactgtagtcctggttttaaaatttacaaagggtcctcctttgccccccagtcatacatttaaaaaggaatggacacctgagggcagcatgacataatcaaacttatttgatagcaaagcatgcaaaataaaagcaaaacaggagctttcagcagagccacataactgaagtaattaccaaatcagtagtatgcctttccaccatttattgtaacatgttggaggaggtggaattgtcatatgggagagtatgcct

SEQ ID NO: 45842 - DNA, 1047 bp, Homo sapiens
tcttgacatgactaccgcaatctaatgttcatccagcttgttaaagggatggccagtcagtggattgtcatgaccacttttttcgtgttactggccaagcaagttttcactgctttgtctggctgtttggtgataacagttgctctttgcacccttcttttccttagcctttctggccaaaggagaaaattttgagtgcgtttggccacatataacattgaatcaagtcagtgatcaccagcgtgaagaattcccttcacactagatattttgaggttccatcaacataaaagagttgtacgtttagcatctgttaactgagaaaagtttaatggtgggaggaaaaaaattcagtaatattgcaatttctctttaaaggttgcagatctcttagagcttttgtcacatttttgatgatttgtttctactaaatcctagattgcatttttaaaaagctaatatagctttaataatacttttacataagcatgtatctgaatcataagaacttgaaatgtagcaaccaataaagatgttattttttattagatatctcagcatgcttgatgtctagatgagctgtggacacccaggtttcagtagctacaggtttagagctgcaaatctaggacatttgctcttctttagacttacaaggaattgtaaggagattagatgaagcatcctgcttcttcttggcaactgggatggaaaagagtttacataaattaacattttaatattaccttgagttaggccaatcatggataattaataattggcagtcgtggcaaaattactgatagaagagggagaaaattatcaataacagtgaatctctgtcatattcaggatcatgtgtttggtgataagtagttctctgttttaaaaatgtgtgcgatatacttgggattgtctatttaggttttatgtattagttttccataatgcatgctgttacaagtctgttgaatatatagtagctatcataagaactaaccatgtaaatatgtttcttctatctttctcctctggattcattttaaa

SEQ ID NO: 45843 - DNA, 1043 bp, Homo sapiens
tgtagtctaccaagcacctaaaatatgtggcacagtatagggaattaaatacgtattcattgaatcattgaagacagacataccagaagatgactggcaggagcaaaatggatagtagtaaagcttataaaagtagtaaagcattggagtctcactgaccatgtccagctccttgcctcagttttcccatctgtaaaatgggttatactattgcctgtttcataagactgacaattcaatccctaggaagaagcccagaggctggcacatagtaaatgcctaaccattgttaacctattaggtttatggtaccatggtgggtgctatggctcttctgaataacttctcatttacatttctttgggaattagatgatgtgctctctacaatgcctaggaaataaatgccatagataatgatggacaaaattattttcttttcccttttcagaggcaatttatgatttagggttttacttattttttgctgatggtgtacttacttctgacttgtatttcagccctggaagctgtgcgtttgtacccgccctcttgtctgttggttccagtcttctgtgtttctatgtcatcagcctgaagaatggcaaaggagtcatgttgttcccactggtctttttattccacttgcagctgaagtcatttcttctcactccttgagattcttctaatttgcctttgcctaagttatgtataaaattcaactcgactaggtggctgttattattttctatgtacaacccttggggtacactttataaatacagggtcatacagggagctttgacaccttaacctaacttctttttggtcctagttttattaccacaattacataaaaatttaaagaaattttaaatttaaattcaaagtatactattgcctgtatgaaacgggcaatagtatactgtttattaaagttctgggaaaaattgaaagtaaaacagtacactattgagtatattgttttatacaggcaatagtattctactgatgtcagtttttttccaggattagctacagtga

SEQ ID NO: 45844 - DNA, 1052 bp, Homo sapiens
ttcatttgatcaatgagataacttaaaacctttcataattatgttctttagtagagaaattagggagctgtgtctgtacacgacaggtatttacaacagtcctctatcatttcatcccagagtgactctccccttacctactagccatctgcctgatagacaactggcatcttcaagatcaaacaaatcatgggtctgattgagattagtgaacagccatccttgttcttaattcaagtggagaattacttgaacatctcagagatgactagtgcttttatttttttaaatatgtttaaattttaattaaatatatagggacggggtcttgtcatcttgcccaggctggtttggaactcctgggctcaagtgattctcctgtttcagcctcccaaagtgctgagattacagacggagccaccatgcctggcctagagtacttttagagtttagtctcatttcagttactatctacatttatcatcttttgccagtgagtattaaaacatcaagaactaaatggtttgacctaaaacctccacttaatcccagttacctatgaggaatacactattagaacagagagcagaagcatgattagtttcttttagagccccctctgatttttattgaacttgctcctactcctcttgagcttggcgtatgcataggaatgtttattttacctgttttaagtgacgtttacttggaagcatttgagtagtttataaatacatggtgtcatagtattggcttgtgtcaggaagacttgcttaccacaaagcagtgaagtctcagtggagagctggcccctggtctacagagtgacccagagctgggtcatggctggttcaagagcgtctcacattcgctgtctatcttatactgtctggatcttgagtttttgcatgtgataagccatccactttttgggaatatatatgctgtctctgtcactgctatctgggattcagtttctagtttctgaccatagctcctcactcctaccttgtaggctcctagctcagtccctttctctccttctggatatt

SEQ ID NO: 45845 - DNA, 1048 bp, Homo sapiens
gggtttcttcagctcactactgagatgacagccgttcctctcgccatcctcttcaaagtcatatctatgatcaataccctttaactcataaattacctataatttatgctgccagcttcttggagtaacagaatctcaaatcagaatggtagtaatgaaatattctttttactttcaaagcaatattctaatagacaagataccatatttttacctcatgtttttcctttagaatatacttatcctcaagttaaaattttatcccctttacataacaagattttagaaaatctaggccagtttgaactcccatgacgtgctttgagccatccatggctgtacattcccagattttagtgcaaagcctttcccaccaatttggaatgaactgatcattgtaaccagctttgtatgaaacacttgtttcggatcccagcgctgtagtgatgtcattttctttatacccaaagtaaatgctatgcagagtagcttattctggaatttggctgtacgattcttctcttggttaaaatcttccatagcagaggagccctgctaagtgaacagtctctcttacacattggtttttgtgcttctaactaacttttctaataatcttatttttccctgagaaagcaatccatcctatttaatgtggagtaggggttgtggttggaaatgaaaacaaatccagtatgttctagtctgatttttttttcttttttagcatcagtgtgttttcagtagaagtgattcaatcttaatgtggtttgggctcaagggtagagaacaataagagctataaatatagtagacaagagggggatcatgtttagtcaagataaagtctactttaagttgtttccatgtaagaccttgaactaaaaagaggaaaggtgttagatctcctaggactcattattagagttttaaagtttctgatggaaggtataagtgtctatcttaaattatttatatattaatgaaatacaacagggaaaagatcaatttgtaaaaaatttcaccatctttagaattctcaggggac

SEQ ID NO: 45846 - DNA, 1047 bp, Homo sapiens
ccagcactttgggaggccgaggcaggcagatcacccgaggtcaggagtttgagaccagcctggctaactccatctccaataaaaatacaaaattagccaggcgttgtgttacatgcctgtaatcccagctgcttgagagtctgaggcaggagagtcacttgaacctgggaggcggaggctgcagtgagccgagattgcaccaatgcaccccagcctaggtgatagagttagactgcatctcaaaaaaaaaaaaaaaaagcaggggagagtggggtgcagtgagtgtggagaggtagggaggagcatcatcttaggaacggtccagtttatgccaagtgcagtggaaagccattaagaacaagcatttggtcccatgggtgaccttcagtatttaaaaacaacaaaccaattgcaatgctgaatgtggattccagtaatacctgggaatgtggatgacttatgagatgcttaatagataattcctaattctatgttattcctatttgtaggaatctgaggctcagagaggttaagtaaagttgcttcaagtgatatagctagtaattgagacagccaaaattcagcttctggtttttctaactcttgacctcttgctcttagtagtgatctatctcccaagtttttaattttacttagttatcctaatgttcgtttttaatatttgtagaacatgctgcatattaattgttcacgtttgtgtgccaaagtgaatgccctaccctgtatgttgacttttgagctgtttctaatctctcaaagctttggttagccttgcttctgttgcctttttgttaggccgttaattggctatctaattttggacgtgaaatctctctgcagtgctgctctgttgtcagcagggggcagctcttggcttctgatgcagtcatctgcttgagagcatttggccttatttaaatcagaaagtattaatcaactgatgaaagtttggtgtatttttactgaaattttgccgtatcaagtttccatgatatatttatctgcttctgttataattaggaatgc

SEQ ID NO: 45847 - DNA, 1030 bp, Homo sapiens
acaatgactaaattgtattactgatgatacatcgtgtgttcattaaaaatgtttatggccaggtgcggtggctcacgcctgtaatcccagcactttgggaggctgaggcaggcagatcatgaggtcaggagatcgagaccatcctggctaacatggtgaaactccgtctttactaaaaatacaaaaaattagctgggtgtggtggcgggcgcctgtagtcccagctactcgggaggctgaggcaggagaatggcatgaacccaggaggcagagcttgcattgagccaagatagcaccactgcactccagcctgggcaacagagcgagactctgtctcaaaaaaaaaaaaaagtttatatggtttatattaatagaaaataaagtttgtgtgtgtgtgtgtgtgattgtaagtaagtgacagcaaacaatagggaaagaaagattaaaattctccaactgtgctagaaaaaaagtgcaaataatgtaaaagagtgactttgttctcttcggctcttctttatgttcacatgtgggctgccaactaaatgccccttttgtaaactttggtctgagggttgcttcttattcttttaactgtgtgttgggttaacttcctctatatgcttcaggttgcctaaactttctctatattcttcttttgtaaaaaggaatgaatactcaatatatcccaaagttagggtgaggatgtttttctcaaaaagataccagaagagagggagtggtcttacattaagttcttaaagtgttctgtattagggatcctcttttgattattttgattaacaaagaattctttggagaaaacatatgagcttgaaataactatagataatgtcagtttggaatgcttatggagatcactaaaacagggtaaaaagagggagaaaacaagttgaacacacatttagtaattctttctggggaagtgctctcggaggtgcaggtgttggatgttggataaaccagcttcttaaagatgacttttctaggtcatacatgcagtaagtga

SEQ ID NO: 45848 - DNA, 1048 bp, Homo sapiens
tcagttctgttaatagttagacaacactgccccctggtggactgaacctgcaacacttttcagtagcggttaacattgtgaagcgctgttcctgaaggatattcctgctagcagatttccttcagatttgtttcggagttaatactcttttgttctttctgcttaatttaatctggaggtttgtcaaaatcccagtggtgtacaaatattccctgttatatcttaatctcattatgacattatgaaataaggatctgggattttcatggcaaaaacttctcagatggacattttggtaggccccagaagacaagatgtgttaacaagaatatatgaaacctggtctagtgggttgatttttttcctcatgtataaatttttcaaaaccttctgaagaaatcattcttgttggagtcataataattgaaagactaatgtgaaaggtcccacttaacttggctgtttgtggacggatagtttttgagttgttgcatttgttttggtgtgtattaagttacggtgtaggctgacaaaatgtgtaagatatttttcttaatttggggtgttcaaacctgagttctctgcttcattgtgttcatgatgactagtgatgtgtgtggtggggggtagagtgtgtgtgtgtatctgtaggtgtatgtgtacatttatatatctatgtctatatatatatccctgagttatgaattataaaaaatgaaaatgctgtttggaaagcaaacataaagatttcattttctgttttatcacaccaaattgcagaagtgaacgctcttacatcattattatgcaacagacactctgctaggaactttttgtattattcttggaacctcagacagatcttctgatacagtttctcccctcacccccattttatagatgaggttcctgagactcactgaggcccagtaacttaactaagctcaggttacacagcaaggaagtcacgggtctgccatgcccagtcaagcatgacatcaaggctgtctctccaccatatcctgcagccttacaggaaattggagtg

SEQ ID NO: 45849 - DNA, 1053 bp, Homo sapiens
cctggtacctgggcctgtacgggcagtcctggatcctgagtccatgaaggccagcctggtgcttagaccctgggttcactgggggcaggcctagatccttagtccgctggcactggtcctgcctggagactgggtccctagggatgggcctgggtcctgggttcgtggcagcttgtgtggccccagggtctgctgaagcaggcctggatccttggttctgtagagcatgaggcccctgaggctggcctggctcctgggaggcctggagtctctatctgcaagggccagactggtttctgggtctgtgggtgcaggtctgaagcctttggccattggggcttagaagacattttggaagtgggtatgattgcccaggaatcatgtggaaaatgacaggaaatctgaagtttgcactctaaagaaaaaaaaaatgaacaggttgacaaagtagtatttaaaataaatttagaagaatcaacccgagatagagaagggaaactttaacagaaaaatatttggaaaacgagagagaggattttcaaaaggtggcagtagttgcagagacatgccatggatgagtccagtccaataaagactgaagcatctagcaattaggaggtaattgaatgcattgaaataggagaaggagagtgtgtgtgtgtgtgtgtgtgtgtgtgtgtgtgtgtgtttgtgtgtgtgtgtgtgtttataaagttgtttagattaaaccagattttttttttaatgatcacacaattattgaaattactcagggtagatggtggccgtttcttaagtagctctaggagtgtactctacatcccctgggtgccttgccactcagcagcccacttggggcttttgtcattgtgacagcatggtaactgtttctctcaagctaaaatttagggtgtatttcctgttgcatgaaaatgttttttgggaatagtgggtagatatttaatacagtggccatcatgaactagcttgaaatttgtgatgaagcaatagggtcccacctgtcactgttcactgctttctctgaacttcaac

SEQ ID NO: 45850 - DNA, 1067 bp, Homo sapiens
ggaatgcaaggggcagggttgggggtgggaaatcgcaagagcaaaggggcatgcactagctgtaataaaaggatatggtaagtctttaacatccttgataggttcttggaaactgcgacttcaagcgaaacatataggatgtgtaacaaaactaattatgttatcaatataacaaaacagtgttatttgaggacttgctgtaggtcgttttgcttaaagtcttggtttccaagaactaatctgcaatgttgagtgaggacttgcttttattttggagaaattgccacggaagacttctagttagagctcattgcccctgtgtcgtgccatgatcacttttagctgtaagagaaaggctgaaaatacagtatttattcagcggccgtgtgcctagctaaaaatggaggggttctatcagtaagggaagaggagaaatggatagtggggtaaaccatctccatctctgcctgaaagtagtgcaggaatgcgagggacacataatgaagacctgaactgaggcagtggagatacagaagacgagacatactgcagggattgctgatattggttactgatatgatacgggaagaaaagaaggtgaaggcattgagggtagtttctgctttgggcagctgggtggatgggagggaggatttgggggtaaggtggaagaatgctgacactttgggacatgttgcgtaggagatgcccatggcacattcagatgcagatattcagtgggctggtgggtatcaggtctgggctagagggaagagattttatattatttaaaaagaaatgttaaagacttctctcccttatttccttttttttcatttccttcagctttattaagatataattgacaaaaattatatagatttatggcatacagtattatatcttcatacatatattcgttgtgatatgattaaattaaattaattaacatattctttaccttacatacttatttttttgtggtgggaacatttaagatctactcctttagcaattttcaagtgtgtgatacattattgattataggcaccatgctgtctgacaga

SEQ ID NO: 45851 - DNA, 1296 bp, Homo sapiens
ctactcgggaggctgaggcacgagaatcgtttgagcccaggaggcagaagttgcagtgagccgagatcatgccactgcacttcagcctggatgactgagtgagactctgtctcaaaaaataaacaaaaaatttaaaaaataaaactccttggcatagacataactttgaatgtgacactgtgatttttttgctaattaagctttttttttttggctataataaaactgatttttccttaactatatagagataataccaaatgtctacatagttctctgccttatttggtgagtgagtttggttcttccttactcgtgggttttgagtagttttccctgtatcagcagctcagatatatcatagccgaggcaaaccaaaatgacaccttaaaccttttgtttcttatttgccttggtaaaaatggttggtagtagttgctcctggtgtgatgttatgctgtaggtgtgacaggatgcatgcgttgttgaacaaatacatttaatgagcacctttgtgcaggttacttgcgttgggcacattgaaggtgcaaagacgtggaagacatggttcttactcataagtttcttattctttagctaagaagaaacaatatgtctccaagtgactagcaaggaagaatgatcacatttagtttgtctggtgataacttcatggaggaggtggaagttgaacttggtcttgaaggatgactagaattctgaatattagagttttgtggggagagcatttcaaattgcagaaatggtatgagcaggaaatagaaattgtttgacgaactggggaagactagcctggttagtctgcagacatcatcactgagagataagttcagaaagattaccatttagaaaagggccatatcatgtagggcctcctaaggcaagttgaagagtttacagacttttaaaaataagtaggtgaggaaaatgagcttcagaggtattaaagaacatgactaaaggcacatagctgagatgatttagaatccgattaaaaatccagtctctctcatagcccatgagaagtctcagctttagtgcagtcctcttagtaggcacagcatgccagtaattggaagttatttgatgtaatgaggtaagataggtatcttcatgggttattcagttgcgtggagaattgtagaacttcataaattgtcctaaacttgctttttagagtttgtgtgtgtttttgaaactctctgactgtaattacttctcacagctgtctgtgggctggcataaagctgtatcttgttcctcccactttactga

SEQ ID NO: 45852 - DNA, 1032 bp, Homo sapiens
attccagaatgaaggagatgccgggggaatcttcttcagcctacccacacctggagcagagccacagttggccctcaagcagccacaacatctgagcaagaaataaaccttcactttaagccactaacatttgaaggtgatttgctactgccacaactaatctagtgaaagctgactagcacattgtgtactctgcttatttgactccctcgttgtctgcctgcaccttgatgttatctctttttttggcgtctgtccatcctaacgtgacgtcacttacaaagttgatgcagttcattgaacttgggatgagggtggaaagattaatgttgtaattcccttggattagagcagtgtttctcagtgtgtggtccttgaaccgtctgtatcagaatcctgtggggtttggcagggatacagaatcttgagcccccactgcaggcctgcgaaaacagaatatttggggtgaggtttcaaggaattctcagatatacccaagtttaggaaacactggacttgaagctagacaaatactacatcaggatgttactttgtgcatcccctccaccactgaaattggaatatgatagacagtgtcccttggtattcttctccgaccagaactcttttttgtgatggatggatggatggatggatggatggttgattgcttctagattagggaactaaacattggtcatctttatgagaaaattttagccagatttgattcaagaactacataacacttgacaagtaaaatgaatgagtacctcaactgatatactttttccatactactctttttttttcttataaaaattaaattttagttacataattaattcatgagtacattctcatagaaatttaaagcattactgatgaggtcaaattcagcattgaacccctccccaaatcttgggcccctcatatccactgtgccacaggtatcttggttttttattttttccagatttttttctatgcatgtttatgtgccgtgttaatatttatggctaatacagatgg

SEQ ID NO: 45853 - DNA, 1050 bp, Homo sapiens
gtgggggaggaaatgagatgggagaaatataattttaaactataaaaattccagtgaagtataatgcttaattgttagcatattctaagcaatgagttagccgcatttaaaaatagctttttaacatgaatgaacctttttatgagccgagattcagtgaagaataagttggtcatgcaaatggtgttttaatagtttatattaaatattttagggctgggatttaaacaaataacattttagagctgtaaaagcaaaaagtctgacctgaaggccacacaaataattatagttcctgaaatatagccctgtgaacaaatctatgccaccttgtttataatctacttcctttgagtttcaaaataagtaaaagggtggcttggatgtaaaaaggaggccactggctttgagcgagttgagagcagtggtagacgcaggatcttttgtgcctctctggggaaaattaggcagttcggaaccactcaggacattccagcagctttggagatcaaggaaggcctctccataaagaagtcaagagtagctggttgttcatgagaccacactttaaggagataatcattgcctctcttgtgaattggttctgaggcaacacaatctttgaagtaaaaaaaaaaaatgctccaggttttaaggagtaaagcattagttttgtgcaaaaaaaagtcattaaggttattagttttgtgtaacaagagttattaatggccaggcaatgtagctcacacctgtaatcccagcactttgggaggcctaggtgggaggatcactcgagcccatgagtttgagaccagtttgggcaacatagtgagactccacctctacaaaaaaaagttaaaacaattagccaggcatggtggcacatgtagtcccagctactgggatggctgaggtgggaggtcacatgagtctgggaactccaggctgcattgagccatgatcacaccattgtgctctagacttggttacagagcaacactctcaaaaacagaaacaaacaaacaaaaaaaacccgagttattcattaga

SEQ ID NO: 45854 - DNA, 1035 bp, Homo sapiens
tgaaagcaagtcattctgcttttaattacagtgtataaaaattaaaacatgggccgagggtctagttggatatacttcttggcaacagacattttggaagcctgcaatgaaaaatacaacaaagatggctatgtgctggccgccccccagtgtcttggtggtttcccgtttagtgactgtattcagttattgtgaaatcacagaattttaaagcaggaaaaagacctcagaagtctcttcttacccattcgtcctccagatgagaaaataagcccacagtggtaaagggattatagtgaggtcatatagcgaactccagaaggaacacaggcatctggactcctgtctggctttctttgagactgaactgcttcactgctgcctggaagctcttctgtggttgtggcttcttgctggccttagtgtagtgataagggggtgggaatgagggtagagggtaggagagaggaagggagagaggttgaaagagagaatgagtcattgtcattgagagggattgagagacagagaagatgatagagaaagacgtatgtctgctttgctgcttctcagaagtggtaccaataaagcagtgctctgaagcagtgtctgctgcatcagtgagctgcggagcctggcagtggttgaggtgtgggaacattctatacctgccactggctcctcctcattcctgcgctgtaaaccccatgttgaggttactgtgtctgtgtttattgcctctagtccagtccaaccatagatgtagccatctcaggttatggagagatgttaaggagaggaggggcaaattgaaaggtgcatgttttagaatttgttaattttcagattttttgaatcttagcaaaaggatttcctgagtataacctcacgtttccctttctacttccaaatctgaacaaaatcctgtgaccttccttgcttactcagagctggacatagtaagagaagtcatcatgcaaaatgattttctggaagtattttgaatgttttagttattctttcccagttcactca

SEQ ID NO: 45855 - DNA, 1046 bp, Homo sapiens
aaataaatgtcttttgggtatgaattgtgtctgctcatcttgttcaacctcagggagtccctagttctgttaatagttatgcaatatgcatggatctgaggtacactctgtccacatgttttcagtaactgatgacttctttagctctcatctgaggcacagattccccaccgtccattaagcatgtataagatcacattttccaagaatttattcagtcaactaaatgttcattgcatgcattaaacacaaaaggccccatgtttccaggtagcaaccacagggcaacagatgggtaataagagtaagaatttaaagaaaccggtgtccttggatcttgtgtggatgaccagttgtttcccagacattactgtggaaatcacctggggacattgttgaagtgaagattctgattctttagttctggagtggggcctgagatctgcatgtttaacaagctactaggtgatgctacggatgctggctgatatggtttggctgtgtccccacccaaatctggtcttgagttgtagctcccataatccccacgtgtcatgggagggacctggtgggaggtaattgaatcatgggggtgggtttttccctgctgtttctattgatggtgaataagtctcacgagatctgatggttttataaaaggcagttcccctgcacatgctctcttgcctgccactatgtaagatgtgcctttggccgtttgctttcctccatggttgtgaggccttcctagtcaagctgagctgtgcatcaattaaacctctttcctttagaaattactgagtcccgggcatgtctttaatagcagcctgagaacagactaatacactggtgcacctcattttgagtagaaagagatcttagggtaatacttcctggtttatttttcctccttagattttgcttctgctcttcctctacttctctattattgccacattgggccttttccagctggaactttcagactcagaacaacaatatattgttgtagcatttgttgatagcatttcagtatctccgctttc

SEQ ID NO: 45856 - DNA, 1033 bp, Homo sapiens
agcatttagcactgtgtttgcgcgtggcaggtgctcagagaatgtgtgcgcttagttccttcttactcattacatcactttgtataagagatttgagcacctttgaatccccaaatctatgaccaatccccacttatgccccactttaccgatggacgactatatgtggtgctttggcccagggtcctcattcaatatgtttctttagcgaatgagttaaaccccataggctgttacatagctaagtacaggaaccctattaagaatatacggcagagtaggtgctctgatatttagcttcgtctaacggcagaatagaatttcctgagtcagcaggatttctggcctgatcacttttttgctattggcttcacagtggcttcatctcctgttttggagacagggaattttccccattccctgggctgcttttagagcttcaggtgtgtgactttcattaatagctctcttgcaaatggcaatctaggacataaaagataagagtaatgtgttactatggatttcctcacccagctctttcccttctggcagagacttctgatagaagtagataaaggcttaggctgtgttcaccgggtgtgatgtagcagtctcagagatctgtttcattcattcttttgattgtatcaggttttttttctctctcttttttttttttcagacagagccttgctctgtcagcaaggccggaatgcaggggcatgattctagctcactgcagcctcgaactcctgggctcaagttatcctcccacctcagcctcccaagtagctgggaccacaggcacacactaacatgcctggctaatttttgtattttaactttttgtagggatggggtcccaccatcttgcccaggctggtctcaaaccactggcttgaagtgatcctctcaccttggcctcccaaagtgctgggattacaggtgtgagtcactgtgccaagtcatattttttcattttgggtgcaattcttcctaccttctcggtgtggcttgtatatcagttgttggc

SEQ ID NO: 45857 - DNA, 1079 bp, Homo sapiens
ttttgtaataccacatacatttaagacatggaaatttacaagggttgccttttgtttttattttattttagctgccttcctatttcaaggaaagacgccaaggtaattttgacccagaggagcaatgatgtagccacctcctaaccttcccttcttgaacccccaggtaagtgagcattttcactcaagaaacaaacctttgcatggtctgctttgtgttcaatattctggatgtgtttgaaatgtatgaaatttcattctactgtcaatagcttgattagtaacaagttattacttcaagagaatgatacttcttccaaaataatacaattacttggctccattgaatccttttcattcactttttaaaggctgtaacatctacatctacatctaactttcccaactttttaaggatttatctcttctcagagtggcaagtgacttaaaccaatcatagagctggaagagctacatctttttgaaacagttcgcttacatagggacatttgttctcccattggaaattgggacagaatactgagctttttaaaatagtcaccctgtcatcaaataggtactctaattttgactttgctagaaaataattatttaaataccatggttttggaaattgaagaatgagctttctttctgacatatggtgtcttagagggacactgtctagagctctttgagaatagtgcccttacggattggaagcttggttttagtccggggacaaatgaaaatctctggaatgttgttttagttctgctcttgtaaccagtaattttgagtttctatgcaataagatgttttattacatctgataagactaaacttaaaaaatacaaaataaaacaagtactgtaaaatatcattaatgttgacatgcgatggtatgaaacaggaagctgtatatatggttccaagcttcagcagagagtcttttttttttctagaagtaattcaataggcataaaaatgaaaataggtaagctgcactcagcatatacatatcttcagaaagcccccttcaccttcctccttcatttaacaaatgtctatagaggttt

SEQ ID NO: 45858 - DNA, 1047 bp, Homo sapiens
tcccaatccacaggatcataaagaattaggttaaataacatcatagaggagcaaagcacagtgccaggcatatttcaggaaattgccagctccctagtcccctgtaagctccaaatctatgtggcaaccaagaaaatctgattggattctttatgtattggttgacttggaacttctaggaatttgtctttattctctttatataaaagtcaaggccgggcacagtggctcatgtctgtgatcccaggactttgggaggccaaggcaggtggatcacttgaggtcaggagttcgagaccagcctggccaacatggtgagaccccgtctctactaaaaatataaaacttaggcgggcatggtagcacacacctgtaatcccagctacctgggaggctgagtcgggagaatcgcttgaacctgggaggcgaaggttgcagcgagccgagatagtgcaactgcactcctgcctctcccgcctgggtgatagagtgagactccatgtggggggaaaaaaaaaaaaaaaaaaaaaaaaaaaaaaaaaaaaaaagtcaggtagtggctacaaaataagtagataaaagaaaaattaacactatttaggacttaacaagcggcacttaaatgagccctagcaaggacaatgactcagaaataagttgatttttctgcagatgcttctgaagttctcaagtacttgggggtcaaactggcaaaatttatagaaagattcactaagtcctagaaagccttggagcatgtgagggaggaaggtaaagtagaaatatccgtgcttgcctcattctgggcaagcaaggcggggcactcagtggatattcagagggcctcctccctggagggagaagaagacttgtgcagaagatccaggcaggcccatttctttttctttttctttctttttttttttttttttttttttccctcaagacagggcagcaatctgttgcccaggatggagtgcagtgggttgatcttggctcactacaacctctgcctcccgggttcaagtgattctccgacctcaacct

SEQ ID NO: 45859 - DNA, 1047 bp, Homo sapiens
ctaccatgtgaaaactgcctgtgtgtgcttcaccaacggtttttctgtgacttgctttcaattgcctgccatgacgaaatgaacttctagaaatacctttatgcatttttcccctttgggtcatttctctggagatagtcttttaaaagtggaattattccatctaggaatttgaagttttatgtgctctgggaagatcacaccatttttttatggacagcaaaacaagatatactgttgtagctgggatctttagatgcctctcttgctacctgccccaaagttccctttatccccttctggggaccctggactcccactgcagcctccgctcttaatattctggttctgatcaatgatttctgccttctttctgtaacccagccccaccttatcattcatttttcctcacggattgctgttttccctcatatctgagccccgatcttgatcatctgcctggaccccagcagctctgacactgggttcttccctgaatctcaactcagtatgtgaggatgtgctctctgtccccgacctatgcaagaatattaacctcggcatcaacaccagcgctggtacccctgccgccaccactagcaactcaagtgccaactccaacatgaacgagagccgtctgcctgcctgggtctctggccccaggctcccttcaccccacgagcaccacttctcttccctggccccttggacccagactgcctgccgctggctctcccccatgactcagttcttgttccaactcagagagcccctgggatttgtccacactaaaagctgagctccggctcgtacaatccgtgcagggactaaggagtggcagggatgtttgtgtgctgtttctggaaagaggatgagaaggtgatgtcaaaggtaggggaagaagaaaaaaggcaaaagaagaaaaataaaaggaaaggaagaaggaggagaaccacagggtagaaatgtgggaattgtgttctattattttttgacttcttaagcttgtccaagtgaagccaagcaaagaacataaagcactgtcat

SEQ ID NO: 45860 - DNA, 1335 bp, Homo sapiens
cttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagg

SEQ ID NO: 45861 - DNA, 1022 bp, Homo sapiens
gcctgggagacggagtgagactctgtctcgaaaaaaaaaaaaatcatcaagacatattcacttttgagtattacaaattaaaccttggggttttaaaaatatacactcctaatctaaaatattgactgctgtatcggcctccttccgagagtcttgcccctttgtctcctgtcttgttgccagacctttcagaacaatgttctggaagtgacgtgctgcaggtctcagagctggctggtggtcggggtcagtactggactgtaggactcctggctctgaccaggacattccccactatgtgttacaggaaccggcagaagctgaaaggtctcagaggaggaggctgctggttccagcaaatgaaggtgatcccactgagagtaagtgttttgctcctggagatgcagcaggaatggagggaatagggacagggtcctaactgctgtccccagaggtcagagggctcttccagagtattccatgctggaagccgtgggtcctgtgctatagaccatctggaccctaaactgtcttctcccatctcttctccccactctacctcatcctctctgcaccctatcattgaccctaatgactctgtccgtcccctcatcctctctcctcctttgttcagggcctgatgtagcccccgcctgcccctgaggacctcctgaggggctggcctgtcctgcacagcaccactaaccccagtgggctaaggagctcttgacctgtgcctcagcccaatttgcagagctgttgtgtaaactacatacgaatgccaaagacttaatgcaaaaaagagtggaaaatatttcactcataatttttgtatattgattgtatattaaattatattttaaatatattcagtaccatacattaaaatgaatgtcacttgtttctgatgttctttaaaataaggctgttggaaaacatagcctcgtgttcctgaccctgtctatctctgaggacggcgaggtgcatcatgttgcacacacgtctcatttaatccctcatcg

SEQ ID NO: 45862 - DNA, 1027 bp, Homo sapiens
atatctcccagccaagtccaggagggcagggccagttcctcccatcttcaggcccagccaggcagggggcagtcggctcctcaactgggtgacaagggtgaggatgagaagtggtcgtgggattttttcagccttggtcagagcagaaccagagattttccaagtgtttgtttttactctagttccccttctcatcccccttcctcagggtgtctctgagttgtaaggccccattctgtccccagccccagggctccttgtccagtgtcccagcccccagcccagccctgcgccccactgtcctctgggaggggggtgcttcatgggcccctcccttcctgctaaggagactgcttcttttttaggtggtggtggggaccctgagcgtgtggacagagtgagttgatttctccaggagctgggggctcaggggttcaggaactgcttcctgggacagcagaacctgggtgggtgggtccccattgtcctcatggctgccctgactctctgaagtggcctgggtgctctgggctgactgtgggggacacatggccattttgagcaccacataggctggtgagccctgctgcagcccaggtgacatcctcaccccacagcctgcaccctagggatggggtgtctgcctgagcacagcactgggggcctggccccagcagcgggtcctggatgtgctgagtctgggctgcctgcggtgacctcactgagagggggtggggatgtcaggtgcagctgcatactgaggaccctgcagcgagccctaggtgtggactcctgagtcggctttttgccttcccaatgtctttttccagagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggtgagtgggggacagatcattttgtttcctggcatgctgct

SEQ ID NO: 45863 - DNA, 1030 bp, Homo sapiens
ctaggcaggcagatcatgaggtcaggagatcgagactagcctggccaatacggtgaaaccctgtctctactaaaaaaatacaaaaattagccaggtgtggtagtgtgtgcctgtaatcccagctactcaggaggctgagccaggagaatctcttgaacccaggaggcggaggttgcagtgagccgagatcacgccactgcactccagcctgggtgacagagtgagactacgtctcaaaaataaaaaataaaataaataaatgtgtggcttatatttcttttggcagtgctggtttaaggtgtgtaaatgcagaattgatgaactgaccaagctaggtagaggagatttccctcttttggttccacacatccctgaaagaggagtcccccagccaccactgccagcttctgggaatcctgtggcatttcattcaccggcttttctctcccctcccaggacaccatatctcagaagacggtagagattgcatctcctgcaaatatggacaggactatagcactcactggaatgacctccttttctgcttgcgctgcaccaggtgtgattcaggtacagaacatatggaccccatgcctaaaggtggaatgcggggtgatgacataaaagttgtagctaaaatgggatcaggagacctagattctggtccaccttggtcttcatcataccatgttccatgattttgtctttgagctttttaataaataaaacaggcccggcacagtggctcatgcctgtaatctcaacactttgggaggcatcacttgagcccaggagtttgaaaccatcctgggcaacatgagaaaccccgtctctacaaaaatataaacattagccgggcatggtggcgcgtgcctgtatttccagctacttaggaagctgaggcagaaggatctcttgagcccaggaggccgaggttgcagggagccgagattgtgccactgcattccagcccaggcaacagagcaaaaccctgtctcaataattaattaaaataataataatacagaaa

SEQ ID NO: 45864 - DNA, 1127 bp, Homo sapiens
cacagaattgtctttacaattacccttccacagcttgcttaaactttcatttttattttatccaacttaaaacaatcctttaaccttttaatctagtaaaaaatatccacattctcatgcctccttataatctttttaccaaaagtatattttactttccttacacaacttgcatgtaaactgttttttcaatagtcttaaatacacattacattgttaattcttagcaaccttttcttttggtgaaaaccttggtaaatttgggattttaattatatactaggtatggagcctacgacctagacagaaatgcaggtaaggtctgacttattctagcatctagctccatgtgtcctaggccttacctagctgcaaagcaggcaagttgtacagctaagagtcatagtggcattttataaagcatttaggaggcctaatcacctttaaattgtacaacatttcttgcataaatttcctttcataaattctttcacaacttacacagacaatctctgacatgccttgactttctgacttgttctaaacatccctctctttaaacaaccagttaatttactttaggacaagaatttaccatacaggagcccttcttgtataaattctcttttctttaaaactttttgcatagctaggggacatggctaatttcacatgtccccaggccgtatctagaatttaacagtccaaaataaattgaacactttttaagtcaaagaagcattttatgacctaaagcatttagcaaacctagtatttgacctgcataatttagaccaactatttacatttttgaagatacttttaccaataatctttaaaattctccttatttttataactttctgtatatctctcttatttcctggtttcttttaccttgttttatatataacctttaaataagctttgaataagacaacaattagttacccttggccaggcgtggtggctcacgcgtgtaatcccagcactttgggaggctgaggcgggcggatcacaaggtcaggagatcaagaccatcctggctgacacggtgaaaccccgtctctactaaaaagtacaaaaaattagccaggcgtggtggtgggcacctgtagtcccaccta

SEQ ID NO: 45865 - DNA, 1215 bp, Homo sapiens
ctaaaaaaaaaatacaaaaaaattagcccggcgtggtggcaggcgcctgtagtcccagctacttgggaggatgaggcaggagaatggcgtgaacccaggaggcggagcttgcagtgagctgagatggcaccactgcactccagcctgggcgacagaacgagactctgtctcaaaaaacaaaaacaacacacacacacaataagcattagcaaatttgtagagaagttggaaccctcgtgccctgttaatgggaatgtaaaatggtgcagccactatggaaaacagtatgatagttcctcaaaagtaaaaacaggattagcagatgatccatcattcccacttctaggtatacgtccaaaagaattgaaagcatggtttcaaacagatatttgtacacccacgtttatagcagtattattcacaatagccaaaaagtggaagaaactcaagttggacagatcaatagataatgtggtatattcatacaatggagtattactcagccttgaaaaggaaggaaatactggcacatgctacacaatggatgaacattaaagacatgctcagtaaaatgccattcataaaaggacaaatgaaataggattccacttgaggtacctaatgtagtcaaattcataaaaaccaacagtagaatgttggatgccagcggttgtaaggagggaagaatgggaagatgaaataacttctgaggatggatagttgtgattattgcacaacaacattaataaatgtagtgtcactgaactatgtattttaaaagattaaaagataagtttcatgttatatataatttaccttagttttagatttaaaaaaacagcatttattttagtcactataacaattacacataaaatggaaatattgttgatttaaaaagccaatgcacaagctgggcacggcggctcacacctgtaatcccagcactttgggagggtgaagcgagcagatcacctgagattgggagttcaagatcaccctaaccaacacggagaaaccccatctctactaataatacaaaattagctgggcattgtgatgcatgcctgtagtcccagctactcgggaagctgaggcaggagaatcgcttgaacctgggaggcagaggttgtggtgagccgagattgtgccatggcactccagcctgggcaacaagagtgaaaatccatctgaaaaaaaaaaagccaatacaca

SEQ ID NO: 45866 - DNA, 1022 bp, Homo sapiens
atcctcccaccttgtcctcccaaagtattgggattacaggcctgagccaccgtgcgcaacctatgattttggtggtggtgttttttgtttttctgttttttaaatattcttgagtatatttgtaagctttagatgacctgttttaagttatttaatctatcaacaccattatatctgttattacggccactgtttctgttgattacattttttttcctgcccatagggactttttttttcatgcatagtaatttcttattgcttgacattgtgaattttgctttcttgggtaccgaacatcactgtgttctttcaaagtctattgggcattattctggtcacagaaaactgaggatcagtttgctcctctgatactagcttttatctacatataactatataccttgtgttcagttgccttattcaggggctcatttagttaactactaaagttatagtggttgacttctgatggtaactcgccagcaccctggcatgcgttctgtccactgtgggaaggggaacatgcagatctcccagccctgagtggtccacaatctagtctctccttccctgggtggcttcttctcaggcacctagagtcagtctcagcagacactggacatgtcttctgcaaggatccagagtcctccaggcagctgcttctcccagtctctgccctgcacttggcctctgggagttcctgcctgtggttctcaacagagactacagagctctacagggtcctctgcccctgctgtagctggaggctgtccttacgcagtgagctgaggccacagctagtctcactgcatgtgcttggcggcggggacaggagtgattcattcatcaggtagaggaggaaccctttactctgggaaaatctgtgcctgggttggggaaggacaaatgagccctgtgtgaatactgactactccctggagcccacagtctggtggagcaggtgacagcagggacctaaataactatcaggaagcatgaggtcccaccactgtcacctc

SEQ ID NO: 45867 - DNA, 1047 bp, Homo sapiens
acagtgagaattaagttagatccgagactgcgaagagcttctctttcaagcgccattacagttgaacgttagtgaatcttgagcctcatttgggctcagggcagagcaggtgtttatctgccccggcatctgccatggcatcaagagggaagagtggacggtgcttgggaatggtgtgaaatggttgccgactcaggcatggatgggcccctctcgcttctggtggtctgtgaactgagtccctgggatgccttttagggcagagattcctgagctgcgttttagggtacagattccctgtttgaggagcttggcccctctgtaagcatctgactcatctcagagatatcaattcttaaacactgtgacaacaggatctaaaatggctgacacatttgtccttgtgtcacgttccattattttatttaaaaacctcagtaatcgttttagcttctttccagcaaactcttctccacagtagcccagtcgtggtaggataaattacggatatagtcattctaggggtttcagtcttttccatctcaaggcattgtgtgttttgttccgggactggtttggctgggacaaagttagaactgcctgaagttcgcacattcagattgttgtgtccatggagttttaggaggggatggcctttccggtcttcgcacttccatcctctcccacttccatctggcgtcccacaccttgtcccctgcacttctggatgacacagggtgctgctgcctcctagtctttgcctttgctgggccttctgtgcaggagacttggtctcaaagctcagagagagccagtccggtcccagctcctttgtcccttcctcagaggccttccttgaagatgcatctagactaccagccttatcagtgtttaagcttattcctttaacataagcttcctgacaacatgaaattgttggggttttttggcgttggttgatttgtttaggttttgctttatacccgggccaaatagcacataacacctggttatatatgaaatactcatatgtttatgaccaaaata

SEQ ID NO: 45868 - DNA, 1049 bp, Homo sapiens
atgtttgggaatttgtttaagatgtgtcttggtgaagatctcttcatatttatctgttaggggttttttgggcttcatgaatgtggatgtccattcccatcctgttttgggacattttctttaattatttctttaattacactttctgttcctttcactttctctgatgctccttggaccaccataatgcatatattgttttgcttcacagtaaccgttggtactgttggctttcttccctctttttcattctttattttttttttcttcctgtgacttggtaatttcaaatgatctgttttcaagctcactgattctttcttccgattaatcaactctgctgttgacattctctgtggaattttcttagttcagatattgtgttgttgttaattttagaatttctgctttcttctttattatgttgtctgtgtatattaaactactcattttgttcatgtattgttttcctgacatgacttagttgtctatccatattctctagtagctgactgagcttctgtaagatgactgttttcaagtctttgtcaggctgttgtaaatgtctattcctttcgggttggttacttgtgcttcattttgtttctttggtgccgtcactgttccctgattgctcaggagcctgtggcaatatgttggaatgtgcactttgaagaagcagggacttaatccagtatttacagactggctttgtcagggaacgcccttcaccagtcagcctgttcacagattctgggcaggccatgtggtgtggttcaagggtggtcagagccagtatccagagaggtgacctgaggcctggctccatgagggctgaactggcactggaataggccttgtacttgggtctgcagatgtcagccaggtgctgtgatgggtctcatccttgggtccacagggaagggcctggagcctgagttcatggggactgacctggcactaggacagatctggaagctgaatctatggaggtgggtcaggatcctgggtctgtagtgctagcccgaaggcacaagctaagactgata

SEQ ID NO: 45869 - DNA, 1075 bp, Homo sapiens
actctgaggctctcaaggactcctgagattggaggctgggaacagctgggccctgctgtgcttcccctccagctctgtgacactggtgtggccccagctcctgcctgtaaagtgaagaggagataaaaatcttcagcagccctgtgtaaacctcagagggctgtgttagcaggtgtgggaggatgaaccacatcctcagggctggtgtcagtcactccggactggatccccagggcacatgtcctccacccagcagaggctgcacctgttcctacttgcacctccataccaggctccctggccttggggcagaagcttctgaagactggggtggagcaccatgtggaggggccatcgaggaacagaggagccagagttcaagtgaggacagcgatggcactgcagggccacagcctggtttacctgccaagtttccagttgtgcttctggtgggtgtccggcccgggttggagtttgaagatgagcaggaaaggtctccatccaggtggctgcagatggctgctcacccagcccctactgagaggccacggtcccagttctggttctctgtcctgtatccaggagtggcagggtagcgaggctctagcttccaggttggggatggagacagtggggacagtgccatgccccgagcctgtgctgttgggcagctggtatcctgctcccagccagagagtgtacatcttcgtgtagtggattttcctaacaaccaggggacatgagggcaggttgttttccctgttttacaggtggcaaaatgagattcaggagcaatgtctccagcatttttgtcctcaccttctgaataatagcagccatatttgggcctctgaagggctagagttctctgaggagctgcttctctgatctctgtcctgcacttggcctctgggagctcctatgggtcctcagcagagtccacagggctcttcggagtcccctccctgtgccacagcctggagcctgtccttaggtggtaagctgaggccgccactgcgctcacctcatgggcttggggggaaagtgagtcacccaggaaatagacaatgagctc

SEQ ID NO: 45870 - DNA, 1092 bp, Homo sapiens
gcgctgcaaatcccagacaaggacagaagaacagggtgaaatcctacagccagacctggctagagccaccacaagccatctgctcatcctcttaccttccctctgtttctttgttttcccttttttgcctggactcttaatctaatccagagcctgctgtctctgtatgtccagggatttttttgctcagacctgaactgggtgggtagagggaagagaagcaggcacacccttggaaaggaagggagacaggcctctaccactaaataaagcaggaagcccccgaggggctacaggcgtggcctagtcattgcccttctccacacttggatgggccatctatacaacctggcctttgcaccacatccctgcttctcaaagtgaggtccttggaccagaggtatctgccaccacctgagagcctgggacctgctcaatcccagggcccgtggcagaccgacacatcagcatctgcatttggcaggattctcaggtgaccgtgtgcacactgcagtgtgagaagccgttgtctagatgatgttgaggctccgctgcagctccggaatgtggtcatcactgttatgggcagaactaacatgtcctggccccttctaagtgtcaggcctagggaaccttcgttctcctagaaaaggacacagaggcttggagttgtctcttgcccaagataatgctaggagttgcagagagcaggaatcccggctcgggcctgtctgactccaaactacatgctctttcttttttgtctgctgactcttcatcagaaatctatctttggcttttttttttttttttttttcatatcgcagctgatgacctagtcacattcaaatcagttttgggatagttgttccactagtctcacaagaaaggactatggtagaattcaggggtgctgattttccattcaaacaattgaatattctgaacgtcctaattagcccaagaaggtgtggtctttatagagaagcaggctagtcttcttcaggttgtaagtcagtagagttaaagtcatgacggttttggtgcttggctcccttcggggaacgtgtgggtggaagccctgggcggcgg

SEQ ID NO: 45871 - DNA, 1032 bp, Homo sapiens
aggcaggtcaatcacttgaggtcaggagttagagaccagcctgaccaacatggtgaaaccccatgtctactaaaaatacacacacacacacacacacacacacacacacacacacacacacacacaaattagctgagcgtggtgacgcacgcctgtaatcccagctactcaggaagctgaggcaggagaatggcttgaagccaggaggtggaggtttcagtgagccgagattgcatcactgcactccagcctgggcaacaagagtgaaactctgtcttaaaaaatatatgtaataacaataataataataaagtaagcaaaagaaaaggaaagggatgaagttagcacactgtggttgacagaataattttacatcctagaaaatagattaaatgaaattacacttttcaatgtaaaaacgttgtgtttcctgggaaaaaggcagatgcgtcctaaccactcctgattgcatacatatgcaatttacaattgtactttctgagcagatttggaactctcctggggcttagctgacttggtctgggtctggtctcagcacccctgctaaagcctcctagggaaggtgctcgggttgacagctctctgggcctctggttccatgtctgtaaacaagatgcttggagcacaatttctcaagttacctggcggctctttagatcttaaccctttaaatctctagaattttagggtttcaaccccattggtatagcttggccctgaagagagcaagcgcacattgccgtgtgagagacagaccactaaggggcgctgcttcctcggaggaggcgggagttctcctcctcctccgcattctctcctctgatgaaaccacactcatcaaaagtggttgtgacagaatgctcagatttggaatgatgagaaacacggaagccacatcataggacctgatagatatctggccaacacaggaacactggaatatgtgatctatgtgaccatccccttcccaaggccagatcgaacacccaccccttgacatataccaacgtt

SEQ ID NO: 45872 - DNA, 1052 bp, Homo sapiens
tttctgcttaatcgtgcctcagtttcttccagcttccaattggtgtttcccccaccccccttaattaaaagtcatctcagcttttaatcgtactgggagaccccatgcacagcctgccgagtcctcttcctaaccgcattgactgaggctgttgctggcagcaccactgtaaatccagaagggaagagtctgcatccaatacaggaaataaattcacattttgaaggaaaaaattcgacaatttaagccaaaatctaaaaaggacaattggattggcatatgtgagattggtgttttttcacctatttatttagttgagaagtttggggaattctcgtacagtttttttaggtggagtttgttttgtgcgagtgtctgtgtgtgctgttccctaactccagaacagttaaattcctgtagttggtagcagattagtacccagaagtggggttgttgctataacagataactgaggatattataaaagtggctttggaactaggtactgggcagaggctgggagagtttggagaaacaggagagaaaaggcctgtattgccatgaactgagcattaggggcagttctgctgagggatcagaagagaagaccaagggaattctgtcccagttgtggctcaaactgcctcaggtgcagcttaacctgcgtctctggaaggtaaaatgcatctgatccttgaggcaagagctgtgggggcatggctccctcacctggatttcaaagcgtgttaccagcagcctggggacccaggctctgcctctggatttacctgcatcgtatttgcgcttcgtggtcaaagttgttaagaaaggggtgagcttctggctacctaataagttggtcttggccacctgcctgcgacacttcctggaggagccatggattattggtggaggctgcagggagctggcgatggagccactggtgtcagcagcagagagggaagaaaggaaaggaaggggccacaaatggttgaagtgggcaggtgggcacccagggagttaggggaccccgccttccagctctgggcata

SEQ ID NO: 45873 - DNA, 1050 bp, Homo sapiens
caatcagacttcatccctttctctgagtctcaagaattcatcctacctcgccaatgcatttatcatgttctgctttttctgttgctttttaaaaatcccctttcattgtaagtcacttaagtgcagacactgtatcttactaattattgtatcttattacttgcttagcacagtgcttggcaaaaaataaacctctaataaatatttagagtcatagaatatcagagctgaagagaaccttcctaccatctcattttataataaactgaggtacaaagaggttggaacctgttcagtattcattcaaggagtacatggtgaaatgccagctggaaaagaaacctatctcagggatatatgacattatgccgagaccgggttcatgcactgattgatttgacaggtgaactgctccatgttgtgggaccagggatgtgaagcaagtacatcaaccttgaaacgcgcgcagttggtttgggagagccggcctgaggaagcccctgccccaaggctgcccacagagggaaggattgtgtgtgtgtgtgtgtgtgtgccatcttgacagagtgagtcagtctgacttgcctttgtgcttgccgtttgtaggtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaaggtagggctgtgaatttgggaacgagaatcaaaaagatgcttttctgcagttacagcacctcatggcagctgtggtctgtggctgtttggggcattgctgttagagccggccacggcagaattgtagggacagtgacgtttgcttttggtcttgccccctccccacaagtgcttcctcccttctcaccctaccatcccgtaatacacagcactcctgtcctactgccctgtgtttggttattctcaactgtctgttccccagccccggcaaaagggtcagttc

SEQ ID NO: 45874 - DNA, 1094 bp, Homo sapiens
agcagacgatgaggtcagagccttaacaggtgttagatcctgtagggctttgtagattggagtctttggaggatttctgagtacagaagtaatctgatcggggtcctgagcaaggggtgggagtgtggagctatcaatttccaagaaagtatcattgcccgagggtgataaaggcgaggtcactggttgagactgccggtagaagactagttaggctgctctttagagcaggcaagagataagagcctgatctcaggcaaagatgataaggaaagggattttagataagctgaggttaaagaaattaaaggaatctgtaagaaattacatttggggccaggcacagtggctcacgcctgtaatcccagcactttgggaggctgaggccggcagatcaccgggtcaggggctcgagaccagcctggccaacgtggcgaaaccccgtctctactaaaagtacaaaaattcactgggagtggtgacgggcgcctgtagtcccagctactcgggaggctgaggcaggagaatcgctttaacctgggaggaggttgcagtgagctgagattgtgccattgcactccaccagcctgggcgacaagagcaagactctgtctcaaaaaaaaaaaaaaaagaaaagaaaaaaagaaattacatttggaagatgaaggaagagggatcacacgtgaatctggtttccgatttgtgtagcttggtgggatcaagattgggactgcgggggcagagcagattaggagaaaaaggggagaagattgcagttgttaggggtgcagttttagaattttctcatggttctgtgcaacattcagatagagatggctcataggctgttgaaaaagtgtagaagagaagcctggggtggagaaagaaaaatttgagttacctgatcattgaagcctcagtaatgattgtagttagaagagaatgaggctagacagagagcctggaaacataagagtagtcggggttggcagagaacaacgcttaaaggatcctgagcagcagttattccagagctcagaagcagaccagacgagacagctgtcttgagaggtcaagcagctttgtgagaccga

SEQ ID NO: 45875 - DNA, 1027 bp, Homo sapiens
gagtcactcctggttccaagctgatcttgactggggagatggggtgttgggtgcaaggtgtttttccttcttctctaggtggccatcctgggtttctgtgctctgcaggatttgtgttgcttctttgctattgtccacatctttcctttagttgttttggttgaaatggcattttaaaaaattatgtatttatttctgtgggagcttctagttgactgtcttcctctgaagctacaaaatatttcttttaacctaattgcagttttgtagtttatacttataactgggatattttctcctctgtttagttttgtatctccaaacctgtattcctttcctgttcttgtggagttgtggtcacaatgatcttagtgccattctgtgtaggtgatagagagctgagatgcagaaagaagggaagaaaggaagtccttgtaggaaggatttgaaaggtttgatgagacactaggaggaatgtgagttcagaaaagggactgctctgggattgtcttagcataatggtgactgcattgtaaattgaagacatggtattgcttatgattcaatagttatgaccttggaaaacacagtgatgttggaagaaggttgtctggtgcaacaagaggaggctgttgaaagatagagcaacacctcagagacagactctggtcgaggggtccagctgtaacaagattggtttaaggaacatttaaatgctccccagtgataaaatccctagttcttcagaaatatcacagtgaccttcaatagttcattttcattttaaaagaggaaaggatctccacttacaatcttacatagcaatgtattggagaataacattggtcaaatactggatcaaacaggctggggtttgaacctatgttttcatcattaaagtaaaataagacccccatagactggttaaatttatattttgattacagctgaagtcagtactcactgtaaatattatacataataaataagttattatttgataataacatgaactattatttgatgc

SEQ ID NO: 45876 - DNA, 1052 bp, Homo sapiens
tcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgctctgcatgtctctactgggagatatttggatttcaatgatagcttgactggttggacattgcatcaaatacacgccccatgtatcctttctgtcgtaaagttaagaacgctcttgcatttgatgtggaataaatatagatgatattactatctgctattctgcctttgttctgaaacaattgctttgtcagctaatttcattcaatatttgttttttagacgatctctataagttattaatttaacctgaaaccaaagtggtctccatttaaagttacttaatccctttgtaccacctatttctagttaaatatatgttgctatgcaaataggtaaagtgcttccttgccatgatggtaatggattggaactatgaaggctctcagtgtattggcttctgtaaagatgaggcgtctcctcagaaacaaaacttttcacatttctgcttactagacctgggttgatgtacatggtaagtctcaaacagatgcaagctatgtgcaaaaagtaactttagccaaatggaaatagctggatgctttgagaattacttggttgaagtaagaaaactgtaccatcctctatcctgtgtgccataataaaatagtaaaaaacctaaattgagcttaaagtcttttttaacatttccccaaatttggtactgtggtcagtgccccttttaacctgcagttctctttcagtattccctctcctaatgaatgatcccctctctataatcatctgattccattaaatggactccttaaatgacatcctacctcccattacctctcctctgcccctctacactaacctatcacagagttatagtgagaacacctccatgtcttagatccttccacatctttcaatgtcttaaatcct

SEQ ID NO: 45877 - DNA, 1046 bp, Homo sapiens
aggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccgacgaggcggcgctcgctcgcgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggtgcggcacggccagaaacacaggggggcgggggactcgagcaagggggggagttggtgcgcccagaaagtggagaccaggggtggtgcggctgcacgcagctcttagggatagggcttggctccttggccactgtgtgggaggggtggggcacttgaagggcgtgagtgcgggcgccactgtagtctgggagtgtgctccgtgctgctgcaccggcgttccgcattaaagctgcccagcccttgttgggtgggggaggggaagacgtgggaattgggcgttgcc

SEQ ID NO: 45878 - DNA, 1056 bp, Homo sapiens
atttaatcccaactgttagaaataacctacaagaaatccagtgaggcctacctacccagagataagtgattcacctgacaatatgcatcacaagtcttaactctcatttcattagtcctatccagagaccacattttctacttaagcaatacttagaggcacatctctcagcaaacacaaaccaattggacaatttaaactagcactattcaaccataatgaactctggttgaaaaacagtctgtccctacttgcatattgtagtgagatgagattccactcttcatgtcagaatggcacttacatgagtcaaagtgtctaaatgaaataatttaaatggaacaaagtcaaatacttacattttatttttaaattctcctctatttgcagttatactttaaagtgtactcccttctctatcctatcatgaggactggacagcctccacagagatggctggacaaagcaagggaatttacttaggtaagacaccatttctctttactctgaaatccctgcaaatgtagttattccagaggagactgtgcaatgactgatgggtttagcatcctacatgaggggaaattgccattcccagctgtaaaatgaacaaatatccagttattttttttagccatcttacagcttagctaatataacaggatttacagccaattatacatgaaagtttaattctgtgtcagataaagcatatctttgatgcagaaatagaggcagcattaggccttacctggttaaaagctttttgctttctattcattcattcgttcattcattcattcaaacctatacttactgaatgctcactaaatgccgggggtttattaagagagatttaaataagatgggatctttgactattacaggtttcagcctaggggtaaattaggggaagacaaccatgtattcaaataaatgtaattaagagtaatggttgtgtgtgtattttacatgcttgtcctgtgtaaataacacgtccacggttgcacctctggggtggaacatctataaaatttagataatgatacccacttt

SEQ ID NO: 45879 - DNA, 1047 bp, Homo sapiens
aataaagatagaagaacatcttaatttagggtggtgtatcatcagttttccggaaattaactgagttttattgtataagaacattttcctaatctgccccagaaatcattttgagcagaaatagataaggcctgaaatttccacatgaattacatgaatattgttttcatcttgcagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttc

SEQ ID NO: 45880 - DNA, 1044 bp, Homo sapiens
gatttttttccccacatttcaaaagtactttcatgtgcaagatcttatttttgaatttaaattcaaagacagttaagttcaaggggttaaacaaagcattggaaacttagcttctttgcagtctagattgatagcaaaacctattgtctatataattgtaaggaatagttcctataagcaacagataattaatgtgatttttagattttgatggtagctttttaaattttgatttccccagggatgatgatgttttgtttgtttgtgaaggagagccatttattggtaagtgactttaaaagccaattttatctgccaaaaaaaaaaaaaaaagatggaatgacaattattttaaatggggctattaagcttaaacattaaaaatgatcttatggctgtattcaaatcttcacactttttgattctgcattgggtatgttaaagtaaattttttactatatgatcgtagtttattatagatgcatgttttacatgccgttaaaatgctctggaggtatacatattcattaactgtaacatagtaaggtagttttgatcttagaaacaattgttttgtttgaaaattttttctttgatggtgaatgtcaaaatttttctacgtgttgtattacatatttgtgagtaaatattgcttgcgtaagtagtgtttgacagtatttcacagtgatcagatcagccaaaaaatgacttggtatcaaccacacacacaggtgtgcacacacactaccctttgatttggaagaaagcttatagttgtatatctcaaaagaaaaggccgaaaggaagataaagtatttgatttatttagatccatacagtccacactctgaatatttaagtattttttaaagcatcatactaattgcatttggtgagtggaagtagttctcacgattgttgcacaggcaattgtcaacttagaagtaagtgcatactcttgtctgtctgtctctaccttaaaactgtaagcaagaacttctcatcttcttttatccattggcctaacagtgactggcaggcaat

SEQ ID NO: 45881 - DNA, 1095 bp, Homo sapiens
aactcataggcagctttcacttgtcatgggatctgaaatttaaaaataattgactctgaaaagtagtataatacagacatcatgaactttaatagacatgcttctcaataaatgtaaaatgcttctattcttagggcctaagttgttaaggtagataatcccagtgacatggaaacatcaggccacatggtggagataacacatacaaagtaaatgacctttgtaagcactatcattttatgatttatttggctcagtatgaggacaaaaacaatcttagtatatactaactggagcttatgtccatgatatacaagatttttattgctcctctttctcaaaagagttatataaagaagaatgcatgtgccagtctgtttgcaactttctccgtaacttaatcatcttttccatatgtatgacaaatttatgttgatatatatattttaaaacctggtttctaattagtttaaaatacagagtttttgcatatttgaatattagtattgcaacataactcctttttatttgtatggtattgttagtatgtgcgaatgattagttggaaaacaaacgtcaagaatagccctccaagtgaaaacaagtatattggcccaacttaagggaaattttcaaatttctagaactataagattcttcgtattaattttaattctgttttctctaattgaccaccctttggttatttcacttaaaggaaattgttaactgcctgattgcaaactgctaaaataattttatttatagaactagtatctggagctatggagaccttaaaataaattaaaacttccccccttattacaaaagtaatataggttcattgtaacaaatttggaaaacaaacaaaataaagcaaaaaacttagcagggtgtggtggctcatgcctgtaatcccagcacttgggaggctgaggcggttggatcacgaggtcaagagattgacaccctcctggccaacatggtgaaaccccgtctctactaaaaatacaaaaattagctgggcgtggtggcacggttttaccatgttggccaggctggtcttgaactcctgacctcaggtgatccacccac

SEQ ID NO: 45882 - DNA, 1022 bp, Homo sapiens
gtagaggggctgggaggtgggcgtgcgcgggctgggggcgctcggggacagcacagggtccccgcggcctcctcccgaccctcaggacccccgtgcccgagcctgcccttcagtgcctcagctgcctgggggccggcgcggttcggcccgggggctccgggtctcccggatgcttggtgcggggggcgcggggacgggggcgcggggagggccgcggtcacctgggcgcccgggcggtcgcgcctcttcccgcctctccccgagaccccgctcccgcctgcgggaggaggcgcgccggctccggtgctgagtaatgatctgctcggaaagtggcggcgagcaccagagcctgtggagatgggtcagggagacagaagtaaactgcccgtggataaacaaaatctcccatccgaggtcgcagacaggatttttaaaatgggggcattttcttgttgatttttgccctcctctctgagatgcctcaagcccccacgccccgccgccgccaaacttctctgtactctttttattattttgccttattttgattccctagaggacgggtacagcagacccaaaagggatcgatttgacagtcgcctttgctgtgttaggcctttgcggagagtgtggtgctcagtgttcttccagcgctggagcaagccaaaacgaattctcttccttcccagccttttgccccacccatgaaagttgttctgctcctttgggaaattttcactgttcgaggcagacatttattgcgttgctaaatgatacctagaagtaactcagcctttacgagtctaaggtaaaggtaaatgggtctcgctgtgttggttgccaaaatactctgctgcctgcacattcggggaacactgtaaatttttaaatagtgaaattgtccagtggcattaaaaatggctttccgattattcagtgtagagtaaacatgctccgaaaattcgaaccagagtgtggtttgttggctataattttatgttcttttggtcttagagatttaa

SEQ ID NO: 45883 - DNA, 1072 bp, Homo sapiens
taatttttgtgttttttgtagagacagggttttgctatgttgcccaggctggtctcgaacccctgggctcaagtgattcactcgccttggcttcgcaaattgttgggattacaggtgtgagccaccacacctggccagacagacacatttctaatgaaagaaaaatcattccaggagtcaggctggggaagccttcagtgctgagttggttccaggttgcatgcaagcccaggatgggcctgctggaagggcatcttgatggggatttgaagggttcgagggaaggggttggagctttttgaaaacacacctggcgcatctgccaggcctgtgagaaagcaagaagaagcgcccggtgtgggagagaagggaaccaagggcagaaagatctgccggatgggaatggagaaaggaagtgaggccccgttgggactgactggcgtccacagggtggttggatcatgtgagaggcctcgtgcctgttgctgcaacatgctggatgcgacaactgcagaagaacgatggggcaaatgaatggctctgacaaagacacctcgtacacacagctgggcacgagccattagtcgggtttactaaacgacgtgagagcaaagggcacggctactcatgtcttggaaaagagccaagctccatccagcaaccccttatgatttttaaacccccagctcttatataaaactttttaatggcaccaccatctattttccttaaataaaaaatgttgaatgtttctctcacacccgttggagagggaaacgagagtttaaattaactccaaatggtaaaaatttaatacagctccagctgcctgcaggtttcttcagttcacatctttcagtgtgagagctgctccagctgctctgtgatctcatctaccatttgaaatccggagtgctactgagcagcagttttaaagcacataatggaaatcacttgacttatggcctctctgatcagcaggtgagtccattatctgatgataaaacaaaccagatagtcctagttaagaaatcataattatctatttggagtcagaaaaaaaaaaaaaaac

SEQ ID NO: 45884 - DNA, 1050 bp, Homo sapiens
gcaaacaaataacactcctgatagggccgggtgacatgtgtcaacccttgtcattgagaaacaagaaaggcaatgtgcccagacaaagggtagggtggaatccctacacactggcagaacctgacccacgcgcaagggctttgtgtagcagatgccgtttctcattgttctgtgcctccctccccagtacccctgacaacagccactgccgctggcattccaccctgacatctgttcagctttattgatgcggccctggaggaattcccagtgtaaacagggaattctctaagggaaccccatgttgtaaagggatgagctgcataatgcaaagatttaaccactatttaaaggtgtgacacttgattgaaagtgacttgcttttccccccctttccaatcccacctccctctccatccttaactgtatttggcaccaactggctgcagcaacacccccacttccccctccatcgctttgttttcctgatgcataactgttaggaagaatgaaggatggggggccttgggtaccaccatccaaaaaagccacttaaaaaaaatttctgggttacagtcaattgagtctagttgtcgcgttgggatcctgcccgctgcccacccacactcctggcgagaaacagcttgcaagtcgcttggtcctgtggctgaagctaatggggtgggcttggtgctccttgctagaagcaactgcggcagttcgcagtccctgagcaaagcctggtggtactagttctggcagtgctagaacgtaggggatttgcctttgggattttgtgtttttggcaatggcgccgtaggatattaataaggattttttcaaaaagcagacctgatgggatacgggatgcatacgtcattgccccggcaaacgtacgtgtgctctaaggcacctctgaagtgtcacactctcactcaacttcctggccgatgttcaagtacagggagtgtcgtgcgagctccagccatgcacattgtgtcactttggttgagcatgcagagaccggtgaatagggccctatgcagcagg

SEQ ID NO: 45885 - DNA, 1030 bp, Homo sapiens
ccgcctcccgcagccagggccgtagtaacccattcatggggcccgcgcgcggctgcagccgggctccgtggcgctcgcagccaccgcctcctctcggctccaggtcttccccttctttttacaactgatcctgttggggattttttttttttctaaattggaacggtggggaggagcagggaggggggacctggaggaaggggagagattaggcagccatcaatttcctccagtttctcccagaacaggtgatgcttctaaattgtgatcactttcaggaggcagcactgcagctggaaggatgcgagcgacctagggtggagtggctgaggcggcagatctgaacttgcggaggataagaacccaaactttgactacatcagtccgcacctcgccagtgaagcaaaggacgggttatcttttttttttttctaagactcaaacttgggcacttgatcccttttcttggattgctttggaggagacgatttgctggcaacgttgggaacagtcaggactgtgttgtaactcttacttttaaagcgacagtagaggatcagactttttaaatgtttggaattcaagatactttaggaagaggaccaactctgaaagagaaatcgctgggcgcggagatggattcggtcaggtcctgggtccggaatgtcggagtggtggacgctaatgtcgccgcgcagaggtaacgacacggccgcgcaattattatgctgtctctcgctcttacggtctgtctctccgtgtgcaccccccccgcgcaccccgtgcctttctctctccctgtccccccatctgtcgcccaggccctgcgcgctggggctcgccctcgggcaagcagatcgctgcagtcaggcgaacgctcacccggcagccggcactcgagttcctgaactgcctgggtcgtaggcgtttctctccctctcctttaccacagtccactctttgcaaggaaaaataaagtagcccccaacatctcccagctcagcccctagtcctgcaagccgagccggcc

SEQ ID NO: 45886 - DNA, 1469 bp, Homo sapiens
ctttaatgtatgggactgaaatcaaaccatgaaagccaattattgaccttccttccttccttccttccctcccttcctccttctctccttctctcctcctctctcctctcctctcctctctttccttccttccttccttttttctttttctctttcttctttatttcttgggtctcactctcatcacccaggctagagtgcagtggcacaaaaatctcggctcactgcagccttgacttcccaggctcaggctcaggtgatcctcacaccttagcctcccaagtacctgggactacaggcacgcaccaccatgcctagctattcttttgtatttttggtagagacagggttttgctgtgttgctcaggctggtctggaacccctaggctcaaatgatgtgcccaactcggcctcccaaagtgctgggattacaggcatgaaccgccatgcctggcccttgatttttctttttaagaaaaaaatatctaggagtttcttagaccctatgtagattattaatgaacaaaagattaaactccaaatattaaatagtaagcctgaaggaatctgaaacacttgtacttccaattttctttaaataatcccaaatagaccagaattggcccataccatagaagaaagaattggcagtcaaaaaaaaaaataccttttgtaatgtttgaaaaataaagctgtttgacttgtcaggtgttttcctttctcaaatcagcaaattctctctgagtgcctggctttgtgagacactgtacaaggagttacaagactacagctataacctgcagttgagcagttataaacctacaaaatgggccctgccctcagagaggttccagtctagatgaggagctgatctagacaggtaaaaggctaactaaccctttgtgtaaataagttcatcaccccagtaaaagtgtcatcacccagtgaataggaccacctctgcctgcagatttttgttgttgttgttgtcattgttgttgttgttttaacctgggaagtgttcttcctgcctttctgctaggtgtcagatagatggtcccagagctaggtgctgtgtcaggccctgaagacacagatgactcaacctaagctttactttccagaggtccacagcctgagaggtgtccccaaagaaagggggacatgaggggactgcatgcttgagagcagggttgtttagggcaggtttggatttagtgagcaggctggtttgcttagagaaggcttttagtggcaacaaaggatgaagaggagagaaaaggaactcacatttattgagggcctactgtgtgcaaagtgtttcatgtatatctcattgaatgtatacagccaccctgttgtggtataattttgctctttataaagagaaagaccgaagctcagatgagttaagtggtctcctcaacaccaaaatgccaagaagtgatggagcctagacagaagcccag

SEQ ID NO: 45887 - DNA, 1048 bp, Homo sapiens
aaaggaaaagggtaaaatgagatataaagagattttttttcctggaaaaaaaaaaagccatcaaatacataaggcaagttctttgacatacactgaaagtttggtggtataatgattacctaaaaactcaaaagaatcaactgataaataataaaagacttggtgaagtgaattcaaatgacattaatttataaataggaacactcttgatatcagtaatatccaggaagaaaatatactggaaataagactccattcataatagcaactgaaatataaaactaccttgagttaaaatttaaaacagaactatgaaactttactgaaatctaaaaaactaattagaataagcagacagttataactcaaaatacctagaggtctggttttgaaattagacaaagtgatttttatttaatttggaataacaagaaaaatgttaagcaaggtatttttaggaaaacaaaatgataatttcactaagatttatcttaaggaaatattcagatattaggacaagaaaatatgtacaaaagatccatcgttcatcatggaattatttaaaatagaaaatagttgaacataatctaaatatacaacaataggggaagagttcagtacattattccatatgctggaatgctacgaagccgcttaaaaaacagacacatgcacacatatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcacaaggacaaaaaaccaaacaccgcatgttctcactcatagatgggagttgaacaatgagaacacatggacacaggaaggggaacatcacactctggggactgttgtggggtggggggatgggggagggatggcattaggagatatacctaatgctaaatgacgagttaatgggtgca

SEQ ID NO: 45888 - DNA, 1025 bp, Homo sapiens
agcacgttgctgcactgaatactgtaggcaactggagcccactgttaagtatttgtatatctaaacatagaaaaagtacagtaaaaaacagtgatataatctcatgggaccataccatagtcatatatgtggttccttgttgactgaaacatcgttacgttgcacatggctatattatattttattgattgatttatcaattggtggttgctgtggtttaaatatgttccccaaaatttatgtgttacaaacttaatccccaatgcaacagtgttgggtggtggagcctaataagaagtgattgggtcatgagagccctcatgaatgggttaatgttgttactggcagagtgggttagttattgagagagtgggcttgttataaaagtgagtttgggcccctcttgctctcttgctcttggtcttatgtgtagtctcttgcccttcttccttctgccatgggatgacacagcatgagggctctcatcagatgctggtgccatgctcttggactttccagcttcagaaccacgagtgaaataaactattgtttataaattacccagtctgtggtattttgttacagcaacacaaaatgaactaagacagtggtcatttgggttgtttctattttggctattatgaataatatgactataaacattcaggtagcaatttttatgtggacatgttttcatttttcttggaaatatgtctgggagtagatttgctggatcaaatggtaactctaggtttaactattggaagaactgctaggccattattcagagcaactgtatcattttatattcccatcaggagtgtatgtggattccagtttctccatatttttgccaaaatttgttttttaaaaattataaccatccttgtaggtgtgaagtggtatctccttgtgtattgcatgtcatcacatccctgatggctaatgacttggaacatcttttcatgggctttttgatcattagtagatcttccttggacaaatgtctattcacatcctttgcc

SEQ ID NO: 45889 - DNA, 1031 bp, Homo sapiens
cgaacataattttgtttaggaacatgatggaacatatattaggaacataagatcacctaatttacttacaacattgaataaggaagactagctaacccttctgaacattttccatctgccaaacactgcattgcaaagtgctttactgcattctgtcatttaattccaacaatagccatagtagatttttatctgcatcttatagaagaggaaactgagcctgagaagcaatcaagaaacttgttataagctcatttggctagttagtctcagtctgattctcaaacctacacatattacttactatactcttcttccctttgttcaatttattccattttaaagtaatttttattcaatataaatcaatcaagtaatttatagatgtcataattcaaattaagctgcatgctactaaaattaaggacattagtatgatttttatgagtttcaaaaattacaagcatttaaacaaaatttgtccaccaaaacacagtttcgtatcttctgggcttttttccatagtgtcatcaacatataaaatactcctattaactgaagggaaaactcaatcttattgaataagatttttccttcaaaagtttaatcagtcccactttctaagttgtcactggtcatttgtattttttaataatctccatggatctcagaaaaccaaaaacaattgctatgtttatttccgttaaccgtgtgccacacagacaactttctgtcacatgctgcagaagacagaagaacgtggcacagggctgcagtgccgggaatggaacgcggtgacattgcaagtctttgcttggcacatccagagctgccgtttgctgtgttctgcagcatctgtgaaattccagcaataggctctaagcttctgacttgttttgtaatgtgtttttatacattttgcagtgctagcattcactttaatttctgtctttgaatcttccacccaagatatagaaatctgtgtctattacctgttttaattttgcattcttttatttggctttttgtgt

SEQ ID NO: 45890 - DNA, 1050 bp, Homo sapiens
tgagggaaagatattttccaaggcaactcaatggacaaaggaaaatcttttcaacaaacacctagatatccacgtgcaaaaaataagccttgacccttaactcctattatataaaaaatagctacaattaaatttctagaaaataacatgagaaaatattctgttgtccatttctagtgacagatttttcatattgaccttgtatcctgcaaccgtcctaaactcacttattctattagctttttaatagattgcttgggatgttgtatatggttggtcatttgtggatgaagaaagacagttttactttgttccccagtctgtatggctttgtttcttttactttttttaattgcactggctccagtatgtttttgaatagaaatgttagtggatatacttgccttgttcccaatgtattatgttagatgtaggtttttcacaaataccctttattagtttgaggaatttttcttctatttctagttattatcgtgagtgggtattgaactttgtagagagctttttctgaatctattaaattttcttttaaaatctctcaatgtggtaaattatgttaattttcaagtgttaaactgaacttccttgtgtaaagccagtttggtcatgatatattttatatattgcttgatttgctgatattgtctatattcatgagggatattggactgcagttgtctttttgggatatctgtctagttttaatattaggttattctgtattcataaagatgagaaatgtttctctttttttaatagaaatatctttttctttaactttgtgtagaattggtattattcctccttaaattggtggaattcactagtaaagctatctgggcctggagttttcttagtaggaagagtttaactgtgatttcacagttaatagatatagggctattcaagtgatctcttattttctttgtgaattttgttagtgttttttaaggaatttgtccatcacttctaaattttcaaatgtactggtgtgaagttattcttgatacacccttattaaccttctag

SEQ ID NO: 45891 - DNA, 1054 bp, Homo sapiens
gggactggggtgaactctcattcagcctgtttctccatctctctttcgtctcgaaactcattctcatgcccacagttattggggcataaagattccttaaatggcttcctccagagaaaaatacgtttaaggcacttccttagtggtttgagccctgggcgagcccctcctccactccgtttattttccactatgtatttaaatcttccccgatggtgcctgtcttctcgtcactaaggctgactttctgtttttggggtgaaacctgtgtctccttcaacctccagtcactcagtggattttttttttttagattcataacatattttattttgacttatctaactgatgtcaaaaatggaaaatgttcacatggatattcatctaactcatgggctccattctaaaaaccccctttttaaaaatcaggcttcagtgtcagattgctgaatgtttttttcattttcctgagagatgcaaatgttcattcattcatctcattatacaacacagtacataaatgtagcttcagagcgtattaagtgcttttatacacaagtgctggctgtgtggaccaggtggtagctcatttaggccccaaattcattaagggcagggtctgactcttaggcttcttaatatttggtttggtgcatggtcaagagctggacccacatgttgcatagcagcagggctgatatgtttaaagacgctgggctttttctgctctggggccctttcccgggggttccggtgagtccctccccaggtgggtctgcccccacccgtgtgggcgggattagctcccagaggctggccaggccccacctgggggaggcttgagggcagggccccaaggctgagattcaggcttgggggaacagagcaggaaagagacccggtaccgaaagtgagcggggcaggcacctagtcacatgggtaatgggcaggggtcggtcactggctttggctccagggccagagcagtctgacttagtgttgagctccaagcatggaacactggagttggttcattttgaccagcaagcctcta

SEQ ID NO: 45892 - DNA, 1050 bp, Homo sapiens
gggagttgtgggcagggatcagtcaccaggactggaggctgacgctgttgagataggctgtgaggtgggaatgaacatggctttccagagagacaaggagatgtccttagccataccagggaatgtatcctgaacagtaggagatagaggtggagaggaacaatggttgagattgtgaaagtcttagcccttttggtgattgcatgccaccctgtgtgtcctaaggagacattcagggtttttgagtgagggaatggtgtaatgaacaactgtaatggaagggttttggaaagttgtgttagggggacacatcagtgagcaggctgttggagttgcagggtggccagagtttgcactgggatcactggaagtgaaaaaggtgggtttgagaaacattactgttgaaataatctgtttacagggcagggtgaagggatgagatgaatggaaattaattcttggtggaaattgattcaacgccagggccttggagctgctgtagttggtaacttgagaaatcggaaatgtgtattttggagagaaggaattggctactcaggctatagagaagtttcttgtggctgctaagatatccagatgttagtgtcctgcaagcagctatggctctgagatgggggagcccaggggggacagtgttgcagaggctacagatgccgggagagggaaggggctcagagaagtggggaggctgctggtaataggggggcagcggaggatgcctttgagtggtactcaaggcctgaaccgaggggcttctgtttccctctgctgcactgccattcacatgacattgctcggttctgaacctgaagttggaaaagcaactgtgggcaattgggccctgaggagtatgggctgttgattcttctaatctcgagggtggattggaggttagaacggtgtagaatgggatttgctaaagacagtaaattgctgggctttgaaacattttgaacttttctggggtggagggttggagggtaggagagagagagtgaggcaggaagacattagccctagggatattgt

SEQ ID NO: 45893 - DNA, 1031 bp, Homo sapiens
cagatcatttgaggtcaggagttcaagaccagcctggccaacatagtgaaacactgtctctactaaaaatacagaaaatcagcagagcgtggtggtgtgtgcctataataccagctactcaggaggctgaggcaggagaattgcctgaacctgggaggcagaggttgcagtgagctgagatcatgccactgcgctccagcttgggtgacagagtgagactctgtctcaaaaaacaaacaaaacacaatatgacgttcttcaagaaactaaacagaatttccatgtgatccatcatcatacatctggggaaatacacaaaaggactgaaaacgggctcaaacagatgtttgtacacccatgttcacaacagcattcttcacaatagcccagaggtggaagcagcccaagggaccattgagagatgaatggagaagcaaaatgtggtccattcataccgtggaatattattcagccttaaaaaggaaggacattctgacccatgctacaacatggatgaaccttgaggacattacactgagtgaaataagccagatacaaaaaggaagctgaatcttttttttttttttttttttgagacagagtctgtctctgttgcccaggctggagtgcagtggcaccatcttggctcactgcaacacctccctcccaggttcaggtgattctcctgcctcagcctcctgagtagctgagactataggtgtgtgccaccatacccggctaatttttgtatgtttagtagagatggggtttcaccatgttgaccaggctggtcttgaactcctgacctcaagtgatccgcctgcctcggcctcccaaagcactgggatgacaggcgtgagccaccgcacccggctacaggaaggtgaatcttgacctaggcctggaagcaagaagggtgatgcttggatagacacagagtaggaggtaacagtagtagcaagaggacaaagggaggaaaaagtttgctaccagagcctttgtgggttcctgcgtacagaagtgatatgata

SEQ ID NO: 45894 - DNA, 1028 bp, Homo sapiens
cagagagaggaaggagaggaataaaataagcagagaccccaggccaaacctgggtgaccaagcatcctggtttgccagggctgtcctggcgttagcaccacaaggtccacatccaggaaaccccttgtcactgtgagtggtccttggaaaatgtccagtgcagctggaccctagagaactggggctgggttgcagcagggttggaaaagagagatagcggaaaaggtagccaggagcccaaacaggaagccaagccgagcagttaagactttatctccaagatagctgagcaatcaggacaggattttaaagacgagagtgacttgctaagactggcatttgaaagagctctggcttctggataatgcaggagaggggcaacactgaagaccagtttggggccatcacagttttccagggaaaagatgctggtgacttgaactgaaagtagtggaggagggtaaagagaaaacaaggaggttgtagaatgtcttcaggagaaatagcagaacttagaattttcttagccgggtgaggtggctcaggcctgtaatcccagcactttgggaggctgaggtgggcagatcacaaagtcaggagattgagaccatcctggccaagctggtgaaaccccatctctactaaaaatacaaaaattagctgggtgtggtggcacgcacttacaatcccaactacttgggaggctgaggcagaagaatcgcttgaaccagggaggcagaggttgcagtgagccgagactgcgccactgtacttcagcctggcaacagagagagactccgtaaagaaaaaaaaagaaaaaagaaaaaaaaactttcttagagttaggaggagagaggaggagaaattaaggactcttagttttctggcttgggaaactggagttttgggaggtaattaggatggtttggaaatatcttccccacaccaccctaccccagaatgccaacaaagcaatgatgcttctgcttcccatgcagctcttgttgccataaaagtcatctcagtta

SEQ ID NO: 45895 - DNA, 1045 bp, Homo sapiens
gaaattaggaaagagattgtggatgtgacaaaaaaaaaaagtgggaggtgaaacgtttcaagatatggagcttggagaaattcaggagcctattaacacaccagaggagttaacagaagatgacccgaccaagatgagtgcttctgaacctgtgccagatgatgaagaaggagacatagaagaagcagtgctggaaaacaaattgacattagacagtctggcagaagggttctgattattcaggactgcttttgatttctttcacaacttggatccttctgtgatgtgggcacagaaactaaaatggtggaagaaggattgataccatatagaaacatttttagagaaatgaaaacgtgaaaacatccaacaaattacaacatatatctgtaagcactctgagtgtgcctgcttctcctgccttgccttctacctcctacacttcttcccctctgccacccaagacaacaagaccaacccctcgtcttcctcctcctcagtctgtttaatgtgaagatgacaaaaataaagacctctatgatgattcacttccacttaatggataggaaatgtattttactatcactaaagtacatttacttttccttatgattttttttgagatggggtctcactttattgcccagcgtgaagtgtgatggcataaccataattcactccagcctcgacctcctgggctgaagtgatcctcctgtctcagcctccgagtagctgggactacatgtgtgcaacaccatgcctggctaattgttgaaacattttttgtagagacatggtctcactatgttgaccaggctggtctcaaactcctggcctcaagcagtcctcccacctcagccccctaaagtgctaggattacaggcatgagccaccacatctggctccttatcattttcttaataacgttttcttttctctagcttattttattgtaagaataccatatatagtatatatgcaaagtatgtgttaaatatgttattcaggaaggcttctagtcaacaggctattagtagttaagttt

SEQ ID NO: 45896 - DNA, 1036 bp, Homo sapiens
ggctcaagcaattctcagctcccaagtagttcggactataggtgtgcaccaccacgcccagctaatttaatctttgtagagatggagtttttccatgttttccaggctggtctcgaactcctaggctcaagtgatcttcctgcctcagcctcccaaagtggtgggattgcaggtgcgagagccactgcacaatgtgtctgatttgtatccattgtatgttacttttatcagaacatttttggaggttagcaggtgtttccttatatgccttagctctgcttccttttgtttctcaggtttttcacgcttcagcagcaggaaaatgaaagattggctactaactatttgtaacaaaaataaatcttacatatcttgtatattccactaaaaagtaattttctatacttggatttaaatcattggttagtgtttaaaacaagacttagaggattgtattagtttaagcaccattaaaaaatgacatttaagaatttctgaaattcagggtaaggggtgattgttagccatgaaagatttattttcaaacaataaaaaatatgcatcagaaaattcaatgttagggaagttctgaagtgattatttttttgtttcaactgggacctcttttcccctttacctccccgatgcccacatttcagagtctgttctttcccacattcctatgtaactgtacaatttagtcttctttatgtcacttgctaagtaatgtatgcatttgttcattcaacaaacactgagctactgttttatgtaaggaaatacagggatgaatgagctgtagtctgtctccttccaagagcctgaagtttagagaagcctgtttagagccacaaaagcagatgaagagacagtgcagggtgatgtagataccgtcatgtgtgagtgtctgcggatgacacagcgaagccggtgggcgctgctccctgcagttgcaggagaattcgatcatgcatgagcagagacttagaaatgaatcggtattcactagatggaacacgattccacgggggcggag

SEQ ID NO: 45897 - DNA, 1028 bp, Homo sapiens
tcctgtttatcggttttatccagcaaagagaccttttagaagatttttgttgcaggtgcttaaagctctacccccaagccattagaaataaaactggttctggatacctgagaatgccctttctgttctagaaaataatgctttaaattctgaaaatagctgttttgaaagatgggcgcagtcaactggtggtagcaataaagaaattattgtatactaccttacctttccaaggcatagtagagcaaggtaagatagagcatcagtttcagatagattatcttgacattacattgaatatgattttccttgcttgcttccaggatcgagatttagagagacttcgtagaaaatggctaaatgcattaacaaaacgtcaggagtacttggatcaacaattgcaaaagcttgtcagtaaacgtggtaggaaaaacaaatagaatatttttctcccctgcaaatcaatgcataattaattattctccctttgtagccacatcagttaagaaccagatgaacacatcagtaatggggatggcaggagcagatgagtgttactctttgtttatgtcatatcctttatccagctgtcgtatcttggtggaggtcttcctcccaccccctacaaagaaagagcaaatacagtgcacaaagcatacatggtttgtcaaagataacataaaggaaggtggtaacttttcttatccaaagggctcgagtcctctgactctggaccagtcactcctgtgcggtccctctgtaggcctcccaggaactgaagatggcctctctgcaggagcccatctgacctctctagctgtgggttagtttttatcactggggagcacttgtgagctaataattgaaatataggcaaatccagtctttactcaggacaaaaagataaatggcaagtgaagttttgtcattgaatcctcattctcgatgttctagataaaacagaggatgatgctgaccgtgaagcgcagcttctggagatgcggttgaccctaactgaggagaggaac

SEQ ID NO: 45898 - DNA, 1050 bp, Homo sapiens
gggtataagttgcagtgacaatttaacccatttatagaggtgtcacctcactaaatcctttaatactcttttttttctatttttaaaatggagaaataattttatgtgccctgtttaattttgtgatgttttattttcttattgatcaagaatttgttgaacacctggcatgcgttgcattaggggttgaaaatactaagatgagttcaacacgggccgccccagtagcttagtagaggacatagttactgatttagtccatagcatgtttagaaaaaggcctttgtgaaatgaagtaggggtttcttctggtttcctcctcctctcaagagttaactagtattcaactttttaattcaaaactctgcacactatttgaatatcttttgttaaaataaaacattctttacgtaaatgtcagtgtgttctctcttaaatgtaatgctaaaattcagtaaattttccacagtagaatatcaggtccattacttcctttggccaaaatgcaggactgttagaaatttaaacaaaagtgtaaacaaatcatgataattaaaaccgcttgtaaaggttcgtcaaacaacctcacaaacatcagatagtaagagataattattaggaacaaaattaaaacaccttggcccaccataaagacaattctaaccttgtcttttaaaatagaacattattattcagatattgttacttgaatcctgacgtcagcttacataactaaatacctcaagtgcttttaccctaaaaaaaaaaatttacttttctttcctgtctcaaacagcataagaacttctgcttctgtaagactaacaaaaatgttttgtagttttttttctgtaattagaaaaacaagcaaactgcaaaattcaagactttggaggatgaatataattattctttttcataaaagccattaaaatcatagagtaaataggtttctttaaaaaattagtgaacaaacttgcagttatataggatattaagtctagagatcaaatgggcagtctaaggactatagttaataacagtgtattg

SEQ ID NO: 45899 - DNA, 1023 bp, Homo sapiens
gcagaaatatgaaacggtttttatttcatgttaactctgatataccagaacattcaggaaaaaatacttgataaagatatttttttctgacagtttaggaacaggaaggtatttaaaaattatagccacaagaaaaaaatgcctaacctacttttatccctttaaagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggtaagagcaaaaaatacaagttccttttacctaggagtaaagtacagaaatagtttgggaactttagaagatgattatctgtttagcaaccatggttttatttggtgtacctaccaaaaatattaatagcacagttaactgagatcccacttttaaacattctttaaaaatcaaacagggatttgatttaggcttagctctaccatagaccaaggttttaacttgaaccttactgggtgctagcttccccatatatttaattctgtgatctctagagatcctttaagttctaaactagacttttctaagtagaagcttaaacttaaaattcaataacattcaaaaaagatattgaggtatactttaattttcaaaaatatgattgtaatgtttattggaatgctcagaggatattttgtaaaaagcaaagatacaaaaaaaacaaaggaataactggattaagcatcaagcctaattgggagctgctgggtaaggaggccatgagagattgctctggagtagctttgtctttcaggaaaaggaagttatagaacaatgattaattcttgaaattgatagaaaaatatatttaaatatgttttaaaatgtgagtagaattctcataatgctggtttggatatatattgatacattcaattaaaaaaactggtactacctcctaaaattgaacctatgcatacttc

SEQ ID NO: 45900 - DNA, 1020 bp, Homo sapiens
cctcattttccttcccttagacatgaatacttaccattgtgaattttgcggatcattcccttgcttcattttgcaattttatgacggatatatagcccaagtaacatttttttttttcttgagacggagtcttgctctgttgctcaggctagagtgcaatcacgatctcagctcactgcaacctccacctcccaggttcaagtgattctcctgcctcagcctccttagtagctgggattataggcgcctgccactgcgcctggctaatttttgtatttttaataaagatggggtttcaccatcttggccaggcgggtcttgaactcctgaccgcgtgatccacccgccttggcctccgaaagtgctgagattacaggtgtgagccactgcgcccggcccccaagtaacatatattaaatgaaaaaaatgtttgtttctaatagtctgtttctatttttcttcacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggtatgtttccctcgcagtggccataaatagagcgggtgtgaggttagtgcatcctgtgcttggttctgaaatagaaaatcgttgcattgggaaaccaaaggaggtttgtcttctcattttgttttttactttcaac

SEQ ID NO: 45901 - DNA, 1141 bp, Homo sapiens
tcaaatgtgcacactcacagtcttgcacacaattccaggggcttctcaagaccctgtgagaaactttaacacaatatacttaaccaaactgaccctgacatttagtctgcgtcagagaccgcgctaagcacttcacacagcctgtgacatctaaggcaacgtggacgaccctgggaatcttctccactagaacttaacaatagtggtaagttattaccatgttacagttcactacccagggccacactgtttgggattctaccatccctcttcttcaggaatgctctgaaaatgcagtgcccctgcatggctaacactgtaagtctccagcactcagcatggtgacagattggacaacaggagagcaccaagatacccagaaaaagaagcaactcagagtaaaaatcaaatggaatgctagagaaagcggtacccacccataaaaataatttccatcctcttccatttatagatgaaaaatgaaggcccagaggattaaatacagacagaatttatgttcctaatactgatgccaaggacaggaagaccttgactagtctcgggaggacgccctgcctgaagtaccaacccttctgcagtggtgagtgactggcacagggtaaaactctacagtaatgatttgcattgcgctatcccctttctaggggctgaatcccactatcatacttgcccttagaaagagtcacgaaaagtgcttagcaggtgactggctcaattaatagtcactactgaaagcaaatactctctggttggactgttttcttctctggggaatgaaggggtaagcctagaccagtggttctcaggttcctggaccaacggcatcacctgggaacttgtcagaaatgccaaaactctgggagaggcatccaataaacgacactgtaaccagccccccaggtgatcaccaggcacatggtcaagtctgagagatgctgcttttaattaaggtttcgaaaagtatggctggaagaacactggtctagaaatgctctaatgtcaaggacattagagagaaatgcacaatttggtcccttcagcagtttcttgatatgtgtgggcacagtaatggctccaagaagttccaaaataaagaaacctgtttgacttgatctagacc

SEQ ID NO: 45902 - DNA, 1026 bp, Homo sapiens
tgatgctaatatttcaagtatatagaaaagaatagagaatattacagaccttcatgtgctcctcctttctcaggattttgccatattttcttcagatctttttaaaatcggtaatggtggatacgtttttaaacctgatgacagagacagagctgaagggcttcatcgtcccttttgtttgacttagtgcctagaaccattttggcaggtttttgtgcctgctccttcattcccgatggcatctgcatctcaggggaacaaaggcccggggtctggtcagggcgtgtgctgtgccccatgtgtgctgctgggtggcagagcaggagaagggtccgaacctggcatcctcagccactggcatctgggcatgctcagaacatcctggccacaccacccctcagagcagctgttgtttctaattgtttttaccttttcctttaggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttttaagatgttagtgaattctgtttcttttcattctcggaaatggcaggaagcagctccagtctctga

SEQ ID NO: 45903 - DNA, 1029 bp, Homo sapiens
atattaatatcagacagagtagatttcagagccaggaaaattaccaaggattaaagaaggacatgggccgggcatggtggctaacacctgtgatcccagcactttgggaagctgaggcaggaggatcgcttgaggccagcctgggcaacgtggcgaaacctcgtctctacaaaaaataaaaactcagcctggtgtggtggtgtgcacctgtagtctcgtagtgctactcaggaagctgaggtgggaggatcacctgaacccaggagttggaggttgcaataagccatgactgtgccactgcactccagtttgggtgacggagccacagcctgtctcaaaaagaaaaaggacgttacataatggtaaaagtatcaattctccaagagtacataatagtcctaaatacctatatatctaacaacaggccttccaaatacatgaattaaaaatggatgaaactaaaaggagaaatacatacatccacagttagactacagcattcctctttcagtagttgattgaacagatagatggaaaattatgatatagaagtccggaagagcaccatcaactaatttgacctaattgggatttatagaacagactgtcctgcagcagcagaatactgtgcatgtattttcctttttttctcttttgagacaggtttcactcttgttgccctggttggagtgcaatggtgtgatctcagctcactgcaacctcctcccgggttcaagtgattctcctgcctcagcctcctgagtagctgggactacaggcacgtgccaccacacctggctaatttttgtatttttagtagagacggggtttcaggtcaggctggtctcaaactcctggcttcaagtgacccgcctgcctcagcctcccaaagtgctgggattacatgcgtgagccactgtgcctggccctgtgtgtatgttttcaagttcatctggaatattcaccaagatggatggtattctggcccacaaaacaagctttaattgtatttgaaagaattgaaagtat

SEQ ID NO: 45904 - DNA, 1033 bp, Homo sapiens
tttgtttcaccagattcagtgaacacctttttttttttttttttgagacggagtttcgctcttgttgcccaggctggagtgcaatggtgcagtcttggctcacaacaacctctgcctcccgggttcaagcaattctcctgcctcagcctcccgagtagctgggattataggcatgccaccacgcctggctaattttgtatttttagtagagaccaggtttctccatgttggtcagtctggtctcagactcccgacctcaggtgatctgtttgccttggcctcccaaagtcagtgaacactcttataacaaatgatttgtaacgtcatctttgcttttgtgaaattaagttcatagataatataacctactgatacacatactttcttaaaaagtcagtgtaataccctaagtgtaatgtaaagaatgaaaatatatttttattctttaaaatatattttttatggtttaaaaatttacttcagccaggtgctgtgacccatgactgtaatcccagcactttgggaggcctgccttaggcgatcacttgaggtcaggatttcaagaccagcctggtcaacatggtgaaatcccatttctcctaaaagtacaaaaattagccggacatgctggtgcgtgtctgtaatcccagctacctgggaggctgaaacacaagaatcgcatgaacctgggaggtggaggttgtagtgagcctagattgtgccactgcactccaacctggacaacagagcaaggctctgtctcaaaaaaaaaaaaaaagattaaaaaatgtataagtgctcaggcagttaccctagaatgtaaatggaatggaattgaaacagttgtatatctttctattgtagagtcaccatgaagatgatagccaccaatgggccaatatagttacgatgtattggcaacttagatgtcataactggtctcttccttaagtggtaaaggattcttggtaaagttctgaaaatacaaagtacatttcttctgtgatttatcaaggttaataatgctatattc

SEQ ID NO: 45905 - DNA, 1023 bp, Homo sapiens
atactaaaaggcagatgtgcctttcccttctctagctgcagtccctttcttttgtggcagctgcttaactagttttattttggattcttcagttttttcccaattgctaataatatgcttatgctattgtttcttgattttttttcaactttaaacattgtgtgacttactgtcatttctctttcctatacctatctctctcctcccaatatagttgtatctctagttaagttttagtttctccgtcatttactttgatgccttcaacaaacatatttaaatgttctcagtgggaattttagtgttaagtctgctctgcagatggcagcatagtgtagcatgtctgttgtgtaagcagatgtttaacttgaggcgggtggttgataggaaagagattgcagtagctctgtaagagtgtacatgaagctctagaatttcttaatagcatttctttggggttattttaggagtacactgtgtgtttagcagtgggaagcccagatgttcttgtaatctgcacgctaagctgtcactttctggcccttgtgtgctctttctgtggatactattgttttaactttgctttttcctgtttgtgtatcttttatctatacttccttaatattacccgttttcatttgtcattttatatggcctttgttggcctaaactcttttctatttccttattgcatagcttataggggtaaaatgagaattttcactttcccccctagaaaacattaacaatctagaaatacatagagtaaaatagtaatattaaactctagcatatgtgatgcagaaattaaacatgcatcatggatatgtgttccgtgtcttgtgataacatatgcttggtagttaaatcttacataatcaggaacaagttctgtaaataatttgatgtttattcttttagtttgctttctcagcattacaaatattccataacgatgtatggctggttagtattccactgtgtgtacctgattaatgagttttaaaatagttaacaatgctg

SEQ ID NO: 45906 - DNA, 1033 bp, Homo sapiens
tgtttctttgctgaattttgttttcttttttttccattcgtgacaagtatcttttgttacacccttaagtatgatttcttatagctgctttaaaattcttcttattctaacagccgagtcatctcagagctggtctgcattgactgtctcttttatgggtcatattttcctgtttcttcatatatctaatacatttctgttgggtcttagaccttgtggattatattaatatgtgtaaagactcaggattctgttacattcctcccaagagtgtttctatttgttttgttttgtggttaagtgggcagttactccaaaccttgtctgccctacagcaggtagcatatgatatgtctcttctgttcttctagccttagcccgtttgcttggaatcttggaatctttttccaagactggcttatttcacttagcataatattctcaaggttcatccatgttgtacttgcaacaggattttcttcctttttaaagctgaataatattccattgtgtttttgttgttgaattgtgggagttttaaaaaatatattctggatattaattccttaacagatacatgatttgcaaatattttctcccattctgtaggttgccattttactctgttgattgtgctctttaatttgccagtttctgagtttgctgcactcttgtctatttttgattttgttgcctgtgcctttagtatcatgtttaaatcactgccaaatctaatgtcatgaagcttttgtcctatgttttcttctaggagttttatagttttgggtcttaggtatttagagttaatttttgtatatggtgtaagagtccaactttattccttttcatgtggatatccagttttctcagtgtcttgatgaagagaccgtcctttgcccattgaatagtcttagtcttggtactcatgtggaagatcatttgaccatatatgtgaaggtttatttctgggccctctattctgcctgtatgtctttcttcatgccagcactacaatgttttgattaatgtagcc

SEQ ID NO: 45907 - DNA, 1822 bp, Homo sapiens
tgtaaaattcctaacatacaattcatttatttttttaccaagcaaaatacaggtcttgacttttataatgtaacatgaccattaatcagtataattgtagttcattgtattagtgatacacaaacaatggtaatccacatttaaatttgctggtttagctaaccttgagaattcatagactaccaacatttagttaacaatgactttgatcattttactattctattctcccttttttcttctttctgtgtttcttctctttctcctttcagggtcaggctggcagctgcagaagaaaatatatagggttgctctttttgaagagctttccttctgatactaactgtacaacagaactgactagaaacataattatattcagtaattcctgcattcctactcagtttcattctcaagctgacattataggtaaagttcttgtatgcactagtctggtccttttcagttccttccacagctgccattgccagttgatagcagatggggaagaccattgactagtaagggttatgttccttactttataatgccagtatgtgataagctgtactttgcagatggagtgggcactactcagttcactttgtctattaatatttgtaggtgttttattgattcctacacattttgactactagaagaatatgggttcagcttttttcaaagtagttgtgataaaatggtttatttctcttcaaagaatttatgtaaataaaacacagtttcttttataaaaagtgagcaccgtgctgatctactgttctggaattctggatgtccaggattttaggcctgccagtttgtattcataaggtacttttaatttgccactgtattggctagtgttgtattttaaaataattagtagaattaagaatgtgtatatgggctgggcacagtggctcacgcctataatcccagtactttgggaggctgaggtgggtggatcacctgaggtcagaagttcaagaccagcctggccaatgtggtgaaaccccgtctctactaaaaatacaaaaattcgctgggtgtggtggtgcgcacctgcagtcccaggtgctgagagggagggaggcaggagagggaggctgaggcaggagaatcgcttgaacccaggaggcggaggttgcagtgagctgagatcacgccactgcactccagcctgggcgacagagcaagattacgtttcaaaaatatatatatatatttatgttccatttgttaatatattccaattgtatcactgttacaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggtaatctctcttttctttctatgtcttaatataatttgaatgaataatgacttcttggttttaaaaatatcaaacattttacaattgtttttaaagcttctattatatacacatgggttacagtgagccacttgaaggtttgaaatttgtcttgtgccacctagcaggaaagggagcagccatctctgtgtaactttgacgggttcttgttgctgttactatatgattgtttgattgttcaggctatttctggaaaattttcctcaaaggcaatagagtttctcttgtaagctctgtttgtaaataagagtgtcttctataatactagtagatgttccttacctgaggaactagaggcattaaaac

SEQ ID NO: 45908 - DNA, 1050 bp, Homo sapiens
ccaggttcaagcgattctcctgcctcagcctcccaagtagctgggattacaagcatgcaccaccatgcacggctgatttttatatttttagtagacatggggtttcaccatgttggccaggctggtctcgaacacctgacctgaagtgatcccacctgccttagtcccccagagtgctgggattacagccatgagccactgtgcctggtctattttgttagttttttgaagctcttgaaatgttaggaagaatatagctcttggtgatacgagttgcatatatttttttgtcagtttgtcttttgattttatagagcaatgagtttcaaccccattctgatttcatggtctatggctcttcgtcactataattatgctacctggaataatacatgtttttcattcctgaaggtttgtttacatgtaactatgatttaatgcatctagcattttgaaactgtcttctaataacaatttcttcacttgatagacacggcatcagcgaggagatacgcatcctctaaccttagatgaaattttggatgaaacacaacatttagatattggactcaagcagaaacaatggctaatgactgaggtaagaatttagttgattatcaagagagatttcctgtaactagaattttcttttttttttaagacagagtcttgctctgttgcacaggctagagtgcagtggcatgatctcagcccactgctgactcagcctcccgagtagttgggactacaggcatgtgccacgataccaggctaatttttgtgtttttagtagagacggggtttcaccatgttggccaggctggtgttgaactcctgacctcaagtgatccgcccacctcggcctcccagagtgctggggttataggcatgagccactgcgccttgcctagaatgttttaatatggtgaaatctgataatgctttttactttttcttaaaagaaatggtgtagggtctttgttttttgaatgtacacatttataagattgatttgttggttttcatataattttatgttatctgtttcaa

SEQ ID NO: 45909 - DNA, 1075 bp, Homo sapiens
ttgtcatgttagattaaaaattaaatcagttaaaatatgaagcaagggatatgataaaagttgtgttattcctttatttatttatttgtttttgagacagggtcttaactctgtcacctaggctagagtgcattggcaccatcctggctcactgcagcctcgatctcctagcctcaagtgatcctcccacctcaacctcccaagtaactgggactacaggcacgtgccaccatgcctggctaatttttgtattttttttgtagagacagggtctctcagtgttgcccagcttggtcttgaactcctgggctcaggggatccctcaagtgatccgcctgcctcagcctcctgaagtgctgggattacaggcgtgagccactagacctggcctgttactcctttttaaatgtgtgttcctgcatcttctgatctctgatctcagctattaggtataaataaaagggaatgaatcagaagtaaccttacatttttatttgggtaattaatgaaagagatacctactgcttcaaactactcagtatgacagctagcatatcttattttttgtcagtagaaggtagaaatattaaactgttgaaaaactataatgagaattgactaattagaataaaactttaatgatacgatttgacaaaatagattttaactaccatattgagtaatgcacactcaatctaaagtaatttctatacagcttttatatagcacaatttgaatgacttggcagtcctagaaagtatttcttttatatttaaaggaatcagcctccctaattgatattgttccagctctctaaatatgctttttcttcaagctaataaatattcagggaatgagttttgagaattacttatatttaaattctcggcccagcacagtggctcacacctgtattctcagcgctttgggaggctgaggcaggtggatcacttgagtttgagaccagcctggccaacatggtgaaaccccgtctctactaaaaatacaaaaagaaattaaccaggtgtgttggcacatgcctgtaaccgcagctactttagaggctgagaatcac

SEQ ID NO: 45910 - DNA, 1066 bp, Homo sapiens
ttggttacttttattacagatgtgctgaacaccttgggagaatgaactacgtaggtaatatttcataattgaaacagtgaatggaaaagcacctataaggcattctttttttttttttttttaattttgagacggagtctcactctgttgccaggctggagtgcagtggcactatctcggctcactgcaacctccaactctctcgttcaagtgattctcccaagtagctgagactacaggcacgtgccattatgcccagctaatttttgtatttttggtagagacggggtttcaccatgttggccaggatggtctcgatttcctgacctcatgatctgcccacctgggcttcccaactgtaaggcattcttaatgttattgttacttttggaaacatggtagacttcagtgtgccaattaattaagattgtaacaaagttagttttaaaggaaaattgcatatgaagtttcattttagtctcaaaaaaggatactcaataaagacttcactaatctcaaaggagtatggtattgccatctagaagctgttcttttggatctctgacagttgttacatttgacttgtggttgttctaatgcaatcttttgtttaaattattattaccaacctggtgccagagattggttctcctctccccttttacttaacctctctctttgtggatcagccacatgggaactttataatatctgatctcatgccttgctaatagaatgtgtacttctaaaatgtttttctagtatttatgatggattttttactgttcctggttatgactaatggaatgcatttgtgatgcagtggtgacattagggtttctgcttgtaagaatgcaacaaaatgatagatattttgaaacaaatgatcttttgtacagggttttccacaccagatagagaaggagaggggggtgtttctcaaagtgggtgggtagtgctgtgatgctttttaaagtaagcatccatgttcatgcagtggcagtgcctgtggctttttattcctaatttatctgtaaagtttactttaaaataattgtgatatctt

SEQ ID NO: 45911 - DNA, 1050 bp, Homo sapiens
tgggagtttgagaccagcctgaccaacatggagaaactccatctctaccaaaaatacaaaattagctgggcgtggtggcgcatgcctgtaattccagctactcggggcaggagcatcacttgaactcaggaggtggaggttgtggtgagctgagattgtgccattgcattccagcctgggcaacaagagcgagagtccatctcaaaaaaaaaaaaaaaaaaaaaaaaagctgtattttacattcagccttgaagtcaagggtaaaatattagaaatctggcagttgaatttagatgaactttgattttttttttttctttttgagacagtgtctcactttgtcacccaggctggagtgcattggtgcaatctcagctcactgcagcctcaacctcctgggctcaagcaatccttccacctctgcccccaccaagtagctgggactacaggcacatgccaccacgcctggctaatttttttgtattttttgtaaagatagggttgagccatgttggccaggctggtcttgaactcctgagctgagactatctgcccaccttggcctcccaaagtgtaaggattacaggtgtgacccaccacacccggcccctgattttttaaatttggattttaaaactttgatttttgtgctcaggtgtcttattacacatccttaatatttttagatttatatttattttttaggaaatattatggaatctaatttttatcttttttttttttgagatagaatttctctctgttgctcaggctggagtgcagtggtgccatctcggctcactgcaacctctgcctcctagattcaagggattctcctgcctcagcctcctgagtagctgggattacagtcacgcaccaccatgcctggctaatttttgtattttcagtagagacggggtttcaccattttggccaggctggtctccaactcctgacctcaagtgatccgctcacctcagcctcccagggtgctgggattacaggagtgagctactgtgcccagcctatctttcttgggttttttggttt

SEQ ID NO: 45912 - DNA, 1097 bp, Homo sapiens
gcttcataagatccattatcaaggtgaattttttttttttttttttttttttttgtgagacagattcttgctctgccacccaggctggagtgcagtggcgcaatctccactcactggaacctctgcctcccgggtttaagcaattctcctgcctcagcctccttagtagctggtactacaggcacataccaccatgtccagctaattttttttgtatttttagtggaggtggggttttgccacgttgtccaggccagtctcaaactcctgacctcagttgatctgcccaccttggcctcccaaagtgctgggattacaggtgtgagccactgcacccggccaaaatgcaacatatatatttttttgtttgtttgtttgttcagagacagagttttgcttttgtcacccaggctggagtgcaatgggaggatcttggctcactgcaacctctgcctcctgtgttcaagcaattctcctgccccagcctcctgagtagcagggattacaggcatgcgccaccacactcagctaatttttgtatttttagtagagacggggtttcaccatgttggccaggctagtctcgaacatttgacctcaggcgatctgcctgtcttagtctcccaaagtgctgggattataggtgtgagccactgcacctggcctaatatatttaataactgatgagaaatgagggtaggggggctacagagagaaggaatcagcagttgacaactgaaggctttgtctgcattattgggagcaggtggtaactgaagtggtaaacttgagagagatatgggttggaagataaaattaaggttcagttctaaatagactaagtttgaagccaatgtaaaattgtgtggcgagatagttagaaacatggaactgcaacctggggagaaggtcaaacctggaagaatgcatctggaagtcctgcaagataggacctgctatcctatatccaaaggtttcaatctccttttcactacatgtatatttcactatataggttgtacctcttgtaattcaatgtgtacaccatataggttgaaacctttgaaagaataagcagagaggaaagggccacgtcg

SEQ ID NO: 45913 - DNA, 1050 bp, Homo sapiens
accatgcccaggccagacacaccattctgtaatgtgattacattgcacataaggaactttcgccctcaattcttgggggcaaagatgtcatctttcttacgggggtgccttgcatatacttttttgtctctgggttttggcccaagttagcacttttatttcttcttctttttcctccttcttccttctttcttctttccttccttcttctaacttctttctttcttcctcctcctcctccctcttctcctcctcctccttcttccttcccctgctccccttccctccttccttcttcttctttctcctcctcctccccctcactttgtcatccaggctggagtgcagtggtgccatctcagctcactgcagcctcaacctcccagattcaagcaatcctcctgcctcagcccctcaaagagctgggactacaggtgtgcagcaccatgcatggctaatttttgtatttttagtagagactgggttttgacatgtttcccaggctggtctcgaactcctgagctcaagctatccacccacctctgcctcccaaagtgctaggattacaggtgtaagccacctgtgcccagcctatttcatcttactgtatacttccggcaactaatggcaacccctttcctaagtataggttgccagttagaagttctacagaaacttgaaaaacggagaattgtgttggcatcagcaaaccaagaatcaaaatgttcagtagagaaatgaaagttctgataagttgcagtaggtgtctttgtttttattctaagaacaggctaatgtcatggttccttctttagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgagtcatacaacaggtactcattaacagcagtcaggagtttactgttgctttcaacctgaaaagccatgccaggggatctgccta

SEQ ID NO: 45914 - DNA, 1416 bp, Homo sapiens
ggactgacatccagaagagttgtctcacaaaactctttcttcttctccccggatgcccgtaacaattatttttattttttaaatttttttgttttttgaggcagggtctcactctgtcgcccaggctggagtgcagtggcacgatcatggctcactgcagcctcaatatcctgggttcagatgatcctcctgcctcagcttcccaactggctgagactacaggctgttatttgtggtgatggggtctcgctgtgttgtccaggctcctctcaaactcctgggctcaaaggatcctccagtcttgacccgtcaaaagtgctaggattacacacctgtgtgtgagccacggcacccagtcacactttttaaaaatctggtgatttcctgagactggaaggttcaggttaatgttctgcttagctaagaattgaacaaaaacagcctttgttaatatctcttgcaaatgtatccattgattttcttgctttagattctgctttacacagactgcttttttttttctctttttctcaagtttgatgcctccctgaactaaccttcatctgaaatgaaaaaaaagactttgaaggtggagacatggatattgaatagtgaatatgtgccagggacagggccatgtccagacagcattatatttagtcatggttggtgtaaagctgatgaaatgcaacagagacagggatctttatctgtttaagtcatcagtatagtccaagcccctagaacagtgttttgcacatagcaagtactcagtatatagttgctgaaataattgagttgataaatcgatagtgttttgccttggaaattatgactcgtctattttctgagtagttctcattctggtcttgaattagattttaggcagcaaagaaggacgacagagggaggaaactgtaggcaattctgtggtgggaggttgtggggaaccagaggaaggaagttaacaatttttttttgagacagggtcttgctctgtcacccaggctggagtgcagtggtgcaatatagctcatggcagcctcaaactcctgggctcaaacgatcctcccacctcagcctcccatgtagctgggactacaggcgtgcaacaccacacccggctaatttttaaattttttatttgtggagacgaggccttactatgtttctcaggccggtctctaactcgtgggctcaagcagtcctcccacctcacctcccaaagttttgggattacagcgtgagccaccacacccagccgcaagttcactattgaacacagttgatgttcttggcaggcgcaattgcagattaaccaagttcttgttttactgccaacatgggcaatgtgaagtttctacctggctaggcaggattgaaggtaacgaggcaggccctaggaaaaatggtgaa

SEQ ID NO: 45915 - DNA, 1383 bp, Homo sapiens
aggctagatttatcagaattgtggagtgtgtgcaatgtgagggatttttccagttgagttggcatattctttttttgttttaagtttgtattttgtcaactgggcacagtggcttatgcctgtaatctcagcactttaggaggccgaggcgggcggatcacgaggtcaggggtttgagaccagtctggccaacgtggtgaaaccccatctctactaaaaatacagaaattagctgggtgtggtggcacgcgcctgtaatcccagctacttgggaggctaaggcaggagaatcacttgaatccaggaggcggaggttgcagtgagctgagatggagatcgcgccactgcactccagcctggacgacagagcaggactccgtctcaaaaaaaaaaaaaaattgtattttgtcttttcttggttgtataaattctccaaaagttagccatttaaaaatgtttaaggtcttattttctactttgtgatatgtgtgtataatttttactgtgcaagttttagcatttttgtatagtctgattgtccatcttttccataaactttaagcgcacatgagaatcacttgggaaagaaataggaaattcatgttccttgactccattccagagactgattgacatgtcttgggcaggtccaggaagctgctttttttttttttaaaggcaggatcttactgtcgcctaggctggagtacagtaacatgatcatagttcactgcagccttgtactcctggactcaagccatcttcacgcctcagtctcctgagtagctgagactacaggaatacacaaccacacctggctttttttactcatttttttgtagagacagggtctcctcatgttgtccaaggtgatcttgaactcctggactcaagtgatccttctgcctcggcctccaaaagtgctgggattacaggtgtgagccactgcccccggcctcctttgtgctttcagtgtcatgaaatacctgtatttgtcaagaagattaagaccatgtcttaaaaaaaaacaaaagctagtgagatacaagagataatcttaaatatacctataaagtcctaggaactgttcgtctgatttatttaggagccgaagtaaaagtgatctttcctgacaaatacagaaagagatttttgctagcatcacttcttccaaaacaattttcctcatttatgcaataagtttggattttcacttctttatgtcactaagtttctgcgtgttgctaagttcctggctgcatatttggagtctctccaacagcagcattgtcagcattcccacagtcggttcttccgtgtacttttgatttgaatttcatttccagggttatgtcttgtgtgtttggcttctctcttttagca

SEQ ID NO: 45916 - DNA, 1053 bp, Homo sapiens
tgctaatggcgggaaagtggactttgttacatttctctactttatatatgacgtgtcaaatatatatgactaggtaaatatatttaatacttaatactgccctttaacaataatatacccttgccataagatatttacctaagtagataaagtgaagatatttgcaatgtaaaatttcttttcattgcctgcttttattgccgtgtgtgccttttattcttatttgaagatcttgcagaaattttttcttcacagtcttttctcttcagtacgaatgttataaaagacttggtgaatgaagcccttccttggtaaaaggaaatgaaaatgccagaaattgaagatggaattaatgcttaattaattttcctagattgttttctgaatgtagttttttctaagaagaatgatattaaagttacagaagtaatctgtataagaaatctgagtctgtgttaaatagaaattttttattgttttgaactgatttccttcaagtaaatgtaatgaaatgtaaacctaatccagattgtttaaagaaacttgtatgaagacatcttttcttccttaatgaccaaatgtgatctaatagttcctgtacgttacttttcaactctaaatttcattaataatcatattaacggccgggcatggtggttcgcgcctgtaatcccagcactttgggaggccaaggcaggcggatcatgaggtcaggagatccagaccatcctggctaacatggtgaaaccccgtctccactaaaaatacaaaaaaaaaaaaatcagccaggcgtggtggcaggcgcctgtaggcccagctactcgggaggctgaggcaagaggatggcgtgaacccaggaggcagagcttgcagtgagccgagatcgcgccactgcattccagcctgggtgacagagggagactccatctcaaaaaaaaaaaaaaaaaaatcatattaaccctgggaaggagttctgtgtattacagattccgtttcctttccagagaatgggagagctcaagcactcaagcttagaactggtttgctgttgtg

SEQ ID NO: 45917 - DNA, 1027 bp, Homo sapiens
gaggcagaagttgcagtgagccgagatcgccactgcattccagcctgggcgacagagtgagactctgtctccaaaaaaagaaagctgaaggagtccactgaaatcaagaccagagtagtactagtaaaggcctattttgaggtagttgcaaaaataaaatctatcctagtgccagtgggtgaatgactacaaaaaataaagagtatgaatggtatggtgtgtctggcttccaaggttaatttctgcctagtgaaaaattgtttgcataaaatagcaaggcatgtcttctgagaagactagctcttaacactagcttaaattagcaatccagcttttgaagctaattgtgaatttgactcctcttgtgtgtgcagagaaattgcttctgtgattcattcctgcatcagcagtatgcagttattttagaagattgtgtgccaagagagccaggctggcactgctcaggacactctgtgactagaactatatttaactgttgtctcagaaagagtaaaaattttaagctctttgacctgttaaattttataactgaagaaccttggtgatgattctttaggtggggagggaaattcagccaatgtgtgtgctggcagatctttattctgatgattataaagtacgtattgagaaaaatgtcgaggcttgtgtagaagtataaatatgtaaattttatattgaactgatggaaatgtttctaagtcctggcgttagccttgaaataagcagaaataactttaggatatgacttcattcctaatgtgaaatagtatgcttgttcctgaatacccaaaaccatcttaatgaagattagattctggtaaaaatgagtgatttttgtgaattgagaaaatttttttagattactttctgtgattgattacagcttaaaaaataaaaatagtggtcttgacaggcaaaatgcctaactggtacttccatttttaatttccctcgaacaaaaattagtgccagctttggtggtccattgataaaatctaaaatgcag

SEQ ID NO: 45918 - DNA, 1041 bp, Homo sapiens
attatacagtttcttaaattcagcctaaggagtttgaacttcattctgtaagtattaaaggctaaagtcatgtgaaatttgctttttcagtgatgtaaaggttaagaatattctgagtatagttagaagtaagtcagccaaggcttagaaaagggtgattgtttcacagaataagaaagaaaaatttatatctttacaagatacgatacaatacataaagaattgatggggcttagtaagtggtttaccaaaaaaagacttctaaaatcaaaaagggacttttaaaaataggacaagtgataagattacttttttttttaacttgtgcattttgaagaatggcaaatttcaaaactggcattttaatgagaacctacatagtcatcaattcccatacgatactttgagctctcagaaagtataattttgattttatcgcatttctggtgatgtttcagtgaggctgaattcagtgaaatatttggcttttagtttgttgagtgggatatgtgaattccaggccaaagaagaatttctcttgactacagagaaatagtactacttttcccttctcaacataatatttcctcatacaatttaagaatttcataaagcaccaaaaaatctaattactggctgggtgtggtggctcatgcctgtaatccctgcactttgggaggccaaggcgggcggatcacctgaggtcaggagttggagatcagcctgaccaacatggtgaaacactatctctactaaaaatatggaaactagccgggcatagtggcgggtgcctgtagtcccagctacttgggaggctgaggcaggagaatcatttgaacttgggaggcggaggttgcagtgagctgagatggtgctgctgcactccagcctgggcaacagagtgagactctgtgtcaaaaaaaaattcatatatatatatatatatatatatatatatatatatatatatatatatgtttttatatatacacacatacacatacatatgtgtgtatgtgtgtgtgtatatatgtgtgtgtg

SEQ ID NO: 45919 - DNA, 2030 bp, Homo sapiens
agaaaaagaaaatcaaattgatacagcatttttatctagcactagtaaatatgaaaagcttgaaaaacattcagcaaatcataatgttaaagatgcaactaaagaaaacagttgtgacgctaatgaagtaataaatgaaagtaattctgtatctttaagttgcataaaagaaaacataaattctagtacaggcaacgattgtgatgcaacttgcataggtcacacaaaggcgaaaactgacgtacttatatcagtcttagattcaaatgtgaagcactttttaaatgatctctaccaacaaggtaaccttattttatctgattgtaaaagaaacctggaagtaaagtggacagatcctattgagagacccaaacaaaacattattacaggaaacttccttatgggcccattaaacctaactttgatagcaagtaaaaagtacagtattcctcagttatcagccgctgcagtgacagatagtgagggagaatcttcaaaatcttacttggataagcagagaattcttactgtagattcttttgcagcatccagtactgtaccacactgtgagcagagctgtagagaaaaagagcttctaaagacagaacagtgctcttcaggtaattgcctccatacagatgggaatgaaacaaatgtcactgagaattatgagttggatgtagcatcaggaactgaagaagataaaagttatggggaaaatatagtggaattatcttccagtgatagttctctgcttttaaaagataatgtaaaaggctcctcttcagaaacatgtattgtgaagaaagacactgaggacagaataacgtggaaagttaaacaagcggaaaaagcaaaagattctgtttacaaaagaagcatgactgaaggatcaactgttaatactgagtacaaaaatcaaaagaatcagatctcagaagaatcctgcttaaatgagaaaattattacaactaacttgattgattcccatctgagcactaaaaatactaccactgagtcagtccctttgaagaacacagtttctaatccgcttaacaaaagagagaagaagggggaaattaaagttagtaaagactcgcagtctgacttgacattacattcagaaatagcctatatttccaaaccaggaattctaggagttaatcatacgcctattttacctgcccactctgaaacctgtaaagtccctactcttctgaagaaacctgcgtcatacgtgagtgattttaaagaaaaacattgctcagctaatcatacggcccttatagctaatctatctcaaattttgcagagggcagatgaagcatcatctttgcagattctacaggaagaaactaaggtttgtctaaatattctccctttatttgtggaagcttttgaaagaaagcaagaatgttcagttgaacaaatcctgatttcaagagaactgttggtagaccaaaacctgtggaataattgcaaacacacattaaaaccatgtgctgttgacactttggtagaacttcaaatgatgatggaaacaattcaattcattgaaaacaaaaaaaggcacttagaaggtgaaccaacattgcgaagcttgctttggtatgatgaaacactgtatgctgagcttcttggaaaaccacgtggatttcaacagcagtctaatttctatcctggtttccaaggaagattaaaatataatgcattctgtgagttacagacttaccatgatcaattagttgaattgcttgaagaaacaaaaagggaaaagaattcatactatgtattcttaaagtacaaacgacaggttaatgaatgtgaagccataatggagcattgttccgattgctttgatttttctctttctgttccatttacctgtggagttaactttggagatagtttagaagacctggaaatcttaagaaaaagtactttaaagttgatcaatgtatgtggggactctcctaaagttcattcgtatccaggaaaacaggaccatctgtggattatcatagaaatga

SEQ ID NO: 45920 - DNA, 1111 bp, Homo sapiens
aatatagaaattttgagttctgaagaattttctactaaatttaacttgatttgcagagaagataatgcagtgtcagcagcaactgcattattagagagtgaagaagataccattagtgccgtgaaacaaaaagatactgaaaatactggaagaagtgtagagcatttggcttccacgacatttcccaaaactgcaagttcttcagtgtgtgtagcctcaaatgctgcaatacagatagctagtgctactatgcctgcattaagcctaaataatgacgatcaccagatataccagtttaaagaaacttgttcttctgaaagtccagattttggtttgttagtaaaacatagggtttctgattgtgaaattgatacggataaaaataaatcacaagaatcatttcatcaatcaataaatgagaacttagttcttcagagcattgaattggaaagtgaaattgaaatagaattagaagattgtgatgatgcttttatatttcaacaagatacacatagccatgaaaacatgctttgtgaagaatttgtgacctcatataaggctctgaagtctcgtatcagttgggaaggtctgttagcacttgataacggggagatggaagttttggaaagcaccacaggaagggagaatagtgatcagcattattctaaggaaagtaactatttttattcctctacacaaaacaatgaaacagaacttaccagcccaattttacttccagatctacaaattaaaattactaatatatttaggccaggattcagcccgacagctgactcccttgcattgaaagatagtttttgcacacatgtaactgaagccacaaaaccggaaataaataaggaagatggagaaattctaggatttgacatttattcccagccttttggtgaaaatgcagattatccatgtgaagataaagttgataatataaggcaagaatcagggccagtgagtaactctgaaatctccctttcttttgacttgagtcgtaatacagatgtgaatcatacgtctgaaaatcagaacagtgaatctttgtttactgaaccttctaatgtcacaacaatagatgatggaagcagatgtttct

SEQ ID NO: 45921 - DNA, 1034 bp, Homo sapiens
atggattatatataatcatattatgattaaatgaagataaatcttcccaatgaaagtatatccatgcacccacatgtaaaacagattacctattgttattttcctaattttttctaccaaataaaatagagtagttgaaacttcatgcaaaacatttagcttttaatgaaaaaatattttttatttaaaaacgaattgtgcctttttctgcagacattagtagcctatcaaaaaaaaattgtgggggagaaaaaggaattctgtacatcttcaaaaacattagggttaaacaaggcagctggagaagtttatatggaagtatataaataatatgcaattatattgattttttaaaaatatgagcttattcaactctgattgccaaaattaatcagcatgaacctgttttcatctttcaggtgtacttctatgaatacagtgtcctttcaaagcctgtagataaacctaggcaatgtcttccatatgctgtagtaacagtaaaatttcttggttcaaaagtagataatggacgccttatgacatctttgagattcctctcaacaggatttcctaagagagctggtaagatacacatatgattgtacttgattaatatttgtgctggtcttaaaatttctcagtattatttactggctggacacaatggttcacacctgtaatcctagcactttgggaggcggaagtgggcggattacttgaggccaacctggccaacatagcaaaaccccgtctctagtaaaaatacaaaagttagccaggtgtggtgttgtgtgcctgtaatcccagctacacaggtggctgaggaaggagaatcacttgaacccaggaggtggaggttgcagtgagtcaggatcacaccactgcgcccagcctaggtgacagagggagaccttgtcacaaacaaaaaaaaaaaaagaaaaagataaaaaaagtagtgaatctccaagtaaaatagttgtgttttacctgttttacattttatagatctagaatcatactgcaggtattttgct

SEQ ID NO: 45922 - DNA, 1143 bp, Homo sapiens
gattagctgggattacaggcacacaccaccacacccggctaattgtttgtatttttagtagagacggagtttcactatattggccaaactggtctcaaactcctgacctggtgatccacccacctcggcctcccaaactgaatatgtaacttaactgtagttaaagacagtattgaggattgtgctttgaggattgtcccagcacttggctgttcaagtaaagtatattcaactgattattctttacctttatgtgctgttgttacagatcatgattaatcgaagatgtttttatagcataagacattctaaactattttccattcttccccttactaaactgcgaggtgaacatggcagccttgacaagtatctctagagctggtgcatcttaggagtattcttgttagaaagcagtaccccactattgtctgtcattgtggctgaatggaagaagggctggctttcttctctttttttctagaggtctttttcattccctgatccatgtttgattgggtgattgcaagatcacctttcataaagaacaggaggggattaagagggacatccttgtgaaccttcttagaaccttatcctttgtgatctttctgtagaattttagcatcttttaatttggattgtgatctaatgttggaactaagcagttgataggtgtcaggagggccatcaaccatgttacgaaatggtacgaaaaatacctgcttatatatatttccctgtgtgtatactccatagctttcttttgaaatccagcttgagttctacttaaagaggttaagaatcaatatttggcaggggatggaggttgcaggggagtttggggagagagagaaaggagagggaaaaaggaaggggaggaatatttttgatacttctggtatagcaatatttgatgttgtcttaagcatttatagaatgataccatggaacagtagtcaataagcgattggctgttgttggccatcagctgtaggaatagtcagcaatagttagtttacaactttttgaagtttcttctaaagccagagatcttgatttaaagagagtatcgttttagtcacagaaatgtatagggaaaaaaatgctttttaaaaatggagtatttgggctgggcatggt

SEQ ID NO: 45923 - DNA, 1025 bp, Homo sapiens
aagcaaaagtggaccagcacagctttttgtgggggttagtggtaggagagtgttatagtgaagttctttgttctgttttctcagtctcatttctcattcattcattaaatcaatagatatttattttgcctgtggtatgagctaaccatttctctgggtctggataatatagcagacaacaagatccagtctttggccccaaagagcatacagtacgggtactcacaacatggacaatgctagataactgcccagagagcagagaagctacatgagatcattataaacctgtgcacctgaaccactgcacaagcaatgcattaactttgccttgctcattgggatatggtgagaaataactgttataattagttgtgaagcactttggaaatgaaaagagctacaaagcaactgaatgaaagaaaacaatattaaattatagggtagaaatgattctcataggtatgttcagtatttatgtcaacgatataggactattaccagggaaaagctattttaggtaaatacaattgcctagcttttacaaagtcaagaaaatacgtgtgtgtattaacaagataaattgtggaatgttgtattattttgggtattatgtgagctaaatatagttggaatatcacacatactatgaagtttctataaatctgcagcttctattaagaatttctgtatttcaatgtttatcggaagtatttctccaatatttaaatgctgaaactatccaagactattattcacaaacaacggattatattttaatactcagaaactgtaggaaggtttgttaaataagatgaatatcctgtgattaacttgccagtatgttgggttcagtgatttattatgcctggtcttttctgattttagttaatgtttttaaagtttgttaattctctcagaagatgaggatgccaatttatatcccattatacaccctcaaaagatgaatttatagaatgggccatgtctttaacatgcttctatatagtcattcttatacctaa

SEQ ID NO: 45924 - DNA, 1049 bp, Homo sapiens
atatgtatgtatttctttagccacacaaaataaaattttgtttctagtccttattaagaccaagttgttgtatactaactacgtaactatcctaaactttaattttttaaaaggaatatttttaaatattgattatttcccatctccttattatatcaaatatctcattatttggaaggagcattgcttttttctgcatattctgtaatcattttttatattctgcatggcaaaggaattttacagattaatatcacttcctgaaatgccatttttcctaaaataaccatagatcacattgccaaataatactgcagctgtcatggtagtggtccctactgtcttcgattcctttttgttgatcctgtccaatatcctatgctagaaataatgatgtctgacaaagaccatcagaaaggatactgacctgtgaactgtatggttctgttttagaggacttgtaactactagggtatgcaaagattaaacatctaatggtttgggggttttttttagccttaagaaacgtcaaaggatggtgattggaaaagagaagaagcagcacacaagggttttgtcttagaagcatttattttatttatttatttattattacttttttttttttttgagatgcagtctcactctatcgcccaggctggaatgcagagaagcatgtatttaagcaccccagtcctcagctatgcagtgccccgccactgccagtgaagaggcttaaaaaagagtgacatgtttctccctagacctctcttttagtgcctatttgtttatcagagactccatttaagggtaactgaagtgtattttcaagtgcatatgcatgtgtattttgctaatttcaaaagtttctgtgcacataaattccattacggaaacattccatatgataactaatctttgccctggtggtggttcaaaatagcaatttggttggtctgttttcaacaaattctatagaatgaattggctgttgttagaaaatgttttctctcttttctcctccctcttctcaaaatagcagatacatt

SEQ ID NO: 45925 - DNA, 1053 bp, Homo sapiens
gctacccttaaaaccatgtcaacacttccaatataatcctgaattttacaggtgttttaattctggagggggtggggattttttttttctaaaaataatttagaatacaaatttccagtctgagaaaaatattatttgaagattggttataaatatatttgaaaggaaaattcaggcattttccaaggtgctctttctgactttacacaagactcacccatttacctgtattaaaaattactttccaggaagtgccacagcaatttttcaacacctaagcaattttttaaacaagtggatatagtgttatatgtgtaccaacccatcctgtattaattgactgaaattacatctattcagctatattttcttctgaatgaaattattgtcttttatcttggctttattcacctcccacacaataagtccatctaatcatatttaagagccagaacactgatttcaacccccaaatatcactctcattgatgagagctggctgcatggattcaaatcagaatgtagctcttcttttatatgctaaaagtaatttaaaattatatcagcgatttttttcttccagagttttgtcccccaatacctttacgtgaggtcactaagaaaacttgatggtatgaattaaaaaaattaatttcattggtttatgttacttaagaacaagcaatcagtaaccccgacatatatactagtgttggtttgcagattgtatttcacatttcctctagtagcgtgaaggaatctcattagttcattataattgtggaccatctggatcactatggaacaactgaaggttaggagataatgttagtactagagctaatagcacatggtgggtgttgagactctaaaagtagcaaggatttttaaacagtcctaactgtaaaataactatgtaggcttgctaaaaaagtagtttttggtctatgaaggaatgatgtgcacttgaattactgtactactgattgttattgctgcccatcatagtgcctattaataataatcaacctgtcagattttggcaaactggag

SEQ ID NO: 45926 - DNA, 1064 bp, Homo sapiens
aaaatttgtattttattaatcccattactatatttatttgaaaaatgacagcacatatatttgtgagacatactatttattcagtctatatgcaatgtttagtatatatatgggtttatgaaaaatgaattttgcagctcctaaggagctaatagtcctcatgtttggaatgaatgagatgggccacagaaagaacacatcttagatgattacacaaagagttgagtgacagccaatatcttaacttcctgacagcgtttgcattttaagacataacacttactaatctgattacatctttggtctcttttcaggggtggtgtgaagggaatgagagaaaagaggctcttccgtgatattgtaaatcacaattcctgttaaagtctgtctctgatgtccacccagagtgcaaaattgtattgattacatttattcttctaattctcaagctgcatgttaaagcaaattcagaaaaaccttaaatattttatactaaaatattttatcgtaaaaggaaaaatggagaaaaatgtaacaaatattcatatacctgacccagagaacaaacatgctaaagtttcatcctgtttgtatcacattctttaaaagacataaaatgtaacaaaatctattgaagtcatcactgaatcccttctcagtctctatttctatagcttagatggcattctaataaattctagctgtagtttatctccccatagtacataggctccatcacacttgctcacaggggcctgagtaacaacacaaagctattatacttcaaagcaagggtggatgattatgttgcatttttcttaattcctcctacagagaagaaagcagccctccctgcttaaatcaaagaacaatgttacgcattttctccgctcactttgtagtgcatcacaaagcaaataaattctgtggtatgtaggtattgcagagcttccattagcattacacatctgggccttttggtttttatactcttggtaaataagggaaagaataaatcaaataccttactcagaccaaatctacattacatcaacacagccagt

SEQ ID NO: 45927 - DNA, 1029 bp, Homo sapiens
aagcttttatttctctgttttgtggacgcctcatatgatagaatttacctcgtgaatctctgtcactctatttgaaacatgaaatgtgatacaagtggattgtatttatagagtatattaaatgggctatattattaatgagatgtgttaaaagtactaaaagttcacatttgaagtgagctggcaagtccagaataagtccttttaatttttataccagtgtttattcctgttccccgggagaggaggcatttttttctgtcaacactgggcgatttaagaactgacttgggggatgaaaataactatggtgagtccacaggggcaaacagttctgctccagccaatccacatctgttcaccttaagtagagaggctggggtgagtcaatatttactcagcctcagtgcctcagaaaaggtgatgaattttatcttatgagctgctttcagtcatcatgtatatagttcacacaccattaataagaagactcattcaccatggaaataatctgctagtctgagagaatgttggtccctaagacaagcatcttgaagtatcaaagtttcatcacagatgtttactacttcctgtttctgtggtctaaaattcacctcaaatgtgtagttaacctgtaagtgatgaaccacttccatcacttccgcaataaaattaaaacgtgtctgctggggcaccccctccccatttgtttgcttgtgtgtttatttttgcagtgactctagggctgccattgaagacacatttttgtagcctttattcagaaagaccatgcagctctctgtgccttttagcaggatacgttttctggaaagaataaaacagtaggtagagggaccttataatttatcatccaagttggggcactctgagagtggaagaggcgctattggttaagccagaataataggcataaactgggatgtgtggtcacttgagctatagggggtgtaggggaggaaaaggtgtttcagtaccactatgttcagaaacattctctggtgatgggat

SEQ ID NO: 45928 - DNA, 1050 bp, Homo sapiens
gcagacagtggtgacagcgatagtggcaatgacaataacctgggagtgctggctagagagttcttgcccggttaactcacccccaagagcggagcctcagagacccacggacccacactctggacaatgctcttcccaaaacctctcctcttcccaacacctaattctcactttttcttattattgaaagaaactgaattttgtttcgtgcttggatattgaagttgtcagaagtactttaatttgctttaagcttattctggggagttctaatagggaagtagcactattcatagttatctcaaacactagaagttgtttgagttttgtgaaacaaacgatttaatccaaagcagaaaatgagaaaaaactcaggtcactgcaagtttagttacagctgaggtgattaacaatagttgtaatttatgaactattgctattcctacaatagtcatattttgccaattgtttcatgagctttaacatttttttggccttagttttcccttcagatgggtaaaaggctctgtagtaaaatcttttagcaaaaagaaagtctttatctctgtttaattaagtgtcaagaacacagtggagaggatttgtcatttgtgataaaattagaatgtagtcaaacaacgtaactggagaccttcaccccaacctgattattctttgtggttacctgggtctcagtattctgtatattttaattcttagctcagagaaggaatttacagcacagtacctgaatggggagtgtgtttttggtttcaagtattttgatggtttctttcttaaaaggagtctcatcttctgattttcaatttttccttcttaaataaaaggcttgcatttttcttttacattatcaccagatggatgaagagaagggaaaatagaagcctaggatggtgataacaaggggttagaaccaagaaacatagtatttttagaaaaatcaaggagcaagacagcaagagaaaacttgcaacagaacttggaataatcagttgatcggatggaagttccaagcttttgaaatggacc

SEQ ID NO: 45929 - DNA, 1047 bp, Homo sapiens
tgagcctgggaggtcaaggctgcagtgagccgtgatcttgccactgcactccagcctgggtggagtgagaccctgtctcaaaaaataaaaaagaagtatactagtaaatggtatacttcatggtaaatgaaaatcagtctttaccatgtcaagccctatgccagtcagattaagggctatccttccagaatttttatgtacaattgaattcagcctgtaattttatgtatttttttaactgaatcataccatagatatatatttgtttttccatttaagtggattttgaagattttttttttcatgttagaatatatctattgacttcattatttttaaagctatgttgattctatagtatggctataactaaaattatttaaccattctgctgtcaatagttttttaaggctacttctgttttttgttgtgttactatgaacatatttatctgtctctcctcatatgtgcgattatttctctatctaatatctagaaatttgagttgctgtgttaatgggtgaattaaattaaaaatttactacgtactactaacttggtctctgaaaaagctataccagttttccctccaagtttgaacttttttaatgggaaaaattggaaacaaagtaaacatagttaattaaattttgtaagctcaaatcacaaactgggactttgctctgcttttaacaaaattttatttattatttacttatacatttgattggtataaaacttctcagaaaagcttaggacacttggcttgttgatttatttggcagttataatttaatagacttcacacgagctctgagttagaatgaatctgagtgtttccccatgactgactgataagatgtttctatataataaacactaattaaaatgtgatcagcttggaataatcaagaaattacctgcaactaaaagatctctttcataccaaaggtcaggttaaaagttgagttctttagtatttccttaatatttcattcccatttttacaactcactaatttcttgaatcatcgactatttttttttt

SEQ ID NO: 45930 - DNA, 1107 bp, Homo sapiens
aatcagtgttcgtatgttaattctgtcaagtggtttgcattgcttgtgtgatgtgcatgaggaaactctcagtgtgcaacctgtgaatgaaaactcaggaactgtcaaatgcctgttctgagctgtgaatggtgaacccctgggcaagtacagtgaagagactttgagtgtcagagttctctggcgctgcccagtgaaattcccaggtacttgatttggagctggtcctaagaccgtgttgtagatgaatccctctaggtttggcagattatcattattatttttatttttatttttttttgagatggagtttcactctttttgcccaggccggggtgcaatggcaccatctcggctcactgcaacctccacctcccgggttcaagtgattctcgtgcctcagccaccaagtagctgggattacaggcatgtgtcacccacacctggctaatttttgtatttttagtaaagatggggtttcaccacgttggccaggctggtctcgaactcctgacctcaggcgattgcccacctcggcctcccaaagtgctgggattacaggcatgagccatggcgcccggcccatattgtcattttaaatccaaatgaagattttaaaaaaaattcagaatctattttcttaggaactaatggtgccatgtatttttccttttgagatagaggcattcaataaagttgaaaccagcacatccttttcagcaggtctgctagggagcagattaatggaaaataaaactaagactccctggttcattttgggctcgttccagctgtgctgtggattaaaacgacttcagcgttgccctgtctcacccctccatcctgattttgtgttatttgatcttaatattcatatgtaccttggatcagtgaatttgctatttttctcataacgtcattcaccaattctaatcctctaattcctttcatgcaaactcaacaatatctctgtggtgccattatttttcctgatcactagctccaagttactgggggaggatttattttcaaggtttggcatctgaatggcccagaccataacacccagtggctttctccagctcattattagacagaggggacttg

SEQ ID NO: 45931 - DNA, 1062 bp, Homo sapiens
tggctcactgcaacctccgcctcctgggttcaagcaagtctcctgcctcagtctcctgagtagctgggattacaggcatgtaccaccatgcccagctaatttttgtatttttagtagagatagggtttcaccatgttggccaggctggtctcaaactcctaacctgaaatgatccacccgctttggcctccaatagtgctaggattacaggcgtgagccaccgcccccgcccagtaatggctctttttttttttttttttttttttttttacttggtgtgcctaaagagaaatagacccttctcagttatggaccatattggtagattcaaaatctatactagaaactgttatccctatttttagatttgttggcctgtgagaaatttattaatgtaaatataaaatgttgcattttaggctaacagcatataatctctgattgtcaacaataactcagaatttgaaatgtccaagttctatatggcatgcctgtgagggtcaaaaactgcaagaattggtctggaaatggtggctcacacctgtaatcccagcactttgggagatggaggaaggaggatcacttaagcccaggagttcaagactagcctgggcaacatagtgagaccctatttctacaataaatttgaaatattagctgggcatagtggcatgaacctgtagtcctatctactcaggaggctgaggaaggaggatcacttgagcccaggaggtcaaggctgcagtgagctatgactgtgccactgtaccatggcttgggtgacagagtgagaccctttatcaaaaaaaaaaaaattgtaagaattgtcatcttgatttaatatcaaggatacaaacttatggggagggtttttggtcaaagtgttaatcaagtgaataccagtgtagggaataggatctctgctcctggatcataagctaaaatgagaagcgccataaagtgagttaaagaatttctgaatcgtgggtcacacttgtaatcccggcactttgggaggccaaggtaggtggactacttgagtccaggagttcaagaccagcc

SEQ ID NO: 45932 - DNA, 1033 bp, Homo sapiens
tgcccggccagaaccatttatttatatatattttattttacaaattttacagtcatagtttgatataccttatctagattgttctagggcacagattcgagtcccctggcctttaagaaatgtgagtgccagagagtcacttgcccactgttgagaaccagtgtctatttctcaaccagctttgtgttatatactttttgcatatgttggaactcccttgaaatattaaaaattttgcttactagtgaaaaaaatgacccctcagaaggaagtcaactacatgtactgatcatggaaatgaagacaaaagtcaagtgttttaaaatagcagtttattaggcagcagatagcaatgtaaatagattaaattgtagaacattggactaacttgatggtttgcatctgtgtgaagtggttcacgtgactccatttttttgaagaaatcatatgctgtaatagttatgatttgggataatttgagggtgtctcaggaggtatcccttgctactgtcagagtctgtgctttattcatttatacaactggcatctaaaaacctattatgggttaggtgcgggggggttatagtggcaaagaaaacaagctctgccttcatggagctcatgagatatgtacacagcatgccaccagacagggatgagcattttgactttaattaattaattaattagtttcttgagagagggtcttgctcagttgcccagactggagtgctgtgacatgatcatagctcactgcaggctggaactcccaggctcaagaaatcttcccaccccagcctcctgagtagctaggactataggcgcatgccaccatgcctggctaatttttaatttttcacagagacatggtctcaatatgttacccaggctggttttgaactcctgagctcaagtgatcctcctgcctcagcctcccaaagtgctgggattacaggtatgagccatcaggttctgtcgcattttgactttagacagagtgatcagggaggcctctctgaggacctaacatttg

SEQ ID NO: 45933 - DNA, 1042 bp, Homo sapiens
cctcctgttgttccagggctttgtcgaaggcatgaatggggaagttgtagatgtcgccatactgaagaacataaacacagattggctttaactacatttggatattacacttgaagttccactttctgtggagaatattactttttcctcagtgattaaatcagaatacttaatttgatgagtaatatttttaagtgtagagccagcagtgtcttaaaaaagcatgttcttttgaacatttaaatcatctgcagttagtatcaaataggtaacttctatggagttacattttaaaataatttaaaatgtaatagtctacaaaacccatgcattgggacaaatgtcattttgctgacaaggggaaataataaggaaaaagcatactttagtcatgttgtctgtataaacaacactaatttttaaaaagagaataaaaacttatttcaaagagccttaaaagactagggtaatatgcaggagaagcaaaaccccatggcttttatacagaaatctggaattgttgtcttggggaatggagctgagaataatggcaaaaagggaaaggtctcttatagtgaatggagtatcaagggtaaccaaagcattttatgtgcttgcattaattaaagcaaggaagccaggccgatatggatttattttattccagggataaaattcgagtggagatcttcatatcatgttaaaaaacatttcccagccaggcacagtggctcacgaggtcaggagttcaagaccagcctggccaagatggtgaaaccctgtctctactaaaaatacaaaaattagctgggtgcagtggtggtgcctgtaatcccaactactcaggaggctgaggcaggagaattgcttgaacttgggaggcagaggttgcagtgagccgagattgcaccactgcactctaacctgggcaacaaagcaagactccatctcaaaaaaaaaaaaaaaaaaaaaaaaaaaaaaaaaaaaaaaaaaaaaaaaattcccaatatgtcttagcaacatactaccacttaaaatttca

SEQ ID NO: 45934 - DNA, 1050 bp, Homo sapiens
ctcttccaattttaatatccagatttagagtatgaacatagcttttcttcctgattccagagtttcctgcagacttgtggtcttactgaaggccctcttgaaactgatttgtgatgtagcaagggatccaaaccttacacctgagtctgttaagagcgccctgctacaggaggccacagactgcctgattctcctggaccgctgttctcaaggacgggtaaaggtaaggcagactgaaacttggtttcagttgggcctcattatccttatgtaattcccatgattgattataatttactatgtatgtgcctgaccaagtctggaaatgaacatggagggttttagatctccatatgagccctctagcctcaaaagagcttgatcttttttcttattcatcttttaaagctattcagaaccatttagaactaaaggcaggaggatcagcacatgtcactggggctaaggacgagacagtatgggcaaaagcattatgatcaaaagtttgtaaaatttaagttctgttctagtcttctgaattaaaaaaaaaaagtaaaaataatgggctataagctcccaggaataataacataaatagagcatttcagatgtttccagttttttagggacaaccatcttttaggtagatgtttttccctattcttaatttatctacatggaaattcttcctttggtttcatattccacaaaagttaacttctcaaagccacagcatataatagctgtgtacttctatgtatttaataaactactgcctcatttcttaccccttttagaaatctttagttgaagattgaaggtagcatgaaaagaaattcatgccataagtcactggacaatctacccagcaggaaaaaaaaattcatatcctaaaaatatgtagagatagtatgaattgttattttaccagtttattcaaactatttcatcttagctctttaatcttgggcagttttcaagccctagatccaactgaatttgccttggctggaattctgctgtttcatgagccagcaggagatttgcaag

SEQ ID NO: 45935 - DNA, 1050 bp, Homo sapiens
tgtctggtccctctgcacagctccaaccaacaggactgtagggtgatgacgatcactttcccagtgatgagaagggtggtctaggactgggcttctaccctcagtgcaagaccagtgccagatgtgcccccacttcctgcctcctgaagccttcttccctgctactccatgctggtggcctcacccatcaagaccactgtctcctggtactggactatctacctgccttgtccctgttctgggggaaggtgtccaccccgatcaagaacatggagaaagtcctctttcaaggctcccattaggaggatgagctgccttgacccagaagggatgagacgggctcttacctctctacaaccttccctccccttcccactccttccggagtaaggttagaagggaaggaaggaaagatcaaggaaccaagcgcctccacgggaggcgagggaggctctgtatgaaacagaagagcagggacataaaggaaaatgtcagtgtttacatgggacctatggaaacaaaggctggcgggcgccagctgactccagagtaagagagggcccttcccctgccaggacccacggtgctatccattcagtctcttcctcagttaatctcggagcttcctattccatgttgaggtttgtgggcccctctagaggagggctagttctatacttaaattgattcccaggggccttttttttttttttttttttttttttgatcaaaaggggtgtggggatgggggtgtctacggttaagcaacagatacctccttccctttgtaaatagtatttttatacttcatcctcgcctctcaggctttagatacgaaatctccagaatggaagggggtggggattttctgttcctccctggagtgggtgagggtgggagaaagttacatatttaaagaaaaataaatttaataacaagtttctctaacctacttttgcttgtggttgtggctgcctggcccttttctgccagtagagggaaaaaagttctcaaactgcctcttctcacttttccatacccaaatcaaac

SEQ ID NO: 45936 - DNA, 1035 bp, Homo sapiens
acccccttgcaggtcaggatctgttcttgcagaaggacaggtttgagagctgtgaattgctgatttctttttctttggctgtggtcaaagaacagaacagggctgggcgtggtggctcacgcctgtaatcccagcactttgggaggctgaggcaggtggatcacctgaggtcaggagttcgagactggcctgaccaatatggtgaaaccctgtctctactaaaaatacaaaaattagccgggtgctgtggcaggcacctgtaatcccagctacttgggaggctgaggcaggagaatcacttgaacccaggaggtggaggttgcagtgagctaagatcatgccattgcactccagcctgggcaacaagagtgaaactccctctcaaaaacaaacaaacaaaaaaaaacccaaaaaaacacaaaaaacagaacagtaaccacatgatgctaaaagctgaccccactgtggtgctactgagcaccacctgttcctttagtaatctccttcgtcaccctgccctggtctgtagcctgcctgaagcctgctgaccctggagtttcacagtctcagaggcccactggtacatggtagcctgtgaatgtctatatatagaaagacacacaggcgcagaagccaccacttcctctccctgcttctcggtttcctcctcagccaaaataggccccacttctgacctggtgagctcagcggccaaggccagcccctcgctcattcttccccctctctcagagctgacctctgccctacacaggaatggaggggccggggaagtacaaataggcaggaagggaaacattattttcaggacctggctgcattgtttgttctaaaagggaaaagaggaaagggagagcccactggcagcggctagaaatggtctcattgaaatcagggtatttttagttgctgtgttcacccaacagctgagaaggccacctgtccagactggttggtactaggtccccagctgggattgcccagggtttttgctttttgctctggtttccttgcaag

SEQ ID NO: 45937 - DNA, 1050 bp, Homo sapiens
gggagcaccaggtcttgttggaagggaagtcctgagccccttttccagcatagactgaagtttgtcactctagccagtctgccatgatgtcctcatggaaaattgttcttctttgacccacagaaagtaaatatttgggtggggactggtggtgaaaagcactttctctctaacccctactagagcctagacacaaggaacttcctgttgggcacagcaaagtttagtagctaattatttctttcatttcaacttaatcaaaaagtctttcacaacaagaacttctactttctgttttcccacaatgtgtaggtcagtgcataaagcaagccctcaataatacttgctggttgactggtgatccattagcggagggcagtttctgggcaattttcccaaacatcagtcctgctgctttgaagtgggaggttttgccaaggggaccaggttattttaagaaaatggggaattatttatctgttaactagttattgagaacaagccaaactctaggctaggccggacactggagaatatacaaaagtccaagttggagtcagcaaacctaggagggttcaggcttttttttttttttctttttttcttgagtctcactctgtcgcccaggctggggcacagtggcgccatctcagctcactgcagcctctgcctcagctcactgcagcctctgcctcccgggttcaaccaattctcctgctccagcctcccgagtaactgggactacaggtgtgcaccaccatgcccaggttttttgttttgttttgtttagagacgggagtctctctctgttgcccaggctagagtgcagtggtgtgatctccgctcactgcaacctccgcttcccaggtcgaagtaattctcctgcctcagcctcccgagtagctgggattacgggtgccagacaccaaacccagctaatttttgtattttagtagagatggtgtttcaccatgttagccaggttggtcttgaactcccgacctcaggtgatctgcctacctcagcctcccaaagtgttgggattacagg

SEQ ID NO: 45938 - DNA, 1050 bp, Homo sapiens
tttttaatgtgtacaattatattattggtgtataatgacagtattatttcttctttttcattcaatatcccttttatttctgtgttttgtcttactgcatggactggcatctctagtaaagggttgagaagaaatggaggtagatttgtttcatgtgtcagaaggaaagctttcaaagtttattgaatattatattttctataatttttaaatagataaaatttatcatgctaggtaaattacttctatttcttagcactagaagtattttttaaaaatatatgaatggatattaaattatatcaagcttttttcttcatgtattgaaatgttcaaatgttgttttctctaatatcttagtatgtaagattacaacaatttatttactaacgtaatcaactttacattcttgcaataaatccaatttggtaagatttattatccttttttatatattgctgcattcattttgctagtattttgtttacgatttttgcatctatgtttatgagtgggattagaatatctatccttgttgagtttgatataaaggtaatgctaacctcatgttgtctgttaggtagaggttgtgtatgattgaaattattttctccctcttgaataattggtagaacctcttggagaagccatttgtctttgataggctgcgatggtgaaagagttttttttcttgaaacggagtcttgctctgtcacccaggctggagtgcagtggtgcaatcttggctcactgcaacctccgcctcccaggtttgagcaattctcctgcctcagcctccagagtagctgggactccaggtgcacaccaccacgccaggctaatttttgtatttttagtaaagacggggtttcaccatattggtcaggctgatcttgaactcctgacctcttgatctgcccacctcaggcttccgaagtcctgggattacagatgtgaggtgaggcactgtttttttttttttttttttgaaaggctcttgcattgtcacccgggctggagtgcagtggcacaaccacagctcactgtagc

SEQ ID NO: 45939 - DNA, 1029 bp, Homo sapiens
gtggaagttttctttgatccaaaccatcatttttgaaatacattttcatttgatatagaattttgggatgatagtttttcttttccttttggagctttaaatatatctttccactgtcttctggctttcactgtttttttttttttttttttttttttttacatgacgctcagccgtaatttctattgttggttctctgtacgtaatataccattttcctctgactgctttcaatattatctatttatcattagttttcaacagttttattataacttgtcaacatgtggttttcattgtaactaaccttccaagggtttgctgaactccttagatccttatgtttttcacataaatttggaaaaattttaccatatgtctttgaatatttatgtttccccattctttctctccttgccttctggaactctaattatccatatgttagatatcttaacattgtcctgcaggtgattgaggttctgttccttccttagaagacttttccttctttttgtccaaattggatagtttctaatgagttaccagcaagcttgctggcctcatctttcattgtctccaatgtgcttttaagtctatctaatcatcttttcatttcagatattgcaattttcaattctaaaattctcatttggaccttttctatagttttcatttctctgttgagattcctatctatttgttcattatgacattaatttcttaaagtccttgaacgtatttttaatggtttctttaagttcttgtctgctaatgctaacatctgggtcatctggtggttggtttctatagacaacattaaatttttttttcttgactctaggttacattttttaaattatcccccatatataataatattttacatataccagacattgctgataagacatagagattctggattttgttatctttttctgaagaatgttaatttttatttcagcaagtagttaacttggctgggctcagctttaaaccaccttcctggaataggcaatagtttaa

SEQ ID NO: 45940 - DNA, 1024 bp, Homo sapiens
ttgttgccacctaacactgactcttccttgcgtttgtgtcatcaggccagcctaggcagatacccagagcgggttctgtggcccctgggtaggttagcaatgttttctgccctgggggctgggcctgccagcacaatggtgtgcagggcaggcctctgagaacttggaatctgattaggcagctgtcacatagccccaaggcagtgttcctcaagggtgggcccagcagcaggggctgaggcagggtttgaactgagggcggaagtcaagaagcacagagaaggggagatctctccacagccagaggaaggaggagccagcagtggaggatgcaggcgctgctgagtgcccgcctggcttttggggcctcgtccccgcacaaggagcctgctccgggttggtcggagcatcctgccaggcccttccaaggatgggcagtgcagcccagccagcacattctgctcagctggttttcctccagctcttctcagcgcgttgttacttctgctgggcttagcacatctcctcatccctcccccggctcagtccagtgcaaaccaattctccaggcagagaggagtattgggttcagatcatctcttcacggctgctttcagagcactgcctctcctgctttcagccctgcaagtggagcgtgcggtcccctatggcatggactggcccgtcgcacactcagcagcctccccttcccagggcttagttcagtccaaccaagagaactggagaacctgatccacgcctccttgttctaactcacttctgcttgactaccttgcttttgttactcaaagtctctctctctctcttctcgtctccccctctccttacaaatgcctttgcagcggccctgggagtgcacggcagcaccaataacgtctccatggtttcttgttagctgctctctaagcaggaaagtgactcggcctgacaatataatttacattgctgtataaaactatctgtggaagccaagctaatttgtgccagattaggctatttgtct

SEQ ID NO: 45941 - DNA, 1100 bp, Homo sapiens
tgtgtccccctccctctgcacctatcccactcctttttacatccctgtgtgctccccacaggcagtctgtatttaatttagagtagggaattactaatcgaattttccttccagtgtgtggagcgccgccgccgctgcctgccatcttgctacgcctttgttttgtgcttcccacctcaaggccactgtacaaatgtgtttgatttgtggttgtggtttgtagctgtcactgatttcttttttgttgttgttgttgctgtggctgcaactgtttccttgcagctcaatttttagctgagtgtttgggtagtaaatatggtttacaccaactgtgttggaaataatggcatttatgtgctgaagttttttccaaaacctgtgatgtgtgtatacaaatagatccacggcagggcccctagactggggagaacacagactcaataaaacctttgagatggagtataaacaggtgtctgagactagggctaggccaggcggttcagaaaaataccccccacccctgatgttggctctaaacttaagctctaccataaataccttgcttagcgttgggggaggtaggagatatttttgtgatcgtatttatctgctaaatgttcgcttgtatccttttgagcatctcactataaacttcgcaatttttctattcactcaccctcaatggctttaaaccttaactgccctggatcttagtattggaaaaaaatgtgccaagaaacaatgggattggcctatgaaactggcagccctcttttcttccaaatagttgccagtctgggggttctttggtttatggggtgaatctaaccattttgaacaatgccttttaaactgtatcatgtgactttgctaatcccaaccttgggcagggagtacagagttagagaactctaagaggggggagtcaggctgctcttggtagatgtggctctaccctctgaatttgggtggagtgggtttctttgatgcctagattcttttatttttcccttttttttttttaagagacagagtcttgctctgtcacccaggctggattgcagtggcatgatcataattcactgcagccttgaactcct

SEQ ID NO: 45942 - DNA, 1046 bp, Homo sapiens
gtaggagcttgtatctaggttttgctgagttatactgtgatcactgttcccctttaaatgtgttttgggcaggagaacaacattatgaaaaaattctctcctttctagtttgattcattgttttcctataacttagaaaattcaagagagaagaaacttactgggaagtgattacctaattcctgctttttgtccttttaaaattttacaatggctagattctgatcactgccccattactcctcatctttgcaaacatggggcaagtggttatggctgtttgcttaaaaaatatgtcttctcctctaagccagtgagcttctggagcccagtgagcttgtgtttgggcaacatgggggctagaaggcctatcctgttatttgctctctgaagttgggctgatcatatattcccagagcttgaatttgacaagcactcactgtctgatataaacatgtacatcatttatagaatctctgtgtgtcagaagatcgtgatattttagagttgaaggaaagactgaagttctatgaagtcaaggcttttgcccaagcagaactgggatgggactaaccactttagacaactaaacaaaaaaatctcctgacaaaacaaaatagagaacatggcaatatagatctaaagactttgtttacaatataacttggaaatgtcacctatttttatttattactattttatttattattaactctctttaattttgtcctgagttgatttttatagcttcttttatagaacatcttctatttactctctgttctctgtcttagagcagctttcatggtaagccatactgttctgacctatgggtggcagaaggcaaagattcctgtaaggatgcaaggctttctgcactctcagcttccgatctgaaacgagctcggcctccccacgacctgatgaggtttggcagggtccctgagtcggactggagtgagctattgaagtataagtctgctcatgtctccccagcctgatcctggtgatggctttccatagcttcacgatgagagaagcccttt

SEQ ID NO: 45943 - DNA, 1032 bp, Homo sapiens
ttctttggggcatggtgttataaattgggcatgtgatgatgtgtaatcgctaactgaaaagccaatacattttcactgtaccggccacaagacaaataaacggcaaaatgaaaggtttgtgctctttaacaaaggggaaagcacacaacagacatattaaagaaaaaaatcaaattgcaaattgaaaatgttgtcatcttaggagacttgttttcttggggcagtctggctggtgcctgcctcctgagagtggggtgtcttgatggctgggggtggggagggtgaagggcaatgttttattcctcttgggaaccacattattgttgggctttgtaaaccctcaggctattgccccaggagcttatgagctgggatgcgggtggcccttggttgagaacaactggtctatggtcagagacatttggagaaatagataaagagaaagataaagagacgcctacgtgtttgtgttcatagagtgtatgtcgtagagtgatcgtcactcagtagaaattcagtaaagcctcttgttgatggtgatgtgtgtgtagggcagtgttatctataataagggctttggaaggaatgttgctcagggtgttctgattcggtgctctccgtagaggttgagcacctgcctgctgaataggatgagtgcgtgtgtctgtttggagcatattttgagaatgtttaggagagaagttctctcatccattcatattcaacttcacgacctttggaaatatggtctgcagggccatggagttttattttgttttctctttcccaaagccccgaaggaaatgcaataaaaatgaggactggggagtagtttcctaaaactgattaaagcaaaagataatggggaataatatatattgttattctagaaaaggttagagattttttccggaaaaaataaaagagaaacaaaatcttcaggcttggtaactaatgatgttcgtgaagttaagatgaatgtgaacagagattaggggctctcttttgtaaagaggattcaactatgtgagc

SEQ ID NO: 45944 - DNA, 1092 bp, Homo sapiens
ttcctctgtgatgggaaattttttaaaaagtctcaggaggtggtgatgagacccagggtttggaagggagttagagtactcctggcacatctttttaattttattttttaaaatgttttaaaactcggatagcctttttctttctttctttaaaatattcaacttttattttagattcagggggtacatgtgcaggtttgttacatagatatattgcacgatgctgaggtttgggggtacggttgatcctgtcacccaggtagtgagcattgtacccaatagttagtttttcagcccttgccccgccccccagtagtccccagtgtcaattcttgccatctttatttccatgtgtaccccatgtttagctcccacttataagtgatgacatgcaatatttggttttctattcctgcactgattctcaggataatggcccccaggtctatccacgttgctgcaaagaacatgatttcattattttttttatggctgtgtagtattccatagtgtatagataccatgttttctttatccagtccactgttgatgggcacttaggttgattccatgtctttgctatggtgagtagcttttgcacatcttttgagaaaacttcttttcatggtttgggggcccaagtgtgatgaagaggatggactgggagcagccagctctgctgaagggtctttgatgattcctcttgttgtttctggtaaaattatgttgatatggaatctacttaattaattcaaccagtttgtcacttctcaagttgtcagggattcagccctgggggcaaagatagccagcagaggtctccagggccctgcacccagcagcccgccgagctcaggcctgggcagggcagagaattaaaagcatttagttaacttctccttggggacacaaattcagaccttcttagaacacacccagtcccttaccactctgcaagcaaagcatgatattggtttctttaaccccaataggttttgccaaataagagagcgttaatatccccctcctacccaccgcatggattgaattacttaaagcgtctttttggagatgtcagcagtttaatagagg

SEQ ID NO: 45945 - DNA, 1026 bp, Homo sapiens
ctcttgggtagagaatggatttgaagctggcctaacctagaattggacagacaaaatgggaggctgttgcagtaatctagatggtggatggtggtggcttggactagaatgatgtccaagccacctgtggaggtggacagaggtggtggatttaagaaatatcttggaggttcaactgacctgacatatgatggattggatatggtagggtgagagggaaagaaagtaataagaatgaacacataaaatcaggagagcttggtgttgaaagtgaaccaggaagtggcagctgctttctttcccttacagtcactgtgataccagggtgaggtcaccattacaaagacagctttgggctgtgacacctgtgagtggagatttctgttggagatttctgttgaagtgaattactaggaaatgccattgaaaccagggcgtgtatgtatgtgtctgcaagtgattacccactcagtaccgccaagtctttgtcttgtaacagcagagctgctgtgatctcattgatgtgctgtcacacagcagatgaagtcactgctttaagggatataggactaagaaaaggagaacataatatataacattagtaaagttagacccataaatgaaaaaaaaattctcaagtaagtgaaccagttaaatgttttttgcattacgaactgtaagcatagaaaagagtcttgtgcctttctcattttacttaaactgcctttggttacaaagacttctattgtatttctgtaactcccatcagaggaaggtttttataaatagtatctgatatgtcattttaattgtagttattaactaaaaaatgttataattacattacaagcaatccacatgcttattaaaatgccatcaactctaacatgtatttgctgacattactcttcctatcccttaacaataatcttagacatccattaagatactatggttttcattgctatacgccctggaaaattgtgcttcttaccctatacttttgaaggagggacagctagctct

SEQ ID NO: 45946 - DNA, 1092 bp, Homo sapiens
atttgttgactattttgttacacttttaagaaccaagactagtacccatatttcctgtgttctaggctatcatatctctataactgagattcagaatatcattaaagtaagaaatggagcttaaaagtattttaactgatacgtcattgtttgaaagttgtacaactttcataaacatatttcataaacatcagttaaaatgtcgttctttatgattgctgggatctggctcctgcaaccctatcctccctgccagtggccccttcagccaccgtgacagcacttgagaggctcagttctgtggagcttatccagattattagagttcaaattcaggaaacctgaatattcagcttttcaatgtattgtgaactttaagtaaaaacagagcaaacagataagcactggagaatatatcctacacagtagtccttccatcagacagctctccaagttttgtttctcatttttctttcttctttctggcctaagctctcatgtatcccctcctatactagttttgcttcctgcttggagcagaaaaggaaggctgacagcaaaacaacagagcagttatcagaactttgagatctctaatcagaaaataccattcctaaacctctggcccactaatcttctaaatagcattattccatggtctatttgtttctagaagcaaacttaaaaagcaactaaatcccactttatcctaattactttgacttgaaggtcatcaaataaaggagagaacttagtaaattacccaggcagcctcacatttcctgatctgtcagttgtcaaacaccagttggtagcaaaatgctgctgcctgtgatccttgactgagttggatgtttctgggagagacttaatttatgtaaaaggtacttttcttttctttctgaaggaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcaggtaaaaaagtgactcgttccccatgctttcctccctaggaaga

SEQ ID NO: 45947 - DNA, 1047 bp, Homo sapiens
ttgctttctttcttacctctgaaggagaaaagaaagttgctacttacatgtttgaaaaacctctcaaatctactcagtcaaaagattttatgcttcaatttggtcatatgttaagagtttagcttctaaactgatacctcagtagcccatagtttaaaggagtaaagagtacatggatgcttttggtactactcagaagctctgagtttctggccactgaaaccctgaaaagtagctaaatacgttcacttgctattttaatccatcactgtagatatgactcagtccctttgttattttcccccaatttgaaacaaatttaatgtgctgaaaagataactttctcctttttctttctttttctctctcctcttttctcagttattaagactgtttatttgtttcaaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacaggcaagtttttccaagaacaaagaggaagtattcaatcattgtgcagaccagtttcatactctggatacagagtgacttggagatagataggtagacagcatggacctacttccttaaaaaaaaaaaagaaaagaaccatgttttgaggctgggttcttaaggggttgggaaggttatgttcctaattcattattgaatttctttttctttttctttgggattggttggttgattgtttgtgaggcggtttggctctatcaccaaggctggagtgcagtggtatcgcagctcactgcaccctccacctgctggctgaagccatcctcccacctcagcccccaaagtagctgggattacaggttcacaccaccacccctggctagttttttgtatttttagtagagacaatgtttcgccatgttgcccacgctggtctcaaactcatgagtcaagcaatctgcccacctcagcctcccaaagtg

SEQ ID NO: 45948 - DNA, 1063 bp, Homo sapiens
cagctactcgggaggctgaggccagaggatcgctagagcccagaaattcaaaggtgcaatgagccatgatcacaccactaccctccagtctgagtgacagagcaagactctgtctcaaaaaatatatatataatataaaatgaaataaaacatgtaccatattgatagagaagagtttcattatctggcagagaaagttaggatttctttgagtatgtctgaagatatgaatagaaaaaaggagagacttccattctgcattaaagtgctacttgatatattgaaggtagatcagggtctacttatgtaaatgattcttatttctatctcattacatgatatataatatcattttgttctttgggctgtcgtcattgtacatccaaatacgaagcagtgtagctttgttttccctaaggggttttctgtatgatgtcaagtgtttatatcttcaaattatttgaagttttcttctgcagaatttaggtttctataatatatagggataaggaattgagtagttcagactccctttgaaaactgtagaaaacctttctgtcagatctttcttttttcttcatattctcattttcgccctccccaccccagctttgaagcatacataataggtgttggtttattttttcctcatggaatcatgggtagtttcattgcagctcatctctttctgtttgtttcgtatagggctgatagttcaggaccattcagaccccatgttcagttcatatgcctataagtcccactacctactgaatgaatcaaatcgtgctgagttgatgaaattacctatgattccttcttcgtcagcttccaaaaagaaatgtgagaaaggtaataatcaaaatagtttctcttgcttttatttttgcatttcctatttttttctctttcaatataggggggaaatgtatgcctgtcaagcaccatctgttgcttttggtaaattctgccttggtggttgtgactgtttcttcatatggctgcacaattattaaaaagggcttaaaataattccattgttgcacatttttacatactcttc

SEQ ID NO: 45949 - DNA, 1034 bp, Homo sapiens
tggataccaccgtctctgcagcattggaacaaataattttttctttggatgatctctacgtgactattaggcttacatttaggggccatatagcataggatgacagagccagactagggaagaaaaaaatgctttccatctactgtaactagcatctcagagggacccaaaaaagcccaactccagaaacttatttttatgtcccgctgatgccttattagattcctttttgacttgtctttaaacaggccgcatgatgagatgtttaagatgtccagttgcctatcactctggagatgcttgcattgcggccggaagcatgttagtatcctcctacattctcatctgtagtaatcattccaaacggagcagtaattcttctgctgtaaatgtaggcttttgtttcgtttgtgccagaggtgagtgtctgacttttctcttcatttatttttgaggtcattggcatatttctccattaacatagagtctcagcattgggaaagaactcaggccatctagtagaatctcctacccagtgcagaattccactgtaatatatccctgagagagatgaacatttccagtaacttttataatgctagatgtccaaagtgttagaatactaattcttccataagttaagctaaaatctgcatttctaaaaataacagaattatagttaagttcttagtttttctgtttggagcattaaaagattaatcttttcccttctgcaaacaactcttctattcaaagtagatccttcccatttcataatcttaaaccagaactttcaactgattgagatttcacttggaaggcaaaactagcacatccatttttcagttgtttatgctgtattttatcataatgttttggtctggcattgaggagggcctgatgggacacagccaaggcagcatatgtggtggtgttagttcagagccagccatgtgggctttcttgttgccagctgttgacgtttaagtacaccaagagattgatcaactaaaaacaatactgtagccctacgg

SEQ ID NO: 45950 - DNA, 1111 bp, Homo sapiens
taacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagctacacagtgtgttgggttttatgtcttccccctccaaattgaatggttctttgaattgctccaaatccatcagctatcctgcaattttcatagaattgatttttaggttggaacgtgggctctgttgactgaaaatagctttagagaggagaactgaattaaatgttttgatagagcggttgtaaattaaatcagtcactaccaggaaggtcagaagttctgaagttttgactcattatttcagtgttacaaagagagctatgctttttccacactaaagatgagtttgagaaaagaaaatattctcccacacacaaaaaaattaaaacaaacc

SEQ ID NO: 45951 - DNA, 1051 bp, Homo sapiens
ccacgtgttttacatatacattggcagaataacttctgatctcgctctcctaatgtaggatcaagacactgttcataagacactcaagaaagtgcttttgcaatatcacaaacttattttcttaagtttgtactagcagcaaaagtattgagcttccagctgtatggagccctgtagcactctctacagagagggtcctgattcccagcaacttagctgtgagtgcaggcgcggaagggtcttaaagtggcgtgagttacattaacctgagtatcatagtaagtaaaaatttatcctaacgtctttggggcgggaggggtttttagcaacattggggccggttgcagaaacaacccctctcctgccttccagacactgaggaaagtattcttgttctcttcatataccaagggaatggtgggaaaagtctttgctagagagcatgtggctgtgtgttgtcacttgatattcagcacaggcagctaggatttaaaccctccctgatcttgagacagagaactttacccaaaagatgggactgagttcagatttcagatacattaatcactcatcattgcttagattgatgaaagtatcttttccctctgttaataattaaaagggaaaaaaattctttgttaatgctgtatttttctgtccaaacaggttgaaacagttcctcaggctacagtgaagactggattacagaaaggtgagttaatattataatgttgctttgcatttccttgattaaaaccaatttttaagaattatttgtacttcatgtatttttgtctgtctctgtaaatcgttgttgctcttcagtgtgaaattgcagtattccccagtgttcgtgtgtgtgtgtgacttttagagttgatcttattctgtacctccacgtgaaaagtcttacttgttttggtaaattggagaacacaacgtagacttgatactgtttccaacttttctccataagattctggggtttcactggcttataaactagggatgtgacgaatccactttttttggtattcgactgaataccgaa

SEQ ID NO: 45952 - DNA, 1031 bp, Homo sapiens
tcatatatagtaatcactggtttccatattgttattagtcagtattttttttttcttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccattagtcagtatttttattagattcttagcactggaaaatgtacttaacagtttttcacacataaagatgtaataattatttgtaagagcatgttgaaagatgtttggatcacaattctattttaagttgtattttattatttaggactcattaaaaatttagctcttcagtcagagacagatgtgcttgtttcttgacttttcaggtctgtagcttcttatttcagtcttatttcatagttttccaggtgtcaggaaacaaagtgctaacaaataggcaaaatgtttgtcttgtttcctctctagtaaatgatttaatgggggaagaagttgaaaatacagattaaaatgaaattgtgttatctataaatttcggcttttatgttaagtcctttgggattatctgttcatatctgaagaaataactctgatgtttggaaacattatgtactatgtttttttaatctgaatacctgtacccactaccctgtccttgaaattcacttattagtttaggttatatttctatttttccccccaaaaaccctttggatttcagataaatcttctttgactaattataattagatttgtgcttgggtctttattctcagatgagatgatatgaaaatctgagtccactgttgcctttttcttcctaattactttgggttctctga

SEQ ID NO: 45953 - DNA, 1048 bp, Homo sapiens
cgaggcgggcggatcacaaggtcaagagatcgagacctcctggccaacatggtgaaaccccatctctactaaaaatacaaccaggcgtggtggcgcgtgcctgtaataccagctacttgggaggctgaggcaggagaatcgcttgaacctgggaggcagaggttgtagtgagccgagatcatgccactgtactccagcctggcaacagagcaagactctgtctcaaaaaaaaaaagtactaggctaaaatttgtaaaggaatatttaggataatgtaatttattttagctactcttaacataatttttaggtgttcttatgtggagtcaattaaaaatgtaaaaaagtggtatatacccacaaaatcataattttaaaattaagatgaattgaacattaaggagagctaactcactgtcatctttttctctgatgttttctctttctgacaaagcagtggaattagtacccaaagagggtatctctgtccctacttaattttaatgtcttaaacttgtctctgtctctgaatgcctaccaggtatatctgttttgctcacgtacattttataatagatactccctctctattattgcagcatccttacttgaattctttttcttctcttacttatatagtcttgaaagcttagaataaatcctcttgggcatccttcgctccctagccacttatttcttttaaaatgactgtgtaaaaaactttaattctttgaaagtgattttgatggtgtttcaaaccagcctgaaggaaacaccaacaatctggaacaaatcaaaaaattaaaaaagataagacatttgaattataagatttggaaggaagtccttttttttttgtttttttggagacagggtctcactctgtcacccaggctggagtgcagtgacgtgatcatagctcacacagcctcaaactcctgggctcaaacaatcctcccaccttagcctcccgagtagctgggagtatataggtacacatcactacgcctggctctttttttatagagatggggtctcgccatgttgc

SEQ ID NO: 45954 - DNA, 1057 bp, Homo sapiens
caatgatctaagacttaaaggtatgacaatgaatgaaaagtagagatgcctgctctcaggatgcttatattctagtgaggggagccagaaaatacacacacatatacatatatatatacacatatatacatatatacaatatatatttatatatacatatatatacatatatacatatactatatatactatatacatgtgtatatacatatatacatatacatatactatatatactatatactatatatgtatatatacatagtcttcatagcatctaaagctaacttatgtacacacatatacatatgcatatatacataatacataggtatgtatatacatatatgtatatatacatatatacatacatatgcatacatatatgtatatgtgtgtacataagttctcatagctttagatgctatgaagacaataaaactgggtaatgagataaagagtaatcagtgatgtttctagtagtcattttgcaatgagattctaaaaccagttctgtctctgttagatgtctgctatacctagttctttatatcacctaaaccttcagttaactattatagctcaggattagaatgtttagattttattttattttattgtttttgagacggagtttcactcttattgtccatgctggagtgcagtggtgcaatcttggctcaccgcaacctccgcctccagggttcaagcaattctcctgcctcagcctcccgagtagctggggactacaggcataccaccacgcctggctaatttttttttttttttcaagtagagacagggtcatgttagtcaggctggtctcaaactcccgacctcaggtgatccacctgccttggcctctcaaagtgccgggattacaggcgtgagccactgcgcctggcccagatgtttagattttaatttaagggttttaattcattttcccttttattgaatcatgatgagcaaaatttactatttgattgtttaggatcttacaatagcttgggataaaggaatatcaacttgaccaaaagtatagctggagaaagtg

SEQ ID NO: 45955 - DNA, 1050 bp, Homo sapiens
gttaacagaatttttaaacatttccttcttatgtctgttgctgtgagctatacatttttgccaaaagttaaattaaggtaatgtttcagttgttaaacattgtcagtaaatatggtatgctaatcaagagcacagaccctggaactgcggtttttttgcagtgagccaagatcgtgccactgcactccagcctgggtgaatcttgggttgaatcttagccatgtgcacttgagcaagtcatttaacttctctgtgcctctatttccctatgtataataggagataatagctacatgaatgttgttgggaggattaaacgtagtacttatgtcaagcacttagaatggtgcctggcatatgcaaagtgctatgtaagtgttaatggtggttattagaatatttgtgattttggtagtgacgaaggaataaagtacctgaacaaaagaattcttttcccagaactgatagctgagggaaacagaagtgatacagtagtaaaaatcatggacatcaggagctcgagatcagcctgggcaacatagtgaaactccatctctataaaaaatacaaaaaattagccaggtgtggcgcatgcctgtagtcccagctacttgggagcctgaggtgagagaatcatctgaacccaggaagtcaaggctgcggtgagctgtgattgtgtgtttctgcactccagcctgggcaacagagtgagaccctatctcaaaacaaacaaacaaacaaacaaacaaaaacaacatggacttcagagtcagacatgcctagatccaaattcaagttctcccactttgtggtttaagcaggccacctagcccctctgaagctcactttcttttacctatgaaccagaaatcacaatccctatcttgcagagttgtgattattaaatgagctgatgtgtaaagtgcctgacactgaggtgacactaagaaaatgagagcgctctggatccctcccaccccccaccaatgtaaagcaatacatacagttcaatttcttgtgtgcagtcttattcatttgtttgtaatttta

SEQ ID NO: 45956 - DNA, 1065 bp, Homo sapiens
tgatttcttttcctgtttttgtttttttcaactctgtatctgtgatttggcttaaggattctataaacttttctattatcagcccaccatcccccaccaccatgaataagttggtaaataataagagcactaaagctttgattgataattttcaacttttttttgcttatttaaaactgtatagtttcagcaaaattagaagtattcattgattgatttatcttttttaaaaaattagcctagaaacattgttcagaggatgaatttatcagaaatgtttttgtgtggtgatttcatttacttgaaagtacatattagaatggatagattagtacaattatttagtctcccaccaaattgttagttaactctggggagtgggagtggagaagggtgaagtgaggttctgttgttgtttacatatttagggattgtgggaagtaagcttacttgttaagagccaatgctgtggaacagagtgtgtgtttgaaccctccatttacttgatctcagactatggcaagttatttgatcatactggccttgatttttcatttgtaaaatgggatagtaatagtatttcctcaaaggggtgttctgtgaagtaaaataatataacaaatgtaaaatgtttagaatagtattgacactaagctctcaaatgttagccattaaaattattgctttaaaaataaattgaacacattatctttatcagggatttatttaggacaaaggtttaagaatttctgatggcctgtaccaagtaatttgaaaagcaatgtgtgaagaacaccttacttccacatcctacttgtttctcatggcctaaatgcctccttgcccagcatttttcttctccttagatgtctgttataattgtagtagtaacacaattcaattcttagtcatcttctgtttcacattgtttgctactattttatgtgtcttactcacaaaatcttacattatcttgctaaagagattgaaagtacctttaggtcagtgatttttttttttttttaactttttagcagttctgtatgcccagcattgcaatgaatg

SEQ ID NO: 45957 - DNA, 1039 bp, Homo sapiens
ataggcatgagccaccacacctggccaaaagttagtattttaaccacatatatatatatattcttttcagaatgaaaactcaagccctacacttatgtattgataataggaggaatcacagctcattttcccatttttcgtggtcattttatatatgtggatcacctgatccaacctttcttatgatgttaaatgaaaacccaaagatactgtctgtcctcggaatttatgcagctaagttaggggtagaagcagaactaaaattcaagtcttatgactctaagaccaatgttagagtacatccttctactctgtggacattttgcttgtccctaggtatatgagtttgtcttactctggcatagagatctatttgctgaacttcctcttatgtgacttctttctagcatcacagtaatattaacagatttctttaaaaatttataattcttatttaatataagcttttaaaggatgtttttgttaaggtaaaatttgaaaaataatgtagatcagcactgtctaatagaattttctatgatgacagaaatattctgtatctgcactgaccaatatggtaaccttagccacatgttgatgttgaatgcttgaaatatggccattgtaactgaggaactaaatttttaatgtaatttaattttaacttgtttaaatttaaatagctacgtgtggttagcccagaattagctattcttagtgaagggaaagaattaagtagatataggctgggcacgttggctcacacctgtaatcccagcactttgggaggccgaggtgggcagatcatgaggtcaagagatcaagaccatcctggccaacatggtgaaaccccgtctctactaaaaattcaaaaattagccaggtgtggtggcgggcgcctgtagtcccagctactcacgaggctgaggcagagaattgcttgaacccaggaggcaaaggttgcagtgagctgagatcataccattgcactccagcctggcgacgacagagactctatctcaaaaaaaaaaaaaaaaga

SEQ ID NO: 45958 - DNA, 1029 bp, Homo sapiens
aggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttcctt

SEQ ID NO: 45959 - DNA, 1097 bp, Homo sapiens
accgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaacccc

SEQ ID NO: 45960 - DNA, 1941 bp, Homo sapiens
gtgcgtgtgtgtatgcgtgtgcatgtgtgtgtctgcagcccccgccatccctcctgtgttcaccttctggctatctttacctgaaaccaaacagcccctgcccgccggccccatttctccatgccgctcaccgcccgcatgctcggatgggccagtggctgccagcatctggtgaagggtcgtaaccagccatcgtcttctcaggtctgccggagttcttccctcagggtctcaccctcttcctctaacaggttttgctgcctggtggttttcgtttgttccttgttgcaaagaagatgtcagggagcatttcttcctctagtcccccttctttctgtctccttcccttgctctgcgtctcttagaggtctcatgtcctgtgcttgtccattttgcttccgttgtctcttctagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaaggtacacactgtaacttctcctctcgatgtcctgccctcgccacgggcacggggggagcatgcatttccaggcttggggagacacagaggcaggagagctggaagaatgggctcctgcctgcctggtgccacatcctgccccagctttgagggctgaatcctctcagctcagagaagagcttccctagttttgcaggcgcacggaggcctcccacccgtacacctgcctctgctctccccctggccattgcaatgcatgcccgggatctgggtttaccctgcagcccgactcctccagggcaggctccttccgtccttgggtccagcagcctcccccctccgctgggtactgagcatctgaaaagtctcagatagggccctacacctcttctcccttctcaagtgctcagcccaggggtggggcttgctgcttgcaaagagcagcccaccctcctgtactgccatcctattgcctttgaagaaggaggtcagcctggacaggtgaactgagttgccttcagaaaggcctgtctcaggcagccgcagcaggcttcacgatgtccatgtatcctgtttgcctgctgccgtctctcctctcccaagaggggaggtctgcgtgttgagccagggaggaaggagcctgcagcctgctcagggtggtggctggtgactgcggggccagggcttgctgctgtctctcggaatgtcctgcatgtgggtctggctgttcctgctggcactgccctcttctctctcccctcctttcccactctgccctgcttgcccgtcagggtctccggatgcccctgctggaggcagagaagcgttctgtttttatcatcgtccctgtcttggtcctgtccgtgctccccatgtgctcccaatcagttgtcttcgttcctcaacatcagggaaagaaaaaacagcaacacttctccctgtcatcagctctgctgtctccttgtcaggccttgggacgttctctgggctcagtctagggtcgtgcctcatgcctcatgcctctctgggaaggttcccaggggcgccgcctccatggttggctggtgggttttaaaggggaaggttgggaggaggcctgtggaaggaggagggccgtccacacccgtggggcaaagcgtgttccatgaaaccagtgctgtgcgtgctgggatgaaagcctcccagcctctcgtgctgaagggaaaggtggaccgaactggcttagctgctgtggcaatggggtggggggtgagtcctaatcagaaggtgggagaagagaataacaaaatggaactccgccccctgccgccacatttccttaagttttaggagttggggcctatgagtagaatttgaaagaactaccaaaaaagcttatttttg

SEQ ID NO: 45961 - DNA, 1063 bp, Homo sapiens
agtatctctgtcagtttcttttcatcagcccttttttttccttcattcacttactcattcatccagttaacaaacatgttggcatctcctgtgtacatgctaggtgccgagggtgttagcaaaggttagggaggcacagaccctgttctgaaggagcctgcagtttcgtggggagagaagagaatgaagaacataaataacaatcatataatatgacctaagtgctatgtgagaggggctagtaatgtggtttgcaaatttggaggaatgaaattctccagctagaaggcccaagaaagtcttatggaagaaacagcttcttaaggtggggttcagagaaaagggaagggctggcctgttgcagaacaaggaatggcatgaagaaagtcttgcacagaggcatggatgttgcttcgagctgtggcgccctatagaaatagaacatgagcagctggtcacagtggctcatgcctgtaatcccagcactttgggaggccaaggcaggcggattgcttgagcccatgagatggagatgagcctggacaacatggtgagaccctgtgtctaccaaaaaatacacaaattagatgagtatgctcgtgcttactggtagtcccggctattcaggaggctgaggtgggaggatcacttgagcctaggaggcagaggctgcaataagctgtgattgcaccactgcattccagcctgggggacagaggaagaccctgtttaaaaaaaaaaaaaaaaaaaaagccaggcacagtggctcatgcctgtaatcccagccctttgggaggccaaggcaggtggatcacctgaggtcaggagttcaagaccagcctggccaacatggtgaaaccctatttctactaaaaataaaaaaattagccgggcttggtggctcatgtctgtaatcccagctacttgggaggcaggagaatcgtttgaacccgggaggcggtggttgagccaagattgcgccactgcaactccagcctgagtgacagagcaagactccatctcaaagaaaaaaagaaaggaagaaagaaatataacattataa

SEQ ID NO: 45962 - DNA, 1030 bp, Homo sapiens
ccaagctcagctcaaatttcacctcagtgttctctgtcacatcatcctattttgtctctacctagcagttaacccccattatattcccatctttttatcatatcaatctatcaatcaatcagtctatccatccatccattcatctatccatctatcatctatctcttcttttacaaatagagtaaaagctgcagaggtgtatggcttttctgggtcttgttcacagctgcatctccagggtttagaagggaccagcacacagagggcaggcactgcactctaatgttgggaagagacagccagagagaggggatgttattataaggtgggaaatgccttgttaagaaaaagcagagagtgctatgggaatataaaagaggggctaccaacctcacctgtgaggagaacttgaagagctggtacttgacttgagttgttgaagaatggacagatatacaggaagagtaaagaggttggttcaggaccataagtaaaggctgatttatatgtttaagacggacacttgcatgatatcttcagggaactacaaatctttaaaatagtactagaaaaaaccctggaatgcagagaggaaagacataagcctgagacattagcaggaggtaggagctagagtaggagtaggagctagattaagaacctaaatggtattttaaattaactattatattctttttatggctgaagagtattctattgtgtatatataccatatattcattggtcaatggacatttaggttgattccatatcattgctattgtaaatagtgttgcaataaacatgagagtgcaggtatccttttgaaatatacatttcttttcctttgggtgaaacttgaggtcattatgttaagtgagatcagacaggcacagaaatactgatgcctcatgttctcactcatgtatgggagctaaaaaaaattgatctcatggaggtagagggtagaatgataggtatcagtgtctgagaagagtttgtaggtgggagtgggggttaaagagagttg

SEQ ID NO: 45963 - DNA, 1079 bp, Homo sapiens
ctcataattcctgccttgtgtccctgagatcggatttcttacagaattcttatctggaaaagcgtaaagataggtgatgtgagtccattcggaggcatcccagtccatgttttcattaatcgaacatggtaaagtacacggaagggtcttgttcctgccctgtcaaagtaagctgcacacatgtgggaggacacatgcaagtcggagggaatcatgcctcacgacagggtcattctcagggtattgcaattgtggatgaagatggaagctggatgtagatggccaccagagctaaactggagagcgcgtatcctgtttccatgcatggggaagattgatgtgttctctgtgatgcagcagtgtgagttacttgtctgtttctgcattaactcaaattcatcagtgaggattccctgtatacctagtgctttctgagttctatagatacagattgagggtggaactcttcctctaaataaatgtaatacatgagtattgttttttaaaaaagacagaagttggaggattcagaccctttgccacataggctgaagaggcaagcctgggaaagaatttgaatctggcaaggttgaccttaaggtgtagggcaggggtctagagggcactcaggtaactcatctgggatggacatcttcttcccacggcagcaggcacctgccaaatcagccagcgttctgtacacagaagaggacagaggatctcatgtcgataaccagtcacggtttgtggaatctgagtgattagctgtttgggattgggttcctttagccctgacaatattttcctcttgggttcacagaacttttgggttcctcctggacctcagaggtcatcttatccagtcctcttatttgataaagaaggaatttgactttctcaactggagtccttttacactctgccacctgccctcctcacttaagagttgatgcacagccgctgggctctgccacggaggcgctgacctccttagtgtgcgtatggtgtatggcaggcttctttgagctggttgcaggagaaacctttttgtttttttgtctgtaatgttctcataaaac

SEQ ID NO: 45964 - DNA, 1033 bp, Homo sapiens
atgactttgggtgactttcctctgctagttatggcaaagcaatttgcctaatctgtgaatgggctaatgcactcccactcccaggtagaatacttgtgtttgaacaagaacctcctgaaaatgatgccctgacacaatgggagagctggaattcgaggaacgcagggtggggctgcggagatatttggggacgtgagtcagggaccccgcacatcagacctgcagaaaccaagccctccgtctaggtggtgaggatctgtttcatgaactggagcctgaagtggctctgaggcctcccctggaaaggaacgcaatagaacagaattaatcaaaacgggaggccaggaggaggaggacaggaggggaaaattgctggcggggaaggaggaggacaggaacaaaataaaaaagcaggaggtggagtttgctcactgactaaaatcattttctgtacggagccaagatcgactcatccgttggaattgatattttgctccttcatattgtcagacttatttgtggctccgagtagcactccttgatgtcagcttttgccggaaagtttcaagacctttcagggcaaggatcagaagagcaggaagcatgagagtgatgaataaaacttgaacttggctgccttccataaagcacagtggcagcttcaccagatgcagctggaactttaattggttaaattttaattggctctgctcttgtgggctaagggttgggcaaggaaaatgtgttttgtttgtttgtttgtttgttttttgcttttcctaaagcttaactgtcaggcagccttctttggtcacctttgaaatggtgggatggcaaaggggctattttatgttttacattttatttttatttttgagacagggtctggccctgtcacccagtagcaggatctcagctcactgtagcctcaaactcctgggctcaggtgattctcccacctcagccccctgagtagctgggactataggcacacactaccacacctgtctacttctgtgggcttttttttttc

SEQ ID NO: 45965 - DNA, 1050 bp, Homo sapiens
gcagggatggaggaggttggctgggaggcagagcgaggaagcagcatttctgcaggcctggggttgtgggtgggggctgggaggtggtgtggggcagcacctgagtgtggagggaggaccccctgtctggaaggctggagaaccctactgctgatgccctagggactccctgtttcagtggtgaagacgtgaagcgctgctttgtggaggaggatgagagttccatttggtcttcggctgtagatttggagtcttctgtgttcaagggtgttcaagggtggtcatcactagtgtgtgcatgagtttcccatggttgctgtaacaaatcgccacacacttagtggcttgacactacggaaatgtgttctctcgctgtctggaggctggagatctaaattaaggcctccacagggacacactccctccagggcttcagggccttcttctatgagcctccacctcccagaggttccttgcttccttgtgcatggctaaagtcactccagtctctggctctgtcttcacatagtttcacctctgtgtgtgtgtatacgtgtgtgtgaacatgtgtgtgtgtgtgtgtgcacacaggtctctgtatgtgcatgtgtatgtgtgcaggtgtgtgtatctgtgcatgtgtgtgcgtgtgtgtgtatgcatctcttggtgtgcatgtgtgtgcacacacgtctgtgtatgggtgtgtatgtgtagatttgtgtgcacacatctgtgtgtgtgtgtgtgaatctgtgtgtgtgcgcatgcatctgtgtgtgcatgtgtgcatacacatatatgtgcatgcatgtgtgtgtgtgtgtgtgtgcatgtgtgtcttctccttttctgtcttttctaaggacacttgtcattgaatttagggccagcctaggtaatctaggatgatctcgtctcaagatccatgacttaattacatctacaaagacttttttttcaaataaggtcaccttcacaggttccagggataagagtgtggacatatcttttggggggcaccattcagcccactgcagcatgtttttt

SEQ ID NO: 45966 - DNA, 1050 bp, Homo sapiens
gccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaac

SEQ ID NO: 45967 - DNA, 1084 bp, Homo sapiens
tacaattttaataggattatgtgaaaatgaaggcattcttttgtacttctcagttcagatacagcagttgccatctagtggtccaaataaagcatgcaaggcttgttttccccaggacgttgaacgaaactgttaacagtcctgatttttaacacttcgaatattttaacaaggtgattgatattaactgtagacataataatactaacttagtcttcaatatatataaattatgtattctttctgcagatttgttttgaagtagttttgcaatttgtttctctctttttttttttggaaggaatttacctttggagttattcttggttgtagaagaggggattgttattttggtgaatccagtttttcagagttgctgacctagttctgatttgagttatttgtgattctttaggttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccagtgagtatcacatctttttgtatacctttgaaagataattaggttgaagttttttggatcagccagtcagattattgatgaaagggcattaactaatataaatgatatacttggtgataatgagatatcattttcctttctaggatattttatttgattgactatatatatggtctatatatagtctatatatatgctttttaaactgaattgtttttctgatacccctaatttttggacctaagctactgaatctttcatcttctagtattgggagctctttcacaatacaagaagtaaccactctagaaacagtcattaaataaaatgcccatgttaaattttcatataaatggcacaaagtaaatatagattgaaaggaagaacagacagttcacccttcactaaagtggtcagaaaaaggtcacaaagaaagg

SEQ ID NO: 45968 - DNA, 1023 bp, Homo sapiens
atttaatccacccccttgctaccccctgttagttatcttagattaaaaggtcaattctagcctggaacatacgtcttcttttaaataatttggcatatttaaattaggaggacatgaagtggcagaatttgagttaaacatttaaatatattttgtgcccttgattatattagacacctgctgctttggaaagtcacatgtttagcgaaaacgtactttggttgaaatgttaaaataaaaagacctagcaaaggtaaccttgtagttcagatatgacagtttgattttggctaggactggaatgagtggtttctgtgtagccatttcttcctccctgtgtagagagccttgctgatttctaaatcttcgtaaaaggaaacacccttgctgtggaggcttgctcaggggagctgggagtggaggcgggctcacacatgagcgcatgtgcaggaacgtttcacggtgcaaaggttaaaggcgggtgtgggcagaggggaacctaccacaggtcccattctggacagacgtgcgcagttgtggtgatgtgcaaacagctgtactggaactggatatccactttcacatcgggcatccgcctagaagagcagcgggcagctgatgggaagaccctcaaacaacagacagtgccgcagcaggtgcatgacttcagcttttgggctttctatctgatccttgcctcaggaagttagatctggtttctggtatttagttattttgaaagtttcctatactgttgttattactttgagttgtgaagatagatgaaaagatagtactttatgagttagagtagttgattctagaatgtagtttaaaaacagcctttaaaaaatctttttacaaagttctgtttgggttttgagaaatgaaagaaatcttattttaaccctgtattatgtattcttcattgtttttggttttgtatttggaggagccccagtacttggtggtgttataacacaattcatcccacaaacagatctttgtcttttgttttgaggt

SEQ ID NO: 45969 - DNA, 1040 bp, Homo sapiens
cagagatgatttttgcctgaatcatttactttgttggtggccaaacattattttctaattctatcatttctttgccatttattaattggcattctattgtaaggagaagctttttcttcttcctatttgtttattcattttgtttaaactcatagattattttatggttataatccattgctattagtatttattttgatgcttaaattgttccaaatttaggcagaggggaactcctttctagaagctcctctgtccttttaacacatcatcatcatttttatttacttctggccacagcaagatgttctaggctcttactgttgtagccatagattctggcttttagtggtgaacaagagtaaatggtagctctatcctgtacttgcttaggcccacagagatgtcatcttgattttttttttctctgtcatacttcacattcagtccatcagcaaatcctaatggttctgccttcagaatatgtctgtatttgctactgccaacccactgtcatctctggcttaggctgctataattgcctccagactaaacttgcttctgcttttgccaccaccccactctctagtctattttcttcatacagcggccagggtaattatttttgaacgtaggttggattataccacttccttgcttagaaaacctttcatgtcttacagtcttctttagaattaaaaaaaaaaaaaaagagtctgttctctcatctccaaggctgtatatgattttgtgcctgcctccctctttggctgctctttttgctctcaggctactccagccacagccgcctcctcttcctcagacacaccaagcatgcctgccttgggcctttgcagtcgctgcaccttgcctcgatggcccttcctctagagtcgatgatttagtaggttcactgcccattccatttaggtcttgctcatatccacacgaaaatagcttacagcccattgtgtcactctatcccctgacctgcctgctttttctgcatagtacctaccacctcttgaatttaaattttt

SEQ ID NO: 45970 - DNA, 1027 bp, Homo sapiens
ggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacaggtaagagtttagaacagacttagaaacaaatagtattctgtacatgtattattcgggataacactaattatctataatggatttatatttgattattaacaattggttatagaatataagaacacattgaaaaaacatgtagatgatactgaggtgataactgtggcaggaatttagaggatggaaataaagttgcagaatgggacagtaggaactcttaggcaaaaggaagctgcttttttgtagaaccacaaagaatctgcctagagaaacttggggtgtaaccttgaggattactttacatttcacaaattactaaagaaatcatatggtgaatgttatgatgcctgcttattccaggaaggaaactggaaagaatagaactgggtgaaatgctgttgatctaagcataaaaaaaagaccaaaatatttgcagatgtgatgaggtcattgacttttctacttcagatcttgacaaatatagttgtaagtcatggattgcacttaaaaagggagagacagaaccacagctccaggctgcttatgtatcaggctaagttccctaattttcaaagtagaaaacatctgtggagaggacttaataatgtggcaaatcattcaagtcagaggagaagaatttgattaactgtccaataaattaaagcttaaaatagtcttattgctgagccttgaatttagagatactaaccctgt

SEQ ID NO: 45971 - DNA, 1049 bp, Homo sapiens
gaatatctcttctatttttcctataaccaccttagtgcatttcagattcaaatcttatggtgaacccaatatagttttagccctacctcactggttttcatgctcattaatagtttgggaatgagagtgacctggagttataatttttaaatgcttttaacaatatagtttggcatattgtaaaacaaatcatggtgtactgattagcagtgctatttgaccaataaattaaagaaaactgatagactgtgtcttaacctagatgatttatttaaaccatttgttgctgtagctcatcagctgaaatgacttaaacccccaaggtactgttactctttcccaaattgcacttaaaaaacaaactgaaattatcacttagttaaaatgtcatgatcattgtcagtaatagtatatctctgtggattcactttggtttggtagctgaaaagtttattatttttatgcttggccaaagaatatgcatcttcagtggggagcatgccatgtgtgactgaaaactgtttttatacagcttgactctgtttggaataacgcctttatttggcttaacaaattgcttttcagctttattttcacactgtaaatatcaatattgtataaacttgtcattattgggactaatcagcaaattgttttgtgtcatgagtaagcacggtctaagactgggattatttgataagtgctagaataatttggttaaactgtctatccagctctaagtaacaacacagccagttggtctgaatcactgtgcctcaacccttcactttgatgaataggtttgaatggctgaagctaatttggtttggggtagacaaagtctagtaatgtgaaactgatcatatataaaagaagtgttaacagtagtaatattacagggaatatacagggacatagagggacaattttgctagcggtttcttagttatgattttgaataccattttttttgcagttagaaactttactgtcttgttctggatgataaagacacatgtttgaagacaggtttcctatgctgaagaata

SEQ ID NO: 45972 - DNA, 1035 bp, Homo sapiens
ttacttagttacagagacactaatgtgctgtgttaaaataaaaggtcttattagttacatttaggaacctgctttggttccatatttttgtctatcttttcccctttcttaataattctctgggagtggaaaaagggagtaaagattgatttctttttgctatgaataatgctgttctttgaggaaggcagcagagaacctctggtcagtatttgttttaaatatccaagtttaaaccattctacactatattatgttagtatcactatttaccaataatagaaaccgagcattttctacctgtaaagcctccttcctcctccttccttccctccttcctctccctccctcacgttttatctatagattgttcacttgagcaactgagttgaaaactgcataatgtatttagagttatgaacttggagtcagaatatctacctgactttgaatgtcacttttgtcactttactagtcatgtgcaccgtttgacagtgattttttttctttgtttaactgaggagcgtataatgatttttgcagatccctttcagttccaaacatcatgattctgatagcagaaccttgcattctatcagatatgtatcagttattgttcttcataggtcttgaagaaaatgatgctatatgccgatttgttcacgtgttcttaaacctttggccgaaataaatgcctacaataacaatattttaaaaatttaatgaacatgaaagtcttgttgaacatcttcttctaaaacatcacttttttttcttttttttttcttctgtttttttgagatggagtcttgctctgttgcccaggctggagtgcaatggtgtgatctcggctcactgcaacctctgcttcctgggttcaagtgattctcctgcctcagcctctagagtagctgggattacaggcgcttgccaccacaccccgctaatttttgtatttttggtagagacgaggcttcaccaggttggccaggcaggtctcaaagtcctgacctcagatgatgcacccgcatcagc

SEQ ID NO: 45973 - DNA, 1093 bp, Homo sapiens
atgtagctatttaaatttaaattaattaaagttaaagtaatgataaccactagcacatttcaagtacccactagctcacatgtggctagtggttacagtattggacaacagagatatagaacatttcatcatcccagaaagttctactagatggcactgttcttgagaacagtgttaaaaaaatgtcactcgaggggccaggcgcagtgtctcatgcctgtaatcccagcactttggaaggccaaggcagaggcaggcggatcacttgaggtcaggagttcgagaccagcctgggcaacgtgaaaccccgtctctactcaaaaaatatataaaacttagctgggtgtggtggtgcacgcctgtaatcccagctacttgggaggatgaggcaggagaatcgcttgaacccaggaggcagaggttgcagtgagccaagattgtgccactgcactccagcctgggcgacagagtgagaccctgtctcaaaaaaagaaaatattacttaaggatagggtttcagtttttaggctctaggatttttggagttgaaaatgttagctttggattatcctaatgaggggagctttgtgagttactgtctgtggatcaagcctgtcatgttcacactctgcctaatcttttactagtctctctggctctgtatatatcagccatacttggctgagggttttttttggggggttaagtagtacagaatttgcaaatgtttgttttatgtagttaaagccttgatgcttagtatcttttccttatcaataaaatgaagtaatgagatactgactatatggaatttgaattaattgattgggattatgaagttaacaataaaaattttttttttttttttttttttttttgagacggagtctcgctctgtcgcccaggctggagtacagtggcacgatctcagctcactgcaagctccgcctccctggttcacgccattctcctgcctcagcctcctgagtagctgggactacaggcgcccgccatcacacccggctaattttttgtatttttagtagagacggggtttcaccatgttagtcagggtgttctcaatctcctgacc

SEQ ID NO: 45974 - DNA, 1056 bp, Homo sapiens
gggtttggtggcatgcgcggctgagacaggagaatcgcttgaacccgggaggcggaggttgcagtgagccaagatcgcgccactgcactccagcctggcaacagagcgagactccatctaaaaaaaaaaaaaaagaaagaaagaaaaatgacagagccacctccctctgtattgctatatttatttatctataaatttacatgcaataatgcattcttttctgtgtctacttttatgagttttgataaatggatagagttatataaccaatcaccacaatcaagatataggaaagatccattatccactaaaaaaaaaaaaaaacttgacttttgtagtcatcaccctcccccaaccctggcaaaccactgagctattattctccctataatattacattttccagactgtcatataaatggaatcaagtatagttttttaagtttggcttatttcatttggcatcatgcatttgggattcatccatgtagttgtcaatagtttgttcctttttgttgctgagtagtactccatggtgtggtaggtacaccatagtttgtttatctcttcccctattgagggacatttggtttcagtttttggcaattatgaataagctttctataaacattcatatataggtttttgtgtgaatatagtacagtagtttcctgtggctgctgtaaaaaattgcgaaactggatagctttaaaacagcagaaatttattccctcactatcctgagggtcggaagtctgaaattagtatttctggactgaactcaaagtgttggcagggacacattgcccctgcaggcattctgagcttctggtggctcttggcatttcttggcttgtggtcagcagcagcatcactcccatctctgcctcttcacatcatgtcttctcctttgtgtgtgtgtcacctgttcctctgcttctctagggacacttgtcacaacatgtatggcctgcttagataatccaggataacccccccatctcaaaattcttaatttaatcacacttgtgaagacccttttcccaaataaaatta

SEQ ID NO: 45975 - DNA, 1935 bp, Homo sapiens
tcttagaccaaaatggaataaaactagatatccagaagaagaggaactttggaaactatataaatacaaggaaattaaacagcatgctcccgaacaatcactgggtcaatgaagatactaagaatgaaataaaaaaaatttcttacaacaaatgggatatagcaaaagcagagttaagagggaagtttacagccaataagtgcctccattaaaaaagtagaaagatatcacataaactacctaatgctgcacctcagggaactagaaaagttaagaacaaactaaatcctcaaattagtagaaagaaagaaataataaaggcaggagcagaaataaaatagaaactgaaaaaatacaaagaatcaacaaaatgaaaagttttttaaaaagacaaaattgataaactgctagcgaggcaaaccaagaaaaaagagagaagacccaaataaattagaaatgaaaaaggagacattacaactgataccacagaagtacaaaggatcgtcagcaactattatgaacaactgtatgctaacaaattggaaaaccagaggaaatggatacattactggacacgtacaacctaccaaaattgaatcaggaagaaacaatacctgaacacccaataatgagtaacacaattgaatcagaaataaaaagtttccaaaaagagaaaagcctaggaccagatggctttcctctcaattctacctgctgaattttaccaaacttaagaagaagaactaacaccagtttttctcaaactattccaaaaaattaaagaggagggaattcttcctaactcactctacaaggccagcattatcccaataccaaatccagataagaatacaacaacaacaacaaaagaaaactacaggccaatagtcctgatgaacatacatgcaaaaatcctcaacaaaatactgatagacaatccaaacaatccagcaacaatcaaaaagataacacaccatgattaattggggtttatcctagggatgcatattcaaatatgttcatgttcaacctatgcaaatcaataaatgtgatacattgcatcaatagagtggacaaatatcttgataatttcaatagatgcagaaaaagcatttgataaaattcaacatcttttcatgataaaacctctcaacaaattaggcataaaaggagcatacttcaacattaataagggccatccatgacaaacccacagctaacgttatactaagtggggaaaagctgaaagccttttctctaagaattggaataaggcaaggttacccactctcacaactcgtattcagcgtagtactggaaatcccaaccggagcattcaggcaagagaaagaaaaaaaaggcatccagattggaaaagaggaagtcagattgtccctctttgcagacaacatgatctcatatgtagaaaaacatgaaggctctacaaaaaaacttttagaactgataacacaaattcaataaagttgcaggatacaaaatcaacatacaaaaatcagtagtgtttccatacaccaataacaaaagaatggaaaaataaagcaatcccacttacaaagctaccaagacaatcacacaaaacctagttataaatttaaccaaggaggtggaagacctctataagggaaactgtaacagtgattaaaaaaaaattggaggacacaaacaaatgggaagacatcccctgttcatggattggaagaattactgttgttgaaatgaccatattacccaaagcaatctacagattaaatgtaatccccataaaaataccatcaacattgttcacagaaatagaaaaaacaatcctaaaatttttacggaaccacaaaagaccctgagtagccaaagcaatcctgatcaaaaagaacaaagctgggggcatcacactacttgacttgaaaatatattacaaag

SEQ ID NO: 45976 - DNA, 1052 bp, Homo sapiens
cggctgtcatttcttacagtggtaagagccattgccatcgattctgatgcttaaaatggaaactttggtgtcatcttccatacctcacttgtctgtcttttggattcagttctattccatcccatgtcttctctcttacactttttaacatctcttatttaacctcttctgtattcgaggtcctctgttagagcaggtcctcatcatttctctcctgattaccttagtagtttcttcattgattttccttcctccagtatcatcttcgtctagtccacattattgccaaaatgatcttactaagaaatgattaagaacacaagcgcaaagaccagaccatctgggctttctatcccacactgggactacttgctttatgaccttgggtaatttgcttaaccattctttgccacattttcttctataaaatggggataatacagtgcttatctcatagtgaagttgtgagaatttaatgagttaatatacatctgggctgacagaactttgtgcaatgatggaaatgttctatatctgtactgccctctgtgatagccagagccatgtgtagctattgagctcttgcaatatggccagttgagtgaggagctgaattttaaattttatttagttataatttaattgaaatagccacatgtggctagtagctgctataatggacagtacagaatatgtaaagtccttagaaatagtgtttagcacataagtgctccataaatgttaactgttattaccatctttctaaaattaaacttctctgcttaaaatccttcagtaccaaattctgcgatatagtatatatgagttgtaacccattcccgtgcgttgctccaaacttgtcaattgccacttcttcataatgccctctgtgttccactgtaccagttctcaaagtgtggatgtagaggacagcaccagcaatagtatcccccaaaaacttgtttaaaatgcagattcttgagccatatttcaggcctattcaatcagaaactgaatttggggctttgcaacccgtatgttagtaagtcctc

SEQ ID NO: 45977 - DNA, 1028 bp, Homo sapiens
aaatttgagagccaaagaggttgaagtgtcttgtccagtgccacacagccagttaataccatctggaagaattggtcaggcccttctcaattttgtgcttttttcattatgctgtagtactgctttatagtattagagagcagtgagcctaaaataatttagttagaattctcttccttaatggaaaccatagaataaaccttgtctagagaatattggtggtatcgtaaaccacaaatatataaatctgctatttcagtgtgtgaaaatagctatacactcttgttagagttttgaaacaactttttgggaaaagactgctttcttatggcccaagttagaggaatcaaggttttcttatgttgttggctaaatattagaaggggaacatgttgagctaccttaatgctggaagaaaaagtactccttgagttttgggaaaaaaagtccatttaaaggtaagtctaattttcagtaggtctgcaacacaaatgacctctgagtgacttggatcattggttagaatttaaaattcttgagactgagctagagatagcaaggtacaaacctttctattaattaatgaagtaatttttaccaaagacattaaatatgggtggaccaaaagtgtatagtctagcacttctataaacatagtgtctgggaggagcttgagagatttgtaatgttacttgtaaacagaccgtgtggggaagaccgcagacagcacatcattttttgtctttattggtctttatgactaacacttcatctctgcatcacttctgctttgctgtaaaacttagcaagtacattaggatagtggcaaataaagattaagattgaggacagatgtttgtaaaataactgggcgattttaagattataggtgtaacttgttaagaagaagataactggtgtggaaataaaatctggcagccaaaaaaaaaaaaaaagctttcaatgtgttaaagaagatagttgcttcttttgccgtttaccttttatgtagaataggtgattccgca

SEQ ID NO: 45978 - DNA, 1033 bp, Homo sapiens
atgctgaccaccatgcctggctaattttgtatttttagtagagacggggtttctccctgttggtcaggctcatctcgaactcccaacctcaggtgatccgcccaccttggcctcccaaagtgctggcattacaggcatgagccaccctgcctatagtgttaactgaagtaactaaatttagacatgttggaaaatagagtttgtttcttcaggtagacttgtatatgtactaatctcattggaaaactaatttcatgatagtatctattcaattagagttggtgagctctgttctatatttttaaatggagtcttattttcagtagtgaatttcctgtgtgacttcccccaaagatatgaaaagtttacattaaaaatcgtaatacagtgaactctaggatgagagattattcctttgaacagattatgtctgctccttttattgtattttaactattttctttcctctccttcgaactacgcagtcagttgctatgcagaattgatagtttgctgttacgaacctagatgttctcaaaaaaagaaaagaattatccagagtttatttgacagtgatggagaaaggaaggtgtataggtcaggagtagtttcacttttaggaattaattggttcagcatatagtcattgagcacctactgtgggccaggcactctgcttggaacagaaacagttctgtcttctctgggatgctaatgcaggtatttctattgacctggccaactgtaaggtgaagatgaaattcaaagactgcgtggagtaacccgagcaagttcctctttactttttctggtatcaattctaactttttgtttttttttggtgatattaacctttggaaggaactgtatgttagattttcggcagctgagtggttttgatccttttgggagatcaactgtgttggaatacgtttaagaggagtttttgtgaagacattggaactttagtgtgttcttttcacattgataagtactgaggagaatccatgggatactgtgattaaaagttttt

SEQ ID NO: 45979 - DNA, 1046 bp, Homo sapiens
aattttgttagtacctgttttttacattgacctagtatcttagctgtaaatttacttaaggtgctctgaattatagttccttggagagcagtgatgctttaagttgctgcacaccttggtagacataagtaaaatgatcttcattttgcttaagatgatggaggatactcctagggtggaaagatggtaaagttaacattgaatgtattttgaaaattggagatttgatctcaatttgttgtattattagcagcccactgaatacctgtagatttttctttaacaattgaaaattaacggtatttttctttgatgaaatttttagagatctatttcagggttcaattttccctgtgaacattgaaataaaacataatcttactgttattacccttgaaatgattctcatacagtcatgaattgatagagaatctcattcataaaatggctctatgtaatttgagcatttattaaaagtatatattaaaaattcagggtagacaagtaattaaaatgctttattctatatttaagtgctgtaagaactcttacctgtagaaactttatcacatgtggctgaatttaaatacagttatcggatttctacaattattaaatgatctaacaggttaactgcctggaaacaggaaataatttatagttagatcagttcagtgccatacctgtgaattggatgttataagttcctgttaggccacctgtttgcttttatttatttatttttgagacagaatctcgttctgtcacccaggctggagtgcagtggtgcagtctcactgcaacctccgcctcccaggttcaagcgattctcttgcctcagcctcccaagtagctgggattacagacatgcaccaccacgcccggctaatttttgtatttttagtagagacggggtttcaccttgttggccaggctggtctcgaactcctgacctcgagtgatccacccgcctctgcctcccaaagtgttgggattacaggcttgagccaccgtgcctggcctgttgtttgcttttattgtaatta

SEQ ID NO: 45980 - DNA, 1033 bp, Homo sapiens
attggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataaggtaagaatggcatatgcttcggggtttatagagctgatgatataggatgctacaaattcacatttctgggaagttatattcaagttttttgtttggggacttctgtggagtgatcacctctggttttttattggtgagttgtagctatgagagcttcatagatttgttctggtactttgaaatatttgaagcctaagattaaaaatgtagaatgttaatctgactaaaagaacttatttacattacaatgaaaaagtgacatatgagtttaaaacttttttttaaatttttttttattattttgcttgaggagtactccagcgtgagactttaaaactttaactaaaggttcttagaacaccttactactggaagttgatgagcagccaaatcatggagacttgaatttgaaacaagcagatgactctgagaacatttttctgttttccattttgttgcagattactcgttagacagaaatgagacagattctcatgacccataggcgcaactaagcaaacttagcaattcttgtttctgctgtttgtattatagctttctgtcatgtattatggctttgcatatgatgaagtcctaaatgctatttatgacagctgtagttgcatgggacaggaatacagtatcctaaactagaaaagttctggagggtctggaacagtagttcatgcctgtaatcccagcgctttgggaggctgggacaggag

SEQ ID NO: 45981 - DNA, 1034 bp, Homo sapiens
atagtagcagtgtccagtaggctcaacataaaatactacgtaaaagttctgattcatcccaccaacatggtgcagcctacataactgaatcccaggactctttcagagcacctgttacttctgaatgcattagcggtacctgggttccaaccgagaataccagtacctgaaacctccacagaattaccgggatgtcccaggatgctcagatcaatttggtggtggttgttggtgaccaaaacagacctgcttccagatactgtcaagatgagagggcagcagaggaagcagtaacatctccaaagggtcatcttaccatgaggtaagccatgctctgggctccctctatcccagtggttcttctacagaggctggagcttcctcaagtttggggtgcaggctgaggggccagtgaccaccagcagcacagcctgcacaccacgtgcaccagcctcctggcaaggttttgctatgaggatagcaccgcaaggatggatattcaccaaggcatgctaaatctgagtaccatcacttctcagcatgctaatggctacaatattttgggcaactgcactgatactaaggaataaattataaacactcacacatgtgtgtgcagctggaagtccgcagccttgtaacccagggcgaaattattctgtgacagtttggatttggctgtgtcaaaactcatctgatagccagcaagccacccttcgaaggccaacacagcccagccatagatggttggtccagaaaaatctatatcaacattactgccaacactaaaacaatcccgtttataggaggccttcaatttcccactcttctttctgcaataaacaaacaaacaaaagcaaatgatgaaaacaacatgagttcttactactgtctaggaatttttagagtaagatcctctctctcatctcccaatgtaaatattattttggtacatgccacatatatagtaaaaacatttcaaatgacctagttctacaaatataattttgttaggattagacatgtatagacta

SEQ ID NO: 45982 - DNA, 2029 bp, Homo sapiens
taagtgccatgaaatagtagggagtgtttccttcgcttatattcgaaaggctggggctgggcacgttggctcacgcttgtaatccgagcactttaggaggccaaggtgggcggatcatgaggttaggagcttgagaccatcctggccaacatggtgaaaccccatctctactaaaaatacaaaaaagttagctgggcatggtgtcgcgcttgtagtcccagctactcaggaggctgagggagaatcgcttgaacccgggaggcgaaggttgcagtgagccgagattgcgccattgtactccaccctgaggacagagcaaggctccgtctcaaaaagaaaagaaaaaaaaaaaaaagactggaaaatgagaccttctctaacccttttcaggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgaggtgggtgctttcattcattcattcaacaagggtccttgaggctccgccaggggccagcgctgtgcgggtgccgggatccagcagtgaacggcaccgatggaagtccctgccagggataggggtgcgcaggcggtggacagacccataagtcagcattgcgtgcgggacagcgagcagtgttaacaggaaagtaaggtagatagacacagggcaggagccgccaggatggcagtgcgacctgggcttccagggaagggctggccggtgacggaggtgcaggggcggccacgtggcgtcagcaggacggcaggtgcagtcttgaggcgggcacacacctgtgttctccaggacaagctaggaggtcgccggtctgcaggtcgtggatgcagagcacgtggccgatggacacaggaaggaaggcctcgcctcgagaggggagccgtggagctgtgagcaggggccacacagggcacatttgacaggggccacacagggcacgtttgacaggggcactggctttggacgacggcctggatgcggatgtgagagaagaaggaaagaggcagctgccaagatcggagccgtggccttggcaaaggcaagagtggagctgctgtctgttagggatgacggaggccctggatgcagccagggcgcgatgctgctattcaggttgagcaggcagcggccgtgtacgcccgagttcaggacaggccgggctgggtgcagagcaggtaacgtgggtggaggagcactggggcagtgaggcaggcaggcaggaggcagagtgcacagaccgaggaaacagccagaaggtatgctgaaccaggacgctaggagaacttcctaggaggtgatttaatttttttttttaagacggagtctcgctctgttccccaggctggagtgcagtggcgcaatctcagctcactgcaacctccttctcccaagttcaagtgattctcttgtctcagccttcccaagccgctgggattacaggctccccaacctggcccggctaatttttctatttctagtagagacggggtt

SEQ ID NO: 45983 - DNA, 1074 bp, Homo sapiens
tttctcaactaagttgtttcagaattcctattacataggtagctcctctaatgctttgaatatattgatctagagcaaaagacaaagctcaatttataaggcaagatattagagcagttctacaaaggaggtaatctctgtgtgtgtgcatgtgtgtgcacacataagtgtgaatgtttactatgagaagatatccgcagcatattgttatgtgacaaacaaaagcatagaatagtatatagtgggattctgcttctgtttaataaaaggaaaaaagaaaaataaatgttcgacatggtgtctgtgcctacctagaaaatgcctggaaacatacacaccaaatagttcttactgtctccctgggaagtaagttgaagaggggaggatgatgaggaaggttcatatttgtacatcatacaattttgtaggtactgctgatatttttacgataagcatggattatttatataatgaagacaaagaatctgcattgagtcaataagaaggaagattgtagggagatgatgggtcatgatataaggaaactgatatagactaaagccttattggtcccatataagttttatttgtttatagatccttagtcatgagtgttagatgtgaaaaacaagaagtacaacaaggcaataacaatggagactgagctcgtataaaaagttctatgtatttctccctaaatggcttgaatattcgtctaatcttttgggaatttggaatagaattgtaaagatgcttgaggttagagctaaatcactattcatcgtatcttagctgctccgcaaatgaaaggcgcttgacatttgcgccttttagtggctaaaaccgagaacggagacccagagctccttgcgcgggttcctggcagctacttttggctgagtgaacacgagccactgaggctgtgccccagtatgtccatccgcagggggaaatgacggccatgtcttactgcctgacgtagccataattgtttggaaacaattcgagatccgtaccagaaagacaatttaatagaaagtatttttgtcaaaaatgttgttgtgtagaagccag

SEQ ID NO: 45984 - DNA, 1064 bp, Homo sapiens
cattcgagactttaatctcttgcttggttttggccaaaattcaccccagaacaagttcatacacagcaccctcactgaaaactgacaagggcagtcagtgtgtagcaccaggagacttgcctttaaatgcataatctggccggacacaatgcctcacgcatgtaatcccagcactttgggaggccaaggcgggtagatcacttgaggttaggggttcgagaccagcctggctaacatagtgagaccccatctttactaaaaatacaaaaattagccagagggcttgcttgaacccaggaggcagaggttgcagtgagccaagatcaggccactgcactccagcctgggcaacagagcaggactagcttcaaaaaataaataaataaccatcatccctgtcccctctgtgttgaggaaggcagaagctttcctttaactgaagttaattgagtgatttttgtccaggctgtagcgctttgtaaagaaacaattcacagaaaattaaactctgggagatgttgttatggaaaacatttggatttcttcccttggtgtctgcacctctgtactctgtatctgatggttttttgtccttcaatctgtaggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattggtaattggcattttcttttacccataagaaggaaagtttacattttctagagtaagttttattacaagttactttttttttttttttgacccggagtgtcactctgttgccaggctggagtgcagtggtgcaatctcggctcactgcaacctccacctcccgggttcaagccattctcctgcctcaacctcctgagtacctggtactacaggctcctcctaccacgcctgctaatttttgtatttttagtagagatgaggtttcaccatgttggccaggatggtcttaatctcttgacctcatgatcggcctgcctta

SEQ ID NO: 45985 - DNA, 1033 bp, Homo sapiens
gaaagatgatctttatcgtgcatggggaattaagagccatgagcattctcagagtgaggaaatagttttcaaagaaatcttataaaatgtcttttctcttttgtgttttttactgccatcccatggttttgtgaaggtattaataatatcaagccagtgctcatggtttcttaatttagtaaaaagatttcactctcagtctccatagaagatgagaggaactgctaaatttctacctgacttaccaatcaaatgaacgctcttgggactatattgccttgtttagtgtgtttatactgccaatttagcaagttattagtgaagtagaatcaggttttcagatttctgatgaagcacttcagagaattgaacagattctcccacatggcaaagaggaagaggctgcctagatcaacttaataatcatttgtcctctgttgttttttctgctggctaagaacaattgcttaagaatctctggaatgataacaagaaatatggggctgtaagttgagcatggaaaggagttaagataatttcatttgtcagctcctctgtttatattaatgttgcattaatggaaagaatatgcggttgtaccaggaacaaaaagttttataagtaccatccatatttttattgaacctccaatagaatcaaaacaaagttagcaaataaacatgtaagagccatatctattttcatacatggttccattttaaactgtctctgaagggaaagtattttcctaatatagctcttggaacttagccaaacagtccaacatttcagggcacagaattggaacaagtgatcctaggtttgtcatttgatagaagtttcatatgttaagcgatttgctcacgaatatctacctatttttggttatgagtgaagaaaatacctagaatatctgggagggcggggaatccatttatagtgcatacggaaaggaagaaaggagaaaatgttgaagagtcttttctgtgttagagagtgggaataaattcataaagcttggctattctcgtcc

SEQ ID NO: 45986 - DNA, 1057 bp, Homo sapiens
cataatgaagaaagggctctctgaggacatgttttgccagtgctgttaaaaaagtgtcatacttcctgcaggagctaggtttttaaaaataataataaagataaaaataaaaactgtcacacaagtaacgcactgccatgtctgaaaaagacccgccctaccttagccaggaaattgtggccctaatatttcagcacttgaaaatgggatctggccgggtgtggtggctcacgcctgtattcccagcactttgggaggccaaggtgggtggatcacttggggtcaggagttcgagaccagcctgaccaacatggtgaaaccccctctctaccaaaaatacaaaaattagccgggcgtggtggcgcacgcctgtaatcccagctacttgggaggctgaggcaggagaattgcttgaacctgggaggtggaggttgcagtgagccaagatcacaccactgcactccagcctaggcaacagaacaagactctgtctggaaaaaaaaaaaaaagggggagggatctgtagaatccttggcttttatagcatagttaattacatgtttgcagagtactaaaaattgcttgaggtgagaaaagactggtgaggacatttgagccaaactgtagtttgcctggtcataagatattgatgttactattcagtctttcaatctttcaacctcattatgtttcaaaaaactgacctctcagacatgaagctgcatgcactgttattttctacatctgtgtctgttttcagaacatatgaggcccaatgaacatggtgtctgtacagagataagatcgacgtgtctccccactccagagggcacagggagctgatcttaaccctgaatgagcctttcaatataagtagagtctgtgaaacccatgaacttccaataaatatacagccagtagggaacattccaagtgtctgtttaatttggttcttaataatggcagccaaaaagctattttcatttctgtacaaagaggaattactaaatagtcattcttttcttggtatttcttccttggaaaaatcacgtttcta

SEQ ID NO: 45987 - DNA, 1331 bp, Homo sapiens
ccacctcagcttcccaagtaccttggactacaggcgggtaccactgcacccgctaatttttttatttttaatttttaattttttttttatttttagagacgaaatctcactatgttgcccagactggtttcaaattcctgggttcaagcaatgctatgtccttggcctcccaaagtgctgggattataggcatgacactgtgcctggctaagcctagcatcttgtatcagcaagtgcagaattattgcccccaagagaaaggagaaagcttccagtgtgaaagtagaggaaggacagcctgtgttcttttaactgagtggaggctgatgttggggtgcatggaacgtgtctgaccttgtgctctagatctctgtggactccagacaatggaggaggaagggaaacatttaagtgtgtttagcattttctacataccaggtactgttcttggtgataaagctgtatctctgtatctacattcatacatgcctatctatatctatataactgtttgctgtgtatgcataaacatatgtttatttaacaaaacatttataccaggcactattctacatactttacaaatgaaaaactcatttagtcttcataataaccccgtgaggcatgtataattattattcccattttaaaagtgatgaaggcacagtgagaaagtaattgcccaagacaactacaaagtgatgaagctggcatttgaaccaggtagccttgctgcagatgccactttcattggatactttatagcctagatttggaaaaattaagtaatttagtcatcaaagcagctattacttgatggagcttgaatctcaatcaagctgtcccctagacaaacattatagctttcctttttctccatctttgcttgtgtgttgcttctgtatagtgttctttctactcctgctactgttgagagcttaggagaaggctccattcaaatgccactcccaggccgggtgtggtggctcacgcctgtaatcccagcactttgggaggccgaggcggacggatcacctgaggtcaggagttcaagaccagcctggctaacatggtgaaaccccatctctactaaaaatacaaaaattagccaggcgtggtggcaggtgcctgtaatcccagctactcgggaggctgaggcaggacaatcacttgaacctgggaagtggaggctgcagtgagctgagatcatgccactgcactccagcctggggttacagagcgagactccgtctcaaaacaaacagagcgagactccgagactccgtctcaaaacaaacaaacaaacaaaaacaaataccactccctccaag

SEQ ID NO: 45988 - DNA, 1051 bp, Homo sapiens
aaggtagatggatccttatcctcattttacagatgggcagagagaactctgttaaataacttgcctactgtctcaaagctagcaattggttcagtttgactgaacccaggaatatggctctgttaaaagactcctacagccctcttttcctcagaaagccttaaatttcaagttaaaagtagggtaatccttacctaaagacccttaagtgcttttgaaacagacttgaatgattgtgaaacaatatagattgaaatcacaaaaattagtattttatactgtgtatcaaaagatttgggcaattagcagctcgttgcttgatacttaatagttttcctattatctgagggagtaaactgagaagtggatgtttatgattagcagtttagcacaactcattatttcacattctatccaatacagaattgacaataagcctttgtttgtgatgggtggagtttaccttggtgatacctatgaaaaagtggtttctaaacaaataaatactgtaagattgcaggaaaatgttacttatttcaacatagtcgaatattttcaagcacttttaatgggtttttttgtttttgtttttagtataatccagtaactatccttagtactttccttttaaaaacagaggaaactcagtttaatatttgttgattcaagtaataaaactgcatttaaaagtattttcagtttagatatatatctagttcaagccaaattagtctgggattagtaaggtttttgttaacctaactttcgaattactgtggctttaaatctaatctttgactttttccccaaaatcttattgcattcagagtttctcattttagattagcttgcatagtaataaattatagaagtgaaggttgcacttaataagcctgtgcttatttttccatttgaggtgcatatatcacataaggtggtattagtgctcttttgttttgaagctagtggccatgttgtatctgtctctagtggtttcaagcctagcatctttttgttttgttttgttttgttttgttgagacaagttctcg

SEQ ID NO: 45989 - DNA, 1051 bp, Homo sapiens
atatcttagctactcaggaggttgaggcaggaggctcgcctgggcccaggaattctttgtaatgtggtagaggttaatttttacttatttatttttttggtgttcctgggtggacatgaagaatttttaaaatacttataaagatgggcataaagaggctgggcgcggtggctcatgcctgtaatcccagcactttgggaggctgaggcgggcggatcacttgaggtcaggagtttgagaccagcctggccaacatggtgaaaccccgtttctactaaaaatacaaaaattaactaggtgtgatggtgggtgcctgtaatcccagctgcttgggaggctgaggcaggagaattgcttgaacccgggagatggaggttgtagtgagccgagatcatgtcactacactccagcctaggcaacagagtgaggctctgtcttaaaaaaaaaaaaaaaaaaaaaaaaagattagcataaagagttgggaaattgggaaactcattaattgactaatgtccggcaacatttcaactgattggtagagcaccactggcacttttgttttccaaaatgtttggggtcctaatatgttttataaaatcattgtcttccaggctaattatacatgataaattatcagagtgaggctacaaatattcttttgacatgtgaggggcttctaactatgacagccataaatttaagtcactttaagttgggcatcaaaagccaacataaagacattccaggttatggatgggagacaggcaggggctggtccataggttttggccttcccagatgtatctggctagcctttacatacctgataaaggaagtgctctttgtaagaagttagaaaaagagaaggaaaagagtgaaatataaaaagcagtagttcttgaccccaactgcatattcaaaatatctaggtagctttaaaaacaaagcaagtgtctatgctgggccaattcaattaaaatctccgaaagtggcgcccaggtgttggttgtaatttttttttttttttttaagatggagtctcgctctgtcg

SEQ ID NO: 45990 - DNA, 1084 bp, Homo sapiens
gtaaaaagggaactaatattagaattaatttttttacttatttatttatttatttattttttgagacggagtctcaatgtgtcgtccaggctggagtgccatggcactgtctcagctcaccacaacctctgcctctggggttcaagcgattctcctgcctcagcctcccaaatagctgggattacaggcacatgccaccatgcccggcttattttatatttttagtagagatggggtttctccatgttgatcaggctggtctcaaactcctgacctgaggtgatccacctgcgtcagcctcccaaagtgctgggattacaggcttgagccactgcacctggccctaattttttgtatttttttgtagagacaggatttcgctaggttggccaggctggtctcaaactcctgacctcaagtgaaccacccgactcagcctcccaaagtgctgggattacactcatgagccactatgcccagcctatttatttattttagagacagggtctcgctacattgccccagttggacttgaactcctggactcaagcagtcctcccatcccagcttcccaggttgctgggactacaggtatgcaccactgcacctgattctaaaattaatttaggctggatgtggtggctcacgccggtaatcccagcaccttgggaggctgaggcaggcggatcacctgaggtcaggagttcgagactagcctggccaacatggtgaaaccctcgtctctactaaaaatacaaaaattagctgggcatggtggcaggtgcctataatcccagctacttgggcggctgaggcgtgagaatcacttgaacttgggaggcagaggttgcagtgatccaagatagtctcttattagggtaacattatcttgatttcaatcgggtattttatagagtgataatccagagtgattgatactggtgatacactgtggatatcatgggggaaataatgactagatgatagcagagttaagtgaactccactaagcaggttgttcttaggattcctgactaatgttttaatatacaccaaatagaaggacattgtatattgctgcagg

SEQ ID NO: 45991 - DNA, 1045 bp, Homo sapiens
tgttaactaatcgtgaaagttattgggaagggttacctaatttgaataaatgtatcattttgaatttgtaggtcttgttacattgaagcacttcaagactccctttttaaaagtggagccctttcttcctggacactatgaagtttttgatttaaagccaaatgaccaagttgcatccgtggtaatggttaaatatcatcactgtcgggatgaacccccacacgtgctctattacaatgtggagaaactctttccaggtagcagacacccacccacccacctattccccatccttctctaagggaaaaagttataagctgtactttcacatcaattgaatgattttagtttcaagacctacttcctattttgtttggagggaatacataaagatttggcagactccagcattgagtaaatgccatcatgatagatgttgatgattgtgtattttatttcaataactcatccagcccaagattttctggagctgtttgatttatttgccgtgtttataggttttgagacagaaactgtgaagaacaaactccggatcctttttcatgatgctataaagaggcgttttatgatagacaggttgccttttatcaggtgaagtcaattaagaaacctaattatacttcgtgcatgtttaattgaaatgatgtgcagccatccctttggtttttactataaaatatttactatatgatttaatctttccttcattataggatggaaacaattttttataagctgcatttaatagtcatagtaatactccaacttgagttacactatagctatattattggtgtaaaagtgagccagtgaacattctttagaattctgtgtagtgatttttaaccaattcaaatactactattatcacagtttatatacttttctcttcttgaagttgatttcagtttataaaacttggggattttaaatggtaaaactattatcttggtgtttatcaggattgtacatcctctgtccctgtcttatgcaagacacataactaggacacttccacttcctc

SEQ ID NO: 45992 - DNA, 1022 bp, Homo sapiens
taaaattaatttcaccttttttttaatggggctactagtatatttaaaattacatacgtgactcacatatttattggacagccctgctccagaagtttaggaagaaataagaaaaatattgaaaacaggtagcggcagtaggaagtttgccaacctttaagactgattacaataaaaataggtgacagttttaattggctttttcctactagaaaaaataagtatattttacatgcctctttgttctccctccttcccctccaatttagtggttagcttgtatttactatagcacgctaaatattcactaagcagcattaagaagacttaggtaaatgattccctgatgaccacacttgattttcaaagcaatttcctaacccatttttaattggtacagagtcaaagacagatggcttattagtagtcatctcatttaaatctcatagaattttcccactaaatctcaaagtaagtaatttgttataggctattataggctatttggtcaagtgcatggaagggacagcattaggacatgtggtagttcatttccaaattacttgagatgattttcattataatcatatattatttggttctggttttccagaaaagccagctaaacctttgttttatttagatataaatgaaatatcttcaaaggattgctcaaactgacttatgcagcttgaatatatattttttccttagggtgtttatcccaaattatctggctatttgctgcaatttgcagttaaaaaaaaatagttatttttcaagttagagatgttttagtaaaagcagtcattttgagctggcagcagccaaataaaacagccctttatttcacagttgagagtttgaaattggaagttaattgatgtatgtaaggatgatttatttgcttccaggtttataggaaggagcccagttgttttttttttttttttagaaatgttgttgctgtatatgtcccacctacttggcttccttcctaaacaatgcaactttcagacaga

SEQ ID NO: 45993 - DNA, 1032 bp, Homo sapiens
aacttgattaattggagaaggattagtacacacacttcataaatgatgctatattgaatggccagtgaacacatgaaaatgttactaaacatcgtcaattattaaggaaatacaaaagtaaactgcaaggaggtgctgctttacttgtcccattagcttaaagagtaatactaccatatatgtagagcaatgagaactcttataaaattaagagtttttctaccctaacccatgacttagcaattctactcctagttatttacttaatagaaaaagaaaacacatctacaagatttgttcaaaagtgtttataataggccgaaactggacacagctcatatacccaccagttggagactggatcaacaaataggtatagtcataaatggaatacaacttagcaatgataaggaacactgtcttggtacatcaacaacataatgaatttcaaatacatggtaggtgaaagaaaccttacacaaaagagtacattctgtattccatttacatcgagttctagaacaggcaaaattgatacataatggaagaaaaagcagtgctgtcttcgatagtggggtggggattaattgcgaaaagtcttagaggaacttgctgggtgataggaagtattttatttcttgtttggagtttgagttcagtgctatatgtatatgttaaaacttatcaaatggtgtgtcttttattgtatataaaacctactgaaaaaagtaaatacatattaatagaaatatacattgaattcttgttattgatgttcatgctgagatataatgggatgatgtgtactgtcatctgcaactttgaaatgcatcgaaaagtaagatggattggtggagccaagatggctgaatgggaacagctccagtctagagctcccagcttgagcgacgtagaagacgagtgatttctgcatttccaactaaggtactgggttcatctcactggggagtgtcggaaagttggtgcaggacagtgggtacagtgcacccagcgtgagccgaagcagggcga

SEQ ID NO: 45994 - DNA, 1048 bp, Homo sapiens
attataaacaattctttggagttgtgcttttaataattacagaggggcacatgtcggactacctttcctgaaaataacaatgacaacttttggacaaaatataaaaaaagtatgtgaaagcacagtaggaggacagaaagtaggaagaaactgaaggatgttgacatttggaagatagaatggtataagatgagcatttcattttttgtggatgtttcccagaggacagaactcggtcattggttgtgtaggtgacggaagcttgaataaaaaccacaagacagagttaggggtgactctagcagctagaaagttagtgagtataaagtagtctttcataaagaagcgtgtcccaaattctgcataaaagtcttaggctaaaataactaaagatatttcatttgcacaagaaagagttcagaggtgtatagccaacttacctacctattaagcaaaaaaaaactaaatagtcttcagaagaacataatcaaatccagagtttctaaaaatgtactatgcacagtgtccagaatacaatccatattcagtagacacacacatacacaaacagaaaaatgtgacccatacttaagtgaaaagccaattaattgagactggccttgatatgactcctatgttagaattagcagctgttataactcttcttaaggttatataaagaaaatatgtacaccatgaataaacagataagaaacctcagctgaaaaatggaaactaggtaaaaggactaaatgaaaattctataggtaaaaaatacaatatttcaaatgaaaactgattagagattacagaagattaggaaaagaaaaggagtcattgaagttgttggattcatagaagttattctttcttaaaaagtgaaaaagagatttcaaaaaatgaagctagcctcagtggctggtaggacaatatcaaaaggtctaacacttggagtcctagaaatagaggccaggggaaattgggtcaaaaaattctggagaaattatggctggaaatttccctaaattggtaaaaaacatgaatttac

SEQ ID NO: 45995 - DNA, 1115 bp, Homo sapiens
ggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtt

SEQ ID NO: 45996 - DNA, 1721 bp, Homo sapiens
atcacttagttcagcctcattcagtcaggtcacagaagtcatggtgatcagtgatatcatcagagccggtaattaaatgtgttcgcagatcaaaggaagactctaagaaagttttaggaagccccgtaataaaaatgtctggtcaaaaatgtgatacagatcttttctctggttaacctctgaatgttttggatcatccttctcaatctctgcggccctgtgtcctgtgcacgtgggttttgcattgagggataactcaagccgagggggttactctcgagcataggaactcacatctgtgtagctgatttcaagggaagcagagtctgtatttttactaaatgtgaacagtaactatgtgaggatgctgccatttgtgctcggtactttgagagttctggcttacatattctgctccttgccttttttcttgtttagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaagtaggttttgtttcatgtgcacttttcacttttgtgacagtgtccccgtgatcaagctggtatctctcgtgtatgatggaagtgcattgagtcatgttgatgaaaatatttacattattttgtacagcatttctcaaagttagtatttaggattgtctgcttgaaaaccagttaagaggctgggcccagtggctcacacctataatcccaaaactttgggaggcagagacgggaggatcacctgaggtcaggagttggagaccagcctggccaacatggtaaaaccctgtctctactaaaaatacagaaattagctgggcgtggtaacgcacacctgtaatcccagctccttgggaggctgaggcaggagaatggcttgaaaccaggaggcagaggttgcagtgagccgagatcacgccactgcactccagcctgggtgacaagagtgaaactccgcctcaaaaaaaaaaaaattaacaggcaaaacctttatttggagaaataaggggactgctgaggcccctcgtctcgtgatgtgtgtgccatggagtctgtatgaacagctttgtagctgtagaaagcaaggctgctcctggttatagatgtttgtttactttaagatcattactagatttaatctgtttgggcatgattgtatataccattatgatcagccgggaaaatcatgttcttttcttctagaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttggtaagatttttatatgtggaaaaaactaacggactaccgacatgctactgtttctcgaggagccaacatatatacaaagtgctgagctcttgacactctgttagcatgacttctctgctttcattgaggaggaaagcagggcttagagaggctgacttccccaaagccagggcaaggcctgcaactctgacgtatgtgacccctgcactgtcttcaggtttaaactcagtccctggaacagtggcgccaatt

SEQ ID NO: 45997 - DNA, 1047 bp, Homo sapiens
ggatttcactatgttggccaggatgatcttgatctcttgacctcgtgatccgcccccattggcctcctaaagtactgggattacaggcctgagccactgcgcccggcctacagttttataacctaagaattttcatctcagtttaaactaggaggagagaattttaagatggagtggactacttttaaagctaactttaatagcaactcagaaaagatttcacctgaagtgattgaattgctaagtcacacgtgaaactgttctgtctttagattttatcgggaaaacttgttaaagctttccacacaaaagtacttaaacatacgtgtatcacattgtttcccattgcccaggtactgcctttttcctaggaaacactgaaaacagcttttcaagttcacttaaacatccattgtcatttaagaaaatattttctcataggagtgcagaagccttattggaagaaaaaagaaaaacaaaatattttctcatacttactatggattgtgtgtatatctacctattggaaatataaagaaagatgtggcactggctgggcgcagtagctcacgcctgtaatcccagcactttgggaggccaaggtgggcggatcgcctgaggtcaggaattcgagaccagtctggtcaacatggcaaaaccctgtctctactgaaaatagaaaaattagctgggtgtagtggcgggcgcctgtaatcccagccacttaggaggctgaggcatgagaattgcttgaacccaggaggtagaggttgtagcaagccgagattgcaccaatgcactccagcctgggcgacagagtaagactctgtctcaaaaaaaaaaaaaaaaaaaagacaaaacaaaacaaaagaaaaagaggccaggcgtggtggctcacacctgtaatcccagcactttgggaggccgaggcgggcggatcacgaggtcaggcattcgagaccagcctggccaacgtggtgaaaccccgtctctactaaaaatacagaaattagctgagcatggtggcatttgcctgtaatcccagct

SEQ ID NO: 45998 - DNA, 1053 bp, Homo sapiens
atcacgaggtcagcagttcgagaccagcctggccaacacggtgaaaccctactaaagaaacaaaaattagccgggcgtggtggcgagcacctgtaaacccagctactcgggaggctgaggcaggaaaatcacttgaacccaggaggtggaggttgcagtgagccgaggtggcgccactgcactctagcctagacgacagagcaagactctgtctcaaaaaaaacaacaacaacaaaaaaaaaaatgaagaaaaacgtttgcaacacatataagaaacaaaaagctgacttcggcaatctacaaaataaatggtcacaatagaccagtagaaaatggtgggaggaaatgcatgcgtgattaaaggatgtaaggcaaataaacatggaacatacagcctcactaataatgtaagttgaaaatttaaattaggtgtttttcacttctcagattgacagtgattttatttttatttatttatttattttttatttttttggtgacggagtctcgctgtcacccaggctggagtgcagtggcgtgatctcggctcgacagtgattttaaaagatgattatgtgcagtgttggtaaagactttagaaagtagtcagtctaatactttcagaaatgaaaatttgaaaaattctttaccgtggctcatgcctgtaatcccagcactttgggaggccgaggtgggcggatcatgaggtcaggagattgagaccatcctggctaacacagtggaaccctgtctctactaaaaatacaaaaattagctgggcatgatggcacatgcctgtagtcccagctactcgggaggctgaggcaggagaatcacttgaacccaggaggcggaggttgcagtgagccgagatggcgccactgcactccagcctgggcgacacagtgagactcttgtctcataaaaaaaaaaaaaaattccataccaatgtttattacaatttttaaagttgacactgtaattttagttctaggaatttatcctacaggtatatagcacaaagagttacgtgtacaggggaccaggcgcggt

SEQ ID NO: 45999 - DNA, 1033 bp, Homo sapiens
gtaatctcagtgctttgggaggccaaggtgggcagattgctagagctcaggagttcgagaccagcgtgggcaacatggcgaaaccccatctctaccaaaaatacaaaaaatagccgggcatggtggtgcaagcctgtagtcccagctaattgggaggttgaggtgggaggatcgcttgagcctggtaggcaggggttgcagtgagccaaaatcgtgtcgttgcactccagcctgggtaacagagcgagaccctatcccaaaaacaaaagaaaagaaaacttctatagacaatgaatttcttctttttaattccacacacacatacaaaattttgttttgttttgtttttttaatccaacagatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtaatactggaggaatgttttacgctagtgtgctgtgtatgtcttcaatgtgcagtgttcaggctacaggaaagtaataataaggatgttgctttgtgtttttaaaatatatttgacagttatgcacagccaattttctttttatttatgtatttgtttttatttatttattttctaaattattattatactttaagttttagggtacatgtgcacaatgtgcaggttagttacatatgtatacatgtgccatgctggtgtgctgcacccattaactcatcatttagcattaggtatatctcctaatgctatccctcccccttccccccaccccacaacagtccccagagtatgatgttccccttcctgtgtccatgtgttctcattgttcagttcccacctatgagtgagaacatgtggtgtttgattttttgtccttgcgatagtttactgagaatgatgatttccaatttcatcc

SEQ ID NO: 46000 - DNA, 1178 bp, Homo sapiens
tgaattgtacccaccctgccacaccccctggaatttttttttttttttggagacttgctctgttgcccaggctggagtacacagcagctcactgcagcctcaacctcccaggttcaagtgatcctactaccttagtgtccagagtagctgggactataggcacgtgccatggtgctggctaattttttaaattttttagagacggggtcttaccatgttgcctagtctggtttcaaattcctagactcaggtaatcctccctctttggccttccaaaatgctgggattacaggcctgagccactaaacctggcctgaattgtactctttaaatatgaattatatcccagtgataaatttagagacataattgaagctaaagaaatggattcgctactctaaggtggattgtgtcgtgcaaagggggaagcaggccaattagaaacttctgtcacttgtgtatcatcataccaccttctctctttttattgtattcatacagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttgggtaagttgaccgcttttatccacttatatcttaaagggctgtgttatattgtcttgtgtatcttcctcttctttgtgctgcatcatctgacatttgggaggtaaatctttgcagtaatttcagggaatatagcaaagtgagccagagaatgatagtttaattattttgaaaactttgtgtttgcatataagatgtaaacaaacatgaaaagccatttcagcctgggcgcagtggctcacgcctgtaatccgagcaatttgggcgaccgaggtgggtggatcacgaggtcaggagatcgagaacatcctggccaacgtgatgaaaccccatctctactaaaaatacaaaaactaggctgggcatggtggctcacgcctgtaatcccagcactttgggaggctgaggcaggcagatcatgaggtcaggagatcgagaccatcctggctaacacagtgaaaccccgtctccactgaaaatacaaaaaaattaaccaggcatggtg

SEQ ID NO: 46001 - DNA, 1112 bp, Homo sapiens
cccctccctcccataccctcccttcccctctactcccctgcactcccctcccctctcctttcctctccttttttcctctttttcctttccttttcttctttcctttctttctttccttccacgcacagggtcttgctgtgccacccaggctggagtgcagtggtgcagtcatagctcactgcagcctcaaattcctgagctcaggcgatcttcctgagtagctgggaatacaggctcacgccaccatgcccagctaatttttacattttttgtcgagatgaggtatcactatgttgcccagggtgttctcgaactccctggccatactgtttctaagaaattggaaatgagttcctggaaaaacaacagaaatttacttgatggttgatcagggatgagctttgtatattagggccctttgtcagtgttactaatattaatagaaataaaattacttggacagaatcatacatgtaaattatgattcaaataaaaagaattttgaagttgggcatggtggcacacgcctattgtttcagcttcttgggaggctgaggcaggaggattgcttgagcccaggaattcaaggctgtagtgtgctatgattacatctgtgaataactactgcactacaggctgggcaatatagtgaggcctgtctctaaaataataataatttaatagcaacctagacttctcttttaaattttcatggctgggcatggtggctcatatctgtaatcccagcctttagaaggattccttgagcccaggagctcgagaccagcctggcaacatagcaagcctccgtttctacaaaaaagtgtaaaacttagcttgatgcggtagcacgcacctgtaaccaaccccggctatttgggaggctgagggaagaggattgtgtgagcttaggaggtcgaggctgcagtgagctgtgattgcaccactacactccaacatgggcaacagagcaagaccctgtctcaaaaaaataaaaaagaaaattttcagtgattttaaactgtttactgttatgtatttatcaccttaagttgggacatataaggagcaaaatggctcaacacagggtatgttacccattcatcaaaaga

SEQ ID NO: 46002 - DNA, 1065 bp, Homo sapiens
acttaccttcttgaatctgtacctttttgtcaccagatttggggagttttcagtcattgtgtttcttcaaatgctttttgtccaaatttctcttggtctctttgtgggaatgcagttacacatacatcgtgccttttgacattgttccataggtccctgactctgttcatttttattgtctttttttgttgtttattcatcagattagatcatttctattgatttgtcttcaatcttactgttattttcttttgtcttacttgttcttctagtaagtctgtctagtgactgttttatcttaggtattgtattttccagttgtaaactttccatttggtttattaaaaaatattttctctttttctactgagatgcgcaccttttcatttattgcatgtgtgtttttcttgacctcctggagcatagttaacatagctgctttaaggtccttgtatgatcattccagcatatgggtcagcatagagttggcatctgttttctgttgagatggatacattctcctgattctttttatcagttaatttttgaatgtaacttgtgaatatagtagtcgcttcttatctgtaggagttcaaagatccccagtggaatcctgaaaccatggataataccaaaccttatgtatactgtttttacctatacatacacacatatgataaagcttaatttgtaaatttgtactcttaggcagtaagagtaacagcaataacaataataaagtagaataattcaaacagtatactataataaacgttatgtgagtgtggtctgtctctctcaaaatatcttattgcactatatctccagtaactgaagccagggaaagcaaaactgcaggtaagataagggggactactggattctcttgtgtagatgctggcttataattctgtagctggtgatctgtttagatagtaggctctgtctttccttttgttggttgaaacctcagttcctgtccaaacctgtgctgttttgagtctgtctgcacatgcacacttcagggcagcctgagcctggtgggttcatgtgcagaactagagg

SEQ ID NO: 46003 - DNA, 1041 bp, Homo sapiens
tcagcctcccaagtagctgggactgcaggtgcttgccatcgtacctagctagtttttgtgttttttgtagagagtttttgcgttttttgtaggccatgttgcctaggctagtctcaaactcctgggctcaggtgatccatgtgcgttagcctcccacagtggtgggatcacaggcgtgagccagcgtgcccagctgggtttttctattcatttagtactgtaggattccttttggtttttcttccattcagtgttactctgaatagcttctcttttctctctcctttccgtaaatctgaaaaggattgtttttagtgtgattgttacattcctcctttttacgtgttctcattggtattctttccaactttgtaaaataattttattaacttttctccactaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggtgggtaaaattattttaagtgattgaaataattattttagataggtgttttctacttaacaaaattgtttaaaacatttcaaaaacaggtagtacttgtgaagcactagggaattgcatgacctgagtccacctacaaaccccatagtattgttaaatctcttatcacttttagctaatcatcttttcaaagtgaatgcaatgcattttaaaataaatattaacattcctagtatgactacataggagcatatttcctgttgtctcttatattacaagaagtcgccccggatcactggctaaacacaggcctcccagctcctgtgacaagaggctctccgcttttctccacaccatacctatcctgactgtgcttgtaaattcctcagtttgtacgtaacatccaaatcatcttccagccaaaagtagttcccattttttgtagaacg

SEQ ID NO: 46004 - DNA, 1070 bp, Homo sapiens
cctccactagatttcccttgtcaggatcgccattgctttccctcccctcattcctcccaatccacagtggatgctgagcttgtcctgtctcgcagcagcctaaacagtgggatgatgggcaggttgcagggagctcctggggtagggcccctcctgtcccactcacaagctcaggatctgtcccagtggcacgtgtgtatgtggacaagctgggtcgcttgactcattgcatttgggttgtggtgctgagcatgatatcaaacctttttatgcaaacattaagaaagctgggttttctcactcgatagttaactagtttttctagttggcaaatcagttaaaacttttaaattagagaaggttcttcttcagctgcatatgaagttatggtacaaatatgctgatggtaccattagattttaaatagaaatatatcagtgttcctaaaaaaggagcattatttcatttgaaactttatttcatttgaaactttcttatgtacaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcaggtaacagtgaccctgcccgctggccatgtatacagcaccctgacctctgtgggcagcttctgtcacaacagtgttgggcttttgtgagagaagtaagggataatagcaaaaagcgttaagaacccaaggaagatgtcattcaaaagagggggttcctataacagtcaaactcatggaaacagaaagtagagtgccaggtgccagggtctggggaggaggaatggggatttatagtttaatgggtacagaatttcagttttgcaagaggaaaagtgctgtggaggcagggtgcagtgactcattcctgttattccagctggggcaggaggatcagttgagcccaggagttccgcaccagcctgggcaacatggaaag

SEQ ID NO: 46005 - DNA, 1083 bp, Homo sapiens
ctttgccattattaggtttttctaaaaataaactttttatattgaagtaattttgcatttacagaaaagttgaaagatagtacacataatttccatatacaccctttacccaactttcccccttacataatcttggtacatttgtcaaaagtaagaaattaacattagaacattactatttaccaaactagactttacttccatttcaccaatttccttctaatatcctttttctatttcaggatccagtgtagggtagcacatgaagtaatttgtcttatatttgataatctagtccatgatcattttaagaatataagttttatataagtgtagcgttatctattataactaattttgaaacaaagaagaaaaagttgcctgtcatactttgaaagtgcaataataaaaatagctaaatttgtgtgtttttaaaatctctcccatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacaggtaagctatacattgactattttattttgttacttttttgagataaggtcttgctctgtcgacgaggctggagtacaggggcacaaacacaggtcactgcagtctcaacctcctcctgggctcagttgatccttccatctcagccttttgcgtagctgggtctatgggtgtgcaccaccatacctggctaattttgtttattttttgtggagacggggtttcaccttgttgcctgggcaacattaacattttagggatcatttgggtccccttagcaatctggaacataataacacatttttttttaccatatgattaataattaaaacatgtattttggtatatctaattgtatccttttaaaaactcatttcacatatgtgtgtgaaaaaatcagagtgaaaaagtgtggtgttgtgcttataaaacctattttcatagttgtccttttaagatcttg

SEQ ID NO: 46006 - DNA, 1573 bp, Homo sapiens
caatttccttgtctatgacagaataactgcttgataacaacaaaaagaaaatgaggtcttttccccatttcttttttgctttcttaatctggataataggttaataatcactggcttgatgaaaaccttagattaaaatgtgctttaattttcatatcatttgaatttagagaaatacatttcttactaattatgtttgaatacatgtaattttctccttttttatatttcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggtgatcacatttcacatactaaaagaatattgtcgatgtttgtgaagaaagggggtcacagctatgccttgctgttactacaggaagccagttctctgtccattgacaaccctcggagtatagagttaatttggagaattttccaagatctaattcctagccttttattctgtagactcagcagtcagatatcatcagcacagtaggaggtcagaggtcaacatagcaaagatgctctgacctgaggtgcactcccggggagtcaccatacagacggttcagggggtcacatagcagagacatctgacctgaggagccaccctgaggagtgaccatagatgggggtcaggggtcagtgtaacagagacatctgacctcaggagccaccctgtggaatgactgggcagacgggacggggactatgtacttgggatgcaaggaagacatgaaatccttcttatctgttaattgtacagtgagtgtatttgatattattaccagattatcattattacctaagtgtttgttatatgctgttgccccagaaagagcctcccacatccactgccttgtccactgaatgttaactgtaccctctgctctcctgggccctccctttcgcaggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggtgcttttcccactcatcttacctgttaatactatattcattggtgtcatactgagaatgaacatttaatattgaaaacaaaaccaaactgcttatcaaataaatgtgatttttttttgttcatgtcttactttgtccttgttttcccataatatcaaaatgtatcattattttattccacgttttaaggtaattttgaatgttttattttaggattcagtgccaagagatcttccttcttggatgaaattcctccatggcaaactgggaaatccaatagtaccattaaatatccgtctcttcttagccaagcttgttattaatacagaagaggtaagtaattgattatttctttattctttgaatagattctgtaagtctgtttattcaattctatgaatgaatcaattgcaattctatgaatatact

SEQ ID NO: 46007 - DNA, 1041 bp, Homo sapiens
atcacattttgcatcaccaaacaaattcattattaccctcctcttacttggtgctgtcttacctcatcagtgaatgatgtcaccgttcagtcatgactaggctgttgtctgtcctccttgcttccttccctctctttacttactgcacttgatgccgttgcgtcactgaccactgtgttgcaagatccatgtatatatgctgcctttgctgtgagatggatgacatgttccttttcatattcccagtgcctaatactctgcctggcacaagcctgaccctcgagaaaggctgaatggcattaggtcctgttgtctggcattgttgggcttgagcagtgattgccatgttgtgtgaattgatttgtcacatggatctctctgcagattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaaggtaggccactcctacggtgtgcactattgttattgtaggagttcaaaagttagattatatcagtcaaacttacagataatttataccatcttatattaaagatgtggttcgtttaattctgcataggtatatttaaagctggagtgcttttccatgagctattacatagcattaattctaaagtaacatcgattatgaggatcttcaccattcagctatttttatatgattctttgtattcacagaacttgcttatttttgaaaatctgatcgacctgaagcgccgctataattttcctgtagaagttgaggtgagtgaaattttcaatgttaaaaaaaacttatcaagtgctcacaaagaaaaccatattatgtcaaacacgttaagttgccaatattcaagtcggctttcaacaaaaactggtggtttcatgtggtttctataaaatctggcaattgtagcttcagatacaatctcaggcaactac

SEQ ID NO: 46008 - DNA, 1047 bp, Homo sapiens
ggaggcttctatttagccttcttggtccactccttccattgaattttatcattcattcattcatttattatttttgagataaggtcttgctctattgcccatactggagggcagtggcatgatcatggctcactgcagccttgacttctgggctcaagtggtcttccttcagcctgcctagtagctggaactacaggcatgctatcacgcccagccttttttcttctttctttttttttttttaaacgtagagaggttcttcctaaattgcctgggctggtcttgaactcataagctcagatgatccttctttctcagcctccaaattgctgggattacaagtgtgagccgccatacccggaattaaaatatttaaaaagaaattgtaccagtagttcataaacccttcaggatatagaggaggaaggaatacttcccaactccttttgtgaggcgagtaacaagaccaacataagagaaagacagcacaagaaaactatagaccagtaagtatccttcatgaatataaacacaaaaatttttaaagatacattaagctattcagcaacacccacaaaacattatacgccataacctattggtgtttattgtaagaatgaaaggttgcttttctctctgggaatcagttagtcttagataccatataatagaataaaggaagaaaactcattataatttcagtagatgcaggaagacttttgacaaactacaacatccatttgtgataaaactgacaaaggctgtctatgaaaaaccaatagccaacaaaatatgtaatagtgaaggagtgcatgcttcctcctgagattgggaacaaggccagagagcctgaaaaaataaacaaaaataaataaaaggcaactaaattttttactattaaaatttttttcttattcttttttctgttttacaggattttaatgtaacttcttttcttattcctttacgctgtgcatcttgttctcttttcctttctaatgtttccagtgatagtctataattactcaatggctttacaatatgcac

SEQ ID NO: 46009 - DNA, 1034 bp, Homo sapiens
cattatataatgacttcaaaaatccctttttatactttttgtcttgaaatctattttgtctgatgtaagtacagctactcctgctctgttttggtttccattggcatgaaatatcttttttcatccctttattttcaatctgtgtggatgtttataggtgaagtgtgtttcttgcaggcaacagatcattttttttttttttttttttacttttttatatcagtttagccactttatttttattggacagttcaatccatttacattcaatgttgttgttgataagtgtggacttctaccatttgttatttgttttctggtcattttgtggtctttcctccttgcttcccttcctgtcttccttttagtgaaggttattttctcgggtcatatgttttaatttctagctttttatttttgtgtgtttgttgtatgttatttttgatttgaggttaccgtgaggcttgcaaatgatataactcattttaaactgctgacagcggaacactgattggataaacaaacacatgagcaagagaaaaaactaataaaaattatacactttaatctcatcttccgctttttaaacgttttgctgtttcaagttataccttattacactgtctatatctggaaaagttattatttttgataaatttatctttttagtctttctactcaaaatataagtagtttacataccacaattacagtgttacaatattctatggttttctttgtacttattagtgagttttatacttcaggtgatttcttattgctcattaatgtccttttctttcatattaaagaactcctggccaggcgtggtggctcacgcctgtaatcccagcactttgggaggccgaggctggtggatctcctgaggtcaggagtttgagaccaacctggtcaacatgatgaaaccctgtctctactaaaaataagccaggcgtggtggcgggtgcctgtaatctcagctactcagaaggctgaggcaggagaatcgcttgaaccctggaggtggaggtcgc

SEQ ID NO: 46010 - DNA, 1054 bp, Homo sapiens
ttgggaggccaaggcgggcagatcataaggtcaggagatcgagaccatcctggctaacaaggtgaaaccctgtctctactaaaaatacaaaaaaaaaaaattagccgggcgtggtggtgggcgcctgtagtcccagctacccgggaggctgaggcaggagaatgacgtgaacccgggaggcaggtgactgagcgagactccgtctcaaaaaaaaaaaaaaaaaaaatagcaaaataccattgactgtaatcaccctattctgccatcaaatactagatcttatttattctatctaaccatgtttttgtacccattaactatccccatttccccctccctcttaccctttccagcctctggtaaccgtctttctattctctatctccatgagttcaattgttttaatgatttttggatgccacaagtaagtgagaacgcgcaaagattgtctttctgtgccttacttatttcacataagatactgatttccagttccattcacgtttttccaaatgacagtatctcattcctttttgatggctggatagtactccactgtgtatattttctttatccatttgtctgttgatggacacatacgttgcttccaagttttggctgttgtgaacagtgctgcagtaaacatgggagtgcaagtacctcttcgatatactgatttcctttcttcacccaggctggagtgcagtggcatgatctcggctcactgcaacctctgcctcccaggtgcaagtaattcttctgtctcagcttccctcccgagtagctggggttacagatgagtgccaccttgcccagctcattttttttgtatgtttagtagagatgggttttcaccatgttggccaggcttatcttgaactccagacctcaggtgatccacccgctttggcctcccaaagtgctgggattacaggcttgagccaactcgcttggcctatttttttttttttttttttttttttgagatggagtcttgctgtgtcacccaggctgtgtgtatacctaacagtgagattgctggatcatatggaag

SEQ ID NO: 46011 - DNA, 1055 bp, Homo sapiens
gcaggtgaatctcctgagggcaggagtttgagaccagcctggccaacatggcaaaaccccgtctctatgaaaaatatgaaaagaattagccaggcatagtggcaggcgcctgtaatcccagctactctggaggctgaggcagggagaatcacttgaacccgggaggcggaggttgcagtgagcctactaagatcatgccactgctctccagcctgggtgacagagtgagactctgtctcaaaaaaaaaaaaaaaaaaaaaaaagctgaggtatagaattgtattcatgttggtttttaatataatttagaaattatggtgaagccattcattgattccacataatgctttatttgcaatgtcttacagtaattttatttattctgtaggatatataagccataattcgtgcagtttcttatgtctgtcttgctccacagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaaggttagtttctagtagtatcaagtaaaattaaaacactgttttttttttcttgttacatatcttgatgaaaagaggtgagtaaaatatccacaatcagagaagttgtaaaccacccaataggttattcaaaatgttctttctacacaaagcttgtacagtacatttttactagggtcattatttgtagaagaggaagcacatactgaatcagcaccatgtcccatttatttatgtgtgtgtggcctgagaattcatttaattcacttggaaagcagtgacaggagtatatgtgaatccactggaatttgtttttttctcccatttttaattgtgaaatattttatgtgtaaaatggaatgtgtaaaatatatgtaagttatgaagagtaataccaaaagaagctaagaaatagaatattaccaataatttccagtttctaaaatttaat

SEQ ID NO: 46012 - DNA, 1051 bp, Homo sapiens
tactcgggggtgctgaggccggagaattgcttgaacctaggaggtggaggtttgcagtgagccgagatcgtgccactgtactccagcctgggcaacagagcgagaccctgtctcaaaaaataaaacacaacaacaagacttttggacatttggaagaaatatgggtcaaggaagatttctttcccaaaatgaaacctagaaaatggaggctagttgaaatatatacaatttcagcttgaatccaggcttcacatatcaggctctttttagacctgtgtcattttccaatttcaaagttatcagttgcccaagggtctttctgtgccatgcaaagatgtgccccagttatggtacttctcctttctttttcccagtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtaacaaagtttccctttaaataaactgttttttttgtttgtttgtttgtttgagacagagtcttgcactttcgcccaggctggagtgcagtggcacgatctctgctgactgcaacctctgcatcccagattgaagcgattctcctgcctcagcctcccgagtagctgggattacaggcacccgccaccacacctagctaattttttgtatttttagtagagacggagtttcactatgttggccaggctggtcttgaactcctgacctcgtgatccgcccagtttggcctcccgaagtgctgggattacaggcgtgagccactgcacccggtcaatattttcttatataatccttataaaagggttgccatattcctgaaatatttcattaaagtatgacaagactttttcctataaggttgaaagctcttgcttttaacaaactcagaaaaacccaaaacataccccttatc

SEQ ID NO: 46013 - DNA, 1050 bp, Homo sapiens
cgacccaggcaacatggcaggaattcatctctacaaacaattaaaaaacaacaacaacaaaaaaaaacattgtccaggagtgggtgccgcggacccgtagtcccagctactcaggaggctgaggtgggaggattgcttgagcttggaagcctgagaatgcagtgagccacgattgtgtcactgcactccagcctgggcgacagagcaagaccctgtctcacaatagcaagaacaacaaaagcaaagttgaattaaaatttttctgaatattggaaggtagttgtcagtgctatctgaagtgggttttttatttaatgagaggagtgaagttgtttttttctaagaaatatctttttgctaggcatttcagtgttggcttccttttagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactggtaggaaaaacgcctctgcatgctgcactcccctaataatagaaatacatatgtcacttgcaggtgtctctagaaactgtggaatttgggtagtaaggttttagctggacaagtattgtatgatttgcatgagccaactttctaaaagattattttctcaatagttaaaaaaaaaaagaacggaatagaacaacattctttttaaatagaggttttgtctatcccactttgtttccaaaaggaattagctagagaacgttttgtgactatgaagctgagtcatgttgacatgtggcctcttctcctctccttggtggtccttcacatggatgattgggagggcctctgaaggataatcccagaggaaccagagtctccaaaaaaatattctcatggctctttgaaccatgcagggctggccttaaatagtccctgctgtagctgaaatctgcagccagccctctgtgttcactccatcccaactttctttcttctgtagcagaa

SEQ ID NO: 46014 - DNA, 1044 bp, Homo sapiens
aaatttaataataatcagctatatatgccttctttggaaatatgtctctgtacttgagaacaggtacaattcaacagtgttgtgatgccattgatcacctatgccgcatcattgaaaagaagcatgtttctttaaataaagcaaagaaacgacgtttgccgcggtaggtgatcttgcttccttttccgtcttttcccacaacataaaactaattcacagctaatgaaggacaacctgggatggatctgtggaagtataaggaattacttcctaaacaaggaatgtgtggaagtctgaagagttcgttttccaaaaacgttaaaaagctttgtgtttgaaaatacttggtttaagggataaggtataaggtatttgatctgggttgagatagtacatacaaattgaaaattagttttgtaacagacgttttatttaatatgcactaattttgaacatgttttgatgtggatgatttgactagaatatgcatgaaccattattccgtaaattttgaagtgtatgaactgaatgttcaaatagtaacattttgacagacatggaattataaaattaggaaatgaaactgcttagagccaaccaaggctgggatgttggccagtggtttccagtttttgcccttattccatcctagtggtgttgccttctccagtagggtgagtgccctccataagcccctccagatctctgcagggtatctggggacatctgttatccatgctagtgaccgccactctggagaagcacagtcccatgtggactggattattaatattttctcagttgttttaaaagttgattcttccagattctactattaacttacgatatcagtttagttcattggttctaactttagcatacattagaattgcctggagatctagttaaaacacagattgctgggctggccccaccctcaatttctgtgtacccctggggtagggccagataatttggatttataacaagtgcacaggtaatgttggaacagctgtccagggaccacactttgagaagcactgc

SEQ ID NO: 46015 - DNA, 1019 bp, Homo sapiens
gatatacatggagagtctggccttagcacatgcagatgagaagtccttaggtacgttttgcttcagtgttctgtgtgcgttacaggtctgaagagtttccccaatgaggagttaaggctcgtgtgattctcttataaggttttttttttcccaagagttctataaattaataaatgtgaagagaatccccttcagtgcctcaaacccagcttgttaataattttttcatgcccttattttctttgactcaccatgtactcctggtggccattgaggttgaccctggttggttgcagattctgcccagggcaggggagacaacgaagccagtcagacactatgatgctgtgatgacagaacatgaaactgtgcagatatggtgctgaagaaactggatgtggtaaccactgagatgtggtcagtgcctctgcactcactcgtgatcatttagaaagtagaaagtggatctcattacaggactgtgatagagttgtttcatccatgatgaaggaatattataaagatattaagtcagaagtaggctaaaatagctaagagagtaataaatgattacaattaaattctatgcaagaagctattaggaactacatagagttgttgagctagaagacttcttaactccccgttggtcccagcacatgatgtagttggggcacagaggctcaggcgtgtcattgactgagacggccacacagctgtggcaggagtttatcactgatacgggtcttgacttattttattttatttgtttattttttgtgatggggttttgctcttgtcacccaggctggagtgcagtggtgcgatctcagctcactgcaacctccgcctcctgggttcaagcgattctcctgcctcagcctcccgagtagctgagactacagggacctgccaccacgcctggctaatttttgtatttttagtagagatgtttctccatgttagcctggctggtctataactcctgaccttacgtgatccacctgcctcagcctccc

SEQ ID NO: 46016 - DNA, 1027 bp, Homo sapiens
cttaggatatagccattttcttttttttcagggaagggaaagattgttttgttataattaaagttttctctcccctcttcatggcttttcagtttattaatttgtttaaaagaaaatgttttcattatatcagaaggaaatagttattcaagcctagattctggatacactatggagattggttttactaatgtttatttttttcttgactagtgctataaattaatttttaacatactttagttatgctcagagatagaccaagggtattcagttgtcagtggttataaaaattagtacaatcaaggtctctttgttttgtttcaggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcaggtttgtaagctacacaacagagaagagaaacttgtggttttgaaaggtgacttggagtttcactctgtgtatccgtgtgtcatatttcctgcatttagtaagtaattatgtgctggatgctgtgctgtcttctggaaattaaaaagtgaattaaaattcagtttgcactccagaagcttggaaactgctgagaaatgcatgtaaacactgtctcagccattttggaaatgcaacaaaagacacatatacaggggctttgggtgcacagaggaggagtagctgatccagggtgagcaagtttgctgtggcctcttgctagggtttatattggagatgagacttgaaggataaatggaagtcagccaaggcattttagatcaaagttagtgggtggtgggggggtagagataagaaataggaaggtgtctgaggcgataaagtcctttgaggtttggaggcaggtgtcgtgaggc

SEQ ID NO: 46017 - DNA, 1193 bp, Homo sapiens
ctgttctttttcagtgtgcactgatttcatattgttcaagcacacatattttacaatcaatttgtacggtagtggtcctgaggtgatgtacattctcagcttacgaagataacaggattaagagattaaagacaggcataagaaattataagagtattgattggggaagtgatgaatgtccatgaaatcttcacaatttatgttcagagactgcagtaaagagaggtgtaagaaattataaaagtattaattttgggaactgataaatgtccatgaaatcttcacaatttacgttcttctgcctcggctccaaccggtccctccgtgtggggtccctgacttcccacaacagaagaaacatcaggcataaagaggattgtggctaaaccaatcctaagagtgttatggctgaagatgggccagggtgaccagacactgcctgggggctggggggagatgaggaattagattatatatcaaggggaggagttttcactgaactgactcagcggagttcttggtgaaactggactaatagagatgaacatggaagcccagaaatcaaggcctagttgagaagagttcagaggagcctgactagagttagggtaaggaagaggggctttgtcacaagtgaagaaactaactgtaaatcaataagatttagaaggaaaaacgaactataaataaattacagaaaaatgtaatgaccacatagcatatctgtctgtgtatatctttaggtcttttttgttgataacacatcagtttataatattaaaatgttcaaagataaaaatgaacgttcacgtcacccctttcacctgcttgttccctgggaaaagatgttagatcctctgtaaagtctggagaatgtctttataataacacatcttgacatgtgcatagatgttttgttaacaaaaagtagactcgtagcatttcaaaacgttttcttctgtgtgcagtgtgatttctgctccttggatggatttcattacttttctataatcagcatccttctgtgtctttctataaagtttgtacagatagggagacacataaaagtgttaatgtattgatagttttgaccttataaatgtttaagactactgaatggcacaaaaccaacattgtaacatgtataatgtgcaacatactactgaagagatcagattttaaaatggacaaat

SEQ ID NO: 46018 - DNA, 1050 bp, Homo sapiens
aggtatgcgtgtattaatttgtaaattttctatagtgcttcaaaaaatatttttacttaaagtgatagttgaaaatgtgctaacagatgaagcaaagttatatagttctttaatatggcaacagtgaaatatacttcccagtttctaaagcttttacattttaattctttgttcttggataaaaaaacaaagtgaacagaatcattagttttatagaacaagaaatgttaattccagttaatttatatttgggttacatgatagttatgtgcaatgaaatttttcttcttaaaggctaaattgagtgacatttcaaatattctcttgtcatcaacgtgataacttaaacattgctgacctcctggtctgttttaggttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtaagggctttgaatctgaaatagttgtaaaatttctaaaagtttggtttgtctaattcagtggtcagcagagcagtggaattacctggagatggttaggaacgatactgctccctgactgctaccccaggtgctctggtttaattggtcatgggcatgacctgggcaccaggacttctaaaagctctcccctccactttcagtgtgtctcggagtttgggaatcgctgttgtagttaaaagttactgagagtccaggcatctaaaggtgaattagctgtcacccctctcatggacaaacgtagtctttcacaaagggaagaagagagaaataaccatgggccgcgcgcggtggctcacatctgtaatcccagcactttgggaggctgaggtaggcggatcacctgaggtcaggagttgaagaccagcctggccaacatgataaaacccccgtctctactaaaaatacaaaatttatctaggcgtggtggtgcgcatctgtaatcccagctacttgagaggc

SEQ ID NO: 46019 - DNA, 1059 bp, Homo sapiens
tcccaaagtgctgggatcactggtgtgagctaccatgccccactgtgcctggccaaaagtctacatttttgattagtaaaaattcctctgtatttttacttttgaaatttggtgttaaatataccagtgacttttggttatttagggagttagagcctgtatttggaaagtgtttcaaagagattttttttttaagtaaaaattttgttcattgactttcttctacaaaatactttaagtaactcttactgaatttggatattaaacatttgagactattaggcttgtttaaaagtaattttactttaaattaaatcgagtgatttctgatgttgtaattacatatctgaggcaaaagaaaagggaaagatgaatgaagtgcttcactttaatagaatgtagaacagctggcattagaaatgttttgatttgtgaataattctgacactaataaaaagaaaaaaagtgtttcattcttcttaaatcttttctaacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagtacttctatttttcatttcacccattatttagatcctattgctttaaaaatacatattgcttaggatatagagaacatgtttcagccattccaatattagtaattttgtattttctgtaatatagtaattagaaaactacttacttattagaagtcagtgtcattgataaatgtaagttaagtataaatcatcttaataggtaattgggctgggcatggtggctcatgcctgtaatcccagcactttgggaggccgaggcaggcagatcacttgaggtcaggagtttgagaccagcctggccaacatggtaaaacctgatctttactaaaaatacaaaaattaggtgtgctggcatgcgagtgtagtctcagctactcggtaggctgaggcaggaga

SEQ ID NO: 46020 - DNA, 1034 bp, Homo sapiens
cctcttgatgagttttgggctgtgcctttttgacagacgctgggttctcttcaggacacttggtgcctttgctggttgtttccactgtaaccatttggtcagtgtttgcatcatctttttgtggttgtcaggttactgtttttctctctgtgtgagttagtaatttgaggcattccatgctccactttctggagtgatcagtcctgaggcctttaggtggtacagaggaaggtagatgctgggcagggggaggtcccaggtgctcccaagggtgtgaggaggtcatcccccatggggtggcctggcatggggtttacccaagccagatgaggcacccacgtgttgggacagctgtctgggatgttggggtgcaggcagggtgagaagggcgatggaggtagtagtttggttacatacaggagattgaacaaatacataaattcattgagaataagggaaactaggtttctcatgttgaagtgagctacaaatacagaaagacaggaaactggaatggacactgtggagttgcattggaagtgggtatatcagtgtgaacccatggtcctccgtctccctctgcctctccccagttatatatgtgcattcacttatggatgcatctaaataaatgtgaaaatagaactgagagagagagagtgtgtgtttgtgtgttacatgtactctggccactgaagggacctctaggagtgtggtatctgaatagtaacaagcaaacctggcacccaggtcatggcctccaaatctcattttccttttttttattattattattattattttgagacagagtctcactctgtttcccaggcgggagagcagtggtgcaatcttggctcactgaaacctctgcctgctgggctcaagtggtccttccacctcagcctcccaagtagttgagactacaggcatgcaccaccacgcccagctaatttttgtatttttagtagagatgggggtctcactatgttgaccagactggtctcgaactcctgacctcaagtcatctgccc

SEQ ID NO: 46021 - DNA, 1031 bp, Homo sapiens
caaaaaataaataaataacaaataataaaagacaaaatctgtaatcgattatatagatctttaaaatatatctaagtgtactaggttacagttttcattttttatatttaaaagatcctcaggtagagaaaaatggattatagatataactaaacattttaggatacctcaaaatgttacgtgatgggtttgtagcttagttgttcgattatgtcccttacaattttaagatcagaatgatacaaatttctaccttcaatttctaatttgtttttacagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgaggtgagtctttcttgcaggatgttgaatcttgcgtttttttaggtcatgagtatatataaatgtatcataaaatatgtgattgtggcctatgcagttttaaagtctactaattttattctatgtgtttaaaaaaattgatatgtgaatggcagttggatagcactctaaaaagctagcagcattttttgccctgatgctcaaacacctggctaattatgtaagattaacaaggcctctcaaagtatggtcccaggaccggcagccttgagcattgctttctgcatcacaaaccttgggggcaggtctctgctgccctgctaagcaccaccaggtgattctggcacccagtgaagtttgagaacaactggattagcattctcgacgctccagtcagtcacatgaggagcccacctgggtaattacagggtgagatgaggaagagggaatggacttagctgtgtgcttggcttctcactagctgccaccttccctcctcttgttctgactagcctgtgccttgaaatgtctgcagagctgattctgcctcctgtcttcattagatgttggtaacttgaaatggattcacccctct

SEQ ID NO: 46022 - DNA, 1035 bp, Homo sapiens
gctggagtgcagtggcacgatcttggctcactgcaaccttcccctccaaggttcaagcgattctcctgtcttagcctcccaagtagctggtattacaggcgaccgccaccttgcccagccaatttttgtgtttagagtagagacattttgccatgttggccaggctggtttcaaactcttgacctcaggtgatccgcccaccttggcctcccagagtgctgggattacaggtgtgagccaccgcacctggccttagctttttaaattatgcttttttaatacgatgtcttccttaatcatatggtctcctatgggtggcagtttaatttagaaaattctgaaaaccagcatgttctggcagcagtgctgcttctgagaatccatcactacatattgtcatgctgtctttctggccagggccctgagtctgaatctgaagaccaccgtgcttcaggggaagtcagaactggcaaatggaaggtgcccacatacaaagactacgtggatctcttcagacatctcctgagctctgaccagatgatggtaacatttaccattgaaagccataaatgtaccttacttcctttattagtctccatagtttagacataagacttatttcagaattatattttactaactttcaaaagtttaaaacagtgtacttcaaaaataaaaaattaaaaccgtatgaatcaggaagttagaatgagagtggaaataaatgaattgaaagaaacacagacatagaactcctttaacattagttactgtagctgagtcctcattttagctttaaatagcaggatggtatagctcatgctaagctgttcttcctaacaggtccagcctgaggatggatatatatgtatttgtacgtatgtatgtatgtgtacgtttatatatgtgtgcatatttagttatgtatgcacataagtatatgtgcatgtacttacatgtacacagacataaaagatatagtgtctatatatgcatattacacatatttgtgtttatacatacacatccacagat

SEQ ID NO: 46023 - DNA, 1035 bp, Homo sapiens
gttctgaactctgtttattgacgatgtctgaagtcactggtcccctgacagctctctttcaccctgtgggtgacaggtgagctctaaagactgctctttgcttcctcagagagccttaattcaaaacctgtttttggttttttttttttttttttttcagacttatgtgtatccttggtctcttagtcccttctctaggaaaaatgtatcacatagccttatttaagacacttttctgaacctgatagagactaagcaaaatggaagcaaagggtctttatgattaaaagcaattgcgtgtaactataacagtacattagtagcatctaaacagttctagtttttccatgtttgtatagattccattgctattaaatatttccaaaaaaataaatattatgtatttgcaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggagtatgtctcattaacttactctattttgtcttggtttcacgtgattgtttaaaggaatctaattcattgcattttgaatagtgtctaatacttgtaacaatacagtagacccttgaataacatgggcgtgaactgcacaggctcacttacatgcagatgtttttctaccatacggatcaaaaatacagtgtgtgctggatgtgaaacttatatagagggctgaccttttgtatatgaggcttccacagggtgactgtgggacttgagtatgcatggatttaggtatactgaggaggcctggaaccaatccctcccgcatgtactgagggtcactgtattagtattgtttattaacagttaagatttcttcagtgtctgctgtgtactagaattctttacatgtggtatctcaaaatctcctaacccttaggagctcagtattactctgttttgcagattagcaaactgagatgcagag

SEQ ID NO: 46024 - DNA, 1066 bp, Homo sapiens
gtgataacatctgtgatgtttcacacacagttatttacagggaggctttcggtgacttagtaagctctggttgaaatgctgatactcaggttacatggttgaaagcactttattttagggtatctttcaggggatccaggctgtttgattctgactttgcctcaatgaatcctgattccacttctgacccttgttttgggatttgtcagccaagttatgggcctgttaattggtagtgttagagctctgacaggaatccctgggttactgtagtgtaatggtactagatcttcctgagcacagtgttgactttgacatatccctgcaggtttgttggttttctgttctgtgttatgtcgtctgattttaaatataatggcatttgcatttgcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtaccacaaattcaactgtcatttaacaatatttctttcacacacagaattaaattccctttgcatgcatgcatgtttgaaaataaatacaagttgatctgtagcttctgtagtatttaaagcagaaagatgttgatcagccagccatatgggaggcagccagactgaaagagagctagggagatgccagatttgattagggcctcagagcctagattgagacaagtgtaatggagcaaagacgtggtgaggtgatggccggaagggctgggaggtcagggctggagagtgggtggagggctgaggggagccccatctctcctggaagaggagggctagctgtctccaggggatagatgcttgtgtgtcaacttgaaaacaaggggtgcctctttgccattgtggattttccacctggataggaggtggttacagaatctgtacctgcgtatgtggaagcttgtctggtcggctgaggagaccgtgcttgtcattctgagcactggtctccagg

SEQ ID NO: 46025 - DNA, 1040 bp, Homo sapiens
tcctgacctcaggtgatctgcccaccttggcctcccaaagtgctgggattacaggtgtgagccactgcacctggccaagagggggtttaaaaagtagaagtaggccgggcgtggtggctcacacctgtaatcccggcactttgggaggctgaggcaggtgtatcatgaggtcaggagttcaagaccagcttggccaagatagtgaaaccccatctctactaaaaatacaaaacaattagccgggcgtggtggcaggcgcctgtaatcccagctactcgggaggctgagacaggagaatagcttgaacccaggaagtggaggttgtggtgagctgagatcgtgccactgcactccagcctgggtgatagagtgaaactcggtgtcaaaaaaaaaggatagaattttcacacctatgttcctagcagcaagtccatagtgagccaaagggccagaaccacccaagtgttcatccagggatgaatggataagcaaaatatggcacgtagacacaatggaacattacttagacttaaaaaggcaggaaagtctgacacatgctgcagcatggatgaaccttgcagacaggatgctaagtggaataagccagccacgaaaggcaaacaatgtgtggtttcactcacacgaggtacttagagtagtcagattcacagagacaaagtaaaatagaggttactggggctgggggaggggaaatgggagttagtgtttgatgggcacccttctgttattgatggtgaaaacattttgggtatagacaatagtgatggttacacaacagtgtgaatatgtttagtgccaacgaattgtatctgtacacattgtttaaatgataaatatgtctgttttaccacattgaaaaaaacagatacaagaccatgcttctacagggagtgggccactagagggaggggctgcaggagagtggactgtggagggcagagcctggagaagtctgtccttgctaagtccccaccctaaacccactgtgtactgtgggtgtccttgtgtctgcacacttg

SEQ ID NO: 46026 - DNA, 1922 bp, Homo sapiens
cctcccaaagtgctaggattacaggcgtgagccactgtctggcgggaatcagttgatacgttgcagttaagtggttgttggggtcactgtgacctgtttctgttttttttgtatttgtattttagaattcctttgtttctggttgctccttggttttgtaggcttctgggagaaaggttctagtcatgttgttggtttcttgggaacgtaacacacctagagcattcttcccctgatgttcttccaccatacccatctcaacctctaattcccagataagctgggtggatgtgaatcctgtgagaccaagtgtaaatccttgagacacacctaattctgaacctttgctgtggacagatgcactgagatagaggaatcccgttatttccctctttagagagaatgctaatttgtattgtgttttttttcttgattcccgcactacattgatgtactaatttgtattcttttagttacttcagacttttagaagttctagactcatggatgaatttaaaattggagaattatttagtaaattctatggagaacttgcattgaaaaaaaaaataccagatacaggtgagatgcatttacatgttattttcaaatagtttagcaaattaatattaacaaattattagcataagacttaggttttctctaccaaggtcttattttacagtcgaatactttttgctgaaaataaaccaaaatggaaccaaacaaaaacaacatgtgaagacttcccttcacaaaaatgttaatttttacaaaattattcctgtaaatagaaaactcacaagatatgacaaatatgattaatacatttgcataaaacttaggaaagaatgcagtcctaaaagctttatattttatatctcttactgtaaaatcaattttgaactttattttattttattttcttcatacattttggttagtttaacttatttaaatgtagtttgaggccttcacttgtctaaaattttcttttcagttttagaaaaagtatatgagctcctaggattattgggtgaagttcatcctagtgagatgataaataatgcagaaaacctgttccgcgcttttctgggtgaacttaagacccaggtatgatgaactttatgacattctgcttccatagatgtggttgtgtttttctcttgtaatgacatcttcttaaatcttttcttttagatgacatcagcagtaagagagcccaaactacctgttctggcaggatgtctgaaggggttgtcctcacttctgtgcaacttcactaagtccatggaagaaggtattgcttggcttcacttgattttctttattcaaaaactgtaagtctaaccagcaatgcctgattatttctttgaactcttaaccaatcctgaatttacatacagtagtgagaaataatctagagggacctgtgggccctcccgagttcccctgatgatgacatctttcccaactacagcacaacagcaaggtgggcattaacattgatgttgtccactgagctttgtcagatctcaccagtttaacgtgcacacatttgtgtatgtgtatttagttctgtgcagttgtttaaaattttatttattttttttgagacagaatcttgctctgtcgctcaggctggagtgcagtggtactttcttggctcactgcaacctctgcttcccaggttcaagcagttcttcacttcagcctcctgaatagctgggactataggcacgcaccaccacacctggcaaattactttctttttttttttaaacagagtctcgctccgtagcccagggtggagtgcagtggctcgatctcaggtcactgcagcctctgcctccctggttcaagtgattctcctgcctcagcctcccgagtacctgggattacaggcactcgccactaaatgg

SEQ ID NO: 46027 - DNA, 1024 bp, Homo sapiens
ttatgatttctttgcattctggctttcattgtagctattatgtcaactgacagccattcctttgaaggtcatctgtcttttacttctgtgtgctttaaagatttcatcttgacattgttgatattcttgtcttggcactgttaattttctgtagtttgatataatgtgcctgggtatgaatttcttttcatttattctgcctattcttgtagctgtgcgggttcatctctttcatcagttctagaaattcttggctgtgttttttcttacaaatgttgtctcaactttatgtttctcagcattgaaatctagatttccttagataatatcttcttatcacgaatcttctctttagttgctttaaatctgctgttaaacctttacattgagttttaatgcttgttgtattttagtttatagttctgtgttttcaagtctgcctgtttgtttttatggtcttctactctttattaatatgttcaactctgtaaacatactgcctaattctattctatgttggattccagtatgtgaacgctcaaagtgggctcatgttcataaggtttgattgctagctttcataacactgtttctgtttcttttgtattttgtgggttttgactgagcttgtattgtaaactgtgggaattattagaggccccaggttgtttttgccaaggagcactgccaacttatgacctttttaaatgctccacctaaaagttttttgtgccatccaagtagagtggcccaaaaatccatgtgaaggctactttggagatagcacgcctccaggaagatttgtttgctgcctccccgtagcaagctttgaaataggtcattttacttgtgtcttctgggttgtataggtaggtgggtgggtggaagtggaggcagggggcagaattatttctagttcatccttaagatatggctgtggctttatacaggagatttttgaaataagactctctcataagaaaggacttttctttttcctgtatccctgctactccaattcctg

SEQ ID NO: 46028 - DNA, 1048 bp, Homo sapiens
acaatatggaggatgtttaaataattaggactgagacttatctaaaaggttttgtgtcattcaaaagaacttttttttattaattgtttgagacagggtctcactctattgcccaggctggagtgcagtggcatgaccatggctcagtgcagcctcgacctagccagactcagatgatcctcccatctcagcctactgactagctgggaatacaggcgtgtaccaccatgcccggctaatttttctcttttttgtagagacaggatttcaccatgttgcccagagtggtctcaagatcatgggctcaagtgatccacctgcttcagcctctcaaagtgctgggattacaggcttgagccattgtgcctggcccaaaagaacttttaaatgaagctcacatgaatgctactttaggagtcctgagtgttagcagctactgaagtcaagtctgaatctttttccatgctgggtccagttggtcttgataaatttctggtattcctctgatgatttaggattgaaagatacatcgctggaatagcacacagtgttggcaaaggaagaacataattacagtattggcaaaggaagaacataattacagtgttgacagagaataccagtaacagaaaaattcaagagccaagatcagcggaaaagactgatatagtttctatttcctagctcctttataatttctaaaactttagggtagatttattcttcactctgtccctttacagagccctctcaggcttagttctgggtgctttcttctactcttggtctttgcatgtcacgatgggctgatgacatgagattagcatctccagccccgaccttgcccctgagctccagagtcataatcttatggtggcttatggtgggaaaggcagcacacactctgcagtcaaaacctgcattcagtacgtaatctcctagcattcagttattacttgtaaaacattgaaaatggtgacgagtataacattgtagttattattatctctgaaatctccactttggataaatgatagacaattcacat

SEQ ID NO: 46029 - DNA, 1046 bp, Homo sapiens
agtatgtcaattacttttccttatctgcctaagagagtctgagaatattcattggattttcaggtttaaatcaataaatgattataagcttagaatgaatgattttgtggttattatacacatttcaggactgttgatttttttttccttctgtatacatataacatttttggtagtgtaatttaggagtgtgggtcatctctatcttggaaattttgttttgaacattttttttttcaaagaataaaaatgattgctactttttattttacttacaaacataaaattttaatgaactcctaaatcaagtataacaattagggaaggaacacgccaaccattcttttacgagtaattataaacacatattaagtatcattttagtagactttttgccatttttttccttctcagatttcatttattgtgtcgttgatataaaaaggtagatttcagattttctctttcaccatttttaacctatgtgtgtaattttataaatagtgtagtattattttgtgataaactgagaactttcgttgaatttattgttcagtcttagagattatacagaaattgtatttgtagtttaaaatatgtcctttacctctataggtttatggaaacttaggtaacatacagttttcagaagatagtcaaggcctaaggaggaaaaatgtttatttttttctctactttggaagaatcaataggagttgtaatttactgtgttcgataacatggtagccaccatctgtgtcttgaatcagtcatctagttattcacatatataaatatatatataaatatcagtaaacatttacctgaattcttttttttctttgagacagggtcttgctgtgtcgcacaggctggagtgcagtggccatggtcatagctcaccgtagtttacagcttgtgggctcaagcgatcttcccaccttggcctttggagtagctgggactataggcgcgtgctaccgtgcctaactgatttaaaaaaaaaatttgtagagacagggtcttgccacattacccagactggt

SEQ ID NO: 46030 - DNA, 1117 bp, Homo sapiens
gaaatgatggatcttgaattatttcatcttcagaactttatgtattgtgaagtactttttgcctgtggctatgttctgtaagttagctttacacaaaatactaaaggcacagtgaacttcattcaaatgcagtgtggaactctcaggtttccttggtctgcctcagtcttctactcatcagcaccacactgtcaaaatgttggacattacaaggggcgaacatagacataaataaaaaatattggtattgcatagacacttgatgcctaaacctaataattattaacttttatgtgcaagcttgggttcttgactaattggtaaatgataaatgaactagattagatccaattattagaaaagcactcttaagagtgcaatgaatgtgatttgaaaacttgaaagcagcctagattttactatatttgttattgttatcaatgggggtttgtcaaccttaaaaattattttttatgtaaagatacctaggaatttctaataactgtatttgttttaataaactttgactttgctgtatgtttctatgttctctttaatatttagctattaaaggtcaatattttctttttttaaaaaaaaagttacaaaaattaagcccttgtttcatagaaacatctttacattggcgaatacaaaataacattggaattcagagtcaaattcatgcctcagttggcctgttaatatcatcatcttttggataccatttcacttttttccattgacaacttgtacctattagctatatattacttgtttatttatttgaacatttatgttttttttaatctttcagtagcccattgttttttaattgaaaaagttatacacgcaaatggttaaaacaaattttatacaagagcatataatgataaaaatgtttccttaccaccctagatctcttagtcccctttctcagaagcagctatgtatgctttttcagttttctgttttattttcctgttgttctatttaatacagataccaaatgtgagttgtaataatcagcattgcattacatttttatacacttaatgcattcaaggtgtatatcacattctaaataaatgagatattggtgacattgctatttaaa

SEQ ID NO: 46031 - DNA, 1048 bp, Homo sapiens
tgttttgtgtgtgttttatgtcatggaggggaaggtatacatccataaaaatcacttagaactggatccagaggaggatgctcacatgctccctgtgattattgagtatagtgaatcaaatttggctccactgcttcacagccaccttattaacaaaagttctttattaaaaacaaaaaactataacactatggctcagccatttttcttttccactcacaagatagggataacaggtgctcccccataaacagtgggtcctatgggtactacatatttagtagtaaactctgggggagtcccggccaaagcagggagagcggggtatctgtgatttggtaacacagctaaggaagataccccttggggaatttccacttgactccagaaacacaaatccagaaacaaattcagtgagagtggggcatctgtgatttggtaacacagttaaagaagatactccttggggaatttccacttcactccagaaacacaaatccagaaacacgaattcagtgagagtaagttaggtttttcttttattattattattattaatttattcatttatttttaggtagggtctcactctcttgcctaggctggagcgtggtgacacggtcttggctcactgcagcttcgacctactgggctcaagtgattctcccgcctcagcttcctgagtagctggtagtaccaacacgcgtggttaatttttgtattgagttttcttcagaaaatttcttaggattaaagcacactttagggaattattcataaatttacttttatcgaagaaagtggagaatagatcaactcctgagatgtctcattgagacatgtttttcaatttcaaattgaagataattcatgtcctgtttgcttctccttaaatattttccctgaactaagggttttcgtaaagatctagtacttagttgattctcctctcagtactgtcgtttcattctcagggaattcctttgaaaaacaggatgcaaataaagcagcctcccacgtcctgtattttacctctgctttccataac

SEQ ID NO: 46032 - DNA, 1035 bp, Homo sapiens
aacccctttaattttacctttacttgccaattttgttcaaataatacttgtaacacagtttgtaaagataccgcaaaccttgatgccaaagcatagcagtccctggcttcacctgttttcacccccagcctcacattccagaaggaacttaacacatatagccattttgtagggtatttaatgtacacattgctaactaagatgctgcttttcctttttattcattacttttggacagatttactttctgtcatcatagataaggttttagctcccatgcccctcttttcctcttctctctcactcagtgtggttaaacgagtattaaaactaaataaggaattatgtttatagtattttgactatgtaaactgtgtcattctcccacacccccccacaccaagtaatacagttctctttatagttttggtttttccttaaaatcctatttaatctttagcaaagaataattgtatatttatggggtgcgatgtgatgtttcaatatatgtttacagtgtggaatgattaaatcaggccagttaaaaaatttgcctctcaaagctatcattttgtatggtgaaaacatctacaatttacagtttcagcaataattgtttcagcaatcacagataacacagtgcattgtgatttattatagtcaccattctgtaaagattactaaagcgtatttctcctgtctagcagaaactttatgccctttgaccagcatttctcctttcccccatctaccctcctgccccagcctctggtaatcatcattctatgctctacttttgtaagtttaaccattttaggttccacatgagtgagatcatgtagtgtttgtctttccatgcctgtcttatgtcttagtatgtcttatgacttagtgtaatgtcttacaggttcatacatgttattgcaaatgacagaattacccttcttttaaaggctgaatagtaatccatttatatatatataaatggattttatatgtatataatgtaagtctatatttatctttttcttcttt

SEQ ID NO: 46033 - DNA, 1050 bp, Homo sapiens
tgagaggctgaggcaggagaatcgcttgaacccgggaggcagaggttgcagtgagctgagatcgtgccactgcactccagcctggtgacagagcaagactctgtctcaaaaaaaaaaaaaaagaaattatgaaaacttttttgtgaaactgttctcaaatattgggactgagcgtactcttttttttttttaatttattttaaacgaggaaaatgattgcatggcttgataattaccataccaaatgattgatagttttgtttttttgcagtttctagttgctacttaaaattgagtttcagggtgttcagttagtttatacatagttattgctttagttagaggattttagactatcttaagaatataaccttgcgttatttacctgtaagagaaaataaattccaagtctgtcaagtaataataagcatatttcttctgctgatcctttctgccatattgtttcttcacctgtatgctggatgagaaatgggagaagggatggatttgggctgccggtatacattttaagatggattgtatctgattctctatggaacagcattaccctgaagagtaggagtcaaagtttgggtagtgtgctaggcaaatagtagccccccaaagaggtccatgttctaatccctggaacctgcgaatatgtgaccttatatggcaaaggggaattaaggttgcagatgaattaaagttgctaatcagtttaagataggaagattatcctggattatcccgataagcccagtgtaatcataagggtccttaaaaatggaaggaggaggcagagcgagagaaccagagagacagcagaaaaggaatcagcgtcatgtttcttgctttgcagatggaagaaagaaagggccatgaggcaagagagaaaaaaaaaaagcagatggacactagacactgatgcgagggaacagatttctcctaaagaaccttcagaaaggaacagtctccccaacaccttgatcttaacccagtgagacttgtatcatgaagcctgtgtcagacttctgacctccagaacta

SEQ ID NO: 46034 - DNA, 1044 bp, Homo sapiens
tgcctgtaggtgttaccttaggtttagttcttttcctttttagagtttgttctcttctttggcaatcccacacagatccgtggtttcaactgctcattcccctcaccctctttgctcaggcttccacttgtgtatcatcagccttattttcattcccaagcttcagatttgccaatgttgttctccctgatcaacttagtagctgtcattttgtaatcttgaatcagtagattcagaattaaactttttttgcaagcctgattcttcttgcttgtttatattaatgacctttgcattttcttagtcatctagactcaaaatcaaaaggtcatccttggttcttctctctctccttttcttagaattttttttttttttgtcatcttactgcattgtggttcctgatttcttctatctttcttcagttcttccagcagccatatacacagcaagagacattaatctctaggtttgtcattcattgtgaatactgcttattaattgtcctaaatgtagtcctgatcatgttccctgcctgatgacaagcaaacaaaacaaacccacttgggtgtttatgtcagtcagtgtgctgaatcctttgttctcatgtggtcattataatttatattatccccattctacaggtgaagaaattggaacttcatgatcttgaaggagttgttagtaggtagaagagctctgggatttgaatcccaaccatgtcttcttccaagtctgtgttcttgaccactgtgcctctgctgagtggctcctgatccactctggaagaaagcccgagttcctcagtgttgcctttcaaaactgcattatttgacttcagtgcccctttcaaaacttatttcttgttttagtttaaaatattaagttacattctttctgtcccagcagctgttccaaaaagaatgtaaacttcagttttactttacttttttgatttcttatgcatttccatttcttggaatttttttctttctcccatctctgcctttagaagtcttccatgtaaaagtctagtttatacag

SEQ ID NO: 46035 - DNA, 1021 bp, Homo sapiens
aaaaagagtatcatgtaaatgtgaaatttaatattgcattaatatcttaatatgtagttgagcattaagtatatatgctaagttttcagaatagggggattgaaagtaactctaagtcaataaaattgcatttctttattcagttttcaggtgggagatttggtactcatcatcctagacgaacgccatgacaattatgtgttatttactgttagtcctactttatattttctacattcagagtctctacctgccctggatctcaaaccaggtgagggtggtaagtgtcattccatgactaaaatataaacctggaatggaggaaattatataagtaaagatttttttttccctgtttaattacataagaattaagtcactaagagggaaccctgtgtaatctgcttttttataaaatctgtattatctagattattttcatggattccatttacaattcagaattaaggagtgtagcttatacaagggaccagttgatcagaatgtgcagtgattcggacatctcataaccctagcagttggataattatattgtcaaagttctcatgtacagactattcaaaattaatgtatgcttatttgtttatataaaagcattattttttggcaaaaaaaactttcttaaattataaaatgtctagtctatcctatatcatcctatgttcctaccttgtttatcattatactgttctatacacttatttttttaaaaaggaaataagctttgttaaaatatactaagtaacaatgtctattatctatttgatttttaaaatactaaaaaagaacagaatagatatcctggtgtacttagcctaagtagaattatttttaacactaaaacgaagtaagtccatttagattgatgttcctaatctaattggactgactcgcaacaaagtcaagtatcttatctatatatttataggtagatattttttttcgaaacggagtcttgctctgtcgcctaggctggagtgcggtggcacgatctcagctc

SEQ ID NO: 46036 - DNA, 1054 bp, Homo sapiens
taggagaggtacctagagccaaatgatacagaaagtttactataatatgattcagaaagatatagaagggaaaaatataaaagcaattcaaagcaaaaggctttaaaaagctttaggaatttaaggcttttttgattgacacataaattatacatatttatggtttacagtgtgatgtagttacatgtgtacattcaaattagagtaatccatcacctcaaacgtttatcatttctttatggtgagaacattcaaaatgctcttttctagctattttgagatagcgcagtacattattgaacaccaaaacttattcctcctatctggctgtagctttgtacccgttgaccaacctctcctcatctcctctcctctgtactctccccagcctctggtaaccactattctgctctctgcctccatgagataaacttaagattctgcatattagtcagatcatatgtaggtttttttataaatatgaaaattgagttattcagaaccaaagtatcaaaaacagatatgacgaaagtggtactctgagagaactgtgtagttcctttatttttaaatgaattaataaaaacaaatgagccacaataaaataaaagttgtttagtagatattgggataaatagaaggtacaaataaatatatgtaatgaaaagagggacataaccttagttatagttttaaaaattacagagaacatgatacaagttaatctcacctgtgaattataaatacaaggaatcctgaagacaattttagcttatcaaatgccttgtggttttatgatgatatagtcatcatgacccagtggagtattttaggaatgccagagtaataactaaacagtacaatacctaaccatactcactgattacttgagaaggtttatagagtcatgtcagtagaagctgaaatgacaattgatataatgcagtgcccatttatttaataatttaacaaaatccttagcaaactaggagtagatgggaacttctttttatttgtaagtatatgggagagacatagcaagcatcgtatttca

SEQ ID NO: 46037 - DNA, 1343 bp, Homo sapiens
ccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgag

SEQ ID NO: 46038 - DNA, 1050 bp, Homo sapiens
agattagtgtttgtttaaaggcacacagctgctacagcttattggagtttccctcaatttgctttaagtatcatggaagaggagaatggaactgaggtcgtctatactctaacgatttctaaagcttctgattgaaagcaatatattggctgtagatcatgcagaggaaaagctgaactgtcccagattggaagagattaaatagatattacagctaaaagcaatatgatgatcctgaaataaatcctggatctgaggggcggaaactacaaaggatattattgaggcagtagtttgaatatggactgtagattagataataatagtgcatcagtgttaaattttatgatttgataaatgtactttggttatgaaggagaaaattcttgctgttaggtaagacattctgaagtatttatggataaagggaaattctgtctgcaaattacagtagttcaggaaaaaatatatccctgtgtgtatacgtatgtggagagagagcatgtatggagtgtgcactgacacaagtgataaatagaacacaagtgttcacagttggtgatctgagtaagggggacgggagttctttgtactattcttgtaatttttctctaactggaattatatcaaaacaaaagataatattcaaaggaaaacgagaaaacaaaaaacaatacagtgattattattgaagattttgtgtttagtctcacaaaaatggtgtgtctccttgtactgctttacatcttctcagttcaggcctcttcttatcccaacaataccgtttaaatgtaacccacgtagaggcctcctttgatcacataaatctaaagtaagtcgttcttcctacccactcttttcttttgtgcgttgattacagcttatatcatgtttgctttgttcttgtttaatgctgctttctccttcaagactgaactccatgaggacaaagactatgtctgttttttcccccacagaatacccagtcctggcacataatatcaatacacgtgttttggatttggatgaatgaatgaatgaaggaatatt

SEQ ID NO: 46039 - DNA, 1055 bp, Homo sapiens
tgaacctaatatagccatctcacttgctttaataagtaccaacattttgccaatctcacctttctactgcccagctaattctgttctttccttccagccttccttccttcgcttatttttgctagactagtttaaagcaagactcaggcatcattttacacactaatttttcagagttcattttctgttactacaatgccattatcatccaaacaaaagtaattctaattctttagtataatccgataccctgtccgtatttagatttgcacatttatcccaaaaatgttattatacagttgttttaagtcaggatccaggatctgaacaaattcacacatggcatttgtttattttgtctcgtccatcttttttagtttataaaaagtcttcttttttttttttttttttagtaaccatttgttgaagaaacagagtcattgttctgtggaatgcttattctgaatttaactgattcatcataatgtttgtctttttctttatactccatatttcctagaaactggaaaccgtaggtacatatagttgcttgattaaattcaggtttactttttcagaggtggtctggggtggcaagaaaactttatacttgggctgtgtccagttgaatcgctattagctggaggttttccatataaatggactgaaatacgtatcttttttgttttgttttgttttttgttttgagacggtctctctcccttgcccaggctggagtacagtggtgtgatcttggctcactgcatcctccatcccccaggctgaaacaatcctcccacctcagccccgcaagtagctgggagtacaggtgtgcaccatcatgcctggctaatttttgtatattttgtagagacagggttttgccatgttacccaggctggtcttgaactcctgagctcaagtgatcagcctgcctaggcctcccaaagtgctagaattacaggcatgagccactgtgcccagctatccaaaatacatttcatataggaaggacagtgcttaatttctttgctttttaagtttttatcatgggt

SEQ ID NO: 46040 - DNA, 1052 bp, Homo sapiens
gagtgtagtctgagaataagaaaaccttgaatatcctttatattggttagatgttggtgcaatttgtttttgtgtatacatgtttacttataggaaactgtaattttcattattggcaattgtttctatgttccctttatttagtaaagcatatttagtgtttatgccttgccatggatacagggtggtcatatcagacattgtttgtatgttctgctcatgttaatggattggctgcaaataagatatgccaatgaccaataagatatgcttagtccacacttaattaagaacatgttgctgattttttttcttttctttttgttttttctaaagatagtcttgctctgttgcctaggctggagtgctgtggcacagtctctgcttgctgcagcctcaacctcccaggttcaagccatcctcctgcctcagcgcccccaccccacccccccataactgggactacaggtgtgcgtcaccacacctggataatttttgtatatttgtagatatggagtctcaccatgttgcccaggttggtctggaactcttgatctcaagcaatccacctgccttggcctcccaagggtgctgccaatgcacccagcatgttgctgattttctttgagacatagtggcaaagaaaattttctcagctctgtcttaccaccgtgaaagactgccttcagagtgtttcagttacctcttcccatcaatatgagaaaagatgagtgtgaggaataggtagagggaaaaattaaagttttttgtgtagcatgaattatgggaggggattatataggtaattctagcatgcacatagctcttgtataggcattgtgccagtaggtaggtattagagtagacatggttctttgtagtagccttttataaaattgacttgctttggtgaaacagctcctggcatcattcagacatttttatcctgttgtgtgggtgtggaaacactgggattgttctataagctttcttttgtttttgtgtgtatatatatatatatatatatatatatatttttttttttttttttt

SEQ ID NO: 46041 - DNA, 1049 bp, Homo sapiens
tgggaggctgaggcagggagaattgcttgaacccgggaggcggaggttgcagtgagctgagattgtgccactgcactccagcctgggtgacagagtgagactccatctcaaaagaaaaaaaaaagtgatttttttttttttcaaagaagactttagtggtataggagctaaggtaaagaagagaaaatttgagatcaagcagctttatcaagagatttaagtgacagaaaagtgatgatctggccgagcatggtgagtcacacctgtaatcccagcacttggagaagccaaggtgggaggatcatttgagggctggaattcatgaccagcctgagcaacatagagagaccccatctcttaaagaaaaagaaaagaagaaaaggaagtaatgatccttgtgagcaaaaacaggtcagtatcctcttgttttgactggatcagagtgttcaggcaaagcagtaatcaaactcctttttccatttactgctgttgtatagatctggtcccttggccagtcacagtggctcaagcctgtaatctcaacacttggggaggccgagacaggtgaattacctgaggtcaggagtttgagaccagcctggccaacgtgctgaaaccctgtctctactaaaaaatacaaaaaattagctgggtgtggtggtgggtgcgtgtaatcaaagctgctcgggaggctgaagcaggagaattccttgaacccaggaggcggaggttgcagtgagctgagatcacgccattgcactctagcctgggcaacaagagcaaaattccatctcaaaaaaaaaaaaagatctggtccttcacacattgttatatacataaggttgtacagccatttgagaaagagaccagttatgtctgtttccctaaacaactggcttgagagtccaatttatacaacttacttgtagaatctttagtaattaggcactttgggtgtcacctaggtcaacctccctcttaatgcagtgacaggtccagggaaattcaattcaagtaaagatttcacgtttcatgcctgcagtggttgt

SEQ ID NO: 46042 - DNA, 1033 bp, Homo sapiens
acattgaggaagactttacgacagaatatttgtgaattcttggttacataatggaagctgtggaatgacatgagtagaggcatgaaaatccatttattcatgcacctcatttcaggagatcagcctaaatggtatggagcttcatgtagggacccaaataaaggaaatagtggagtgtcagtctaaggaatttatacttgagtagaagttatgaagcatttttagtttggggagaagtaaacattaaaagaatctaagattatgtagttggtggtgtcatctgagatggaatctgcagatagtaggtgctcagataggtaattgttagagcccgatatgcagtaggaagatctgaattagatagcttaatgggaataaggtggaagagaggatacacatacttagtaactgtttatgtggaaccaaggagtacttattcatatatgatgttaaaatatattaaaccaagttgattacttttttttttttaatataagatactgggaacacattggctgataaagaaactgctgaaaattagctacctgcatgtgatctctctctgttactaagttactatttggattctgctttgtcatttgcttagagtactgctactagaaccccaagagtacatttgcttatgaaaccctgtttattcaacagatgcttttgagtgctttgtgttatgtcacagagttacttcctgtccctagagaacattttgggaatatttactgtgatttcttttttttttctgcaacagccatatgaggtaggtatgataaatatccccatttacagattagagaatggaaatttagacagacatgtattgatgaagaaagttgttttcttgttttatctacatttttttcttcttcttttctttttttttgagtctcactctgccaaccagctggaatgcagtggcatgctctcggctcactgcaacctccacctgccgggtgcgagtgatcctcctgcctcagcctcctgagtagctgggattacaggcgagagccagcatgcc

SEQ ID NO: 46043 - DNA, 1138 bp, Homo sapiens
tatccccagatagggaaggacagcctggaatagcctgggctccattccacactcccttcctccccacagcagggtgagcttcagcacattagcccagcacatcatgtggcccccagggtgtaaaactcagggtgggctacttcctggggtccttcagctgccttggaagtgaggcatgcacagatgagacttcatctgccctgggctgctttcttgcacgttgggggactggcttgccatggatcccaggcctctgttgtcccttgcttcctatctgtaagtaataaatctgcttcatatagcctcttgggtgtgggtgttctgtttctccaaattcagccaagttggtaaccagtgcacagtgaacctgtttcatattttcttcttcctctcttccaaaatatcaacttcacttttttctggtctggtcatcctaattttaaagacaaaaagtataacttaaaaaaaaacaacaaaaactgggctggccaaaaaaaacatgtggtgctagtctcttatgtttgttgtggggaggtttgaggagggcagctgctctggcccaaaggttttcagcctctgccctcgaatctccagctgtcggtcatcagccaagagcggaactggaacaacaagactaattgtattaattattaatttgttcattaaaggtttattgagcatttgttttgtgtccagtcctgttctaggctatggtgatgtacgtttctgccctcatggagctagaatctgttagtgggaggaccaacaagtacagaaaatgacagcacagtgtgttgcatgcttagataggaccgagctctgcatccgttggggaaagatgagtgaagtgtttatcttggttgtggtgaaatcaggactgtcttcctggaggcaggcggcctgtgctgaggccttaagcaggagctgacccatgtgatgaggaggaggaaggcagggctttgtgctttgctggccttctgttagctcacatttgttgcccacctcaaggtagcacctaacaaatgccgtcgagtggatggcgttgccagaagggacaaagcaggggatctgcatggaattctgttgcctagaggagcacagcccagtgaaattgtaatgcgagcaacacaggagaaat

SEQ ID NO: 46044 - DNA, 1807 bp, Homo sapiens
gagtgctagctttgtaccctgataagtgtacaaatctgtaccctgataagttaaatgatgttaggtatgatgaaagtgggtgcaactttacataggatgattagagaaagcctccctgagtaggccacatagctaagttgacaataatgataagtaaccagccatacagctctattactggagtgaataagcattttaggtggagggaatgagaggtgaaaaggctgtgaagtagtaacgaacttggcttgtttaaagcaatgtacagggaattatgtggttgtgacactcaggggtggaggtgctactggcacctagtggatagacagctggagtgctggtaatatcctgtaatgcaggcagtccctagaattaaagaagtatatgtgagtgccaatgttgggcaactctgatatgaaggatggtcaagggcaaactctgacatgaaggatggtacgaggggaaaaacatggttcaggagaggtaggcagagacctgatcgtgtagggccttgtaggctataatttgactcctgtaagatgagttgaaaaccattgcaaggatattaaataggggaatgacaagatgtggtttatgttttgaaagggtcactttggctactccctggagaacgggttgtgcaagggtaagtgagaaagcatgaagagcatttgagctggttttcatggtagtctggggctgaggtagttggtggcttggcctagatgataaacattgagataagaagtagatggacttggggtagattcagagctagtgtggacagcacttgatgggctgaaaatgttttttacttttttccataacttcagtgcaagaagaatgggatcaaaacagaaggtgaaaaccccagaatggtttttatcagtttagcaggaggaaaaacttcaggtctgtcagtaaaacataggatacatcacaggatttctctccttacttcactttaccccaagccagatttttcaacataaatcatttatttagtaatttcatatcttatggtttgtttatatctctttcaggaatttaatttaaaggatgttggcatttaatagaatttcaggccattgcaaccaatgagcttatagttgccagatgtttttctaaagtttctgtgaaagtcaaagttttattttcccattgtgttgaaattagggctattgaaatacagttattattttattagcgtatttctcttgaagtctttcttgttgggttagtggttttcttgttttaaaaaatgtatattcctaatatgaaaggcaagatgtgtgtgaaataggatgttgaccttttccctttgccagtggaggaaattttttagttgagaatttttgttgttcagatgatcatgtattgaagatgaaatttttaaatttgacttttttcttgaatttaggaacttgatgtagtctcatagtacatttttctgtgtgtgattataagaggaagtgtattctgtctttacagggaaatactggtttatttgctctttatgagagagtattcttttttcctctctctttctaattatatggcaaactttttaaattttaatgttttaactacgattatctcctttgcatttaatggagaagcttagtattttcccacacttccttcatagagaaatttttgtatgaaggaagattaaaattcacctgtgatctctgtatttgattgtgacttataaatttctgtggctccctgtgccagagaatgaaagttgctcaagtaataatttattacaataccagtttaatttgagactaaatagaataccatt

SEQ ID NO: 46045 - DNA, 1041 bp, Homo sapiens
ggtcattgaggctgtggtttccggctgagttttacctgaatttttctgagtggggcgtatcttcaggaggagagccatatgtaaaagtagaaatttttctagtgccattccttttttttttcatatctagactccattctagtttctgctaccttttgttcgttcaggtaatcttttatatttcatccagattttatagttggtttctgtggaagggttgatctgatagaagccactttatcattcctggaagtggagtctctggaatatattttaaaattgaaccagtaaatatacactttgttcacaatgttttacatgaaaggataaaatagtaacatgatagaaattcagaagtaacctgatgaaaatatcacagaatcgtagttttgtttttctgacttaagataacagttcaaactgaactgtcctctctctctgaaatgaatactttctactttaagtagatggaagctttgctaactttaatagtctcgaagtttaccagggtcactttggttcttatgttttagttttgtgtgtttgtctgtgaattataaactcagaattctataggcaacaaaaatattctttaaactttttgtcagcttgacaatgctatgcctttgcatgggcttggtgttcactggacatcttgtgtctgaaaatttctctgagattgaatttgggaaacttgcagccattatttcttcaaataaaatatcagccccattctcttcctcctctccttttggtattccaattgcacatatgttgggccatttgataatacataacagattactgagcctctattcatttgttaaaaaaatcttttatctttttattcttctccttggataactttaacctattttcaagttcacttactctttttctgttttatctccacttggttcttaagtccatcagctgatatttttttatttcagaaattgtagttttacttctaggatttctgtttctttttaaataatttataagttttttgtttgaaatttttcatgtattgaaagcatt

SEQ ID NO: 46046 - DNA, 1022 bp, Homo sapiens
aaagcccagcaaaagctgctttaatcattatatgatattctatccaagcttcccacataccctacttttttgtccccacttagttcctcctctcttcctttgtttttcactgaatcattaggtaaaataaaaaggttattggaagcatgtatctaatactgtaatatcacagaagagagatattagttgatattaattgaatcctgcctttaagttcttccttctccttttctctcccattcttcctcttgtatttattcatctatcagtgcatcagatgtttattgaagaccaaatatatgtaaggcaatttgttggttactgagtatatggaaagatgcataagatagaataccttttctcagaacctttgcattttgtttaaacctttgttttgatagcgtaacttgatgaagtcactgtgtttacggtatacaaagctcaaaaagtcaccataagtgtagagccagactgagattcctaagttttttcttttgacctcatttgggagctttctgaattaattatgtacctttatggaaatctgagaaatagagtagtgtaactgtttcataatggcgcagtagaaggatagacaagagtctctctggagtggatagacctaggtgtgaattccagcacttgattgtttagtgttgggagagtggcttgaactcccagagctagtttctttatggtgaaaggtggtagatggtacttaactcatttaaacattaggtaaggaatccatgaaataacagttaaagtgtctgcaatagtaaatatacagtatgtatttatttccctgcccttttctccataaaatcatggaataataacagttttcctctttatctctgtaagttggattcttgctaagttaatattaagcccaggtaaagatctagtgctgttttgtttgatttaaaagagacagcatgaatatgttactaatatttagcaagatttaaaaatctcatttaaactatatttataatttcaaatttttacttataatgcat

SEQ ID NO: 46047 - DNA, 1059 bp, Homo sapiens
ttgcccgggctagcctcgagctcctgagctcaggaaatccccccgcctcagcctcccaaagtggtaggattacaggcatgaaccactgtgcatagcctaaattatttttcttaaatctaacaatattcagggtgcttggcagtgtttttctcatgaggatgaagaaatttcatattgaaaaagttcaggaacttgtccacggtcatttacatataggcctatcttgaagtatttactcttctttttgttaattttattgttctttgatagttctgtaattatgtggaacagtattctctatacatagtatctttattcagggatatgtgaaacattgcaaggcagtgtgcttatttatcaaactgtatcaaatataaattattttgttccggatttccctgtgtgttaagtagtcttgacttgtgtagatttaattcaggagacaaaatcttgttcatttctaagaggtagagattaaagcaaacatgaggattaacttttgaaaagagattagggaattttggatgctcagatggtaattccagtaggtaatctgacttttcatttagaaatgtgtgtctgatcgcatgactttaaatgcttcccatttaaaaactcaacacttcttcttgtgcagagttcgcagtatgtgcagtgcgtggccgggtgtttgcagctgatgctccgggtcaatgagtaccgctttgcttgggtggaagcagatggggtaaattggtgagtgccctttccttttaatgtaaaataacatttacaagcatctctccttgacattttcaaagaaatatgtaatcatctaaaagaaatattttatttttttcatatctgtttaacaattgactatgctaagctttttagaagttagtaactatcaaactgagcccctttccttgcttgatctgttcttttataagaggttaaggcctcttaagaacctaatgcttaacaagacagattccaggtactcagaatataaaaaattttagaaaataattgatgatgaatgtaggcaaaaatcaacaagaaaagttcttacccagg

SEQ ID NO: 46048 - DNA, 1025 bp, Homo sapiens
tacatttggtagaaatagtacatgaagtatccatatgaccattatgattttcactttcagcacagtattcagtaaattacacgagctgttcaacacttgattataaaatgggctttgtattgatttttggaaggattgcctggagatatattctgaaatgcaaaagaaaattaactggtaaagtatttaaatttaagactttcttttacatgtcattttcaaagtatagcactgataacaataataagctaacctaatactatgtatttatcagttatgttctcggaagttgcatacaaagcaataatttataaagaaaatcacttttttttagttatgctgacaattttttttctgtaataaagattcccactagtcatgtaattgaattactggattaagcacattagattgaaagcagtactttgaagatttataaatttgtaaaccaatagtaaaactattttttttttggtgaaactatcttcatttagatattttatgactgttgactagaggatctcttttaatcagccaacttcaagagaattcttggggtatatatgtattttaattcctgaatattgataataatagtatattttacaattgtttagtgttttgtagaaattgatttcagtgtcatgacagtttttttttatttttcccagtggtagagatattatttttcttttcctttgctaacgagaaaacaattttcgagattaagtgatttgcccaacattatgtgacaaaacttctgattcttgttctagtttttactctgtccttctccctctctattcctcttttactttcttttctctatttcttttttaaaattatgtcataacttacataaaggaaaatgcacagatgttaaatgttcagcgagataaatgtatacctcataattcctcctactgccttcacctcaactcgcacaaaggttatcattattatgacatctattaccatagagtagtgttgtctgatcttgaactccatttaatggaatcatacag

SEQ ID NO: 46049 - DNA, 1050 bp, Homo sapiens
tttgtttatgttgggagagacgactaatacctaggatgtatattatcctaagaaatggatttttaagtattaaaactcccaagtggcttggaatgagtgtgggagaggctggcagtttgttgaagagattgcttagaattctggcaagtggtttggtgacagtctgcttctaagaaagatttttgtgttctgttttttgctggtcatataatgaattccaatcttacttttgaaactcaaaataatacagggagtgtcaagaaattcctaagacccagctaatttgggttcactttgatggaaatatttaaaaatatatttttaatgtttgtttcaaaatatattttaaaaaatgaaatataaactattatttttagaggggttgagtgttaagaaattgtgtagcaaaattgttacaaatcctttttttaaggtatatgatgtgatttttagaattaatgttgcgttaaatgtatctcttatttgttttcaggcagcaagaattattgccaagttagcagcttggggaaaagaactgatggaaggcagtgacttaaattactatttcaattggataaaaactcagctgagttcacaggtaaaagaaaattttttaaagtacctttgaaaggaatataacatccgtgttcttttaagctatttatagtaaatatgttaaattacaaaaatgttttattaaaataatgccgttttgaacttgtcaagtaaaccaaactactctcagatatggtagtgtgctttgctttttctttctttgactggcttcatttcaatcctttctgtcttttctgccacttggggtttcttagtcatgcttttcaggggtcagggagtacctttcttctaggtggctgccaagatgatacaggctggagaactgaaaggacccacacagctccaaagagcacgtgcgtgtgaggcttcgataaaggaaaacaaacggtacagcaggagagagcatgcctcgggccgagagatttccaggcgcagctcccttggctgccccaggattgtgaaccaccaagattt

SEQ ID NO: 46050 - DNA, 1022 bp, Homo sapiens
aaagggatatcactttgatgacatgggattacattattttcctgttgatttattaagtatttatatgtcctttgaaatttttttggcggtggcattctttttattttaatatataaggttttgttactttttgataaacagtctttttacatacaaaatttattactgtttgccatatttatagcaaacatagtttccttttttactatttatctttgaagggttgtggagttttttcatatacagtggtttaaaatgtttagttacatatattgatgttttacattctttcatggtaagtttattgtagaaaaataaaatactattaagcaaaagaaaaaagttattctacctaatatttctctgttcaaggtgacttgtttacacttagcgtatacctctctagatatttttctgtgcataaaataacttatacacttatttctacaaatgtgaactttttacaaaaaggggtgatatgtacatatctttgttcttttcatttaactgtatattcttcccttccctactatgcctgtaaagatatttctgtggtatttaaaataattaatttattattatttcccatttatggaaagttccgttgtgtaattttccatttaatggatgaaccataatgatctaaactaattctatactgttgcatattttggctacttccttttttttctgttttgaggcgaacagttagtaatctcataattaattcgagaagtgcaattatctggctgggtgcagtggctcacacttgtaatcccagtactttgggagactgaggcgggcagatcacttgaggtcaggagttcgagaccagcctggccaacatggtaaaacttcgtctctactaaaaatacaaaaaaaaaaaaaaaaaaaaaaagagtgtaattattgattaaactatttgagcgtgtgagagttttgatatgatgaaaatgctgtcttgatagattgtaccagtttgcagatcctgccagcagtatatgagagggcccatgcccctg

SEQ ID NO: 46051 - DNA, 1044 bp, Homo sapiens
ctgcacgtatccctactttcttaatcttctatttcccaaatacgtacatatggaaaaataaagattgagataaaattcttgtgctttatttctttaaagaatgaaaatgcccatatttctttcagtaataaaaatggaaatatgcttatttgacagttttgttgtgaacatgaccaagttatgaatttaaaaattcattctttaggttggcaaattctgataataacagtaactcttttcaacaaaagaattttctaagcactgctgctgttaccagacacttgagactgatccacttcagagcacagtgctttccattaaccatgtagacatccacacgcacacatatgtctccatacatacatacatacatactgtaagatcaagtagaatgctatttttacatgtagtggtcacatcttttatgaactgtgaatttgggtcctgcaatggcactggtaagtgacgtattcaaaccgagcttgctggacagaagatgtcgttgagaaacacctgaatgtcttttctttgaggggagagtaatcagttaccaaactcatgcaaaataaaagtggttccctttgctctggtggatgtacctgctccgggcagcagggagccttctgtgtagccttggccactgacaacatgctactgttattgtaaatgcaaatacgctatctttctacaacagccatatccctttatttttttttttcaaaagtatcactaaaggtggctgcagtttacatggtgaatatatagcagtctgttgaaggaatcatctgttattagaatagcctgagtattactccagcagaagatgctacaacctctaaattccctgtgctagttgtagcccatgaattcttttattattttattaataataaatatatttgaaaaatcctatgcttcaatagatttctccgataaggactgaagcaagtccttatagacagcagagttcatgaatcgaggatatgagtctctgtgcatcagggtgtaaatctgaagttgagcatcatcgaatatgtgttggga

SEQ ID NO: 46052 - DNA, 1046 bp, Homo sapiens
taactgaaaccatggaaagcaaaaccatggataactggggactagttcaagaggagataagatttctttcttaagtgtaagaatgattttttttaaaaaaaattattattatttttttgcggagatggggtcttgctgcattgtccaggctgatcccaaatttccagactcgaatgatcctctcaccttggcctcccgaagtactgggaatacaggcatgagcctctgtgccttgtcagaatgctttcttaatactgattctagttaactaaaaccaagttgatatatttatactttcacagaaatagttactatgaaagctatgtcaaaatttataaaatataagaattaataaaatgaccatgttcttttttaaaagttcataagcaattgtattggttactaggtaaattggccataatcctttttattttgcaggactatataatttaaggaaagttcttcacgctcctccacatggcttatgagtactttaggcttaactgtcttctggataatttgttcctttttgtaatattgataacttacatttatgtacgatatgactagcctttttattctttaacagctgaaaaccgtgttatagttattttggttgcatgtgcatatgtgaaaattttttttatcactgtcttaatttcatttgccaaataggtttttgtgctatgttatctgctgtaaactcaagattgtctccttaagggacaacttactatgtttcagatagtagatttggggaattgattttttcaccgatagaacattaagcacttaaaaaatagcatcactaaactctaaaggggcctttacttaaaacaaattttgttggtagttatttttgtggttaaaaattgaaaaagtacaaaagtttatgagtaggaaattccattcccacttttgcctgtggccacctcgttctccctccctgaaagtaaagcaaggttactagtttgttgtgaaacttaggtattttatgtgtatacatgcaaatatttttgttttcctttttctttgagacagagtct

SEQ ID NO: 46053 - DNA, 1028 bp, Homo sapiens
ctcaagtgatctgcctctcttggcctcccaaagtgctgggattacagctgtgagccaccatgcccagtgaaacagagtttttcaagcattctctctctctatctctagttttggttgaaagctgtcattctctggtgtgaacctgggaggtggagcttgcagtgagccgagattgcaccattgccctccagcctgggtgacagagcaagactccgtctcaaaaaagaaagctgtcattctctggtcccatcccttcatccctctccttataccaagatcattgcttttcatttattgtactgagctataatgggtattttctctattaaaaatattgcttaatatttaaaatgagaatcaaagataaaatgtttagttcaaaaaaaaggcatacttgtcactttactaaattgtaaaatttttaacttctttttaatctgtatgcaggcaattttttttccatcacataaaggtcactgagatactgtgtcatttatttagaccccaaattttgtttttacagcatgatagtagtattgttactttgaaaggattgttcttgatttctttttggggtgtttgtgcgtatttcagtacttccagcggcaatgtaagcaacagaaaggatgagacaaatgctcgagatacttatgtttcatcctttcctcgggcaccaagcacttctgattctgtgcggttgaagtgtagggagatgcttgctgcagctcttcgaacagggggtaagtccagtgcatgttatttctcagtcctttggtcaccacccacaaccactgccatctccaactccatattgctgtttgatgagtgttaccctgtggatagcccacccactgctgcttagcttggggagaagttgttgctgatacgggtctgttaagggggagaggaggaggaatactggggcatttgcttattactatgtaattgtaagaaatagattccctctaatacatggatgttttccctgatttcatagtaatgtacacttttttctcacaaatcttttg

SEQ ID NO: 46054 - DNA, 1033 bp, Homo sapiens
gctgggattacaggcgcccaccacacctggctaatttttgtgtttttagtagagatggggttttgctatgttggccaggctggtcttgaactcctgatttcaggtgatccgccctcctcagtgtcccaaagtgctgggattacaggcgtgagccactgtgcctggggttttttattttttatttttgagacagagtcttgctctgtcacccaggctggaaggcagtggcacgatctcgactcactgccacctccaccttccaaattcaaatgattctcctgcctcagtctcctgagtagccgggattatgggtgtatgccaccacacctggctaatttttatatttttaatagagacgaggtttcaccatgttggccagactggtcttgaactctcaaccacaggtgatccacctgcctcagcctcccaaagtgctgggattataggcgtaagccactgcacccagcccgtgttgaggtatttaggacattaaggcaactaccgattttaactttgtttctcaatattttcccaaaattgatcatgtactcttcatgttaatgttaatgtctcatacactgttatttttttgtatttgtattaactatattaaatatatatattaaacatattaactatattaaaagaggtaagtcaaaggtaggcttaaacagcagttgttaataaagtttatgtaattttttctaacgttatatccgtttagttttcttaaatctggaatagttcctcagtctctcattgtctttgtttttattattttattattattattattattttttgagacagagtttcactcttgttgcccaggctggagtccaatggcacaatctcagctcaccgcaacctctgcctcctggattcaagggattctcctgcctcagcctcccaagtagctgggattacaggcatgtgccaccatgcctggctaattttgtatttttagtggagacggggtttctccattttgatcaggctggtcttgaactcctgacctcaggtgatccgcccg

SEQ ID NO: 46055 - DNA, 1024 bp, Homo sapiens
tatgcaaacttcatctacttgtaggaaacttaggattttagttcatgttgtgcaaatagcctgttaacgcagtattttagtttttagtttttacaaatgctagcaacttaagagatttcataattttcagatgggccatcaactgagaaagaccttgacgaaaagaagaaagaacctgcaattacatcgcagaacagccctgaggcaagagaagaaaggtacttcacagtatagacatatatttatattgaaagtcatagttttacttcctgcatcaattcccctgtctaatgttcccctatttacactcctttttttgttttctaatcaaatggaagtagtaaatgtatgtagccatgtattctaatttatttttttttcagatttcttgaacatttgagaggtagaagacattgaataaataagaagttatttatattgtactcaacaagtttaattgaatgggattgctggggtaggcactgatggaattgataatggaggtagtgattagggattcaaatggttgcttcctctatttaccacatttttttttttagatttattttggcccttgatctcattctcctttgcatgctttttttcttccttttgaatttagcaatttgtggctaggcacagtggctcactttgggaagctgaggtgggaggatcacttgaggttaggagttcgagaccagcctggctaacacggtgaaaccctttctctaccaaaaaaaaaaaaaaaaaaaaaaaaattagccatgtagccatgtgtggtggcatgtgtctatagtcccagctacttgggaggctggggtgggagaattgctggaacccgggaggcagaggttgcagtgagccaagatcatgccactgcactccagcctgagcaatggagtgagaccttatcttaaaaaaaaaaaaaaagccatttgttataagaacttaaaatgtgaagttcattaacaaagagttcagattgtccctcacctcctatgaggcctttgcatgtgttctttcc

SEQ ID NO: 46056 - DNA, 1055 bp, Homo sapiens
caaggaaactgaggaggaaaatgaggcaaggcctcaggaagtagctagaaattgaaaagcagttgggccttgctcaccatctctcatctcttgtttctttgcttgtctgtttcatttacctttccataaacaattggccatcttggcttttgcagcctatagcttttccagctcttgaatttacatgttacaggtgtagccacacagagagtgactggtggtcatcgaatcccatttccacagtgccaggagaaaacatcactgcctgggatgtgaaaggctctcgtgtactcatgtgttgcagtaacccatgggcatggtcagagtgatggggcttctggatgctggcaggagtacagcttccagaatgtgggatgttgtgagctgggtaggcagatactctgaaggtgtctgctaaatagttattattatcttaaattctcatttagaaagtaataccaatttaagggccaggcacggtggctcacacctgtaatcccaacactttgggaggctgaggcgcgtggatcacctgaggtcgggagtttgagaccagcctaaccaacatggagaaaccccgtctctaccaaaaatacaaaattagccgggtgtggtggtgcatgcctgtaatcccagctactcgggaggctgaggcaggagaatcgcttgaactcaggaggcggaggttgtggtgagccaagattgcaccattactctccagcctgggcaacaagagtgaaactccatctcaaaaaaaaaaaaaaaagtaataccaatttaagagcagattggattttatgcctaaaattctgcaaaggagaaaatataaattcagaatattcgtaaggcatgttgtaagtgcagcagtttcccatggtacaaactatgtctcgtcggaaaggaagtctgtatgttctctggtgtagagaaccgcatcctttaggacacggtggggtgtgtttgtatttccgatatttgcctgatttgatttgacaccagccaccaagtttgatttttttatggatatcattagtaacaagatattccctaaattg

SEQ ID NO: 46057 - DNA, 2834 bp, Homo sapiens
cttcattgtgcatatgtaccacattttcttcatccagtcatctgttgatggacacataggttacttccaaatcttggctattgggaacagtgctacaacaaacatgggagtacagatatctcttcaatatactgatttcctttcttttgggtatatatcccaaaagatatatacccaaatatagttaaaagaaagatactttcttttgagtatatatccagtgggattgctggttcatatggtagctcaatttttagttatttgaggaacctccaaactgttccccatagtagttgtactaatttacattcccaccaacagtgtatgagggttctcttttctccacatccttgccagcatttgctattaactgtcttttgaataaaaaccattttaactggggtgagacgatatttcattgtagttttgatttgcattttgctggcgatcagtgatgttgggcaccttttcatatgcctgtttgccatttttatgtcatcttttcggaaatgtctattcagatctttggcccgttttttttgttcttgtttgttttgagacagagtcttgctctttcgccaggctggggtgcagtggtgcaatcttggctcactgcaacctccgtctcccgagttcaagtgattctcctgcctcagcctcccaagtagctgcgactacaggtgcgcaccaccatgcccagctaattttttaatctgtagtagatacggggtttcaccacgttgggcaggatggtcttgatcacttgacctcgtaacccaccctcctcggtctcccaaagtgctgggattgcaggcatgagccactgtgcccggcctggcccattttttgatcagattattagatttttttcctatagagttgttaaagctccttatatattctggttattaatcccttctcagatgggtagtttccaaatattttctcccattctgtgggttgtctcctcactttgttgattgtatcctttgctgtgcagaagctttttaacttgatgtgatcccatttgtccatttttgctttggttgatatgcttgtggggtatttctcaagaaatttttgcccagaccaatgtcctggagattttccccaattttttctcgtagtagtttcatagtttgagatcttagatttaagtgtttattgtgatttgatttttgtatacagcaagagatagggtctaattttattcttctgcatatggatatccagttttcccaggaccatttttattgaagagactgtcttttccccagtgtatgttcttgacacctttgtcaaaaatgaattcactgtaggtgtgtgtgtatagatttgtttctgggttctctattctgttcctttagtctgtgtgtctgtttttatgccagtaccatgcagttttggttactatagctctgtagtataatttgaagtaaagtaatgtgattcctctagttttattctttttgcttagggtagctttggctactctgagtctttcgtgattccatataaattttagggggctaggcacggtggctcacgcctgtaatcctagtactttgggaggccgaggcgggcggatctcgagttcaggagatcgaccatcctggctaacacggtgaaacctcgtctctactaaaaatacaaaaaattagccgggcatggtggtgggcacccgtagtcccagctacttgggaggctgaggcaggagaatggcatgaatccagtaggcggagcttgcagtgagccaagatcacgccactgcactccagcctgggtgacagagcgagactttgtctcaaaaaaaaaaaaaaaataattaggattgtttttctatttctgtgaagattgtcattggtattttcatagagattgcattgaatctgtagattgctttgggtgatttgggaaaaatattccatggtcatggattagaagaattcatgaacaataacaatcaatattgttattggttcttcttatccatgaccatggaatcttttttccattttttggtgtcctctttcatcagtgttttatagttttcattatagagaccgttcacttctttgtttaattcctaggtatttaattttatgtgtgactatcggaaatttgatttttttaaaatttccttttcacgttgttctccgttggcatatgaaaatacattctaattttgtattttaatgaagtgctttgaatttttcactcatttccaccttaaaagtaattgcgcttttctattactaattttttcctaatttaaattttatcagtgggcttaactctgaaagtattgctgactaactttcatgttgtttttagtaaaagctttgattgatcaagaagtgaagaatggcattccttctaacagaattattttgggagggttttctcaggtaagataaaatttgagtggaatgtcagtaccatcagtatacttatttagaagtctgtgcattaatcctttctatagagtagtcttttttgatgttatagaatcttgactgatacacttacctttgatgtttaattaagtttcagtgtactggaactaattaatttcttcttgaaagaactataatacacatgtacacatgtaattaaatttctaagttaacacagtttatccttttaattaattaaaactgataacacaggcatgagtcccctctataggaggagactactgataggaacagtaaagtggaagacaagagaatttcttccctttaccttcacgtattacaggttttaggtatgaatatgtggtgtttatttttggcatttttctttgtctctgtactttttcccctgctttctgt

SEQ ID NO: 46058 - DNA, 1022 bp, Homo sapiens
gtgagctgaggttgtgccattgcactccagcctgggtgacagagggagactgtgtctcaaaaaaaaaaaaaaaaaaaaaggaagaaaaaagttgttaatgttagtgcggtaataataacacgtgccactgattgagcacataactgtttacaagctaggtgtttcttacagggcacctcatttgacaccgctgtgaagtattagctctgctttacaaaacctcgaaagcctggtctctggttaggagtccatctcctttatgattatggtaattctagttgttcggagggagaaacagaatactaacttactgggacgtgtctatttttaacaaatgcacaggaggccgggcacggtggctcacacctgtaatcccagcactttgggaggctgaggcaggcggatcgcctgaggtcgagagttcgagatcaggctgaccaacatggagaaaccccgtctctattataaatacaaaattagccgggcatggtagcgcctgcccgtaatcccagctacttgggaggctgagccaggagaattgtttgaacctgggaggcagaggctacagtgagctgagatcccactgttgcactccagcctgggcaacaagagtgaaactccgtctcaggaaaaaaagaaagaaagaaatgcacaggtgcacaggaatgtgcttttcttttacatatgtgtactgaaatattgacaagtataataatgtgaggactgggattgccttcaggaaaatctggttggtgactcttgagtgtgggtgggtgtaggtgggtgtgggcagcaatggcaaggcaggctggctgtgaattgttttgctttttggtaattttttatttacatagttacttagagactgtcgcccaggttagagtacagttggtgatcatatctcactgcagcctcaaattcctggtctccagcaactctcccgcctcagcttctgagtagctgggactacaggcatgtgccaccatgcctggctaatttttaaactgttttgtagagatgaa

SEQ ID NO: 46059 - DNA, 1054 bp, Homo sapiens
gaggcagggtttcaccatgttggccaggctattctcaaatgcctgacctcaagtgatcgacctgccttggcctcccagaaaaattatcttagatatacaaatatctataaagttctaggatatccctagggtatctctgaaggggatttacctgttagatttgtgagaactctttattacgttgaaaacactctttaattttatcgtttggggcaatgttgatgtactgtggaaagagcacagactttggaatatgataggtattgttttgaattctggctctgaaagttttgagcaaacttagaagatcaataagattggcacattaggtcaagcttgtccaacctgtggcccaggtcagtttgaatgcagcccaatgcaaattagtaaactttcttaaaacattatgagatttttttttttgcgatttttaaatattattttattttttacctcatcagctattgttagtgttaatgtatttttatgtgtggcccaagacaattcttcttccaatgtagcccagggaaaccaaatgattggacacccttgatttaggtcaaaaagttgctgagaagcaataaccatggagaagacaagaagggattggacatactcatgtcagttagtaattcatccccagaagtggtagtagcagtagagttgggacagatacataaacatgaaagagggaatgggaagaagaataacagctgagaagattggataagaaaacatttcttcctctttttatcctgaaatacagtctgtcttacctctaggctacagtgaatactgtggctagggttgctatgtcctctatcattctgctcaagcaagagacagaattctttttattctttttctttttttttgagatggagtctctctctgttgcccaagatggagtgcagtggcataatcctggtttactgcaacctctgcctcccgggttcatgcgtttctcctgcctcagcctcccaagtagctggaattacaggcgcctgccaccatgcctgggctaattttttgtatttttaatagagacatggtt

SEQ ID NO: 46060 - DNA, 1740 bp, Homo sapiens
gtgcttttgatgttatatctaagaaattgccagatctgaggtcacaaagatgtatgtgtgttttcttctagttttatagttttatctcttacatttaggtatttggtcagtgtttacatatggtatgaggtagcagtccaacttctttgtattacatgtggatatccacttgtcccagctacttttgttaaaaagactattccttccctgttgatttgtttcagaaataagtttgacagtaaatgtgaggttttatttctggattttcggttgatttatatgtctgtctgtactctagtactagtctttctgaatgttacttggtaggaatttttgagattaagaagtgtgagtcctctaattttgttctttttcaagatttttgttgttgttgttattctgggtctcttgagtttccatacaaattttagatcgggttctaatatgtgcaaagtcaggtggtattctgttaaagattgcattgactccatagatcaatttgagagtactgccgtctttaaaatattatatctcccagtccatgaaagtgggatatccttccatttatatagattttcttgtatttcttaatatgttttatagttttcagaaaaaagtctttaacatagctatttacacatatacacatgtgcatatacacaaaactcctatataatatcctggttatagttaatgttatgtaagtattgcagttaatactgttgttactaatctttttatatgtctttaacactttgggggaagtgggttgaaatagaaaaatagttaatagaaaagtatttaacagggggctgggcatggtggctcacgcctgtaattccagcactttgggaggctgaggcagacggatcatgaggtcaggagatcaagaccatcctggctaacacagtaaaaccccgtctctactaaaaatacaaaaaaaaaatttagctggtgtggtggcgggcgcctactcgggaggctgaggcaggagaatggtgtgagcccgggaggtggggcttgcagtgagccgagatcgcgccactgcactccagcctgggcaacagagcaagactctgtctcaaaaaaaaaaaaaaaaaaaattaacattcatcaagactctttgatgtaagaaaggctgaaattactggtactttattctttagtagagataatatgtaaaaagcatcaagtatatggccaaatgtaaataagcaggaaactatatgtataacatgatccctgttttgtaaaatgtgcatctattccttaattgacatgcatgggaaaaatcagaaggaaatgcatcagaaaattaactgtttattcctggctagaaggatttgattatttataatttttcaattattccatgttctgctttgaacgtgtatgtatgtgaacatgtacgcatgaagaaatattaaagttgctggattaaaaaatttttttttcttaagttttctgtagagtgggtcttactatattgtttaggctggtcttaaactcctggtctcaagctgtcctcctacctcagcctctcaaagtgctgggattatagacatgagccaccatgctcagcgaaagttgctgtttttattttatttactcacttatttatttattttgagatggagtctcactctgttgcccaggctggggtgcagtggtctagtcttggctcactgcaacctctgcctcctggttcaagcgattctcctgcctcagcctcctgagtag

SEQ ID NO: 46061 - DNA, 1526 bp, Homo sapiens
gtagcccatatgccaggtatttattattgctgcaaaatattgcttattatacacattaaaatctatttgcaaagctaactatgcacgttaagtttattcctaattctactgaaattatcagacagaaaactggacgggcgtgatggcttaggtctgtaatcccagcacttttggaggctgatgtaggtggatcacttgaggtcaggagttcaagaccagcctcgccaacatggtgaatccccatctctgttgaaaatacaagaaaaattagccagccttggtggtgggcacctgtatcccaactactcaggaggctaaggcacgagaattgcttggactcaggagtcggaggttgcagtgagccatccctgcactccagcctggacgacagagcaaaactgtctcacaaaaaaagaagaaaacttagtggctgttaacactgaaaatacgtacattgaaatagtgtatcaaattcaagtgaatagcttgtaataaagtgttaaacataaaaagcaaaaaaaaagggggggggttgttgaacatagacttgcatagacctgtaatatgtacttgaatcaattgatatagctcataacttacatttgtcttagcagatggtagaaggtgtttctatctacagaatctataatcttgtctcaaaatgatttcccaaatgttttcagacttacctcagggcaaacagctcatttccctcaacttcatctctctcttcctgcttatcccaaagtcacaagtctagatcagcagtaagcagcaggtagcccagaaaaggccacactcagccaaatctggtgacctttagctgaatatagatgcgccttgacttacaatggggttacatctggcagagctgaaaagttgagcagcgtacggatgtgttttgcttttgtgccattgtaaagttggaaaatcttgagtctaaccgttgtaaattggggaccatgtatactttagtagttgagtctggtgggtagagaatttatcagttgctttgctttgcaactattatgcagttctaaactcagattggtttggtgtaagaacttttttgagttggatttgctatttttgaaaattattttgaaaattgtattggattatgatatagtcaagtattcagatcttaaatgttcagccaggctgggtgcggtggctcacgcttgtaatcctggcactttgggaggctgaggagggcagatcacttgaggtcaggagttggagaccagcctggccaacacagcaaaaccccgtctctactaaaaatacaaaaaattagcagggcgtggtggtgcacgcctgaaatcccagctactcaggaggctaaggcacgagaattgcttgaacctagaaggtaaaggttgcagtgagctgagattgtgtcactgcactccagcctgggtgacagagtaagactctgtctcaaaagaataaaaaataaatgtttagctggataaatttttacttacacccatgaaaccatcaacatgatgaagatagagaacatt

SEQ ID NO: 46062 - DNA, 1067 bp, Homo sapiens
aatatttgataagttagaattccagcaatttaagtggaaaaagtgtatcctgggcaggtgcaatggctcacacctttaattcaaacactttggaaagccaaggcaggaggatcacttgaggccaggagtttgataccagcctgggcaacatagtgagatcctgtctctaccaaaaaaaaagtacattctaaaactgtagatacaatatagtctcataacaaataggagctaagctgttaatgattgtttctttttttaaaaaaaggattagttcttgatcgcaccagtccaaatgcttttcattttctacttttgtcttttctcccctaattgtaataaggaataaaacatactatggtgcgtatgtatgtgcgtgtgcgttgtggggaaaacctgtcctctgtcttactgctcctgctgtataaattctttttgattttcatagctgaaactaatcttttccttctcttccacattttgacattctttgtaacttgtttgtagggcttaacttttgatctgtgtggtggtatgtttatatcttgtttctcctacgggactgcagtttcgttgaggatacagtctgtatctcaatctttatctttcatgcatgtagaatgtttgttttttaaatttctctcctcagatgcggtggctcatgcctgtaatctcagcactttgggaggtggaggcgggcggatcacctgaggtcaggagttcaggaccagcctggccaacatggcgaaaccccatctctactaaaaatacaaaaattagccaggtgtggtggcacatgcctgtaatcgcagctacttgggaggctgaggcaggagaatcacttgaacctgggaggcggagattgcagtgagccaagatcgcaccattgcactccagcctgggcaacaagagcagaagagcagaactctgtctcaaaaaaaaaaaaaacgaaaagaaaggctgggcgcagtggtgcacgcctgtaatcccagcactttgggaggccaaggtgggcagatcacgaggtcaggagtttgagaccagcctgaccagcatggtgaaaccctgtc

SEQ ID NO: 46063 - DNA, 1073 bp, Homo sapiens
taatgatggccccaaagtgcaagagaagtgatgttgtcatattgttataattgttttattattgttaatctcttcctatgtctaatttacacaataaactttatcacaagcattatgtataggaaaaaacatagtatatatagggtttggtgttatccatggattcaggcatccactaggggttttagagcatcccccactgtttatttctggaattttccatgtaatattttcgaaccacagttgactgtgggcagctgaaaccatggaaaacaaaactgtgggtgagaaggactagggtattttaaacattatataatcacagaaaagttatcccattaaatttaacatttagtattatctaatatattatgcattcaacctttgccagattgttccattaatatcctttatagctatctcctccctagtcatacattatatttagttatcacgtctctttagtctcttttgtctcttttaatctggaacaattccctagattttcttttgtctttcacgacattgacacttctgcagagaacaggctagtcctttaatttgggtttgtgtatttactcatgattagattcagtttatgcatttctggtataaataccatgtaaacaatatgtcctattcattgcgcgcatcagtagactaatgatgctgagtccttttattgttgtaacttcgatcttttgattaaggtggtatcttccaggtctcgactgcagttactttccttttgtaattaaaaagcaagttgcggggggatactttgtgactatgcaagttgttcatcaagctttcacccaatatttttatcatccattgataattgcttgagtcaatcatttctacagtgtgattttccaattctgtcattcctttttttttgtcattccattttgtttattaatctgctactccccatttagttagtatggactcagatttattttctatttatttatttatttgtttattttttgagacagaatctcgctctgtcacccagccaggctggagtgcagtggtgcaatctcggctcactgaacctccacctccca

SEQ ID NO: 46064 - DNA, 1253 bp, Homo sapiens
ttttcccttctagtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggtaagcaaggatactttcacctttgtgttgccattcatgtgtgctgcattggaactgtgttaccattccattttattgattgagaagatactgaaaaatataatagaagtgatatttactattccctgttacctgtttgcatgcattgtgcatatgtatgtgtctttcttaaaatgagttttcccatagacgttggtttccattaaacaaagaaccacgcagcactgtagactataagttgaaataagaaaatttatatttaaaacatctaaaagagtaagagactaaataaagctgtagaaaactgctttaaaaatgcttcaattatttagcatttacttctgttcaaaataagtttgactctaccagtgtggatttaaaaaaatgaaatattaaataatattacattaaatataatttgcataccaaaatttatgcattttctgttgattcattcctgaggttggtgtgtctttctgaataaataagatagcaatagatttctctccaggatagtcattcttttctttattactcgagaaattttgatgttgtatacttaatgattggtggttcttctttgtttggccatcatgaaaattgccttctggtggcctatttttaagtggttagtgtttcactctaccaacttttacttcattattccaacaatatctagtttgttggtctcttttgtttttagactacacaaaaatactgaagattcaataggcaggtaacaaacattggctttctgtattatgttgttgagcatcacagtggtttcatagaaggacatggaaggaagcacagactttaaaagacacttgaggatatatatcactg

SEQ ID NO: 46065 - DNA, 1047 bp, Homo sapiens
ctttggaaggtggaggcgggcggatcacttgaggccaggagttccagacaagcctggccaacatggcaaaaccccatctctactaaaaatacaaaaattagctgggtgcagtggtgcttgcctgtagtcccagctacacgggaggctgaggtatgagaactgcttgagcctgggaggtggaggttgcagtgagctgaaatcgagccactgcagtccagcctgggtgacagagtgagactctgtctcaaaaaaaaaaagttttagacgaacacagttcagttgtatatttagccagcatttgttaggtgcctactatgtgccagaaagtaagtgtttttcgtatgttttcttagataactattttatttactgatatatttagaatagtatctggcacaaacttctcagggccatccacttgtacattgtatcctgtcccctttggcctagtcaaggacagagctctaacaattatctcctctcctacatcatctgtttctcactcccattgatgaattatcgttgacattgaacatgggtgtattttctcctatctttttttttttttttttttgagatgggattctcattctgtccctgaggctggagtgcactgtcagaatctcggcttatataacctctgcctcccgggttcaagcaattctagtgcctcagcctcccaagtagctgagactacaggtatgcaccatgatgcctggctaatttttgtgtttttagtagagacggcattaccatgttggccaggctggtctcaaactcctgacctgaagtgatccacccgccttggcctcccaaagtgctgggattacaggcatgaaccactgtgcctggccctttttttttttttttttttttttaaagacagagtctcttgctctttcactgaggctggagtgcagtggcttgatcattactcactgcagcttctacctcccaggctcaagtgatcctcccccttcagcctcccaagtggctgggatcattggtacatgtcaccatgcccggctaatttttaatttttttttc

SEQ ID NO: 46066 - DNA, 1070 bp, Homo sapiens
gtacatattttcaggatcgttcatctagtgagcaatacacatattataggccaatatttttttaaaaaatagagcttggtcaacctctatactacacatattacaagatatagcactttcaaaatgaatctaaacctttacagaaactttcttataggttatgccttttattttaagacttattataattcaagtgccattagatgatatatatgtaggcctttgatatataatgctttgtgtacaaaaatggtagatggtattttaaacaggtacatttttacagtgttttcttatcaatttgctatattgcacagaatcagtgtgtgtcttttcataaggttttacaatggtttatttttttacaaggtttacgtgtctcaaagcacactgtcttcccagtacgtaagttaaaaaataccagttcacccaagttgcttctagcctactgagatccatgtgacattggaggagatcttttaaatgtttagtattcgtcattagcaatggctggctgttagttctggtaaatgtgtgcctaagttgaatttgtcttgtttttctcacactgtgtcagcagccatgtctacaacacagataagtctgttgtgatcacatagatctacataagttgtgcagttttgtgctaaaaacccatagggagctcctttgggatcatagaaaagaagatcatgcaaccagcattggtgaaggcacactcagattgcacttagggcctttctatgatgttgtcaaccctctgaggatggaaggcagtgtcttttgatgttatctagcctagaaatgacacagaactattgctaatgtataaaacacttcattatataagcttcagtggtacagatgaaccagaatgaatgtttatcttctcagaaacactccttcaatattatattggatcatgctgctaatgtaacttgggctacaactcttcatggtgctacaaacttctctgtctcattcagtcgtatttttttatccatagaaaaaggactacattaggtgtaaaagtgtacaatatatttttatactgtgacttaatttgtcat

SEQ ID NO: 46067 - DNA, 1025 bp, Homo sapiens
tttaaatagaaatcacaaatagcaagtgtggaagcactactttattctgtttaaaatgtacttaagaagtcatcaaattagtgaactgagacattggccttagtaggctgtattcactgctaatttaaaaaagggagtaccaggatttattaagtaaagcattttggaaatggggaatagcgccatatatgtatgtatgtgtatgtgtgtgtgtgtgtgtgtatatatacacacacacacacatacttaaatcttgccctgcatgaaattcaaatacatggaggcacatcttcagggcaccagtgttaaaattttggagtcttaattttcatgtgtacacctctttgcctgttcccacccccagacttgaaataacacttcagagtaagagggaattcagctaatttgtttttaaaattgactgtagtggtcactaaaccctttttgagagaatttctattaaagatgaggcagactcgcttatttgaattgcacaatgttctaacaaggatgtaacacagaattggcttttttttccctagaaaaagattgtttgtttctatgtcaactagatatgattaaaaataagtattgccaatgctgttttcattctctagtggccagaatcattatccttgaaatttctggtagtgccttagcttggttaaaaaaaaaaaaaaaaaaaaaaaaaagggattaacattaaataaaagtagtttagaatttgggcctcagacaagatattgaacctcattcagtttcacttccacatgtatgtacaagttaggtcaccaaacacggaagtgtgagtgtggaaggatcttggcactgtaagcaatgctatccattgatgtatacaagtacctttatagttatcgatcactgttaaaactttcattttaaaatcctattaccaagttcagttttttaaaacttcaattgtcctggctgattatgcatcactctgtgtgcaacttttttatttcatttagtgtttctttcaagctgtgtatttttgcctattt

SEQ ID NO: 46068 - DNA, 1027 bp, Homo sapiens
ggaaggattggattccactctcttccacgaagagtcaatgggactggctaagatcaaagtctgaggctttttccatcagtaatcaggtatgcattgaactaaaaatcactataattctatgcatgcacctttaaagtatttgactgatatgcatattatgaatgtggtcttttattagattttgagctcacaaccttatcctatagtttgaaatgcacctatgataattaatttgagttttgtaatatactaaaataaaaaggtattatcagccatgaaaaaatttcagctggtcttagaaaagtgtaatatttgaaatcagtgcaatcttcattgctcagtatgtacatccaaagataacagaattcatttgttactccatattgattatcaccaattttagtaacaatcaaatgtttgtatattgcatattggtgcacttctaataattttttttaataacttagaagttgtttttcttaactggaattctttgcccattatggttggattttataacacaatggcaaatatgaccagtctttgaagtattttcagatattagttatatacagggatttagatacttgcattccatgtagattctgcaattgggaaatgttcaatttgtttcccacgatgttctaaataggtgcataaaagtatcaggttaggaaatcaaataatgaaaattaaggtttgtttcctgccttggtagaatgctttataccagtttatagtgtcattactggtcacagcagagtagctgtttagatatttccaagggaagcagaggagctagcttttgaatgagaatataacagaaatagagcaagaagcccttgagatccagaaaatctaaaacaaaaagaacatatgttaccattggtaatgtcagttgcattgtgttaatgtcacttttaaacagcaaggcggatttttagaccgtttgaatagcacaaaggccttgcctgtatctacctaataaagaaagacacctgaagcaagtactgatgaacttacccat

SEQ ID NO: 46069 - DNA, 1117 bp, Homo sapiens
agtttctgtgatgatcaggcacaccaaacaggagttagtgacattttatgtttttctttatcttgcttcataaaacgtgagcattctcagggctactgtcatacaaacaaataactgatttaactatgctgtatgttaagcacatctatcaggtctagcttttaatgtaatttgctcagtttatttttaagaaaaaggtgtaagacattttttcagcaataatttggcatatattacgttttgaaagatgctgtattaaaatatattgtcatatttgcttacccaaatcaaaatgaaagtaaactatcaagtaacaggcttaattagacatagaatgaaagctttaaatattaaactgaataacttgatttactgctgaaatatacataattttaattcagatagttgtttttgtatctgaatctactttttatgcctagaaatttgtaaacaaagtacaaaatacacatataaaattctgtagacgttcctaagcagctagcctttaacagttaataaatttattagttttttttcaaatatgtggtcaaaattacttaaagatcgtgatatattcaattattttcattattcttcaaagaaaagtagtgacaaataggtcagtacttggttgaatgtctgttgtatttaaattcttaattatcaagcatttaatacttttaatggtatttcaattttttaagtacagttacagatgtttttcttaaaagcccttcttttgggaaagtataaactaatgtctgtacttcctatctcacaatattgctgctgagagattggtgacagacagttattttaaaactttacttctgtaactgcttttatttaatatgttctcaagatcatgttattcttaaattcctatctaggagcacttttaatcatagcctgggttatcttttcagctgtataccagagatacagttgctctacttaaacattagatctcatgtggtgcttgaatttaattattcttagttcaccttttatccctcagtgcagggaaaagtagagaaagcagtttgttgtgggagaagtgcaattgatcacattcagaggctgactcataatagcttttgtacaatgcatgatactc

SEQ ID NO: 46070 - DNA, 1051 bp, Homo sapiens
gtttttacgaagtatttctttctacccattgttcaagaatgtaaatgtaaaaaaaaatacaagagagttgggtagatatgcatgcttgaggaaacttgcttttactgttttcctacttgtatccccagttcagttgaatttacaaggacctacaagatggtcatgtttgtcttggtatgtgctaccccaattttagtgtttctttctttattttaaatcagtaattattcagttgattgtttatactatataatgaagtaacaaaaacattttggtttgtatgttttaagtaacagttgtgcaaattcctcttgtttgttaggtgctccctttgaatattttgtgaactgtgtcagagggagaggggtggtggctaggaagagggtcagaaagaagctagagggaggtcaggagaagggtaacagggaggatgcaaagcagacatctaccctggtcaccccaggatcaggatatctgtccttgtttcatgttgaattcaaaaattggatctcacttaggctttgaaggtgacagccatctctgatagctgagcataagtaaagaaaggtggagtgccgatgcagaaaggaaaatattcagctttcctctcttagatcgcactttgaagatggccttttggagacaatctgacaggttaaaacaggaactgttggaattattctagctgtaactacctattggctatgtgttgattgatcctagaaagaaaaaataatttttcattttagatcttgattgaatttaagatgtatttatatgcctacaaaaggtctgtcttgtaactgttgtataaaataaacctaatctatggtttcatttttaatctaaaaaaagttgtgccttaacaatagggcattgtatgttaataagggaaaacaacctttttagtagatgggggaaaataggaactttttgccattaaaacttaagttcttttgatgtttttaatattatagttgggggagattcattaaaattaaattgaaataaaattatttttgcataacctagcatttacaactaaagtatg

SEQ ID NO: 46071 - DNA, 1048 bp, Homo sapiens
cacgggcggagcgcccactcgagccgggtagcgcgtctcggcccgtcgactcttaacagtatgggatgtggagcttctggttccattttgtagatgtggaaattgagacgcagaagttaacgtgcacaaggtcagacagacagcagaggagctgggtgaggttgcacgtagtctgactcagggcccgtgcccttttggctcgtcctgggtcgggtgtgcgccgtgtgtacctgggatcagaaggccttgaaacgaaaaggctgacaaagttaattgcacccgcagcttcaggctcctctgtagaattaaggggttggctaaaatccaccaagactctctatccttccttgatttcatccctagaagggtcgaaactggagtacacattttctgggtggcctgccagtagccagctgaaagaccgagtcttgttgcagagctgttagtgtgcggggcatttgtgtgtgcgtgtgtgcgctcgcgggagtcggggtgggggggtgggggatgagtatgctcatttcgctgtctttttgtcaggacgctctaaagtttatagtttgcgggccctttaaggaggtacttagaaatataccagctgttggtcctacctggcccttgattaaagatccatatttactccagagaataagaattaaataacatttggcttttctttgggtaggtttctgggaagggagttgacattttcttaaggaaatccagacattttggatttgttattaatactttttgaattcatcatttcactggagctgctattgagttgaataaagcatatttaaaatttgcagttccagaaactgcaaattttgttgaggaagagctcagcatagcgtagcagcaccttattaacgtatatcttaactcacctaactgtagttttggctactgggaagaaaaattgtcttcactggaattttattagataaacagtgatgtgcaaacccaggcttctttggaaggtgactgaccttttactgctgatcttgaaagagttaggagaatattgtcattgtttagttat

SEQ ID NO: 46072 - DNA, 1023 bp, Homo sapiens
ttgatcctttatcatatttactatagttatcttaaagtcttcctctgattgatccaatgtctgacacaccttctatagagtcttttctctcttgagcatgagtcatattttcttgcttctttgttatgcattataattttattgtattgtaatttttttattgagcagtttgttaaaaaggaagtgttgagaccgaactaaataatatttacctccagaagtggtcaagccacctcttattctgtcaggctacttgtacagggaggctctgtcaatcaaatctgtcactgagctgcattaagactttgttgcacctgtggttaaatttaagccaacactgcctacaactctattgagggagtgataaagactttctcttccacaggacttgggatctcagcacttgaaggattctagagatatctttgtgctttataactgagccatcgggtttctgaactgtgggagatttcccttgttttgcacctcagtcgacagcatttttggatctctggggagctttctttgctctccagtctcaactctggctttccatttccctgaagatctctcttcattctgcagcccttactcacttctatcataggttgctcctcctcctgccactcacctgttgatctcttctttcctttttgcaatcatgttcatttaggttgctttacatgctcaacattccagtcggttttaaaaagctatgaagattgttcagtatatccagctcattttggttgttagggtgaaagcttcaacagtctcttacagctttcccatcctaacttgaggtggagatcttcctctgtatctttttgtcctgtcacttataaagagatttatttttaacccagttatttcagtaattgccttaaaatgttgatgatttggttgttttcccttattttttcttaaatcagttaaagcagaatgagaagggactttgttgattaaatattttaggagtgagtagtgaagagatcatttttcagaggttttctgcagtaaatt

SEQ ID NO: 46073 - DNA, 1028 bp, Homo sapiens
catgatataccaaaacttaggtgatgcagcaaaagcagtataaacagggaagtttatagaattaaatgtctacgttaaaaaagaagaaatacctcaaataaaaatcctaactctaggccaggtgtggtggttcacacctgtaatcccagcactgtgggaggccgaggcgggtggatcacctgaggtcaggagtttgagatcagcctggccaacatggtgaaaccccgccctgtctctactaaaaatacaaaaattagccgggtgcggtggtgcacacctctagccccagctactcgggaggctgaggcaggagaatcacttgaacccaggagacggaggttgcagtgagccgagatcgtgccactgcacgccagcctgggcgacagaacaagactctgtctcaaaaaaaaaaaaaaaaaaaaaaaatcctaactctataccttaagggtttggaacaagaagggcaaactaaacccaaagttagaagaaggaaggaaataataaatagagcagcaaattatgtagacttgctcccctagaactctcattccagtggggaagttacactaggtaaaacatgcagattttatcatagcaggttctgtacacatgttcttaaagtagcatagtttggcacacttcttctcttcctgtattttgatatcttcccctttttgttagggcaaaatggaatatgtttttgaattggatgttcccgggaaagtggaagatgttgtggagacgttgcttcaggtaagcacttgctgggtagaaaattcaaagcaaactgaggcaaaaactgtttttataaatttcgtatttatataccttacccaaatcatcatctgttttctaaatatgtagcagattgacttaaaatgttgagtttaaaaactatatattaggaagaagccataggtatatcagaagtaatcttgactgttaacagaatgattgctgtttctcattgcttctaaagaaatacttcatatcatctgagagaaaaaataaattcatgtctgtttatg

SEQ ID NO: 46074 - DNA, 1009 bp, Homo sapiens
ccaagttccattcttctattgcttttcttacacattcctctcaggccttcctattggtccatgactttgctagttactaaaacctgtcctctaagatgccagcagcactctgaagtaggtcatcacagtgacatgggaccatggaccgtcctagaaagaggacagatccaaagtgtacacggttattgtgcagtttcaatattgactccactggggctcatttagtgtgttcaatgaatgactgaaagaaaaaaaaaacataaaattaagtgaaacaaatctagaacccgtcaatgcccttgaatgagcgcagatagagcatataaacttggtctcatttttttgccactcttgaaacttgcacctcgataaagctgtagtcctgtgtgtttacactcacgtggtgcattgcttacaaccagttcaattctattcagtcaccctttttgagtactgactccaagactggaactccgttagttctggaggtagaatcagagtgaggcaaggtcctggtccttgatgagtcccctacatggggaaggcagtcctatgaacactggatgctgcttcagtatgagaagtgcagtgacaatgatgaggatgaaattggaggggaatgcaggtaagcgaaccatctgcctggggaaacaggagctggagagccattgagaaggtgacctctgagttgggccttgaagaagaaagtcaccaggccgattgagagactagggggagaaggcagagaggtgggaagatcactggatgttcgccagcggtgtgatcagtaggtgtgtttaaaatgtggcatttatcaggttagaatggctatagagaaggctagaagtgtaggttgggatccctttatgcttgaaggtcctatgtgcctggctaagaacgtaaactttgctgcttactttatgtgtagtcctaccttcccgattggataatggtgagcctccgtggagggtggactggcctcagtctcatattggatgtacagtaggta

SEQ ID NO: 46075 - DNA, 1051 bp, Homo sapiens
ctaaagcataattacatgatattttatacaattgctctttaagagaaggaagaaatgcatttatactgtctttcataattacataattacatttaccagtgcccttttttttttggaatggattcaaattagtatctggggtcacttcattccaggcagaagtcctttttttaatatatttttatataaggcaaatctgatagggacaaatctttagtttttgtttatatgggctatctttattttaccttctttgagatagttttgctaaatataaaactcctggtgaaaagtttctgtttctgtttttgttttctcagcatctgctgagatgccagctataaagcttaatgaggtttccttctacaagacaaatcgtttttctgtttctgctttcaaaaacaaatggtttcccccctgccccagatttcgtactatgatgtatctgggtgtgagtctgtatttattctgcttggaatttgttgagcttcttgggtatgtagatgaatgattttttttaagaaaaatattaaatttgggatgtttgagccattatttccttgactattcatttccacttctttttctctctccttttcttctggtactcccattatgcatgtattaatgcacttaatagagtctcatatttctctgatcttctgttcatttttgccccatcttacaccacccctctggggcttttgttgtttttgattgtttatttgttcagtgacttggctgtactattttattttatttatttatttatttatttatttatttattcatttttgagatggagtctcactttgttgcccaggctggagtgcagtggcaggatctcagctcactgcaacctcctctacctgggttttctcctgcctcagcctcccaagtagctggcattacaggtgcctgccatcgcgcccagctaatatttttgtatttttagtagagacatggtttcaccatgttggccagactggtcttgaactcctgacctcgtgatccacccacctcggcctcccaaagtgctgggattgcaggc

SEQ ID NO: 46076 - DNA, 1048 bp, Homo sapiens
actagtgtaattcttgataataaaataagagttttgattaagaacagcatagagcttcaaaatgcaaagtgaatgattagtaaaattatgtctcattttattttttcagcacccataccacaattaatattaggctggattgccatgggaaacattttttggcattaatgcagcaacataatactcactttaggtattactacatagttgaaggatttaactgaatgtatggatcaaatttatttatttgacatattcgaagctgtggtttaataggaatttgagaaaggtgtaagaaataggataaaaagaaggtcagcaccatgtaccaggaatagctttactttccatacatagaaatataaatttagtggtatcctatattactttagtgtcgtacgctttgtaagacttaaatattttattctattgattccactactttggtatgttaagacatttctttaaagatgaccaacaatatccttattttaggtgccactagcagatgtaagcgtatacttagttgccgttagatgtgacagaatgagataatttatgtaaagcagtagagtacctggcacaaagcaaacaataaatattattgttattgttgttataattgtaaaatgaatgacttcaaaaacatagtcccagtttggagggattttgtgatgcagaatatctaagtcatagaaatagaagacaggtggaataagtatatgttcagagtttttagatgtgttgagtagagacggtaataatggaagcattaaatacaaatgaaaatcacaccagatatccctgaaattcaagcaaagaaagttcatcatgtattcttgggcagcaagagaaaggactagggttatggcaatgtgtggaaaagttgaggcttgctaagggttgagatctgttggtagccctggatcacatggggtcagcaccaggcagtgcctctgaaagcggagagaggtcctggacttcccttgtgtataacagttcctagtgtccaacaatgaggaaacggtgaagcatggttacaaaactg

SEQ ID NO: 46077 - DNA, 1133 bp, Homo sapiens
gtcccttctcttgctgactttgtatttctgaagcagagaaggggtctggggttagcaggcatgtgagggccatgctcactgccggccgccccatccaggtcagactcagggactgcaacacgagcaggggccgtgggtcgtatagtcactgttgttctatgaatgatacatgtaaaacatcaaactttcctctgcatttacttttcctacaatttgtctcgaggatacatacacatttttttgttgttgttgcagatagccaaagtcttagatgcccaaatttcaaagccccaaggcttaacatacagcatgttttatgatactcgaatgcattcatttgcttttacttgtcattgaccctgttaatacaagcagtgtattgatgtagtaaggtaattatgtcatagtcctagcttccttttttttatccttttcataggcagtttttagcatgtgaaattgctcctttgagactgatgtggagtctgaaggaatgcatgcattcattcattcatttatttggcaattattcgacatttgctatgtgccagttactggaatcagtactgacaaggggagataaaaaagacactctcaaagaattcaccatctaggaggaaaggccagctgatacataggtgtacataaaaaaaaaaaacccagtcatttgctgtgtccagcgctatgggatggtatggacgtagtcttgaggtagcacataggaaaggtacctggatgagagctagttatctagaaggccttccccaagccaggtcaagaggtgttgtctgagtattcgtgggaattgccaacaggggaaaagtgtctgtatgcttgtgtctggcagggaggccagagagcagagtgtatttggggaacgcttgcggtaagtgtggagagcctgcgacatgagggggttggagagggaagcaggagacttcctcattgagcctcagggctgtgccatggaggttgggttttctcctgaaggtagcaaagaatcacagaaatgttgtaaggaggagagagatatgaccgaatttgaattcaagaaacatgctctgtagctgcagtatgaagatgtgggtcacatggcaatgagatggagggaagggagtaactttagaaataat

SEQ ID NO: 46078 - DNA, 1962 bp, Homo sapiens
agagtgaaggatgcgtgggagagctgctgttgctgctttcatttcgtgttattttgctggacatgtgggggtcatagcaaccttctgttatccttgttagcttgggttggctgaagtgccagcatttctcttaatttttgtcttttgttaaaaagaatattttttagaacagtttaacatttatagaaaaattataaagacagtacagaaaattcccatataccccaaacccagtttcttctattagtaacattttacattagcatggttacatttgttacaattaatggaccaatactgatatgttactaatccacattttatttggatttccttagtatttacctaatgtccttcttctgttctgggatctcacctatggcaccatacaccatattacatttagttctcatgtcttcttaggcttcttttggctgtgacatttttctcaggctttccttgtttctgatgaccttgaccgttttgaggagtacttactggtgaagtattttgtggagtgtctctcactgagatttgtctgatgtttttcttgtggctagattgggttatgggtcattgagagaaaacacagcagtaaagtgctcatcacatatagggatacatacaccctatcaacatgactaatcactgttgatgttgaccttgatcagatagtgtttgttaggtttatccactgtaaagtcactatttttatccctgttccatactttactctttgaaacaaagtcaccacccacagtgcacacttaaggagtggggaccctcagctttttaaacacacaaaaaatgtgcagcagcttttgaagggcagctgtgagtgatgatgttgctgaattgtggggagtagggaaaaagaaaaacccatgcttttgtggtttattaatgttttgtttaaaaaaatgccccaaaatattgctgtgagaagtaagaaaaatgccagttggaattttgtaatttgtggaataaaaatttattttaaccttgggcctagaccttctttgttggtggtttaattaaggcaatcagttcttacctctaccactaggactcctatgctgttgttgcagctggagaagggaagattaaaattgtcttttattattgagagattataggacatcattttcttaaaagcagtgcctttcagttgcatttactgggtagtcacagtctctgtgagtttttcacagcctcacagcctgacctggctgagtgggccatgggtacagtgttttcctagttatctgttctattattggtagaggacttcattagctccccctagtggtcagttttataatatcagattctacctgggtaaattcagcagtggaaaaatccaatttgtggccatccttatgataattttcctgaatattttaatataaatgctaaaataaatagtggttgaattttagctatgtcttttggtgttagaactaattttaaaataaggcgacgttgtaaggcggtaagtaattataacgatgaaaagctatagtgatgaaggtaatattctaggcagaaggtttacctacctactattatactaggaacctcagtggacatttggtttttaatcaggaattgagcttggcttcttgcaagtgttttatcagtgctgtaggagcaagtgcatattctagataaacttgaaagctgcaaagctttatgaggctaggagtgagggaggcctctgagcattgtttgtcatttcttcacagataaaattttatcgccagtgcaggaaatcgccttcttttagagatttacatcagcatttattattttaccgtggctttaaatatgcagcttttttttttccaggatgctatctctgaatattcttagaaagttgaaataatttactggaactggaaactggctttgtacatctcctgatggaagtactgggtgatgcagtatttgattatgcaggta

SEQ ID NO: 46079 - DNA, 1051 bp, Homo sapiens
ttgttcattttagccgtctgggattttgtacatccctttttgtttgctccattgttatctaagagtaacatagttttctactttctaaaataatttagcagtagggtttggtaaacagggattttgaatcatccagggcttgcttatttgttttttcttttctaatttacttgggtgggtttttgtgcaatttaccatcttggcctgagctgatcaccatttgaaccatggatataactaagggtggtttatggatgattcacttttcaaagactgtgaccctggtccagggcttaactcactaatcctctttcaaatttgtgttgtacagcactggaaatattttgcagtgatttttaaaaacaaatatcacttatccaacttgttgcggagaacaaatattacagatttttatcagtgggcattgttcctaattaacttaccagcgctgacgtggtttgtttaactgtgttcccaatcttgctgttttctattctaactgatctagagactgactatattaaaggggtctacatacaggcagtggtgtgggtcatagtggaatcaaggctgtaccgttggccatggtctgtcaccttctcctcagctgagctgcaatgggatgttctgtggttgctctttctcttccacaggctgtttactgagttttgagtctgttagggagggagatggtagagtggcatataccattcagcaaacaagttttaagtgtctatgtttaaagccaaaccctgtgataaatatagaatgtaaaaaaacaacatttgtgtttaatgattctacagtctggtttaaagaggtggaagtaagacagaaacatgtgaaaagataacgattaaagggttaagtgacaatgtaaatcagttcaaaacacactcaggaagccactgctgtgtgtttgccactgtggctggtgctgagggtatgaccgtgagagataatctaggccacagttcacattcccatggtgtggcaggcctattcaaaagctactgtggctactatatatgaaaaaagccctagggaatgg

SEQ ID NO: 46080 - DNA, 1030 bp, Homo sapiens
catggcgctggccccatgggttgtaccatttagtctccacagcgtctttcttgctgcctgtgagctcctgaggaccgaagctccctctcaccccctttttactcccatcatttgcccactgccaggcacagtggagatagacagttcacactggtgaaagtgaggggatgttggattcagtccacgtcttgatgttatttctagaaggaacctcagtttaccccagaaaatagccctttggtgtcatgtaagagtatgttctgggggctgctggtcttccagtctttttttttgacattcacaactgtgcatgtgcttaatattaaatataaaattgctcatgaccagatgcaatatccagtaccacttcagtggctggaaatcatggctgtataattctatgtcagtgatacatgtattttagagtattctgttgaagtgtttgacagcattactgtaattataataaaaaaatctctggaagctcaggatatctctttcattaaaaataaaagacgtgaaccttagaagtgaaatgttcatgttttaaggctggagagaagaaaaccaaaccagcatgttgaagagtggaggaggtgtgcagtggtgtggacagtaaggagaagcactttctcaaaggccttgatggggaaggcccccagagcttacctgtctaggagctgtttgctcagtgcctatagacatcctctcctttctactgcctgtgacacttctgtgtcacctctctctcctgtcccatcctcagccaacctgacaaggaaaaattcataccagaatgcatcaaaaaggaaagaagacacaaaataatccaagacagttaaccccactgggtcgcgggtcacaaagtgaggggcaggaccaccctggactgtcagcgcctttgccctgcctccctctttgggtttgaaaggccatttcatcatttcatctcagcccccaaagacagactctagtaacaaaagttctagggaaaggtagctgtaaatggggaggcgagaacttctggatg

SEQ ID NO: 46081 - DNA, 1048 bp, Homo sapiens
ttttggctttatcgtaggaaagaggaaatcagatttttaaaaaatgtagcattaatagcatgcatttcatagtgaataataactgtctttttcttttgggaaaaattaaagtatgttgaaatattaggacgtacttgataaatagagactgtgctcgaaaattaattccaagttgataaagttgatacctcaaactataaaatctttaggtttgttattaatcaaggcagctgttgatttccagctatggatttattttattcattgtaaatgtttctaagctttaatttagaatccatgagatagtcatagattcatgtagtctccttcgctgttctgagtttagtcagcatgtgagcattgcccaaaagagttactgggctttatatgtacttagtcagagtcagtttaagatggaaatttcgacttgaatttttttgggggtgtgggtttagctttgatgggacattacttactgttttttaaaggatattgtaaaattattgaatgctgactgttctggcatataaaaagcaatttaaagaagtacatgtgtgttgatgtgttgagatgctttgaacttccggaaataaatgtttatatatccacaaaacaaaaatacatttcatgtcaggtgccatgatcaatattggttgcatataaatttataagacagttcttgaggattcatagcctagtgaaaagccagttctttaaagtactagtgtacacttgatgtggcaagtgttacaaagggttgtgggagcagagagcaatgactaagcacatatactccactgcatctgtgtgtgcctagtcctgctctgagataaaatttacttcatcaatttgaacttaccattttcttctgctaccttctcaaacacaattttctttaatcttctgcctcactctaaaacagagactatggaccaacatctgggccctctcaccatgaagtgtgtttcttcctcacctagcattttgtgcttttctcttcctccttcttccacccctgcccactgaagaagaagtgtctgcacttctg

SEQ ID NO: 46082 - DNA, 1027 bp, Homo sapiens
ggaggctgaggcaggtggatcacctaaggtcaggagttcaagacagcctgaccaatatggtgaaaccttgtttctactaaaaatacaaaaattaactgggcatggcagcaggtgcctgtaatcccagctactcgggaagctgaggcaggagaattgcttgagcccaggagatggaggttgcagtgagtcgcgattgcgccactgcactccagcctaggtgacagagcaagactctgtctcaaaaaaaaaaaaaaatgtgtggcccctgctcttttacccccggtacttcagtgtgtcttctccaaaaacaagatcattctcctctataatgataaaatcaggaaattgatgcatttaatctatagatcttatttgaattgtattaactgtttctcttatgtactttttaggaaaagaaaatggttcttttcctggtccaggagccaatatccaacctggggtttcacatttcattttgctgtcatgtctctctgtctttcttctgtctggaacagttcatcagcctttttgtttttaacttttatgaccttgacttttagagtacaggacatttactttgtggactgccattcaatttgacaacagatttgtttttaatgtgcactttctggaaacaagatattgttcctcaaagaaatgaaaaaaatgttgggaatacataagacatcataacagacaccaggtaggaatttttgaggttgggtaggtctgaataacattcaaattggactataaaatggatatcatgattgaccctgctatgaaagttgttcgtggtttgtcttggtaattcagttgccttatataaaattatgggtttgatgtatgtggtctctaatattttgtcaagctctggcattattctaatgtgaaattctgacatattgttaatgatgctatttacatgctttcttttttgtttgttttattttatttatttattttttgagacagagtctctgtcgcctgggctggagtgcagtggcacgattttggttcactgcac

SEQ ID NO: 46083 - DNA, 1027 bp, Homo sapiens
aattaaatggcacactagtaaatatctatctgttgtaaaggaaggcagtaatggaggaacagaggaacaacaacagcaacaaaaaggacattaaaaatgaataacaagatggcagactttatcagcaattacattaaatgtaaggacatgaaatactgcaatcaaaaagtacagattaacaaaatagatttttaaaaagtgatccaattcaggtccacatgaaacattaaccaggaaagactatacactaggccataaaacaagccccaacaaatttagaagcactgaaatcatacaaagcatgtttactgaccacaaaggaatgaaattaggaaccatcaactaaaagctctccttgtcctcaaaatctgtttgcttgccagtaccccactactgctgtcaaagttactgacttctgcttatatatcttgtgtccttttcctttttgatatcaagtattttattaaaattcttatttccttgggcttttttctttcagccctgcctgtcttaaactctgctttatttaagaagaaaagcaagatcagagtgtgaatcatagaattctcagtgcatggaatctcagtgtgtgtggcatctcatggttacaactccatgctgtgtgattgtactttgagaactatatttgcaggaatgttaatttatgacttaaaaaaaaagtaacgtcaggatgaccacttgacagtagtgactgtgacattaagagagctgctgtgtgcagaaacccagagttcattgaccgtttagttgacagaccctggaacatcaagatattcttctattgtaattttcaaattacagaattgaatattatgagtcatggaacatcacccaagtattgacgtcttaaagtggaaaccctctagatttagtagctgcaacatttggccaaaatacttttagaataattacccagattttggcccttgagtgacttttaactaccatgaatagggcatttccctttttttttagacggagtctcactctgttgcccaggctggag

SEQ ID NO: 46084 - DNA, 1039 bp, Homo sapiens
gatgctgtttttattcccaagtgtttctcatactattacacctacacagtaagagtcttcactgagaatcatggagcttatctctgccttgtaactttttttgttaaaagtcaggttcattaagaaggaatttacatacagtaaaatttaccttttatagtgtgtattctatgatgcatatacatctagatacagcttttatccaccacaactaacttacagaactttgcaaccccctaaattattttgtgcccttgtagtcatccccttttcccaccacagcctctgaagccacttacctgttttctgtagctgcagttttcagttttccagaatgctatctaaatggaattagtcagtagccttttggactaggccactttcacttaacataatgcatttaaaattcatccatattgttgcaggtactggtgttattgctgagtagtatttcattttttggatataccacagattgttttcattcaccagttgatggacatcgggttttctctacgttggggctgttgtgaacaaccctgtggtgaatatttgcatgcaagtctttgtgtacgtcttcatgatttatgttttcatttttcttgggtccgtaattaggagcaggattgctaggagggcatcccagtgaatttaatttctattttttatgttctggggatctatgggtgtattttcagcaatgtaatgacatgaataaatagtgtttcaaaaataacctgagaacaaggtagaacatgggaacagactcgagtcagggagactagttaggaaattgttgcttttcaaaatataccttgtaggagaaattgctgttttcttcactgtcttcagtggaatgggtataggacatagagtaatgtgaagattctgtgtctgtttttattgatgatcaacttctccccatggactgtagtataaaaacatcttccatgaactaagtggaaatgaaaaggagtcaacgtaatttttataatctacaaatgcatcactagtgttttcctcctgccttcagctatcc

SEQ ID NO: 46085 - DNA, 1062 bp, Homo sapiens
cagaaaggcaatggctttgtttttcaatatatcaaataatagatttacatccctgttactgatctataatctcatttgtctgtaatgagaaacctcccattgaaacatgtattttctctattgggtaatacatcagaaatagtttgtcacttcatcatcctgctattgctcaagtaaacttaactatttcttactccccagagaccaggatcttcacagttgggtatttgttgaaagtttgtggtcatcctgtcatgcctaccacctctactataaagcaagattaatcaattttgtaatgtcaggttttcattcttatagcatatggagaaactctaaagacactcttggggtttctctcattgtgattttcaagttgtgtttaaagatatccactctgttttggtgaaatctcagatgatatctaaaaaatatgaattccatgtaatttatttcttaaaagttataatagtgaaaaccagtcaatatcagttctgaacaaacatcggtcaaacatagatcctgctgacatctaaacaatcaaatgaaaaataagatagttcagacataggattaaaaatactgaaattattcattcatataatatatacaatagtccttccttgtccatatgggatactttccaagaacccttggtggatacctaaaactatgaatagtaccaaacctatatatactatattttttcctatacatacacactatgacaaaacttaatctataaattagtcacagtaagagattaacaacaatcactgataataaaatagaaacattataacaatatactgtaataaaagttatatgaatgtggtctccctctcaaaataccttattgtattgtattcagctattttgggactattgtagaccatctgtaactgacactgtgaaaagcaaaaccgtggataaaaggggattcctgtactaatctttacatgtagctgagatgttgcagagcaaaatcacctgtagcaatttttttggtattggggtttgggaacatctgttttgtttcaggtccttcaggagacactgatg

SEQ ID NO: 46086 - DNA, 1052 bp, Homo sapiens
gaataagagagcttttggcctggggcctggaatgatctggtccaggctttaggtcagactgccaacccccttttagatacagcatgggaagttgaagaaagatggtggcccttgtttctgggcatatgtccaaccacactcaccctccacgttcctgggaggacgtgagtctaaaggacatgaggagacccggccagggccctcccacatcgggatcagcaccttccacttctatatggaatgtgaccagttcaaaccactcctccttccttatttccctcccaagagtgggaagatctgtggagagccctaaactccccttcatgaccagcacccacctgttctatctagtccagttagaaacttgcattttacgcttgatttttctaatcacattagccttatgcaatgactgggggatgtggagggttgcagtgttcctgcaggtactgctgatcccactaggaagagctccttcaggactggaattttttatgcttttcttcattgctgtatctccgatgactacaaatgtgccagacattagtaggtgctcagttaatatttgctgaatgaatggtattgaatagtctagttcagctacctaactttataataaggaggctatagttaaagagatcggaaattctagaacattctaccaagacctacatgtccttaaaaaaaaaaaaaagtcctgcattattcttgcagcactgcgcaggaggtatgtgctgtaaaccctataaaatcaatcaactctttgcaaaagtcaagactggcacttctctttgaagaaaggtacacagtggttcagtggaaaaaaagtatgctttggaattatgtaaactgctggccttgatagctttggggactctaatttctcagccatctattttctcctatgcacaaagagggaggtaagaccttctccacagggtgtgagaagacaagagaattcataaatgatgtgcttagcacttagcctggcacgctagatttcaaagttagttttcctttcttcctcttatgtagagtctcaaaggagcaag

SEQ ID NO: 46087 - DNA, 2146 bp, Homo sapiens
aaaaaaaaaaattactttgttggtgggttttttaaaaagtagaatgaaaatgaagcagtttcacagtctgtgtctggttggtcctttaatttagatttccccttatttttgcagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagtaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattctctatattgtcattatttttgaagtataaggtatttttaatttgttacataataaaatcagttcattttatccttactagtattttagaagattatagcatttttgataactaaaatcacaaaggaataccttcagccagttaacgtatttctaacagataatgcttattttgcatttactatcatgctacattgccaggaagcaagattaaaattaaatagcccctgcagccatcctttgtagattttgtcctgcacctagaagttttgattattccctggacagcctg

SEQ ID NO: 46088 - DNA, 1020 bp, Homo sapiens
gtatttttgcacagtctaattttgcatctgattgtaggaacactaattatagggcctacctccttgccatttttcaatctttaaaattcttttattcagtggaagactcaaattgaggacttctgcaaagtgctgaatattagttcactttttcttttcccttggaacctaattgacgattgatttgccttctctgattatcctaatactaagttatacagtcttaatatagcttattaaagttcataataatgtaactatcaatgtgctaatcccaagtggcattatcaccattgcctccatctaaagtagggaacagtgaatttcatgtttattaagcattatgtaggcgctctgctaagcacgttctgtggattgacctttaatagttctaagaccccaagaggtagatatgccattacctccattttacagatgagaacactgaggcacagcaaggccaagtaaccttccccaggtcacagagctgacaagtggtagaaatcggattgatccttgcattctggctccagagtccacactgtcagctgccgtttttcaaaggattttaaataaatgaagacgtgacagctgagagatttgagagcagttttggtgtggtaaaatcagatgtgttatatattcttcagcatctttctcttaatctgcattagttcatcacataggcctcaggaatgtcaaaggttgagttatgatgtatagtagaaaagtaagttgtccagtagtttgcattctgccttctttcttgcatatttataaatttgtaagtgctgtgcacgtggattcttggcaagcatgtggaagcttaagcttaagatttgatttttctgatattataggccaatcactttggatattagatttttaagattgattttggaatttctcatccattagcaggttttcacctttctccttaaactcatagttttccttgaaatcatacagcatatttgtagcaatctgacagcataaatatacacaacacaaatggaacga

SEQ ID NO: 46089 - DNA, 1028 bp, Homo sapiens
aagaatgttatatgttttcatagggcagagtatcataataaatgtaatttaaaatgttagcaaaaggcagtaaatataacctaagagattgacatgatttggtaagctactttggatttctttgttatatagaacataaactgtttcaaacaaatagatctaattgaacagtgtattattcactatatgctaaaacaatacctttgtgaaaattcaggaatcagagcagagaaaccaagtaactgacatgtaagtgaagctgtaagtagggtgaaaacaaaaccacatttcaatgggagaatagaatatattctgtatgaaacttgcaaaccccagaacatacacttcgatagaactatagtaggaaccagcttctacatcaaagataacctagaaatcatcatgcctacattggacaaacctgggaagtgacagtatggccttaccatgtaattgacttatttattcatacactgtttagtgtcttcggtctgaaacacaggacactggagcagttctagtgaagaacacccatggttcctgttctcatggatcttatattttagtagggtagtagaaattaaacaagcaatttcactgtagttttcatttccagttgtgataagtgctaggaagaacaagtacagtggtaacaagaatatgtaatcaagagaccttacctagtttgtggatgaggcagggccttcctgaagtttgagctgaaggtgagaacaattgacaaggcaaggagaaaggtgactggagagtcgtatgaggtctctgacgtgaacttgcaagagtaaggctgaggtggtgaaatgggctgggttcagaggatgcctgtgagcaagatcaaggacgttcatcttcacctttgagcactgccaagtcagatctgcattttgaaaagattgatcggtctggcatgcaacaaacagactggagagacaagagtcaatacagggagaacagttaagttagctgtaatcatccaaattgggtctttccgtgcatcacatctctctctg

SEQ ID NO: 46090 - DNA, 1682 bp, Homo sapiens
cccagttgaggaatttcgtacagtcacatgcctcatgctatcattttggttaaggatggactgcatgtatgatagtggtcccataagatcatagtgtcatatttatactgtaccttttctgtgtttagatacacaaacactttgtgttacaattgtctacagtattcggtacagtacgtgctgtacagttttgtagcctgggaacaataggatgttgcatacagtctaggtttgtggcaggctataccttctaagtttgcctgggcacactgcaatgttcccacagtggtaaaatttcctaatggcacatttcaacatgtatttccacacattcctcagaatgtatcgctgttgttaagcaacacatgactgaacttgcagttccctacccgaaacacacgtgtaacttacatagccacatccctgatttccttcagggtctgttcacatgttatcagtgagtccttttgccaaagtattatgaatagtccccacccccacttttccctaatgtgctccctgttctgtgtcttccccgtactatctgtccccatccaatatactctaaatagttcatgtttcttattttttaagtttctctctcccccggaaggtaggtgtgttgttttcatttactgtagaataatgccttgaattaataggtgctaaatatttgttgaacgattaaatacaacatacaatttagtaagtttacaactactgcatatttatggaaagaaatatattgattctttctcattatgggcagcagtgaataaagtaagctaatcctgggcttgggtatttgtgtcactcatatttgctatgagtggttgatttaaagtgctgatttcatttgcatttcatagcttcatctaattttaattaaaattggaggggcaattatatagtgattaaatgcaaatgttttataatttccaaatttatctgattaacctaaagaactaaaaccaaggtatgttttaagggaattaatgtgttttccaaatcatgttgtggccattgctgtggactggcagtatctattcaccatacataatgactggaaggcggctgtggacaccctgttcctcttggcagcacaggaatggaagtgggtcccagtcctgatgattaacactgaaaagggagactgctggtagcttctggaaaaaatttcctcaagcctaagaaagaagcagagcaagagatgctccttttgcttctggacatcgccttgtctgaaaaagaagcttgcagctggggagctctgattgccagcctgagggtgaagcttgacctgcgatgcagtcagccgcctccgcacttcttgtttagttagatgataaatttccttcctacccaaccattataagctggcagtttggtaactgcagccccaggaacatcgaaaccgacacatctcatgtcataacctaattttgaatatttatttcattgctacttcattgccacttgtacctcataataaatccatttttgaaaacctttcctatgactgaattgagcttatatgcatttacttttcttgattcattttcgcttgctttttccctcaaattttagaactaaaatgagcttgggtggcaaaaagttttttggaaacactgaaataaaatcttgtacggcaaattcttccatatgggttgttaaagcaatta

SEQ ID NO: 46091 - DNA, 1052 bp, Homo sapiens
tggaattttaagttatactgtatttactttaccttttcagagttgagaaactctgtggaacaggcttcgtgttgagatatagtgttgtctcctcagagtcactgttctggcttattcggatgtgctgacatttgtccgattgcaaagacgctgggttctccggagtttggcacgaaaacaagacagcagcactctggggattcttttcagccctttagcttccttcagcctgccttgctttgggacatgagtggtgggtataagtcagtaggggaagtgtcttctgggtgccaattttacccagtcctgaggcctggctgtcagcctgctgccctggggatcctgcagacgcctcggtgctgaggacatatggaatagtgggctgtcctgcattttcatcttgtccttgattctttctttattctagaaattacctccctgtcttatagagctgtatccagacatgaaagagggactattttctgtttgaattatttttatttagttagatagaacagattgtctaccttgatgtttgtgactttggataattatcaaaaaattagatctagcacagccagttattcttaatttggtcacttgacagttaactttttgggaattgatgctccatgaccctttctaaataatccgctgggctagctccttaagtctataaaacatacaagaaattttctgtgatttggctgtggaatctttgatcacaatgcatatttggaatgcttaaagaaactcagtgacccagactttattttcataagttaaatgatggaaccagtattcagaattcactgcctttgttatttgttgagatgaccctgtaatacttaggagttagatattaagtagtttgtggactccttgaaactaggaaccagatcttcggttttatttgaattctccttcaatgctaagccttgcatgtgatattcattaatatcatatgaataatgtcatatgctggtgtgggtcctgaaggatgaggagttactccttgcataataaaatactgagttttttttttttaaaaa

SEQ ID NO: 46092 - DNA, 1028 bp, Homo sapiens
ttctctaggattttgcttagtgttagtttgtcagagagctaaaaatttgaaaatgcttgcacttcctcacgttttatttaactataatttctacttttcaaatatttcttgtcttctatatctaatcaaattactttcaataagtgtatcattcatccatttattctgaggggactatgacaaatttaaattgttatgaattactcttgtaggctgtcataataacagcctgaaagtagcagcctcaagtcagcatgggacatccattccctctgcccaccatttacctgtgtcagcaaatactgtccaatttgctaatcttattaaaaagcaaacattctgtagctacttttggatgtggatatacacactggacaataatctcttaaagtttaaatgactattaaagtgactattaaagctcttgtttgtcttgcctgcactaatgggcaaatatgttttattctgttaatgcagaagatagtctgttaaagcttctgtttccaaatattcaaggacttcagttaagctgtcacttagtagcatgttctgcaacaaatgagtatcattcagtaatgttccttctgaaaatttattcaatctttgtatttattgtgtcttctgctttcatacttgggtactatgaaatatcaaagtttattaggtttaaattctaaaggaatcttcagccccactcaatgaaattcacccagcctaatttccgggatatactttttaaaggaatcttatttgttaacgtgttgttactactaacactagaagatattcgattaattgataagaagtaaatgattaaattttgtgttaaaaatatttgaaattactaatttttcatcaggctttatttgccctactaatgcatattttatgtacagaaattaattatgctttatttttgtaagtgaaaaacaagaatgtgggataaaaatttgctacttattttgtaccacctctcattagttcctctgaaagcctctgatgaaggtgacacccaggtagctgacgaa

SEQ ID NO: 46093 - DNA, 1030 bp, Homo sapiens
tcttaagtggggtggtggtggggggaggggagaagtttgaggaaataaacctttctagtttgaatgaacaaatgaacgaatgtgtgtataatcaactctcgataaaatctggttggtaaatgagcaaatctggaggttgtcagagtatatatctttttttccctgatactgcttttactcactcttccttttactgtcaactgatttttccattactgtccattgatttttgatgataaaattttgtctttcaactcaacactctaatgagagaaaggtaaacctgggtaggggctggtaggagtggtgaggcttggtcaaattgtggctttcttttgacatttgattgagagttgattgtaaggtgtgcattttaatggacttctttattttccaaataccgtttctgtaaacctctctgaccttgatgcacctcgcttttgagatcacccttcctccacttcttttttccacctaactgctctccttattttctctctctcttcctttattcttatgtaggcctgaccaaagatggcagtaatgaaaatattgattctcttgaggaagtccttaatattttagcagaggaaagttcagattggttttatggtttcctctcatttctctatgatataatgactccttttgaaatgctagaagaagaagaagaagaaagcgaaaccgcagatggtgttgatggtacgtcacagaatgaaggggttcagggaaagacttgtgtcatattggatttacataaccagtaaccttgattcagggactgaagtcattggctaatgaacacctgaagcagcctcctttttcttttctttccttggcttatgcagggcttaatgtgcagtggggtggttgtgatcttaccgtgcaagtcaaccatgtgatcttgcccagtacagctactagctagtcccttgctcgctcagctcccccaacttctattgaagaaaatggtactcctcattcttgtagtcagctacaaagtacactgaaaatgatgttcttggtggta

SEQ ID NO: 46094 - DNA, 1022 bp, Homo sapiens
tctatgttaatctatttacatttggtctttatttgaggcttggttgtttcttttggttcagatattgatagtgtgatgaaatttcatgctttagaaacattaaatttcaagtgacttaggaatgcatcaatattatttcatatatgctaaaaactttaccaagaatatttttagcagtataataaaaattattctgaactaattagatcaggatgttgttcaatctttaaagataatgctgtgtcagttttatttcatagcatttattagctgaacatttcctgactctcttaactgaattgctcgctatttttaggtaagatattcatttgacactgctttgcaggattaaaagagcaaagaattgtattaattggtaacatttatgactgagttgcatgacttcactaagttataataccttattaaatttcttttcttttttattcccatatccatcatttctgccctattataggaaaactaggaatctatgatgctgatggtgatggagattttgatgtggatgatgccaaagttttattaggcaagtacacattttatgttttttgttagtggtgataaaatgctggaaacaattatttttgctttaataatatctatctcaatagtatatatcttacaggagacttttctcccttaaatcatatatttcattactgttaaaattttaaatggcttatttttccacactctttcatgtcaatttacttttatcaatgaataagtgtatatctcttacacatatatcttttgataagtataataatttcatgtgtgtttccagatttaaagtacttcttattctgaacttagaatttgaatagataatatcctagtctgtttttagatatggtaattatagccatttttcattaacattacacattcacttccatttcaaaatgtaaatttctacaggcttacataaattaatgatgaaataaaagtgataataaacatcttaaaatgtcccatgcatattttaacggtagcattaa

SEQ ID NO: 46095 - DNA, 1050 bp, Homo sapiens
agtggtgtatttttaaaaaatgcatatatccttttaacacaaagaatttcattttttcttccagaagaatatattggcaatatattcttgacttgagccgctggaaattactaatagtattctgtaattagaactggacttagaagtcaaagggcaagttctagattagagctagtggggttttttgaaatcgtgtaatttggcccactgattagagattaaggaactcagagctgtagagatgagagtatgttcttagttctacccaacttgtactggtgactttgggagaatcatttcatgtttcacttataaaacagataattattcctgtccttcttcctgttggttctcacccaggaactgcccctgaagggaacatgtggaaatgtctggggatgttttttttgtcataagccttgacagctccttgcctttgagtccaggggaaaccagggatgccagaaatcttgcaatgtgaggaacaggtgcacaggatgaaacattgtcctgcataaacatccagaaatgccctctgtagaaatagtggcaggacaccgtgaggatcaccggcagcaaagcacatgaaagcactttgatggcgactctacctgccacacaaatgggagacaccgccctggccttccatcatctgtttgataaacttttcctcttctcagaaggcattttgggatattatttattctttttatttattaatattgatatatgtattatattcctttttatgggaaatttgaatattgtatatctttttaagggcagtgttgactattttctgttaatatcaaatcatttttgtttatttttggctgtaagaagaatatttacaaaagaatataaggtatattaagcatatcaaatgcgataaatgacactttaggtggacagcagtttacaaagctgtttcctgcagtgagaccaattgtgaatgagccttttcctgtttccttaggcctcaacggatcttgtaaaggagtaggaatggattgtgctgtttcacttttctgtccttttctctctggctaa

SEQ ID NO: 46096 - DNA, 1045 bp, Homo sapiens
ttcatgtagccatgaagaagaatatgagatatgtatctgacttttagttcttttggaagacatttctctcctcttgtggattaggtaatccatgtagttaggaaaaatcagctgttgcatctgatgcacttttaacagtttttgattcccaaagggtgacattttatagcatggaaaaataatcagtttgatgagttgcttgacagtttttgtgtttttcaaaaaactttaaatgtgtagagtttatgtgtaaatatgaaattcccaacataatgctaactaaaacttataaatgatctataattcagttagtagtaggccagtgaagtagctggtgactgttcaagtgctggggttcatcttcttgtctccctttcctcaaccaaataaataaaactacacattgcccttcccccggcttttgttttggagagtcttcattttggactgttgcttgccatagtaatttctgtgtttggtggtatgtgggaacattttctgatttggaggtcatgtacttttgatggaataacatgggaaaaaatgaatcgcatcgttcttgcagtattcttaaaccccagtaaaaatccgctttgactgatcccagaactacaggttgaacatgaagccagaaaatgaaatgaagacttagatttattctgatcttagaaaatagggacatctactagatgttcttcccaaatacctttggaacaagatactggtttcagatttgcttagggagttgtaaaccctcttaagggtttgtcttaccatgcgttcatcagtttcattggacagaaactgatctgccctttgggactaggcacagcatatttaccaaatgacatatcaagagtatattgtttgctgtcgataaaaactgcccctaaaaaaggtgtcttaaaaaagaatcccttccataacttagtattttgttcctttgtggaactagtaaatatcaacagtaataaggttaataatactagagtaacagctcatttatttgatattaaaaagggatatataaaatattgctgataat

SEQ ID NO: 46097 - DNA, 1031 bp, Homo sapiens
aaattctttataaaatacatgggatattctaacatctgtgagaaggtaagccatttaatactggtaatttggtttaattgacttgatatgctgctcattttcctccttaaatggtaataactagcaataggtacattggtttgttaaaaattgaactttcttcatgactaaaatataatgcttattttcttgaatcttaagatttatttgattatttggtggtttctagctggtccatctgtttagttgtaaccagtaaatatacctggagacctagggagcctggcatggatccaaacatagcccaatgtttcaatcacatatttgctttgtaacattattaaaatgaaattaacttatatgaaggtggaaaactcttaagccccttgtatttattttatagtttttttctagaagtagtacactatttgtgttaataagtacccaagctaatttttagaattaccttgttatcagtgagacatttaagatgactgggtaggatagagtaacattgagtaagagcacagttcactagcttaagtacttttactgatttggagtaaacttgaaataaactatgtatgttcaacaccttcctgctcagctggtccttcaccagtgccttgtggtcttagtgtgcttttagcttatgcttattcgtattttcaatgccagctatttcacatcttcaccaacttcagccaatatcttactatttatctttcagttgtggcagacggcaaactacagtgagaaaaaaagcagaacagtggggccacctctgaggctggggatggggtgcaatggaaatggccatgagggaatttaagcagaaatattgatgttctagatcttgatagggatctgggttacatgttgtatacacttgttaaatctcagggaatgtatacttaaaatttatgcatttcattttgtgtaaatttcactttaaataactataaagaaatgtgtaactatagtttatgatactcatgccgaattatttaggagatgtgtgctgatgtcta

SEQ ID NO: 46098 - DNA, 1032 bp, Homo sapiens
ccctaccacacctggctgaattttgtatttttagtagggacaaggtttcaccatattggccaggctggtctcaaactcctgacctcaggtgatccacccaccttggccttccaaagtgctgggattagatgatctaccgggaagcgctatatttactcagcaaccaggaactccagtgagttttggtgtctagagtttttactggaacgttattatgaaataattgattgaatctttgcctgtgtgattgaactcaatctccagcccctctttcatacttggagattgattgggctggctcgaagtttcaactttctaatcatgaagttagtttttctgatgattagtcttcatcctgaaataattgagggacccaccttgaattaccacattagcataacaaaaatacttatatcattccgggaattccaagggttttagaagcttcctgtcaggaacccaggacaaagaccagatagattcttagtgatatcactctgtataaatagataatgattattgtgggttacttgatctccgaatgcttagaattgaagccaccagctatttctgttctcatagggattttgcaaggaaggtagcagtcatacttaaaacttgtagaatgctttgtgcttttgaaagctctttcttccattgtctcacttaataattgcaaaaacctggtgggaagtacatgtattaggtcagagtactttggttgtgtgttgccagaactcagtttatacagaaaaggaatgtttcaaggtgctgtggttttcatggaagtctctagtaagaataaggggcctggtttgaaacagctggcactatcgccttgaaaacgtcagtttcttttttttcaaaatctgtttgttggtgtttgagtctgtgcagaaccttcagggttgaccactaagatatattgctttttgatctgtttactgagtcaaaatttcttggcttggttcatgttcttttctacattgtttgtatttttatttgtttgtcccagatacctctgaaaatatg

SEQ ID NO: 46099 - DNA, 1045 bp, Homo sapiens
ggcccgtgctgataatccaggacaatgttctcatctcaagatccttaatttaaatcacatctgtaaagtcccttttgacatgtatagcaccaaattcataggcttcaagaattaggacatggacatttgagggccattattctccctaccataccttttgatatcaataatgaccttattaaagcttttgcttgatagtcacctgtaatagtttgttagggctgctctaacaaaataccacacacaaactgagtggtctaaacaatagaaatttattgtctcatatcctagaggctagaagtctaagatcaaggtgtttactgggttgctttcttctgtgggttgagagagagattctgttccatgcctcttgcccagtttttggtgattttctggactctatgttatatcatggcttgtggaagcttaaccctgaactctgcttttatcttcacacagaattctccctgtgtttgtgtctgtgtctacatttcccctctttgtatggatactagttatattgttttaggggcccaccctactgcagtaggaccacatcttaactaattatatctgtaatgatgctatttccaattacaataacattctgaggtactagaggttaggatttcaacatatgagttttgaggggtcatgattcaacccataacagcatcatttgaaaaaatagattcttcttatgtgagtctaagatttttatttctactaatcagatattgtaaacactcttgggcacattggaggaataggagtgatggttagttaaacgttttgattaattcatgatttaggcaggcattgtgaccttatggaaagttgaaaatagataacttatggcttaaagaataaaaagcatattgtatttcaaagcacccctctctcatacagctaagcatgtccttcctttagctttaggctttgattcctactaaaacacattgatcttggggcaaggagctttcgacttttctcactggacactcacaccacagagtaaatgagtttcagattttttccttttagt

SEQ ID NO: 46100 - DNA, 1114 bp, Homo sapiens
acctcctacgtcagcctctcaagtagctggctaatttttgtattttttatagttacggggtttcaccatgttgctcaagctgatctcgaactcctgggctcaagtgatctgcccaccttggcctcccaaagtgctgggattacaggcatgagccactgcccctggccctgacatatcttaaaaataaatatttttgcttataaatttgcctgggcttatcttttatttgtaatctgagcatgtcagtgacagaatttggtaccaagaatgggatataataaactattttaagatctttattttgttactagtttctttatgatcatagtcccatctgaggcatatttgaggttttggaatccaactatatgtgctggggctgagagaaagagagagaaaggttgagactttaagttgtgcagtcacttctgcctgcctatctctctgaagagtatttcccagcgtaaatgttaaaagggagacattaatctgctgttccctcaattggtcatagattctttgtggcgtgcagtgtgagcttctcactgtgcagagtgtgattctagtgtttaaagataaggattttttgtacaagatggcctcaaaagcaagccaactacttcatctggtgctcacccaaagaatgagccatctgtttgaacactgaaagaaaaactggctgtgttggacatattgagaatctgcctccaacatagtctgtaaatgttgtatactgtattttaaaggtgacttagattttcaagcataatttggactccatgagattttttttcttgtgtgtacaactctatgagatgcaaccactataataaatgctgcatccttccaattttcctttgttaccggttaacatagacaatcaaaaaagctctttatcttccaaggtgagtggatacctctttaaaaaatcttttcataggctgggcgcggtgactcatgcctgtaatcccagcactttgggaggccaaggcggatggatcatgaggtcaggagttcgagaccagcctggacaatatggtgaaatcccatctctactaaaaatacaaaaattagctgggcgtggtggtgcgcacctgtagtcctagctgctcgg

SEQ ID NO: 46101 - DNA, 1028 bp, Homo sapiens
catgcttatttctgatttatcaatatttaacaaatttcagccaggcacagtggctcatgcctgtaatcccagcattttgggaggccaaggtgggaggattgcttgagcctaggagtttgagaccagcctggggaacatgtgaaaccctgactgtacaaaaaaaaaaaaaaaattagctagctgtggtggcaagtgcctgtagtcccagctacttgggaggctgaggtgggaggattgattgggcctggaagattgaggctgcagtgagctgagataatgccactgcactccagcctggatgacacagcgagatcctatctcaaaaaaaaaaagcaagtgtctcaaatgtcttcatttattttgtcatttggtttttatttttaaaaaatgggagggggcataatatttgctccattgaatggagctagaattatcctgattcttacagaatttttacaggagaatatgatatatataaaatagtggttttgattttctgttttataactcatgagctgtgtgattctaggcaatattttaatctctaaactggagatttatttaatctctaaattggagatttattaaaatggagatgattcctctgcctcatggggccgttaattaggatccagtgagagatgagtgctttgaaaactaaaaatttaccagtgtgcaatggatttattgttactagaagtttctcaagtggtaacctttttttttttttttttttccgagacagtcttgttctgtcgcccaggctggagtgcagtggtgcgattttggctcactgcaacctccgcctccagggttcaagcaattctcatggcttatcctccccagtagctgggattacaggcacctgccaccaagcctggctattttttgtgtttttagtagagacagggtttcaccgtgttggccaggctagtcttgaacttctgacctcaagtgatttgccctccttggccttccaaagtgctgggattacagatgtgcgctaccacgcctggccttcaagtgat

SEQ ID NO: 46102 - DNA, 1023 bp, Homo sapiens
tttcttggttaacagttaactgttttagaaatatagagagatcttttgtggatatcagagtctgctcttgctgattttacatggaaataaaggatatgtgtcttccttgcatttatttttaaatactttcttcctaatcttaactaatcctgacaatccaaaaaataaaggtgtaaccactgggcaagtaaatagggtgaaaatccttgtctgttgctactcttttcactagctttgtgatgggggaaacaaatataccttgagctcatttgggttcccatctcatagatgggaggttccatggctatccagtggctgcagtggctagacacttgctttagtcattattacacagagagcggttgctcatttactcctagaatttcagcagatcaacttctgagttcttatttgtactctgcttactcctttctgtattgacacagtgctcagcaattgggcctactgtcatgtaagaggaaaatttaccctgagaataaccacggtaattagaataaggagtaaagttgattttgtaataactctcaatattttctgtatcagatgttggtcccattccaagatactcctgtggaagttgaacagaacacagagctacctgactacctgcctgaggatgagagtcccacaaaggaacaggacaaagcggtgtcccgggtcggctcacacccagaaggtggagctagctggcttagcacagctgcaaactttttatccagatcattttattggtgacttcacttttgggctcaaggactgtgtgaaccaacaaggggccagttttccattgttgtggtgaactgtcaagtgcaatttgcaataagttatcatgaaaagtttttagattacacgatcgcatatgctgcatttcacgttttattggacattttaccccactgagtggtaaaaaggacagaggctacagatggagttgctttgtttatgaaagtattttggtttgttttctttcatttaattgcctcatatttaaaaaccatgggt

SEQ ID NO: 46103 - DNA, 1033 bp, Homo sapiens
aaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattt

SEQ ID NO: 46104 - DNA, 1021 bp, Homo sapiens
gtttaaattagctattttacttaataactatacttaaactaagtctggataagaattacgcttacatgtcccagagataaacccactctagcactgaacctttaaaccttgctctacttgtccctggcagttgacaaaagagcctggccctgcacgtccctccctggcccccgcatccttccctttgatgtcagcaagactgatggttgagttgcctttcttgcagatgtacacttattcatgctctgagtagatgctaattgctagtgacaaaaatatgagtaagataggaattttggcccccagaatcttacttgtaaaacatatgggaacctgacatggaaaccacaggaatgtcaggcctccagggcaggaatttttgtctgtctattccctaatatttacctgtcccctaaaacagcaccagcacatggtaggtacttggtcaatatgagctgttaatgaatgatattgtatatgggctttatcattggctgggtttactctaactgttctctgtttttatgtttttattttgttctgttttgtttttcagatggagtctcactctgtcgcccaggctggagtgcagtggcacaatcttagctcactgcaacctccacctcctgggttcaagcgattctcttgtctcagcctcccaagtagctgataggcatgtgccaccatgcccaactaatttttgtgtttttagtagagatggggttttgccatgatggccaggctagtctcgaactcctgacttcaagtgatctgcctgccttggccctgcaaagtgctggaattacaggcatgagccaccatgcccagcctagttctctgtttttagacctctagagcagtggccgccaacctttttggcatcagggaccagtttcacggaagacaatatttccttggatggggagggggatggtttcaggatgaaactgttacacttcagatcatcaggcattagattcttataagaagtgtgctggctgggcttggtggctcacacctg

SEQ ID NO: 46105 - DNA, 1050 bp, Homo sapiens
aggtggataggagaacttctgagaaagtcctctcctgcatttgctgctctgagtttgaagtccaaagcagcatattttggggtctcattttctgaccctcattgtgatatttcatatagtgcccagatcaagagatagcttaatttgtaatttatttggttatatacaattttgcttatatacagcaaaaagattacaacttaatgaaggttcacataatgattagcattttatagcaataaagtcttttaaattaaggtgtatacatcgtttttttttaaagacataatgctattgtacacttaatagactatagtgtaaacatagcttttgtatgcactgggaaacccaaaattttgacttgctatattgcaatattcactttattttagtagtctggaacttaacactaaatatctcactggtatgtctatacttaatagtgagagaccatcacattgatttgatatcctttttaaaatctttcaattttaagtagagagaaattacaaattattcaggaagtaatttattactgtaggaaaatggtaaaactgtggaactataaaataagttaagatgttgctggtggggacatttaatatttcatacatgctgggcatggtggctcacgcctgtaatcccagcactttgggaggctgaggcaggtggatcacttgaggccaggagttcaaaaccatcctggccaacatggtgaaaccccgtctctactaaaaatacaaaaattagtcgggtgtggaggcatgtgcctgtaatcctacctactcgggaggctgaggcaggagaattacttgaacccaggaggcagaggtgagattgagagagagagagtgagccgagatcgcgccactgtactccagcctgggcaacagaatgagactctgtctcaaaaataataataataattaatataaccatttttgctaatctgcaactgctttatctaggtaaacagaagcctgtgtgactctacagatacaattttgcagtaaattctcaagtttataattaatatagtgtgagtagccc

SEQ ID NO: 46106 - DNA, 1049 bp, Homo sapiens
aaccttatgataatctaaatatacagagaatgaataaacattctaaaatatttatatactcgaagatggttgttacagcaatagcaacagacacgttgttcacttcttcagaaatggctccacaccacatggactcgtgtttgtaccaatagagcatatcaggacctgaacacattttaacatttaatttatttaaaatgtaagatttgaaatgcttttttctttccacatgaaggtgatacgtcaggtagtttttaaaaatagtctcttttggcctgccacatcttttctgtcattgcttatgcaaataatgctccaattaatgtactttttcatcagctgtggtcttttgttggcagttggttaggcagttttagataacaaggttaaccaaacagtcctttattatccttcataaatattattattataaattttcaatttgggactagtatgtcttttatacatttttgtaagagtcatcatagacgagagaatactagaatcgtgtattttattgcattatctgaatgttggcagtaatttatgagtctatgtgaaggatgtagtctacttaaaatagactttttaatatgtagcctatttaaaacgtggtctatttaattgttaaaataatatagtatatgtgtcctatggaagtttacaaaactgagaagtataataggaggtataaaaaatggagagttacaccatggaagggaaaacgaaacatcataaaaatggtagtttttccaaatttaatttctattcttggtgtgactccacttgttagtgacaaaggagtggacgttgaggacgaaaacagtccccattgcgtgtagcagctctttccaaaaactcggctctgtagggggatggagcaggtgaaactggagggggccaggagaggctgtgattctttattgtttcagagatgagagaatctagaacatgtctgaatgctgatgcttgttgagacaatatagaaaagagagagagattggtggggtggggtggggatagttgtacctgatagaacaaggaatatc

SEQ ID NO: 46107 - DNA, 1077 bp, Homo sapiens
cgtggactgttaaagcaagtagtggtcgggtctcaagagccagaggcttttctgttaaaggcctcttttgtgacatcggttgtgggaaaacatgcgatttgggtgatagaaaagaatctgtggaagagttagagtaatactgctccagttgtgttggttcttcagcgcttgtttccttgacctggggcttgtatttcctgtctactttctaatatgaggaggggaaagcaacagaaaaacatgtcttttacattcgtctgctatcccactttttgtgatttggcttagagaagctaagaatcattaactggaagtaatacccgtgatcactaagtcacagtgttcatttaggtttggtggaggctggtagtttgttcttggtcacatagtgaagtaatgtgatattttagaaaagagccagcaaagccaactgctctttaatagtaacttgattaattcactgagccctgttggctttctaagctggattggaatgtaggtaaccatgtaaactagcacaagcctgggacttaaaataaatagtccaggcttgatggaagtggagctttaataaaggcaagtttaatctgttgtgcattatgctgtgaaataaataatttgtctcatgtcacagtgagctcatgagaatattggtaagagggccaggcgtggtggctcatgcctgtaatcctagcactttgggaggccaaggcaggtggatcacgaggtcaggagttcaagaccagcctggccaacatggtgaaaccccatctctactaaaaatacaaacattagctgggcatggtggtgcgtgcctgtaatcccagctactcgggaggctgaggcaggagaattgcttgaatcaggacctgggaggcggaggttgcagtgagctgagattgcgccactgcactctagcctacgccacagggcgagactccgtctaaaaaaaaaaaaaagaaaaaacaatattggtaagaaggtcagatattgtgtaatacagccagagggtgagctttttagtaattgttcggatgaaagtactagttaaattctcatagtcactcttgttcccag

SEQ ID NO: 46108 - DNA, 1032 bp, Homo sapiens
tttccatttttcatatcccttttagcccatagtatagtgctaggcacagagtcggctcttaataaatatgttgcttctttctgcagctttctaaagttttgtgctgaggattttcaacctcctgtaaaacagatattgcttcccaatggcctttttttaaaaaaaaaaaaatgttgcccatgtgaataatatattaggtcatcttatcatacacttgaatcctctttcagaaggctaacttattaaaatatagattataataattattataggggtagatttaaaaaaaatcctcctcattcagccttacaattaattactgagattttgtgaacccttttgaataaatcagctcttaactacctgttccacatatatgatcagtgggctgttacttatgaatatgataccacacggacctttgttgcatatggaagcttcttcccgaatgacaaccttctaaacttatgttttattcttgattctgtccaggagatgtacgtgtaaggagccgagcaggatttgaatcagaaagaagaggttctcacccatatattgattttcgtattttccactgtaagtgttggtagacatgaagtttctcggattttcactacaaattttaataaaattacacagttttccaagggaaaaagaataccagaaaaaaaactctattatgtttggaatgtttttaaaacctaggtcatgtaaatgacactatttctaggtaatcttagtaaatacttagagacaattagaagaggaagatactaaaatatgaaagttgatatagcttttctcttctcctctaatttattacttttttttctttaaaaagatttttttaagttgttttattccaaatggttagtcttcactacttcaactgaaatgtttttgtgcaaatgatattttataaaggtatttcagtagtttaacttatcttttaggtttatttgaaaatgtatatcacctttaaagatgcttggtagaatgcctatttcaaaaacaagcattctttgtggattt

SEQ ID NO: 46109 - DNA, 1049 bp, Homo sapiens
tttaatacctgctatgtaattttccacgtttaaacataatgttttaagcataattatctcttggtcttcttttcttagtgaatatgattgaagaaatctcttaaagaaaaataatgtatttaaattttaaaatctttgtgttttaaaagttaagaattaattttgttgcagtgacagctattttcttgtttttaaaggattggcttgccaagttattgaatgaaggtcaagttaatgttaataatgcattagttgtcttgtgggtgttttcagagactttactttttttttttcccccccctgtagagatgaggtcttactatgttgcccaggctggtctcaaactcctgggctcaagcaatcctcctacctcaactttccaaagaactgagatgtgagacaatgcacctggcctctagactttactcttttaattgccaccaaaaaattaaattgtttttaaacaaaaacaatgctaatattttatttttaaaaaaactgttgaaaaaaggaagaagaatgggaaggatactgtttggtagatcagtgcaatatttgaatactttaggcactcaagtacaagcatgtttttctagcatatgtaagatgactactctgaaaaagctcattttgctatgtcagaggaaattgacttcacaactttggctgggcttcatcttttgctatattattattttttcggtaatgttgccaaaaattttgttcagtgctcccgtgtttaagccctttaaccatcagtttatgaatctgcaaaatggaactaataaagcctaccttatagagatcttgtgtgggttgaatgagattttgtgcgaaaacacttggaacatttttttggcacaaggagcacagcaagtgttagttaatatattatcactcttaccgtgtaatggaaatggcacttgcttttgctaataaatcatttagtggaaaacttggaacaaaataaaaacaatgacacttaaaatatctttgctgggttttaaaacatgtctgtctttaaaagttatgtattaactaatattggg

SEQ ID NO: 46110 - DNA, 1028 bp, Homo sapiens
gccctaaaaggagtttctgtttgatgttcgttgagcaagggccttcttgtcactttatttttatattgtattcaaagtggcgtctttctggttttaaccttactgaggtgtgagagggagaggaatgttactggtatgtatgtgtgtgagagagaatgttatagaaccaaactagggcctactcacctggcacagtaaaaccaaatacccacacagaggaacacagcaataggtgtttactgcagagtgctaagcagggaggacaggcagctaaatgctcaaatcctggcctccccagtgacttgcaggcaaggatttttaaacacaggggtgagtttcaggaaagcagaagctacaggcaaaatcatacttcaatacagggagattacacattggtttaagtttaaaaggttgagatatcttgaagcaggggcttacatgttgcaggtagattcaaagatcttcagatttgccattagttaaggaagagcagctttgtttaaaaatttagggtcagtagaaaaatgttaactggctagggggtgtgactttctccaagcactgcaggaagaaacttagaacaaaaagcagttataaagtttagttttcactgtctccttatctggactccaggtgccagtggatctgttaggtggggggtccgagcctctgaaagacaattcagggacatatgttcagatgttatttttagtttctataaggaaagcaaacatctctggagctttaacttctttggctgttgttttaggctactattaccttcttgttctagttagtagttacctctggggctagctagatgcctggaatttcccttgaaggaacttaaggattttcctttgtgagtccctaaaaaagggagtccctgctctgtctcaaaaaacagctatcttcaggggctgctatttagtttgaatagttaccaattgtgagttttggcctttggccctcccagtccttttctgtctgtgagcctaaaggttttgattttagctgtcttcacttct

SEQ ID NO: 46111 - DNA, 1043 bp, Homo sapiens
gtatactgaatgatgcatattttttctagaatgtgtatgtgtgtctgtgtgtaggagaggtgcaaggagagatgcatatacacacaccttgcctctgctggtttgttctcccaatcgtatcctctgtcctatggttcccaactgctggtggcaaatcccaagagaatttgggaattgacaggagcttcatgaattcatgtatatttcagaaagtaaacttaaaaactctcatacatatatataagcatatttcaaatataaatactgttgtgatgaattaaatccatttaaacataaattcacaataatgttatgctattttgtacttttctcagtggataccagaagaaaaaggcctatcttgtgggtgtgtgcaaactattttgccattaaaaggggtttgtcattcttcaaaagattaaacaccacctattccagccatgtcttgtctcctgaaagtaaatttgtgatttagactgtcaaacacttgggaaaatttctgactggtttaacattgttaaatgcacacctgattactgatgcagctgactgaaaattgactattacgttgagtaccaagagtgctggctagccagaacttgaaaaggggagcactatggtcaaacttttacttgataatgaatcttcagtttatttctttttaaagtaccatgtctgtctgttgctgtaacttagagaagctggccatttaaatgggagcaatgggaacaaggttgagtaatgtctgctctgtagagaggcagaaatcattttaaagaattgaatcaagtcatcgatatgcctgaatatattatcagagcactgtgtattaggctgttcttgctttgctacaaagaaatacctgagtctgagtaatttataaagaaaagaggtgtacttggctcacggttcagcaagctttataggaagcatggtgctggcatctgtttggcttctggtgaagcctcagggagctttcaatcatggcagaaggcaaagcaggaacaggcacattatgtggcaaaagcaggagcaagtgagag

SEQ ID NO: 46112 - DNA, 1029 bp, Homo sapiens
attaagtgtactacagatgtgtaatgagaatctcaaaaggagaaagggtcagaaaaatgaccttttggacaacttctcatatttgatgaaaaacattaaactacacatccagaaggtcagtgaatgtgactaggattaatacaaagagacccatgcctagacatagtcaaactcctgaaagataaagagagtatcttgaaagcagcaagagaaaatcaactcactacacaagagggaagcatcagcaatgactaagggctgctttctcatcagtattggtggaggcccaaggcagtggggtgacatattcaaagtgctggaagaagaaaactgtctgtgaagaagtctatatttagcaaaactaacctttaaaaatgaaggtgaaataaatacattcctacagaaagacagaatttgtagctatcagacctaccttataagaaatactaaaagattaagttctttaggttgataggaaatgacaccagatggaaactcaaatccacaggaagaaatgaagagcactggaaatgtcaatatgtaggttaatatagaagactataaatatattttttctcatctcttctttaaaaagcattgaattctatctaaaaaacaaatttagtatctaacattaccttctgcacattcgtcctagttgtaagcaaattgctttcacctctttgccttttgattcatagaatagactgtgataatgatactcaaaattttttgtttcaggattcttttccacttttattattctgagaactctaaagagcttttgtttatgtgggttttatgtactgatatttattgtattagaaattaaaactgagaaaagagctaaatattattcatttacaagaaataccaattacatgttaacataaataacatgtgttaaatgaaaatagatattttccaaaatgaagtaggagagtggcattgctttacattctcaaatctcattaacgtctaccttaatagaagacaactggatttcactttaggctttgcactgaattt

SEQ ID NO: 46113 - DNA, 1088 bp, Homo sapiens
ctgtcatgtagtaggttggagatattctattctgctccatgaagtaatacagggatccacttgtcatggttgtacaatttcacacttcagtctgtggggaggagaaggaggaaattcaggacagtttgccattgaggaggtgagcaggaagttctgctatttcttttactcacattgcatcattggtgagaacttagtgacacggctatgcctacctataagggaggctgggaaatggagcctatgtgactgattgtatgctcaggaagaacatgagaatagatgttttgggagacaactagtagtgtgccacaatttgaataaaattaatcttactaacttttgtcaatgggaagaattaagaagtttacaatggaataatttttgtaattttaacttttaaggattatgtaatgtatcagttgtgtgtaccatggttttattaatatctagctctgctaaatacttacattgctttaatttttttgctgttaacaataactttgtaaggacatgctaattacagctttctccatattttggtgttatttctttaaggatggtttttatagaagtggaattattggtccaaacaatttgaacattttaatagaatttttatttcttaaacaagttttcttttctttgagacagggtctcgctatgtcacccaggctggagtgcagtggtgtggtccgggctcactgcaaccctgaacgtccgtgcttaagtgatcctccctcctcagcctcagagcagctgggatcacaggcatgtgccaccacacccagctaacttaacatatatttttttgtagagacagtgtctcactatgttgcccaggctggtcttgaactcctggcctccagtcctttcaccttggcctcccaaagtgcctgcataacagacatgagcccttacacccacccttacattacttttgtaaagcagccatttcagtgctctggaggttgactaaaggccaattgtataaaactttgaaaaatgttatgctcttgaatttggagtgagaacagtgggagtcagtggccattctagcttgaggctactcacattcccccaattct

SEQ ID NO: 46114 - DNA, 1049 bp, Homo sapiens
ctttaatacattgaagccatctgtttatggcccagtaatcgtttgaaaaagttaagagtacaaacacactcagttctgaaaatatctgagttacttttaattaacatataatcagagataaagcaaagccattatcagaagtataatgggtcatttgggaagatagcatttgatttgttgaaatgtgatttatgtgcaacttaaccttttataaagaaagacatatcttacttgcctttaaaaattaacttatgaatgaagccattttcaccttggggaacaaaagttaatatcataacatacagcgagctcactctctagcactgttatgtatgaaatggtgagtagtggaattttttagtaatttaaatttttttaaaattttactttttgtgtaaattcttcatagtgaatatatattttaagaaaaacaatgaagttattctaaaaagtaaaatgaaaagattctttacttttaacaaggataatacaatcaaatacccaagaatgtaaagactactcagtagaaaattagcaaaatactcgaatataagactactcggtagaaaattagcaaaagtctcaagcagttccaagaagaaatataaatgtagcaaaacatgtatagcttatctagtaataaaggaaatgcaaataaaaggtggtttggctttgttttgttttggcagaagagtactttcatattggtgaagactgacaaaatccactgttgggaaggatataagaaaatgagtaatcttatatgtggagttggagtatcatttgagtcaaccttttgagaggacagaaggtctatgctatacagatgaaaattttaaatgtagatactaccatttctgcagtcctggaatttgtccaaaggggcaattgcaaaactttgctaagatatatgtatacaggtttttggtaacaatttgcaacattggtaatgatagatattttaattcatttcagtgtttatcagtgggggattggataaattatgggtattttaattcaacagaaaactctgtatccaataaaatgat

SEQ ID NO: 46115 - DNA, 1032 bp, Homo sapiens
cctggccaacatgatgaaaccccgtctctactaaaatacaaaaattagcctggtatggtggcgcatgtctgtaatcctaatcctacttgggaggctgaggcaggaggatcacttgaacctgggaggcagagggttgcagtgagccgagattgcaccactgcactccagcctgggtgacagagcgagactccatctcaaaaacaaaaaaaaaatgctgctatagttatgaaagatatttaaaaacaaaatatgagaaaagatatgcatcaaattaactgtacgttctttttcttcaaccagagacatgaataactgatgacattggaacttagagaaacagtataataaatggaagaatttgtattatagtgggtggctttagttattctatggttaccagatattccttaatagaattggagagttatctatatttaggggtagaggaaaaggacggggggaaagctttctaatttttgtactgttttaataggatgataaattaaagaagttggttgaacaacatggaactgatgattggactctaattgctagtcatcttcaagtaagtgaaatattaaattatatttctaacatggctggtttaaggcattgggttaaatttgctatttttcaaaaatgtgtctacatattttaattttaggtttccttcctaaaaacatccctgttggtttggtctgcctctagttggttgctaatggcttggagagtctggtttagagtctggttttctagtaatgcgtttatccaggggcctaaaaagattattaacttaaaacaaaaatgataataaatgtatgtgggaccttataaatatttgctaatacacgttaaaacattctgtgagaaatatattgagatatttgatagctaaccaaaaaatccagaaaagccctattaaaaaaagcttatcatctgaggcttaccttttaaaatgttgattttaaaaactattatgcctattgtttaccatactactattcacctgctgttcgttatataactttataa

SEQ ID NO: 46116 - DNA, 1048 bp, Homo sapiens
agtgattctcctgcctcagcctcccgagtagctggcattacaggcacccaccatcatgctccgctaatttttgtatttttagtaggggtttcaccatgttggccaggctggtcttgaactcctgacttcaggtgatccgcctgcctcagcctcccaaagtgctgggattacaggtgggagccactgcgcctggccttgtatttcagtttatcattaaggcttgcccttttttatggggctttattctttaaaattgctttttctttttttactccatcaaaactcaggttctgactttggccccttcctcactttattaattttccttgggtcatcctgtgccctcagctattctttgtatgctggccaaaactgcatctctaccctagaccttgtatttgagcaggtccacatgctcatttgccttctagatttgctctgccctgtaggatagccattagccacatgtggctattgagctcttgaactgtggctagtctgaattgtaatgaactctaactacaaaacacacaccagattttgaagactttagtaagaaaaaaatatgtaaaacatttcatttatacttttttatgttgattacatgttgaaatgattatatttttgatatattaagctaaggaatattgactattgaagtacatttcacttatttctctttttttaaaaaatgtggctactagaaaattacatatgtggcttgtattatgtctctgttgggaagtgctgttccagacatccacctgtgtatttttcaagtaccttgaaaacagctagtcccaaactatacatactctccccattttcttctctctcccaaagttctgtttctccttctatcattttccatagtaaatagctctacttatgttttcaaagccagaaactttggagtcatccttaattcctccttcttccatgtccctcatctatcagttgcaaaatcctttcttttctactttttaaatatctctcagtttaatatatttctttcaattcctaatatcattaccttggttgatctatt

SEQ ID NO: 46117 - DNA, 1048 bp, Homo sapiens
tctgaatttctataaattagctgttagatctgctgagatgactttcttccatatatgtggttcattggaagttctttgtaattttaattccatgaaagtcttaatgtttccaacatgaaaattctcttacttaaatacgtttgatttctgaaaagcctacaaatggaggggaaatgagattgtgctaatgttgatgtcatcaaggtaaccatctcatatactagtgtcaaaaggtttatgtaaacttgaattttatctgaactaaattgtatcttaaaattcatacaattatttattagacagtggaatgcaaatgtttctatgaacgtaaacacattcatagagatttcttggcgaaaatatcttgagaatagaatgtaacgatataacattttgctgatttgtgcaagattggggaaaaatttcttctagattgatgaggtcaatgtgattcagttgtgttgctgtctgagccacagccaattgtgtgtgctctattaatatgttaccattatttttgattcctggcttggtcaagaacaacctgatttttttttttttaatcttgcagaaaagttgattgcaaagtgtggtagaaaaagaaataatggtagcagtagagaatttataaataagagtttatctttatgaatgagttaattgttctacaattttgatcagtggtatttaagcctgtatatgctaagtgtatttatgcccctttgagccaaaatttttttttttttttcagaatccataagagtttatttgttggcttcacttgggtttagatgcaaattttactgcatcacaccctgatcagctgggtatttgcttagtgtattcatcaaatcttcagtgccagtttccttgagaagcagctttcatgcttattccttaaaaacaacagaagagtgtttatcctgagattggtattgcactattttattttattctgcaaatctgtatcctgaagtgtacatttcaacccatattcttctctgttcactgaaattaagttgaatttgaatggctgaaagacaaaata

SEQ ID NO: 46118 - DNA, 1047 bp, Homo sapiens
cctcctccccctgaggctccacagactccgtcgtccttggcgtcggcggctgcttcgggggggcttttgaagcggagagaccggagaatcctttccgggagctgcccggatccgaagtgtcaggcgcgtctatttttcccggcctccggttctgtcagcatcgagtgtaccgagtgcggccagcggcacgagcagcaacagctgctgggggttgaggaggtgaccgacccggacgtagtgctacacaacctgctgcggaacgcgctgctcggggttacgggggcacccaagaagaacacggaactggtaaaggtgatgggcctttccaactatcactgcaaattgttgtcgcccatattagctcgctatggaatggacaaacagacaggccgggccaagcttctccgggacatgaaccagggcgaactgttcgattgcgccttactgggtgaccgcgccttcctcatagaaccagagcatgttaacactgtgggctatggcaaggaccgctccggaagcctcctgtatttgcatgacactctggaggacattaagcgggccaataaaagccaggaatgtctcattccagtgcatgtggacggggatggacactgcttggtgcatgctgtgtctcgggctctagtaggccgagagctcttctggcatgccttaagagagaatcttaaacagcactttcagcagcacctggcccgatatcaagctctgttccatgacttcattgatgctgctgagtgggaggacattatcaatgagtgtgaccctctgtttgtaccacctgagggtgttcccttgggcctgaggaatatccacatatttggtcttgccaatgtgctacatcgtcctattattctgttagattccctcagtggcatgagaagctctggtgattattcagccacctttctacctgggctcatccctgcagagaagtgcactgggaaagatggtcatttgaacaaaccaatctgtattgcatggagcagctccggtagaaaccattatatccccttggtaggcataaaaggg

SEQ ID NO: 46119 - DNA, 1023 bp, Homo sapiens
aagctcatttgtggaaatactaggtactaatgagacaaacatactcagttacagaggtttgggtttgtcagtactgactatcaaaaaagcagaaacaggtaatagaataatagtacttttttattaaaaagtggtttgggagtctgaaaggtaggttgcaagtacagttcctaaaggaatgagattctcttcttggaccattcctacatataagatgcccaacaaaatgcaaataaaaatgggaattcgaaatgtaatatttaatttccaggtgcaagaaagcctttgaggtgaaggtgtatgaaagtcatcataacagatgttttccaaaaacttgtagaaggttgtgaaaaaactactaggatcacgcggcatgtattgaggtacctaaatttaattaatgttagttatgtgatgtattcttgacagataggtttaatagctggcacaatgatgacttaaattactttttgccgtttacccagctgaggttgtctttgaagaaataattttaagactgagatgccagtactgtacattgattaattactgacatgtatgtaaggcaataatttaattaagggtgaatattctttgtttttagcatataggttgctgtagatgaatgttcttagctgtcatgtttaaaaatacttctgcttcgttacctcaagtaagtgatttgtcaagcaactatgtctgctgacagttcagaaagtatctgataaacttaagggtgggggcagattcttgttgaagttgcttttgcatgtgtggtattctcaacattagttttttgaggggcacttgtgaatattgaggttatatgagaactttgagtatggaatgattttcactgtggtttctgactttgttttggaggtgtggcatgcagcattttggaaggaaaattgaagacgtgttcaagaaaacatgaacagaagcaaatgatgaaaatgagcattttacttgatgttgataacatcacaataaattatggagaaaaatacatatttggctaac

SEQ ID NO: 46120 - DNA, 1049 bp, Homo sapiens
agaacagaagtagtaatcaaaagtagagaattttcctttttggggtagctttacaagaattgcatctcttctgagtattggtggggttttgtcatttcttttgccttatactttttatcatttctaaaatctaaggccttcacccgctaacctaagtttgacttctgattgttggaggatgcttgtgattatttcagaaaaaagcatagtattctttaaaattatttgtcaaattatcctaagtaataaacaaggaataacagattttaatataatataatattagaatcaatctctaattacaggtttgtataattttactcaccttctaaaacagaacaattgtatcaaattttacgttgtcattctcttgtgaaagttctagtaagtaatgaaatggtcaaaaagacatggggaagactaataaaatcacaagggaaaacttcagattggggtggtttgagaagtatgaataaaactaaactcattggagttacatggatggattggggctgatcttgtgtgtttgaaatagttttcaatttatgacatcatgtgatgtgtgtttttttttccagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaattgtcctttgatttttttgtgggaagattcgcaatatttttctagtatccattacggttcttgaatatgagagaaaatatatttattagaactttctatttttaagtttagactatctaaattagtcaatttcagcatttcacttgccatactgattgtcagaaccacttttcaatttgtcccttcttttgactgtctgtaagtaaaatataatttaacagttcattatttt

SEQ ID NO: 46121 - DNA, 1079 bp, Homo sapiens
cacagaccagcctcaattctttctgcaccactgctctgtcgagttgattcagtacctgtagtcccacatagttaaaatctgcttagctttgctctctgttgtgtggacaatgaaatggttgactaatataaccctggcagtgtcagaccttgtcatgactgaaatttgtccaaatagatattgtcatcaaatgtgcttctggtccttgctagtgagactgtagttaggatccctgtccaggtctcaaagggcacgagaaactatgaagaggcttggcatccctgttcagagtacagcctcatctgccaaattcttggggtcactagaactgtttgggtccctgctggaagctcttaacacccctgagcaactcacgttggaactgatgaaaataggtctcctaagacctccatctactgctaagtccattctggagtccaggtgctactaggagtcttttgcccctgggactgagatgtttttctgacttgaatgagggagtgaatggatgactgcccatgccgctgtcactgtaataaaggactaagaagacaagatttaagaggaagagataaccgtaggacttacaggtttctttgttttgtttttttaacttgtgatctagtactaagaactaaacgttaaatagaatagcatttatgaacagtatctggaaaggagccttcattaatgatctcaataagaataaatgaaagtaagttatttttctgccccccaaaatccctaaaacatgaatttgtcttccacacattagtgccagaaaagggaatttgtagtaaaatgtttttcatagtagaaagaaacagggattgtaagtcgcccagcattgaagccattgccccaagactgtctagtaggcagctccctttgggcagttgtctgcctcctggaaagcttcctgccaaagctgcccctgagaatctgagatggaggcgtggccgtgtggtctgggtcccctgggctgcgtggcagcagcatctcaggagttgagtcctcttttctaaccttgcgctgctgcattggcttagctacttagctggcatggtcagacaagggga

SEQ ID NO: 46122 - DNA, 1058 bp, Homo sapiens
actgtgataccttatttctcaccatattccatgttcagattatgggtagattccagttgttaaagaggttgtgtgtgttctagttagtaaaggagagagaaaagatcagtaaactttgttcagtgatggcctttgattttcctacctcatcccaggatatgtatgggttgctatttagcttccatcttaaaatgtgggccggatgccatggctcacatctgtaatcccagcactttgggatgtcaaggtgggaggattgtttgaaaccaacctaggcaacatagtgagaccccatctctttgaacaaaaagttaactaggcatggtggtcatgcctctagttcctgctgctcatgaggctgaggcgggattgcctaagcacaggaggttggggctatggtgagccctgatcacaccactgtactccagcctaggcaacaaattgagactctctgtctttaacaacaacaaatagtgcagcactataattggtataacactgtgtagaaagaatttcttgtgtgcattcttacttaattcttccaaaattctctagatttggggataaataccgaaaattaaagtcccaaatatagtcaggcatcatttaatgacaggagtatgttctctgcaatgcattagtaggcaatttcagcattgtgtgaacatcatagcatgtacttacacaaatctagatggcatagcctattgctccttgggtacaacctgcacagcatgttactgtactgtaggcagctgttaatacggtggtgtttgtgtatctaaacatatctaaacaggctgggtgcagtggctcacgcctgtaatctcagcattttgggaggccaaggtgggcagatcacctgatgtcaggagtttgagaccagcctggccaacctggtgaaaccccatctctactaaaaatacaaaaatttggccaggcatggtggccatacctataatcccagcactttgggaggcccaggtgggcggatcatctgaggtcaggagttcaagaccatcctggacaacgtggtgaaaccccttctctactaaaaa

SEQ ID NO: 46123 - DNA, 1096 bp, Homo sapiens
aaatgtatttaatacacctaacctacagaacattatagcttagccttgcctgccttgaacatgcccaggatacttaccttagcctacaggtgggcaaaatcatctaacacaaagcctgttttatgctacagtactgaatatctcatgtaatttattgaatactatactgaaaatgaaaaacaatagttgtatgaatatattgtaaagtcaaaaaatggtaagttgaaccattgtaagttgggaactgtctatatatacattatttatatacatgtacgagataaggaactacatctcttcacttgtcccaacatcaaccatagttcctggcttgtgttaagtactcaatgaataaacattggctgggtggaaggaatgaatgatatattcctggaatgcaatgtataatattaagggatataaactttttaagataaagcaaagacaaaaaaaagtttatcttattagaaacaagatacagtgtcacttatagtcttcaaacattattgcactttgtcataatttgacaaagcattcatgaaacaatctgtagactagtttcaacagacaacacctgtaagcaggcatgaccgtcctaaattgtttactaggtatgaattttacaaacattatttatagtaatggtaatggtggagctggagagtattgcaccttctctgagctgcacaatgagaaccactattctgtgggatgtttcttcactttgttgattgtttcctttgctttgcagaagctttttaacttgatgtgtccatttgtccatttttactttggttacctgtgattgtggggtattctcaagaaatctttgcccagcttaatgtcctagagaatcctcaatgttttcttacggtagtttcatagtttgaggtcttagatgtaagtttttaatccattttgatctgatttttgtatatggcaagataaaggagtctagtttcattcttttgtatatggatatccagttttcccagcactgtttattgaagagactgtcctttctcccaatgtatgttcttggttcctttgtcaaaaatgaattcactagatgtatggattcatttttgggttctct

SEQ ID NO: 46124 - DNA, 1026 bp, Homo sapiens
atctcaagtattgttactcttatacccactgtatataaagtcagctttaaattcattaacagcacatttatgttcttctaaactaagatttgaatgtttttgatatctttatttccaataattgtcatggcccttttgagagactgcaaaagctcttaaaccttgagcaaaaacaaatattttcattgttcaacttccctcctttctggttgcacattactcatgtccacctcagagcatgaattagtttatgccagaatggatcttttctgtattgccttcattttctgtgatttttttcatttttatctatattttgttgaatactttccagtttctatcctcaaaagtatttacaaaatctcttatgtaaatattcatatccttaaaatacaagtgtaacctttatgttaatttttaggaattataatggtttttcatatctaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagagtaagtatctaaattaattgaattctgattgttcaaggggaaaaatatgggttcctaagagtttttcacttatggtcaggtgtggtggtttgcatttatagtccccagctactcagggaggctgaagcagaaggatcacttgaacccaggagttcgagaccagcatatgcaatatagcaaggttcttgtctctaaaaaagaaaaaactttttaatttaaaagagagtttttcacttgatttagaataaagtaaccttagaaatattgtttagaaccatgttttgatgagaaatattataatagagtttggtgatatgattgtattttttccccacattctgaagaaagataacactgaccagtgattaatggaaaatggtatacattatatgcatgtgtcagtgtgc

SEQ ID NO: 46125 - DNA, 1024 bp, Homo sapiens
attttaaaatacaaataactttaaaggaatttcttaaaactaattctcattcttagttcttttcaaacttaaaaaataggtggattttaacaagctgtttatgttcccttttcacccagaatatttatagttaggctactttttatgtagtgtgtggtgagtcagtgattaaaaaaaaattttaggcatatttagaacacaatttttgtgtatacaataatcatcagtagtaacaactggctttaagtgatttaaacactaaataaggcacagcttaatacaagcacacgaggataaaagtcaagagtagaatgttccataaaagatggcaggagaagaaaagtaggattttgttttatacagcttcagaatcccactatggcagaagtgttctgtgtgaagcagtgcacttattttggggacctcaaagcaaagtattctgtacgcccacgtatgggatccctaacccagatccacaggcaattaactgctacttcagattttctgtcaagacttttctctgcctctgattggcataatgctaaaacattttgccatgcttaaaatttccaggtgattttaatcttcctttacttcttattggcagcagtgtgtagtcttttattttgttattcctggtgtgttttttaagcattcacctgaactttaggtaaaaaagcttctttctttcattttttttttttagtgccatgacttgagtttttaaagttataagatagtagggttttattccattaaatgatacgttaaacacttgaaaactttcatggtaatatttttacatatttgtagggaaagcactcctgcctccctttctgacatgttagaaaaatctgtttgcagaataatctgaagtaaataagtgtatatatcccagttacattttctgaaagttttggttcctctgtacttttgtttttgtttgagacaggattttgctatgttgcctaggctggacttgaattcctggtcttgtgccatcctccttccccagcctcctgaa

SEQ ID NO: 46126 - DNA, 1055 bp, Homo sapiens
cctgggaggccgaggttgcagtgagctaagatcgcgccattgcactccagcctggtcaacaagagcgaaactccatctcaaaaaaaaaaaaaaaaaaagctgaacgtggagaaagcccagctatgaaaacctaaatttgcaaaacaaaattaagattgtttttacatgaagattcattttatgagaatattcacttcagagtttctgtgatgtgattttttcatgggtcttaaattatatatctattccagaagatacagtttatgtacaacttttcaggagaacatatgtgaagacagcatacttaagatatagctgttgttccacatacatacattataggtcctcgataaattattaaaaggttgatttttttagagcccctattatgataggcataatatcttatattacagcaatagacttttgcttattagtgcaatttgataaaccattgatagtagctaaaattttttcttccctctctcttccagtctatattatttattttgtcaatcagaggatcccaaaagtttttgattcacaagtctgacttttcatgaaagttgcactttggccagaggaatacctccagttctatgttctatttattaagcaggcagggccaaacaacttaatggatatttgtcttcacagcctactatgtatttcaaagacaatagtatgcataaagtaaaagaaaaataatgtttttattttattctttaccgcaattacttaccactgggatgcgtgtgcctattagaaactgcacacagcttcttagatcttggaattgaatactgtccccctcattcctgtacttcattgattttcattcagtacttggttttttatcatagcaactaccaaaacccagctttgcggagataattatgtcattgaagggaatgtagtgtgatttatttgaaaccatgagcaatcttttgaggtatccaacagatgtatctccctctgaattttgcctcagaattttttcagggcaccctcatgagtttgctacagcattctggggtactttgatgcagtttttg

SEQ ID NO: 46127 - DNA, 1029 bp, Homo sapiens
atttgttgaaatgttgttttggttgtgatgttgtatggttttgaaatactcatttttatgttgtcagtttttaccttcatattatgtttgatatacaggttatattttaatttttgttaattttatatttaatcctaactcaagactcataattcactagcttgttagaaaggataaattatttttccagaatttcgaaatggctaaaatagtcatattatcctttaatgttaatgttctgtaatagctatcaagattgatttagagcattgttatgagaatgaaacagaattaggccttggtattttaagtgaaaagctttttaatttgggccatatttttggacaggaaaccatttttggtgcctatatgatgtatgatgtcaagttttaagagtttgccatatgtctgttaagataatacaaggcgtttaactaggaagagttgccgtttttagatagtttttccccattatctgtaggaactataaataaaagacagttaaaaaaacttttagaacttttgcttttgtaaaaaaccagaagtctttcatctgatgatgagacatttaagttggcattagaaaattttgtaatactttatgtaaccaattacagatttttttggacactgagattctgcttctgtaggtactgtttaccgacagtaaaatataaattcttagatctagatatcaaaaattatttaagttgagattactatttttgcacagcaaattcaactttgcaaaaatgaatttgaaaggaaaaactttaagaaatttcttgtcaatttgtagatgtcagattctcattacaaaattattataatattctaatttttaaaaattaggtttatttcactccttattgtccctcagggggcgataatgagggtaaaatgagataaatatagatatactttcaaaaatgttatacacactcaaattataaatgagttgagcaccgggcacagtggctcacacctgtaatcccagcactttgggaggccgaggcgggtggatcacct

SEQ ID NO: 46128 - DNA, 1051 bp, Homo sapiens
actctcagtaattgtatatgttttttctatttcttgtgaggccttcctttccaaaattcatgaggtgtctgtggtccaaaggcagacctcatttctaagctgagatcaaagaagcaggtacctcccttgagcagggtatggctctagtggcccttgggctgtgtagccccttatcattcaccatgttgtcaacacaaaccaaagtcaagcttggggtgaatgctgtacactttttatatattctacactgaggaagatcttcacacttgttgatttgttctcactctcccaacccttgccagggaatcttaagctggcatcattcagtaatggctttaattggaaataattaagtagaaagagagtaggagcctagaaccttagttggttttccttctgtgtttattgcagcattcccagttagctgagatgctgctctctcctttcctggcctacttgttatgttaggagacctactaaacaaataatctactttaattagcaggcagtgatcaaatacagtctagatgatcatggctgtggtcagctctattgatagacattggcatggttccccaagctctttgatttgcatcttccctcttacctcatagcaccttgccattctaggctttgaagtcttttagaacccaagtggtaaaacaatcatatctctcaggttggcctattctttgcatgtgttcagtcataggcaataaattaaataggttttcctttgatttcaacctactttctaggattcctcaaagtttatgatccagtgatatgctccttagtttatcagcatcattaaaagtacatctcttgtttattttttttttgtaatttcagtgggatttgtcaaaggagaaagtaaattggtaggctcaattcaccaccttgaaagtagaagtttgcatctatgtttaaaggataattagaggagaaaacatgagacagttaataatactaactgtattaagtgcttcctgtatatctcaaatgattttatgtgcttgtatttattcatttactcttccctcaaacactg

SEQ ID NO: 46129 - DNA, 1034 bp, Homo sapiens
tcaatgtctttaatagttataggactattcaaatgatctatttcatattggaagaattgtggtagcttgtgcttcttgaggaattggtctattcatctcagttctcaggtctttgtatgtagaattgtttgcacctagtccctcttaatgtctgcggtgtttgtagtgataccctgctttattttttctttcctcttgttggagtttcaattttattgatcttatcaaacaatcagctttttaaattgatttttcctatttttctattttcagttttgttgatttctgctcttgtatttattatttttccttttttttctgcttgctttgggtttattctgtgctgcttttcctagtttcttaaggtgggagcttagatttgggacttttttctaatgaagtattaagtgctgtaagtctccctttaagctgtatcccatacaattttagctgtatcccataaaatttgttatatttttatttttattgagttccatgtattttttaaaaatttcccttaagacttcctctgacccatggattatttagaagtgtgttgtttaatttccaagtgtttggaaatattagtttttctccatgattcctatttttatttcattttggtagagaacacactctgggctgctctgcctgtggagtaaccattcttttattccttactttcttaataaacttgctttcactttactcggaaaaaaagaacacactctgtatgatctcagttcttctaactttgttgagatttgttttatggcccaaaatatggactgtcttggtgaatgttccatggacattttaaaataatgtgtgtctgttactgagtggagtattctataaatttataccctgccgattgatggtggtgttcagttctgtatccttagtgattttttttgtctagtagttgtattgttgtaagagggatgtttacttcttcagctaaaatagcagatttgtctgtttctccttttagttctatccatttcaatttcatgttattttgaagctctttg

SEQ ID NO: 46130 - DNA, 1161 bp, Homo sapiens
caaaatctattatattatctgggtttgtgacttgagctactgagctgaaacttctccaggggtgattcttgagctaccaaatgaccaggaagagttttctcagttttctgctcttggccgagactgttggacaggatgattcactcagttccacccagctccgaaatatttccctaaagtatcttctctgaatatagctttattgccccatcgtattcagactatagaaattaaataaatacagtctgttaattcagacctttgccacatgcacaactcagcttcctcttcaccacacttgattttaccgtaggacaacatggtgtctttagatagttgaccagccctcccagttgactggcatttctggccatgtcattcctaaatccttcaattatatcattcaaaccattcatctccttgcctgtgtctcatgggtagcttaatctacttaagagttttttctccattgtttaaatattttagcaccattccacaaaggcccgcggcgggtgttgacgcgatgtgatttctgcccagtgctctgaatgtcaaattgaagaaattcaatgaagcacaggtaaatggtgggagtaactatgactctcttaaggtagccaaatgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcatggtgaagagacatgagaggtgtagaataagtgggaggcccctggcgcccccccgtacccgcaaaggggcggggcggggtccaccggccttgctgaaataaaagaggatacaaacaaatggaagaacattccatgctcatgagtaggaagaatcaatatcgtgaaaatggccatactgcccaaggtaatttatagattcaatgccatccccatcaagctaccaatgactttcttcacagaattggaaaaaactactttaaagttcatatagaaccaaaaaagagcccgcatcaccaagtcaatcctaagccaaaagaacaaagctggaggcatcacactacctgacttcaaactatactacaagcctacagtaaccaaaacagcatgg

SEQ ID NO: 46131 - DNA, 1069 bp, Homo sapiens
cttgctgaaaggcaaatagtaagtgttagaactggatgctagagtcttgtactccttggagtatataaatatttctatgtgatttttttttttttagacggagtctcgctctgtcgccaggctggagtgctgtgccgtgaactcggctcactgcaacctctgcctcttgggttcaagtgattctcctccctcagcctcccaagtagctgggactacaggcatgcgccaccatgcctagctaatttttgtatttttagtagagatgggatttcaccatgttggccaggctggtctcaatctcttgaccttgtgatctgcccgcctctccctgctcatggtctttctgctgacccacttggggtcacagtgctgagattacagatgtgagccactgtactcggcctcgctatgtgatttttactgaaatattataatacgtatatgctgttgtcatcatttcgatttatttttttcactatttccaaaaagacaatattccaaaggatttaggattccacttccatccactcagccatggtccacaacgtctgttttcagagcactgtgatctttcagcattgcctttgcttgggctcttgccctttgatgtgtacaattatagagttagagctattggtttgtctttacaagggaagtagccttggaaaattccattttgtttttcactgtagaataattgagatacttacttctgcggtaaaagaattaggttggggtgtaatttttaaaattactgtaatttttattgttgtctaaataaccaaatatttgccatccatcttcagccactgaattgggatttggttgaagtgatttacagcagtgccactgaacttaaattgcagcctttgggaatcacttcatctttagatgcaagagatatatgaatgggctttgatttgtttcattcttctaagggcatcaacagcttttatataagtttatgagcagtttttaaaatttttgtactagttttgtaaatgtatacacagatttttctctttaatgttgagattaagcatttaaatacaaatctaagtgttttagg

SEQ ID NO: 46132 - DNA, 1027 bp, Homo sapiens
tagatcatagaatcagagaagtattgaatatatggatggaggagacttaggaaaaagatctttgtaagtaaggaagtcttctaacaagcaagggataggaagtagaaattaactgtgtgttactcattgctacattgttgctcagtagatactgtagtatctataatatactgtgctgttaatagtttagagaagttactatggtgtgctccagtggattatttttagtgggtgcaaaaatattagggctttcatggtttctttagttaatttagttcccatcagcttaaaaaatttaaccatgggaatttcctggaccatattattggaattgggaatactgtaatccttgaagagggaatgatgtaattttgtgtgtgtgtgtgtgtgtgtgtgtgtgtgtgtgtgtgtgtgttgatattttacctctcttttagttgtggtgcctttaggaaaagaaaacatcaagacaaggaattgtggaaaattagaaagcagttaatcagcattctaaagcagagctcatcaatgaagtaactggacatcaagaggagctgtaggatagatttaatgaggagttataagacctagagtttttcttaaaaacaaatgagagcttaactaaaataaacaaatggacaaaaaaacccaacaactgtgatatggtttcataggtggaggtctaacaaggactatttttacagaaaatatttttgagtgtttaaaatatgccaggcattgtactaaacactttatttaatttttaaaattgtaatttgataatttataacagcataaatttatgggtacaaagtgatgttatgatttatgaatacaatgcagactaattaactcaggctaatgaacatatctatcatttcaaatacttaacctttttatggtgaaaacctttgaaatttacttttaacaattgtgaaatgtaccacactctattaactatattcaccatactgtggaatagaaattaaaaacatttctcctccctgaaattttgtacccttttaat

SEQ ID NO: 46133 - DNA, 1061 bp, Homo sapiens
atatatttgaaattactattgggagccagacacggtggctcatgcctgtaatcccagcactttggggggccaaggcaggaggatcacttgaggcaagaagtttgagaccaccttaggcaatatagtgagacactgtctcaacaaaaaaattttaaaattagccagacctggtggtacttacctgtagtcctagctactcagaaagctgaggcaagaggatctcttaaccttttcttaagcccaggagttaaaagctgcagttaactacaattgtgctgctacactccagctggcacaacagagtgagaccctgtattaaaaaaaaaaaaaaagggctgggcacagtggctcaggcctgtaatcccagcactttgggaggccgaggcaggcgggtcacacggtcaagagatcgagaccatcctggccaacatggtgaaaccccgtctctactaaaaatacaaaaattagctgggcatggtggcacagctgtagtcccagctactcgggaggctgaggcaagagaatcacttgaaccctagaggcagaggttgcagtgagccgagatcgggccactacactccagcctcgcaacagagcgagactccgtctcaaaaaaaaaaaagaaaaaattagccgggcatggtagtgcacgcctataatcccagctacttgggaggctgaagcaggagaatctcttgaacctcggaggcagaggttgtaatgagccgagatcgtgccattgcactctagcttgggcaacaagagcgaaactctgtctcagaataaaaaaagagagagagagaatgaatgaatgaatgaatgaatgaaattactattggtgaggaaggtatatggtaaataatatacatgtgtttgttttgttttgcaagatcgtcaagaattagagaccagttgattagatcacacatctatgctttggggtgctgcatgtgttttttgtctgtgattttgtcttttatctaggtagttggtccctgacatacatacctttgtcattttacagacattgtccctaaacactactgttaatattattttcc

SEQ ID NO: 46134 - DNA, 1029 bp, Homo sapiens
tgactcagtgcccattacttagttctaggcactgtccttggaggacaatctatgtttatactgagaataacagtttataccttatgcattcagcaaaacatgataaagaagattacagtggagtcaactttacatatgtattttaagtacataaagtcagttttatgttcctggaagaacagatggttattaaatggttatttcagtagtatgagcagttttgcccaccattgaactcaatgaatacctgccgtagtggagtgatcatgaggtgggtgacatgactttgctgggttttggttcccttgtggctctaatagtgtgaacatgtacctatgggctttttaaatgcagtatggcccctacataaactacttcacttaggactcagccaaagaaatagtaatttgctgccactctggaggaaagactgttgctgttggaggagatagtcagtgcggtgccttcctacagagctttaaggataatttgacctgtctgtgactgttggtactttaggatgctaactttggaacccagctcttaattcataactgactctcctgtattagatacctccctcttttgttacaattgagtggctaaactagctaaaaaatggtcttgtaattgctctaacaatgcgttaggaaaatggatctcccaatcattgctaagctagttgtctctgagaagaaccaaataaaatctcacttcattctattcttcctaacttgagaaatatttccaatcaaaaaacatctcatatggatgttaaatttgctgtaagttgcaaaaatcttagcatatccaacctctgcatggggaggaattgtatgtcggataaaaatgtaagccatcctactttcagtgtaactcattattagatgtatgccatgtatttcatttgatttgccagtgtagatgaaaggaatagttgtggtcaaggattcaaagtccaatgactgaggaaactaacttacgttttccacttacacatcaagaaaatcgttcgtactactttctgca

SEQ ID NO: 46135 - DNA, 1073 bp, Homo sapiens
acaggagtcatggaaacagatagcaaataaccattttccctaactgggaggctaatattgcttctattccacagaaaaatagtaagcacaggcatacctcagagatactgcaggttcagttccagatccgcaccataaagcgaatataaaataaagcaagtgacatgaattttttgtttttccagggtgtataaaagttatacttcactgtactgtagtctattaagcgtacaatggtattacttctttaaaaaattaatacattttaacttaaaaataccttaatgctagaaagtgctataacaagcatatgagcctcgtcaacaagttctaatctctttgctggtgggagggtcttgcctcaatgttgatggctgctgactgatcagggtgggagttgctaaaggctggggtggctataacgatttcttaaagtaagataacagtgaagtttgtcatactgatggactcttactttcatgaaagatttctctgtaccatgcaatgctgtttgatggcattatacccacagtagaactttcaaaattggaatcagtcctctcaaaccctgttcctgccttatcaactaagtttatggaatattctaaatcctttgttgtcatttcaacagtgttcacagcatctttaccaggagttgattccatctcaagaaaccattttctttgtttatccgcaaaaagcaactcctcgtttgttcaagtttgatcatgagattgcagcaattcagtcacatcttggacttcacttctaattccagttctcttgttatttccactgcatctagagttacttcctccactgaagtcaggaatccctccaagtcatccatgagggttagaatcagcttcttccaaattcctgttaatgttgatattttgacctcctcccatggaatcatgaatgttcttcatggcatctagaatggtgattcctttccagaatatttttctttgtactttgcccagatctatcagaagaatcactgcctgtggcagatacacccttacaaagtgtatttcttaagtacaccttgaaacatggctatagcatag

SEQ ID NO: 46136 - DNA, 1034 bp, Homo sapiens
tgctgatatgtgttcaagatgagtgggatgggagaaaatacctctgacccctccagggcagagacaagaaagcgcaaggaatgtcctgaccaacttggacccaggttagattcttgctgagaaaaggaatcagtattgtctgttaaagccacatgagtgcttctttgttattttagcattgattttactgctgattcaaatattgagttggtttttctccttaacagttaaatctctgaatatgtacttgcttacattttgaatatgcaaatcagttacagattgtattctttacaaaaagaggaaagctgtaaacttctgatatcttttgactcttagaatcaatttatttaataatattgagtttgattacacaatattataacaagaagatcctatagtaaaaaggatttgccgttaattttataatgggttttatttttgttgttttatttttaaagacataaaatgttaaacccatgtacttctgagttgagaacaaagattgtggctctttagtgaataaaacaaagaattttaaagcaaatttcatctcatatattatgggtggaagtatgagttgttataatgcccatgtagggtaatttggcagtatcaaaattataaatgcatatcctgtttgaactagccattccacttttaggaattttcctattatatactttaacacatgcaaaatgacgtgtatatgaggttactcaaattgcaaaagattcggaaaaacctaaatgtctgttaaacagctgtggtacatctagaacctggaacacagttcagctaggataaagatgaggatgctctttatgggttaatatgaaaaaaaaatctcttaagaatattgttacagacaaaaagcaaggtttagaaaatgtttttggaatattgccatctgtataaacaaggaagaaaaaagaatgtgtattgttttaggataatcaagaaacaataattgttgctacctgtttcggtggatgagaactgggcaaatagttaccaaaagtagaagagagact

SEQ ID NO: 46137 - DNA, 1055 bp, Homo sapiens
aagcattatttacactgccaaaacagcctataactgtgtcccttatttcttatcaaaccacaagcctttattaaatttgggtcctgtacttttttcatgcaacatgcttgaaagttttgcagaggcaaaactgtgcttttctgtttgattgaggtaaagaacccacaggaaagtttggagttaaatgagtgacagtggacaaaagggaagaaggagtgagtttcttaaggcccatccctgacagagacactcgagtgggaggcagcagcatgagcctgcctggagcccacaaagggctgcctcatggtgacagtgggtgccaacaaaaccgtggaccctctcctgggaaagaggcagctgatcaggaggcatttaaaaaagtgttactttcactttaacataccatgggcttggaaaaagtaaaagggaacctttaattcttcctggtggaatctgtgaagcctgcgtaaagggagtatgctttgagctgctttggaaggatagaccagatttttctgagatagaagggcaattttagtaacctttactggaaagctcttgtgatttagatatatttcttgctctgaaagagttggtagaagaaaaaacatgagaagtccatatagttaaagaacatatgatatgctaatgactctaaaatatctaagtatctgtctatattatacagaagaacttaggataaatataagtttaccctaagttttaagtatagttttatatatatatatatatataaataattaaaacataagttttaagtatagttatacagatttagtaggttggaaattgttatagaattatcctttggtttaccaaagaaaataatttttacttgaaatttcattgctaataccagtaaaatgagatttgatttctcatttcattcattgtaggcagtctttgtgccacttagtacagtataggtttccctcagttgttgcaagattttttctgaaaataagcatgtaaacaattcatacacttacagtttatattccaaagagcaggttactttaaaaattccgtttggt

SEQ ID NO: 46138 - DNA, 1103 bp, Homo sapiens
cttaattctatgcagatctatgcctaatggaaacaataaattcaaatgggcagtattactttttcccttactatcttactatttatgaaatgtatttctcactgcatttaaaaatgtatttaacatataaattatttcatgatattttatcaggttttaaaaatctgatatttagctgtagtatggaattacaatgctaatgggtttacaaattaatattacaaatgactgaaaagttcacactctgcaacttgttaaacatgtcaccttcagagcttatctcatttttaattaataaatatgtggtcatagtgtgtaaagaagaaatctttatagattaaagatttgtcaccttttggaacagtggactctgttttttaacatttgtattatagaaatttagaatagtatagtaaacttccatgtacccttcatacccagcttcagaagttatataaacatttttgccttctttttgaaatggggtctcgccgatgcccaggctggagtgcagtggcacaatctcagctcactgcatcctctgcctcctgggctcaaatgatcctcttgcctcagcctcctgaacagctgggaccacaggcgtgccaccacgctcggctgactttttttttttttttttttttttttttttgagacagggtctcactctgtcaaccaggctggagtgtagtggcacaatcatggctcactgcagaccttggccttccaggttcagatgatcctcccacctcagcctcctgagtagctggagctacaagtgtgtgccaccacacctgcctaatttttgtatttttttgtagagatgggtttcaccatgttgcccaggctggtctcaaactcctgagctcaagtgatccacctgcctctgcctcccaaagtgctgggattacagggcatgagccaccgtgcctggtctttgccatgtttttaaatgatgaaaacgacattactaaaagtttggaaattaggatgaaaatgacctctggtctcacccagtttaactctcatcatcattttttggtcttcttcttcttcttcttcttcttttttttttttttttggaggcagattctctctctgtt

SEQ ID NO: 46139 - DNA, 1050 bp, Homo sapiens
acattatgggtttttttttggtgataatatctatgtagttgcaagtcagtcaaatgttgtgcagtattccattttgtgaacatatacaatttatcagtttttctcttgatctgcatttaggttgtttctaattttttccaatttcaagtattccggcagtgaacatttttgttcatgataccttacatagatatgacagtttctttagagtattacctatgagggtaatatccctagactgggttgtatgtgatttttagcttcattaaatattttcaatttattccaatttacattggagcctgaagtatataggttgacatttggtataagactttgttgttgttgttgttgttaagagatggagtctcattctgttgcccaggctggaatgcagtggcactatcacacctctctgcagcctctaactcctgggatcaggggatccacccacctcagcctcccaaggagctgattctacaggtgtgtactaccatgttcagctaattattttattatattgcccagactggtctgaaactcttggcctcaggcgatcctcctgcctcagcctcccaaagtggcggggttagaagcatgagccactgcactcagtcaatcccccttttttttttttgagacagagtttcactcttgttgcccaggctggatgagtgcaatggcgtgatctcggctcaccgcatcctctgcctcccgggttcaagtgattctcctgcctcagcctcccaagtagctgggattacaggcagaagccaccacgtctggctaattttgtatttttagtagagaagagatttctccatgttggtcgggctggtctcaaactcccaatctcaagtgatatgcccgccttggcttcccaaagtgctgggattataggcatgagccaccacgcctggcccactgttttttttaagacttaatttttaataacatgaggggtatgaaatggtatttcactattcagtttcattatgcgttttctgattactgttgagattacacagtgcacagtggccattctgattc

SEQ ID NO: 46140 - DNA, 1045 bp, Homo sapiens
gtgggaagccctcaacgatgttatgcaaagtcattcttttggaaaaagagcctggaagtaaggggtagaatggatttctatgaggcataactaactagtaggaaaaagccccaaagctgcttggtgtagatcctatgcttgactccaattttctgattattcttggtcatatcgttctttctactgtactataccagtcactgaggacacagatgatgtctcaatttcagtatcttctcctgtcaccaagaaatctagtttagattaacactcaattttgtaacatttcatgaacactatattcagaaaaactggttctatcctatttactccacccatagggaagtagttggtatattgtgtatgggtcagtatttctatatcttacatgaaatttggaagaattctatacaaccaaacctgacccttcaatttcagcaaattgatttctgagaaaacagatgaattttgatttatcttacgtctctaaggatgaaagcaacagaattgcgatcgcccctcagttggtccaattctgtgctgtcttttatcattttccccattataggttgaaagcttcagatgtcacaatttcccagggtcttaggattctaccctggctctggcagcctaccttcattgttttacccaccaaaggaaatggtagaaactcagctctgaggcaaggggttatggcttctactaaggtatccctaagaatagggcatatgctttgtctgagctttaaactatataaatggtgatgcagaatggcagatgcttgaaaggtaggtatagtctcttaatgcctaaggtagactaacacaagaagatagattcttgatgtgtgtagtcatggactccttggctgcaagtgtagaaatgcaactcaaaccagtataagcaaacctggaacttattaccttttgtaagtgggaagtccaaagctacaactggctcagggcaagtctggatggaaggaattaagtgatgtcatcaggaccttctctttttctctactttcttgtgttggcttttttcaatt

SEQ ID NO: 46141 - DNA, 1035 bp, Homo sapiens
ccttcatttgtgaggtgatgaggttagagatgatgaagctttggccagaaagatcagaatggcagaccaagtaaatgggccacccatgtgaaagattctgggggatagctagatcccattttagcctcgataaagaacagacaagattcttaaatgaaaagtataagtgaaaacttgcagttaagatgttattttcagccaggcacgatagctcacgcctgtaatcccagaactttgggaggccaaagtgggcagattacttgagtccaggagttcaagaccagcctgggtgacacggcgaaatcccatctttacaaaaattagctgagtgtggtgatgtgcacctgtagtcccagctacttaggaggatcacctgagccagaggaggttgaggctgcagtgtgccgagattacgccactgtactccagcctgggcgacagagtgtttaaaaaaaaaaaaagatgttatgttctactttctatttattaaattagtagaatgagtgaatgagtgagagactgccctttgttaattagattgtgattgaaagagcattttcaggaactagtctttggtataaattgttactacttttctgaaaaaccactttggctttgtatagcagaagccttaccagttgagcatatcttttgaccaaggaatgcctaggaaataattatataaccagacgaagatttgtgttcaaagatttctgtcatacagtttctgtaaacagtgaaacaatggaaacagcactgtttaacaggaaagaaatggttaggtacatgatgccatattcttaagataggaataacagtaatggtaagggcaaatagctaagtagtaaattattatgtttaaagatatggatagtaaaaacatctgaaagaaataaattaaaaaatattagctaaaatactaagagaagttacttcatgggggtagagatagtggtgaatatttcttcctctcttttatgctttttttctatttttcaaaatttccaaagtaaacataaaaaggaaaatttaaaa

SEQ ID NO: 46142 - DNA, 1935 bp, Homo sapiens
aaagacaaaaagacaaaccagctcagttctgcttttgagatgacacacattgtggtacctgtgtgaatgtgtttgtatcaattcagaaaaggcctgttgtggaagttgaagaaagggaaaagccagtatggggggcagtgtgagcagagatcatggaagcagaaatgaatggaacatgtctagggtgactgagaaaatggtcatagggagagatctttttttttttttttttttttttttttttttgagatggagtctcatgctgttgcccaggctggagtgcagtggcacaatctcagctcactgcaacctccacctcccaggttcaagagattttcctgcctcagcttaccaagtagctgggattacaggcatgcaccaccacacctggctagtttttttatttttgtagagatagggtttcaccgtgtcggtcaggctggtctcaaactcctgacctcaggtgatccgccacctcggcctcccaaagtgctgagatcacaggcacatgccactgcgcccagccaaggagagagaatctgaccagagcaaaatgaatattactaagagctggtatcagtctccattttttcagtctctactttttgataattgaagtttggtcattttgtttatatttcatttctcaccacatctatcaggtagagtatttgatgccttttgccaaggatcatttcagggaatgctctgcgctgtgagttactaggattgatgtaaggataagtctacaacccccttcccttagaatttcatgctctaataggcaagataagaaacgtggaccagtataactaaaatgcaagacagagagtcgagtgatatgcagtatcaagaacgttgtacatagactagagagatggagttctcagagggaagaccagggaaggtcctaaagaagtaggagcggaactttgaaagagaggaaggatgttaataggtagagctaataaaggtatagatccagggtgagcacatgacacagaaagatacagggaaggcttaaagtgtgggaagacagtgcattgacaccatcagaaggtcaagccaacagatgctgtgttaggaagcatgagggttgatatatgggccattttgtgattgttcagtgatacggctgatttgattctttggtgtccatctgaagtaggaaattagcttggataaataaataaggaggatataaatttggccttaaaagttaggcataggggttaaaatttgattgagttcactatatagagctattgaaagagttctgagcagagttttatcaggtaggtagcagtatgtagagtgaattgtattgatgagaaagactgggtagttcaaaggctattgaagagtgaaaagcatgaagacctggactagggtagtagtagcaacagacaccaaaagaagagaggattaacctgaagtagaagaaatagtggaaggaaggaaggagggaaattaacaactaagatgcatattttatttgcaaagcatttattgcttgacattaactggccagtgttacccactcttagagaataggtatgtatattgctcaggcaaggggcattgtcatgtaacagtctgggtgaagaatctttgttagagcaagctgatggggagggtcttggatggcttttaggactggtgaattgacaagtgcaggtagtggtcaccattaacgtgtactgggtttgttggctgtgtccactggtgtgcctaggccagtggttctcacccttccatgccttgataaatggcaaattctgttaaattttgaaagtttgtgttaattttttgctgctgatgtgtattcatgtcgcccaacagagtgtgaaagagaatctaacccagcaggttattcatggcagtgttggagcaaggcaatgattgctcttaagaagcaagaggcttaatctctag

SEQ ID NO: 46143 - DNA, 1023 bp, Homo sapiens
gtctgtttctctagaatattacccatatataaattttcaaatattggcataaagttgttcataatttttttttattgtgacagctctgtatctatgggtgtaatgatgtcatttttcatgtgtgtatgtttttgtttgtttttgcttgattttcttgacgtcacattttaatagtagggactatactgttactcgtcattttacctcaaatataatactcacaggtaacaggctccagtgaacttccagtgaactgaataaccttgactttaattcttctgtttctggccagtcttctctgtgtccattgctaactttccttccccttttccctcccatcccccactgccatgccccccacattttcaattttttccctctcttctatgccagtatgcccttttaatttagtgatcttatgcaatccaagcttttgccttctcttatttacatagctcccaaatttataaccttaacctgacctttcttctaagctttaactgctggcttgacatttctccctgggtatctccttgcttccaccttcagtgcagcacaaccaaagtgaaactccttacttccctccacccaaaccagttctttgtccaaatttcctggtttctattaattggcactgccactcacccaggctcaaaatgtcagtcattctgagactcttctctcttatcttacatgtgctcatctgcaaagctgtacattctactgctacaacctccctatatgtatacatgacctcccttatcatcccttcagccaccacctttattcagaccctcactgctttgtacctggactactgtaacacctccctgtctgattgaatctagttcatctgttacactgaggtgagattaaatttgctaaacacagtaattttgtaccactctttagccccaaattacgtagttctcatagctgctaaaataagaacaaactctttagcttttccaggtcttccataataatgcccaaatatacccatcttggcttgtctttccctta

SEQ ID NO: 46144 - DNA, 1050 bp, Homo sapiens
tgggcacggtggttcacagctgtaatcccagctctttgggtgactgaggcaggtggattgcttgagcccaggagtttgagaccagctgggcaagatggcgagaccttgcccatacaaaaaaataaaaaagtagccctttgtggtggcacacccctgtggtctcagctcctctggaggctaaggttggaggattgcatgagcctagaaggttaaggctgcaccactgcactccagcctgggcgacagaatgaaaccctgtctcaaaaaataaaatactcagtttataatcctgaaaaaaaaaaaagattaatgaggcactattctgcctttagtactttgtagcttcttgtcttactccttaggcaagcacagaaggtataatgtgcctgggacagaaaaatctactatgtgcccagagcttgactcaggttgtcttgtgaaaacctgacagtattactaggaagtaggtaatagcatcccctgtcagccccccaaaacacatacattgactgtttggattgcttggtgatatctcaaattaatcattggcagaagtaggatctaaatcgaaggatgatgataaagattgtgtgccttctgctctatctttaaagctgcctcatgctgccagggagcaagacacagtgaaactcattgtggataattgggtccatgcctcactaatcagaaaactgagttgcaatatattacatttctctgttctattatgatgggagtaatttcattataagtgagtttttatagcaccatctaaaaagaatatacactttaagaaaatctaaaatccaaacttagaaagccagattaatcagggatatttattcactttacattggtgtctctcaattttataaaagaaccaattgtactacagccttccttaaatggacatcttccaaatgtttcgtatgtttaaactatttgagttaccaaaattgaatttgtgtggaattttttagactacgtcagtgtgtaaaatgaactgagtttcaagtgaagtctattcattttgataatggatagaaaatc

SEQ ID NO: 46145 - DNA, 1059 bp, Homo sapiens
cagtttgatgtgataaaggattttttttaaagctgttcaacctattttgcttagaaagatggctcagaattgccaaactgattaaagatagaatgttaaatgatttaatcctttgtaacatactttggatactaaaaaatgtaatgtactaaatactaaatttttatttattaaatttataaggtactattccttttctaattattttgaggaaatataaatgtgttagaattgttaagagttttttttttcttgtcaagttgacacggagatttctaatggataggaaatataagtttttaaaaaaagtttccatgtaatcaggattttaggagtatatatgatccatgatataagaattagtagagatatttcattcatttttttcattttggtttttgactcattaagggagctttgattaataggtcctacaaataaatacataaagcacttttgttttcctgtgttgatcatagtcttagtgtatagaaaaaaaaaaacacaacgtataagcacatttactacagaaaaagccatcatcgtcatctgtggaaaatcaatatatatttttcaaaatttagattgatgatcatgtgttagcagtgttagctaaagcttgggggctgctccaggggtcaagtacaggccagcggagctctggcatcatcagtgactatgagattgactttctcaggcagcttacctagcgccggccctgagcgccctggctgaagatgaaagatacacctgagtaagattttgacaggaaatagtaataaataagtgttgtgttggtctgtatctataacactgctacctttggctaagcccagtagattttgcctgtctatgaaaattgaattttgttggtctatttttatggaaattttagaataaagtaaaccattcaaccatagatctttaaaataatgttgcatttgcacttatttatctaacagaattctaagatgttaaatctattcacaccctggtctcttgattctgtaatagaatttttcaaactgaaggtcacaatcaactagtgtgtcctgaatc

SEQ ID NO: 46146 - DNA, 1066 bp, Homo sapiens
ctctactaaaaatacaaaattagccaggtgtggtggtgtatgcctgtaatcccagctactcgggaggctgaggcaggagaatcgcttgaacccaggaggcagaggttgcagtgagctgagatcatgccattgcactccagcctgggcagcaagagcgaaactctgtctcagaaaaacaaaaacaaaaacaaaaaaaactaggatgattttagtgtccctcttctgtaagaacataaccatttaaaatgttggatttcaagtattccaatttaaacatgatttataaatctcagtaacactgcataggttagaccaataacttctagtaaaacttctgacagtgtgtctgtcttaaatgagtaattataggtcaagggattaaacaaaaggaggtaattcctggtccagctcctccttggtgaggtgttttcctcttagatctggttgctgtacattcacacaggcgataacacagccccatccactatctagccctggccttcatatcccagcttcttggtgtcttgataggacttctctggaagcgcgtacctgtgtgcacgaacatctgaaggaaaggtgtgctctgggcgctctgtccagagttcaccctttcaggtagatgcctctgcagtgggtatgaaaattgactttctaccattttctgtaatttttcgtatttgtttttaatcttgaaataggaacatttattagtaagtcaaatgagctattcactcagagctgtggaaactgcagagtaccatctgtgtagtttgtgatgtgccatatcaactcatatttgagcttttagcaggaaaagtgacataaaattgcgaagtattattattaacacggctgatcctacagtgaatcagggtgaggaaagaatctctgtggtacagactgcttttccatatcggttgtattaacccttctggaacgcgtgcaagcatttggtaattttaccaattggtacccaccaattgatcatcttggttatgtcaagaaagaaatgcctccatgttctgacttggatcagattcatttttacaaattataattttca

SEQ ID NO: 46147 - DNA, 1027 bp, Homo sapiens
agggctatacagatatgttacgtgagcaaactgcattttgcaaggtgaaggaaggcctcagagctgctgtagtgtttgatttgagccttaaagaccggcctagatgagatttcatcagggaaaaggaatcctaaagaggcctatgcataggatgaagacagaaaatattatagtatgtttctatttttcctcattttacatatacctttaataagagctgcatgataatttgagagacttatcaataaagctagtgatctttagtgcacagaatgtggaatatttattttgaatatagggaaagcagccttaaattctttgcttccttttcagttttttccttgagttctgaatcagggagttctatttactattgctgcattatataccatcccaaacttggtggcgttatgctcacaaatgttgtggctcagaatcataaaaggtatgattgacacagcttatctgccccatgatgtctggcacctcagctaggaagacgcaaagccagggctgagtctatgactggggagctggaatcagctgaagccttgctcacctgcatgcctggcctttcctactggctgttggctgggatgtaggctaggttgcaggctagaatatctacaaattggactctccttgtacctgcttggacttcctcacagcatggcggcagaagttcagtggatgaaaattccaaggaagctgtgttccctttatgacttaacctcaaaagttacataggatcacatatgcccttagtcccaagctgcccccccgccctccccctctatcccccatccagattcatcagagaggaagccttgattccagctgtacttcagaggaattcagcagggaggaagcattgattccagctgtacttggaagacacattataagaggagcatgtgggataagagattgcagtcgtgttgggagccaccatctgtctgtcacaggctaatttgtagaaagttgaagcgttactgtcctttcctttaaaataagagaggaaagagga

SEQ ID NO: 46148 - DNA, 1033 bp, Homo sapiens
ctgcttataaaatcagtacatgatttaaatatgaaacaatttcccttgtctttggtattgtagtagcatttgtcagaatatttaatattaacttatcttaaaatttctaattgtactgttaatatgcttaaaaaggaaaagctttcagttattgtcgaaatgtttttagattcctaaataaggaatacggaaattccgtagtagaattgaatgtcgggagtatatgaatttctacaaatttaacctaatattacagcatttctggaaattacagaagcaggttgtagttatggagacaggcattgggggcttgccggtgcttgaggcggttctgctgtcctgcatctgccatcttgtgccagcagcctgttctggatgtagcatagggtgtgcctggcattaagaccagactccagtagctgaccacttactacgcagtgctttgacatcagggtggaatgataaataatgattcaaacttctgaccacttcactttgggtatgaacctttgcacatctttctcctctacctccttttatctttcttcttccctgactttaattttttcttcaagttgaagattaaatataagtggtagtgaaaagaatacaatcaagattacgggggaagtctgttactatcattaaggatttcatgtatgtagatcatgtctgatcatgatctacagtttcccctttaccaaacagatttactctgccaaaaacacttagtgaagaagtcagctgtttgttaagaaagcagttatgttgtgcctgtgttaagatcgcttaacccaagagtggtgaggtattggctgatttgttgttggagttagttgctggacaacattgtggttcagaagactggggctgagcttctattgtagtaggatcgagtattacattccttagcttttatatctgtattttattttttccctgtttaaggatattgttataaaccctacagtgttagatgtcatgaaaatggtgattaaagccatcaaaatggtgttagctgaaaatattaaga

SEQ ID NO: 46149 - DNA, 1058 bp, Homo sapiens
aagggggcggggtttctcctgaccagttagagcagagttgcatgcggggcgggggagtcatggagacgctgagagccagctactcttgtccatccccgagtcacccgctccttgatttctggggttgtgtcacttataggggctccgacccgcagaggctgccgaggcactcgaggtcctgtatgtctttcgtaccgaaatagacgttgtcttagacacgacgaagtctaaagccactttaggatgtggcagtaactcaccgaggccggtttctaaaatggcatatgctgtagtgatcatgtcctggacctcagcgtccggtttacatgctaagggtcacagaagacagaagttacccgtttacctcttatctcggtttcactcagctatgccagaatggggacaatgaaatttgaaagggaaccctgagaatgaaggcatgggagcagtatcacgtcaactgattattggtagtagaaagcatcattgttcataatggcttcactggtttcttgtttaattagagctccagttcccaaagtgtacttgaaacttcggcattggggatgtcattaaaaaaaaaagttgtggtttatggtatgcatttttttttctttttgcaaacaaaatgaagttgggaactaaagcatcactgattgaaacattaagtgtgggtatttaaggagcaaagctaatcaaagaatatttgtctacaggaaaaagtctgagtaaaatgtagtttgccagattactcccacacaaaagattcttaaaaataattttaattttcttaaacactgctgaattgtacagtgtgtgggtacttttctggtttatacaaggtttggagacatctttggttttaactgtttattgcgcgttcagtcaagtgactttctcaactcttgacttttaggaacagaggtctttgattctctgtaaagatcacaggttgctctgcaggaatagcagtcttttaaaaagaaagcagctgctacaaagcatgtgtgtgtgcgcgtgtgtgtgtgtgtatgtgtgtgtgtgttcctgttctttgt

SEQ ID NO: 46150 - DNA, 1046 bp, Homo sapiens
ttcttaatggggctcataataagtttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatctctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttcacaagttgtatcctggatgtttctgtcattgttggtgtttaggctattttggtatataacctcattaaaatgtaccatatttaaaacacttcatagacattcagaataacccttttcaaaattgtgttctgcaaataaacagatttgttccacagaatattggtgaggactactggggggatagatggtcataaccaaataaatctgggaatcactggattaaactaacctaaaggtgtctctttattatgggaccgttcagtccttaatatgcaaacgtgtttcctggtgcaccaagaatgttggatataatatgcagtgtttcccaccttatttgcc

SEQ ID NO: 46151 - DNA, 1011 bp, Homo sapiens
atccccaaggacttcgctgtcaaatgtgaaaagtttctttatttctacagaaggtatttctcttgaatactatttttaaattcttgtgactttatagttttctgtgctgtcacttttttctgcttttaatagtagttttcttttaatttgctactttcagttcattgtgttaaaaatgttaccaggttttgtgattggttaaatactggtaagtaaatttcacctgagtgaattggattttacattttcttttctgaaggtatctttacatataaagattataacttgcatttatttataaaagagagtaacatggattcttttctttttgcagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatcgtta

SEQ ID NO: 46152 - DNA, 1050 bp, Homo sapiens
ggaagacttctgactttaattctttcagtactgactgttggttttggccttgcaagagcagaaaatcagaagctggatttcagtactggaaacttcaatgtgttagctgttaggtacgatcaatttaacatttttttcactttatacagctagataatatatattatcagtttctctacattgaatcatctaaaaaaggatgaatatgaggttggggaaaatactcatttgattttatttcatacccgttgctattttacatgtctaaagtgaagtactaaagcatttaacttttaggataaattattaatgcaatgattattaatacaattttctcaactgagtgggaattattactaaatactatgaaagatgatagaatgtattcagtggcattgttttttatacactaactttttatgtcttaatatttcttagaatcgctgttctggcatccatttgcgttactcaggcatttatgatgtggaagttcattaattttcagcttcgaaggtggagggaacattctgcttttcaggcaccagctgtgaagaagaaaccaacagtaactaaaggcagatcttctaaaaaaggaacaggtttgtattcagtaagcaatgaaaaactcatggaagtagaaaacttttaaaaaatttgttgttggatcttatttattagttttaaggtgtcttataaagaaaatactattctgcttttcaacaaaattagaggcaaagtaatcttactgcattccacaattgggtgatcccttgggtgaggaaactcagttactcccctcaaaagctgtccatcacatttctctttaacaagttttccatgcttggttaccttgagctactttagaccaaactttatgggcaggtttaaactaaacctgaggatggtagtttgttttcaagcatcttattcacattttaaaaagctcttcacaacctcttcccatctgcccatttgtcccaagtggaatagctttttttttataacttctgattgcttgattctttgtctttaaagccttcatttaacctc

SEQ ID NO: 46153 - DNA, 1097 bp, Homo sapiens
agagtttctcccatcgccaccatcttttctcggggacctctttctctgcttactccttatgcttcatgcacactgatagtctctagttttgtaatcccagcacatcacttctttttcctggaacacctcttccctcggataaattaatcaagtactttcatttcccttttttctgggagttttttttttttttttaattctcatatatgaaatcctatgtgggattttacttcaaaataataccaggtgaaggaaagtgaagagggatatagatgaaacaagtttgatcgtttattaataatgattgagttacgggtatgtcagaatcttttctgtctgttgtgtatatgtttacatttttccgcatttaaaatttcttttttttttttttaatcccctttgagaaacctggagtgaaagtgtgacagccagtctggtgactagtttatctttgcctactcaaaagccataaaacactatttttatgtgtgctacaaatagttaattcatggactaggcacttgatttcctactgtttcgtgtctgtgttctgtgtatctgtcgttactcatgttgtctgctaggattagaaaacagcaccaaattaaaggccatatgctatggtacttaagttctttttatgctgatttcttttataaagtagattgtttctccagctatattgataaggaataggatgaagaccttttatttttaaacccttgatttagaactgtcttcagataaaattgttaggcccagattccagtagcccttccatgtttagtaagctcctaatgtgaatcatagatattgtggagctgtactgtccaaaatgctaactactagtcacatctacatgaacttaaaaaacaaaaacgaaattgacttttttagccccagtagccacatttcaagtgcttattagctactgtggctagtatgtaccattttgaacagaggagatatggaacatttccatgattgcagaaagttctattggacagcgctactgagagtatcatagtttcttgatgtcttagtagcatggctcagatatttaaagccttcttaaggtatttgtatactcatgaaca

SEQ ID NO: 46154 - DNA, 1076 bp, Homo sapiens
atcttaaaattaaggatgaattacacaattttacctaaaccgcagaagagtactctagtgaattacattagctccttggcaatcagtaatttccattgtgtctgtcaggattccacaggaacgaggaggcccttggtgcttcgatttagggacagattttataatgtttttgccccgatctgttatttgggagagggtcacaaattgacttgatctttgtttttccttctttgtagataacggcaaaagcttctatcatttttgttactcttcagtacaatgtcaccctcccagcaacaggtaggtaatttacgctaagaattttctacgtaaatagaagttcagttgaacaaacttggaaattttcatgaatgctaggtcctgcgttaattaatcgtcagagatctcatccatgatgtgactgaatgttattgtgatgattttataatacaagatctgatgtttttgattgactttaccctgtatatgttttctgtttactatatatttttgtgaatggacttgaaattccataaaataattttgttttgctttctctgctttctgattttttcctaagaaaattataagaaaagatctttttaaaattgtttaaatgtcattgttcattcaagacttctaaaagcacaatggcagatttagtttttctgtaagttacattttggacctgtaatagcaatcaatccttctaagattattttcactttttcctgtgctctacttttaacaattattttgattccagaaaatgtgttagtaagctctaggaattatctggtaatagcatccaaactattaggttttatttcaaaaatcttatttcttaatctatgtaaaaattaggtgtttcttggaagttgattgtaatttaatacagtgatataattaactagcatgggtgagggatggggtattttttggttgaggcagtaaacctgcacagttttttatttagaatgtaagataatatagtataccacatttagttggggttttttgttgttgttgctgttatttatatgtgtgtttttaagagatgacagggtcttgccaaa

SEQ ID NO: 46155 - DNA, 1028 bp, Homo sapiens
aatttataaaatttgaaaatctaaatagacaaaaatactaaatagaggtttttaagtcaattcaaaagtgagtgttaaagtgatacacaaaagtgaagtttgtgcgagttcttcctttttcttaccatatattaaggtgttaggatttcaaagcatgttatctatatataggactttgtagactaggttagttttgctattcgacttttaaaacaattgctgctgaatctcaaagttaacataattatagaattacagtacttgtgctagaataatagagaaattgatttttttttgcagaactgttaagcctgttgtgcagatacattgaggaaatgtcagaggatttatggtgacattgacaaagaaattcagaaagaaagaaatactgtattactagccaaaatgaagaagcaatggagatacactgtaaaagcatggattctggagctgaagggattcatgttcaagttagggctctgcagcttgctaactgggtgacctagggcagctcagaactgaagtttcctcatctgtaaaatggggcttattgggttactctgacaaattaaccaatttgtattatgcctagttcaatacttgacttccaaaaggtgtgcaataagtggtagctattattattctttaaaaactcaccaaaattgggaaatagaaagcatttttatgtgagagaagggcctggaatctctttagttagcatctaaagagattatacatactgaaaaggctaacaaagtagtctgtttggcagtaatgtaagagtttaatttccagggaacttcacattaatcaaaaattgcttgtaaattttggaatcatagttttattacagtaaatatctgtccacataattcaaatcatagtatacaatgaatggcttcatatttgagttaggaaaaattgaatggtcaaaaaatgttagggatgcttgggaagctttctgaaagtgagtatgtggaggaggggtgaagaattaggggttcacaagagaagtatttcttttaagg

SEQ ID NO: 46156 - DNA, 1034 bp, Homo sapiens
tggattcacagccaaattccaccagaggtacaaagaggagctggtaccattccttctgaaactattccaatcaatagaaaaagagggaatcctccctaactcattttataaggccagcatcatcctgataccaaagcctggcagagacacaataaaaacagagaattttagaccaatatccctgatgaacatcgatgcaaaaatccttaataaaatactggaaaactgaatccagcagcacatcaaaaagcttatccaccatgatcaggtcggcttcatccctgggatggaaggctagttcaacatatacaaatcaataaacataatccatcacataaacagaaccaacgacgaaaaccacatgattgtctcaatagatgcagaaaagaccttcaataaaattcaacagcccttcatgctaaaaactctcaataaactaggtattgagagaacatatgtcaaaataataagagctatttatgacaaacccacagccaatatcatactgaatgggcaaaaactggaagcattacctttgaaaaccggcacaagacaaggatgccctctctcaccacttctattcaacatagtgttggaagttctggccaaggcaatcaggcaagagaaagaaataaagggtattcagttagcaaaagaggaagtcaaattgtccctgtttgcagatgacatgattgtatatttagaaaaccccatcatctcagcccagaatctccttaagctgataagcaacttcagcaaagtttcaggatacaaaatttaatgtgcaaaaaacacaagcattcctatacatgagtaacagacagagagccaaatcatgggtgaactcccgttcacaatcactacaaagagaataaaatacctagcaatccaacttacaagggacgtgaaggacctcttcaaggagaactacaaaccactgctcaacaaaataaaagagaacatgaacaaatggaagaacattccatgctcatggataggaagaatcaatatagtgcaattggccatactgccca

SEQ ID NO: 46157 - DNA, 1024 bp, Homo sapiens
tccacaataagtgtaaggaatgccttctgcagaagctattgctgtgggggaaggaagaatatcctctacgagggatacaaagtgccaagatgtggtgctttggtagtcaggtatcaagggatgatgaatctctggtgtcttgggacttctgaagagagagaccaacctctgactgggaacagcgggctggatgcgttagcaatacccaagtttggtaattaattgtaaaatttttctagtggaggataatcgcaactttgcctcttgcactggccctagttcttccacataatctatctgtactatgtgactgttaccagtggcaaatacctgagtcacacggcaccaaatatgttaccagtggaaggtatccgagttaccagcagtgaatccctatggtctgcagcaacctcaattcttacctcctcagaagaaagaattcaactggggggcatgaggcagaaagagagactgaggcaaatttcagagcaggagtggaagttttctgaaaaaggctttagaacaagaaaaaaggaaactgcacttggaagagacccaagcaggcatcttggtcaagtgcggtgtttaaccttgatcctaggactttatatgctcgccccgttcccatgcatcttcccttagggtgggctgccggcatgtgcattgccccccttacccttgggaactgagcctgtgcagtgtgtttaggaagctgcacgcatgtctatctgaggctttcttcccttttccagtggagtgcccccagaaggtcatactctgccattaggtctcttaatgtgcatgcccagggaccctggtgcctgcattcagttaacatttagtgcaacaggtgtggaccatcaggaaatggcctctccctggcattggctgccaatttatcacttttagagagacaatgtgataattgccagaccatcacccgacattcctagtgggtggcgaagagccctctcctgccccggctcatggctaactacctgtatgtgaaaattggctaaataga

SEQ ID NO: 46158 - DNA, 1051 bp, Homo sapiens
tttgacacgtggatggccttattggtatagttgaggctgatagtgtgttaataaaggctaccaagccttcagttgttctcttcaaacagtggttttctgtttagtgaaatagaccaaccttaacaacatcgtagggaaaataatcattcctcatcttagatggagagattccaaactaaatctggtacagaaatctggaaaagagtttgtggggtgagccagctttttggacgtctggaatttgggagaagaggagatattctgatgtatgtattggatagactaaaaagtacaaaattggtgtgagtaaatggctttttgttcagtctgaacacaagataagcatcttccctcgctccacaatcactgcccgactcttcctttgagccttttgggggttgttctttattttgtggtttctatgtaattattttagtggcttctctgagttacccagatgagtaattttaatgtgctgcctggttttggatgtttggttcaaagggactaggaccgaggaagagccggtgatggacagtgtgtggagtacgggtattgtccatgtatctgcctctttatcttgtcacccgcttgttctcacataaaatgagggagaaaatggggaatgtaaaattttcaaagaaaaatctacctgatgactcagttttccctgccccagagagctggttttttcttttcacctctttgcatgcaccagaacctttttgtagctgagagagccacagctgaggcaaatgtgtgagcctctcagtatggccaggtgctgtgactggaatgaatgagagaagcggggaaaggcatggggagcgttctctaatcacagagaaccacatggaagatgcaggcaaccttgtacaacctgttgcctctcaccttcaattaaattttaattgttcctcatcacactttctttcaaaacaaatcttgtaatcagatatcttataaattatttaccagcgcaagtaaaagacgatgtaggatttcagcagaatgaaatgtgctttactattgaaactccccttgtgaatta

SEQ ID NO: 46159 - DNA, 1062 bp, Homo sapiens
tgtaaaggctttgcagtctttataacctgtgttaaaagttctctttggaaataaaaactattactgggacaaaaaggaaaacttggtcatttaaaatctatcttctaaggaagggggaaaatcctggttttaaatagcccatctggccttcgaaagcttttccccagggagctgcactaacttctgccacatagatcgtgcttgatgatggacatagcccatggcaaagaggccagagatggaaagcaaatggacttctgtgaaaatacacgagggacaaacagcatcctgcttgcccagtaagtgctagaaaatgctctaaaacatggcaagtacagacaggccccagcaggttccagcattcttatgttggctgggattctggtttttaatgtgagtccttgttctctgtgaagcagacctttgacctacttgttactccttttttttttttcttaaaaaaaaaaaaaagctttttgaagttataactgggcagtattatccaggttaaatcatacacagaactttgatttaatattttaagtaatgtttaaatcgacataggctgtgttcttaactacgaagaggtagtgaagatgtattaagagaagttttgagggatgggtttgttttaaaactaaaattgcttagcacttacagaactgcatgtcccatataggatcttcaagcaagactgtttcttgtttgttatggttgacaaggccaccactctttctctgtaggaagccaacattgataagaagaaagcaaagcaaaatctttgtgatgcactgtccctgggacactttatgtaatttacttttaaatttactagcctaaaacggagttacaatgaagaagtcctttaaaaatgggatcctttgattccaaatgtatttattaaatgtcttaggtatgattatttctgcccttagtgtgtctatgatttttgtgtagccaaaaattaataccacttaataccaatttgctttcaacattaccgattcagaaaatctaaaaggtagatttggcatgacagattagaaaaccataacctggcac

SEQ ID NO: 46160 - DNA, 1025 bp, Homo sapiens
gtgatgtggttgttaatcggtttgcatgtttccatctaatgcatgggctttctattttctgtcatttctgacaaatagcagaccatacccacatattctccctaccccttcctcacaaactatggctgcatatgggcaaacacagtttaccacaggaatgcaacaagctacagcctatgccacgtacccacagccaggacagccgtacggcatttcctcatatggtgagtaacctgcaactgtagtggtggcgttatcgcatgggcatgcgtgtattaacatgtttgagtggtacttaaagacccaatctttggccaatttagaacgtgttgtcaccttctgtgtctaaattcttagtatgattgtttctaaagagcattataagaactggtagctccttatcttgaggtcagaggtagcgaaaagattatgtggttcgtatgccttcttgctctcatttttctcgatttacatctcaaccctgaatttgccatttgagcactgggctctggaatccaaaatatttttgtgcatatttgtgataaaacgtctgtgaatgaagtcttttggggtacagattcatttcctatttatcagatgcctagctgtgattaggaacgtacaagtagaattcaacaaactcttgctttaaactcgagggtggtaatagtctcaaatttcagcattatcaaccattaggaaaagtgatctatatatcactgcctggagtgtactttgaagaggcaaatcgggaaacatttaaggctcacatggacatttgttccttcccacctggagattatctttatcttggtgtaatttaactcactttttatgggtcaatacctgtaaattaaaaataaatccaacaaaatcccaaagcttaattaaaaaaatttcagaatttcaaaataccttttcttccattaaattgtcattgcaattctaagtagattgaactgaatagaaacacttgaattattggcattttattaagaaaagaataaaaactagtgatcaaggaa

SEQ ID NO: 46161 - DNA, 1038 bp, Homo sapiens
agatcttggatccaaaactagataacattaatagtaagaaaaaataaatttgattaacacattgaaaatgagatatgattattcaattaatgttttctttttcaaaataattggcctcaatgatctcatctatgaaatctaatacctgatttaatacacgatggtttcgctgtatggatacactttgaccacaaaagtgagtatatattttattttttcattttcctagatttgagaattgtggaattttcattgttatattggaggtaatttttaaaactttgttgaggtctgcagttgtatttttcttccttcttttggcttttggactcagcttttacgtcctcctgaatttacaggtaaggcagttgtatcagtagttgattttatcactgtgaattatggaaatatacatttatatgtaaatctaaatagtctagaaaatttataattacataacaacagtattttaatactttagtttttttcatctgctatatctttcaaatgattttagaaaaatcattttccttttttgaattctacaaaaaagtagggtcttgttaagtaactttttccatcgtcaaaaagtttaggccaggcgtagtggctcatgcctgtaatcccagttacttgggaggctgaggcagaagaatcgcttgaacccgggaggcagaagttgcagtgagccaagatcgcaccattgcactccagcctgggcaaaaagaacaaaactccatctcaaaaaaaaaaaaaaaagtttatgtaaagtgcacgatgatttattctttatgcagaaaatatacttttgatgactttgccactgcttattaatattttatcactgcatacctctgaattttaaaaagtattctgaaacattttttcagaattctactctccaggaaacattttttcattgtatacacctcgcatttcaggatgcctttagttctccattgctgtctataatacagaccttcagcatgatacaaggaaatatcaattattgagagtccttcctagaaccatttctga

SEQ ID NO: 46162 - DNA, 1047 bp, Homo sapiens
atgccaaagcctttgcacttctgagccacaatgctgacatagtcctgaacaaggagcaggcaggcctcctttttgcaccttgcacttcacaataagaagaaggaggtggttcttatgaccatcaggagcaaaaggtacactgtctgcctgtccactgtcatttagtgttctctggtgtcagggatgattcgaagtctgagagaaaagaaatgagtttcagccattaatcacaattttaaaatatcagttgtttacctaaatttttaagaagtcttttatttttaatttgtgtgggtacatagtaagtgtatatgtttatcaggtacatgagatgttttgatacaggtgtgcaatgcataataatcatttcaaggagaatggggtatccatactctcaagcatttattctttgtgttacaagcaatcccattatactcctttagttatttttaaatgtttacagaatttttaaatgatttttcttagtgacaacaggcacattactttacctcgccgatcttcagtttatatttcttaacaaaataaaatatgggcacattaagaccaagcttcgcagcactcttacgagattccagggattcaggcatgtgtattgtctggcaccatgtcactgtcaagcaaacttcacactgccctccctgaacttgcctgacatgtgccagtagaaaccctgaaagtggatgctggcaaaaatattacccaaggtaaattcagattgttatccatgccctttaatgggatatcttttagcaaataatcttttgtggttgtgggtttctaatccatgttctaagagttttaattatgaagttagagggtactttgtctaatttctcataatatctcataatatcactttctgtataatcacagatagacatgcattagggaccagtgtcacccaatagtagacacagaatgaacaattccatattcaaggcagatcaagcccttgtttttgagcatggacagcctcaaaaatctcctgctgatagttcctttttaaagcactttttaatgaaagtg

SEQ ID NO: 46163 - DNA, 1061 bp, Homo sapiens
cagactttcagaagacaagctagctctggactgcaacctcattggagtcctgcgccaggtccagccagacaaatcactgaatttgtggcccacagaatgggtgcgagacaataaatgattactgttgttttaaatcactaagttttagaatgattggctatgcagtattggacaacaaatctatcctagaataaaataagactccatgagtttcccccacatgatgtaaataaataaatgggaggagcagggaagaaaagggcttacaatagattgccaagtaatacatgtaaaaggataatggagttagaaaatcaccatttttcaaccatcagagtgataattggattggtaaaatagttgtcagcagctgctaaaattagagggtgggaatctgatgagaagcaggatattacatagtctcaaagtatctgccacaagaggtttattaatgaggaaggggaaaatagtgacttcacctaggaacaacatggcagacaccaccttaactgaataaagttaacctcctctgtaatgggactgtcacagttcataatactcctttcaaaaatgcataatctaaattgaatgaggaggaaacaccagactaagcctaagctgagaggcattctataaaattatgaagtcataagattggaattctttcagattaaactagcctaaagaaacgtggtgactgcatgcaacacatgagtttctgtgcttatgtgccactttgtttgtgggtataacagcttcaaagaattaaccaaactgtcttgtttgcaaatgagcagaaaatataacatggggttggtaactctgggaactctctgggtgaagaacttgttaacactctaacttgtttgcattatatagacgttccttatgggcaatatttatgtaaaccagattatatttattgtaagcagattaatctccaggctatttgtttatcctatcccttttattcgccctgatacatgaaaggatatagctttggtttagttttatcccaccttcctctaccttgtaactttcctaccataatgtataaacag

SEQ ID NO: 46164 - DNA, 1049 bp, Homo sapiens
aagggatcagatgcttccaacagcctgagtgagcttggaagtggattttctcccagatcttacagaaaagaacccatcatgactgataccttgacttcagctttatgagattcacagaacttagtcaagcccctctggattccgtcaagtttctaaaactggtaatttgttatccggtgatataaaactaatatgtcaccatattagaggggcccatgtggcaaggaactaatggtagactcttgccaacagctggctaggaactgaggcccttggtccaacagtcctgtggaaactaaattctgccaaggatcccatgtccctgaaagcagctccttcctagtcacgtgtttggatgagactccacttttgattggcaccttgattgttgccttcagagaagccctaaagcaggggacccatgtgtgttaaattcgtgacccacatgtactgtgaaataatgaatgtgtgctgtgttaagctgttaggttttgagggtaagggggatcttgttatgaagcaacaaataatgaatacagatggaaattccctcgattccttttcactaaacttacaactgatcactgtgaaaatgcagtctgctacagcctggcttgctccttcaccaccaaaggtaccaatgaacttcacaccaaatccaatgggcatttgatatctaataaacgtttgtaattgctgcccattctttctttggcttccaccacactccaatttccttgttttcttcttactcacatcactgttaagaagactcatgaccaccatcctcctgtgggttttggtcatcatgggaaacatactttgtccttgcttttggtaggaaagcagcttcctctgactgtgtagtaagctctccttgctctgccttcagagtggttggcaagcccttccccattagacattttcaggtaggcatcaaataccggtcgctacctcctccaaatacttacgggcatatgccaagctctgtgagtggtgctcttgcagcttccctctcttgcagtacacccatctccactcacccatag

SEQ ID NO: 46165 - DNA, 1049 bp, Homo sapiens
agatacatgcaacaacttgggtaggccctaggagaattatgttgattgaaaaaagccagtttcgaaaggttatataacatcctggatgtaatgaaattatagaaaggatcacagattcctggttgccaggagttactatttgggggccaagaatgggacaggtatgactatgaaggaataacatgggcatatttgtggtgatggaacagttttgcatcttgatggtggaagtttcatgaagctacacaggataaaattacgcacacatgagtgtatataactggtgaaatctgaataagctctgtgaattgtagcaatgtcaatttcctggtttttatattctcctatagtcatgtaaggtgttaacagtggaggtggagaagtgaagggtgtatgggacctccacatataactttttacttttgtgaacctctaatcattttgaaataaagttttatttttaaaagtatgtatactctgtagctgtcacattgtgaataacagaaaaagtgatcaaatcgtagatatattgcagccatcattggctttggatttaagaaattggcaagagtcagtgaaagcattctttgagaattaattggctaaatgaaaattacagtaaagaatataatgtattttagttgtttaaagtggtatgctacatacatcttttatatcagtaaaattcatagtcaacttctatatatataatcatgtatatatgtgattcttaaaaaagggagggaggaggatcagaaacctcttctttattgtgtaatgcaagctaatatctgtaggagaaataatagaattttttttttgatttataaagaacagaagtttatttcttacaattctgaagctgggaagtaccagatcaagataccagtaggttcagtgtctggtgaaggcctcttccttatagatgacaccatctgtgtctcttcacatggcagaagggatggaggggcaaaaataggggtacaaataatatttcttcacatgggagaggagcaaaagagagtaaacccactcccttaagccctttt

SEQ ID NO: 46166 - DNA, 1027 bp, Homo sapiens
tgtgggtcaattaaacatctttcctttataaattacccagtctcgggtatgtctctattagcagcatgagaatggactaatacaaacaactagatataatagatgtaaataaatgactttattcataaatgcattgattcaaaaaccttttattaagaactgattctttcccaaggatggttctagtactagagaaaatagaggtgcagtccctgatgcagcagattttacatgctatgggacaatagatattaacccaataattactcttaaaattgagtgatgggaaagtactttgagaaagaaacctgtttgtgtgaaaaaatataacaaagaaatattctgtgtactggagttggacaaaagctcaggaagactttcctgtagaattgattaagctgagacccaaaagataagccaaaaagatagctggaatgaaagttgggggtttggaaaaggaatagtgtgtctgacatgattctgaagagttaggaaaggccaaattatgtagacccttgcaagaaagctacttaatgattctgagtggtgatgctagaggtgtagtagggtggtatacatgtgaagcataattaaaccttatttagattgttaatctgattacagaattgagaagtcaaatgagtggaagggacttacatgattaaaacaaaacagtgccctctccaagttgagttgaagacaggggattgctggagcccacacatgtacacttggaagaacagactgtgtgcatctcttcctaatgctgcattcagtgacatcacactggtagtttgaaatcaaccataatggaggtatttatggaaacaggcaaatgttacaaatgaaaacttttcttccctggaaagccagttgttaaacattcaccagcacatcactgattgaagaggaaggaagatgattgggtcaggggaagtggaggcggctaaggatggtggggtaatttgatttgcttggtaaatgacctttgcctttcaaacttaagttaatagttccggccatctat

SEQ ID NO: 46167 - DNA, 1033 bp, Homo sapiens
agcaaataaaaatgtaggccacctagttaaatttaattccaatgatatgacaaagtaaattttagtataagtatgtcccaaatattgcatgagacatcgttgtattttaaaaattatttgttgcttctctaaaattctattttaattgggtgtcctatattttctttggcaactctagaaatttgtttacgtgtgcacaggaaacatgtacaagattgcatactgtagcattgtttgtaatacaaaaacaaactaacaaactggaaacaactacacatttggtaactggaaatggtataaataaactgtgggatatttaaaagcaaacatgtctcaaatgttacaccgccttctagatgaatgtcatgaacttgacactgagaggaaaaaagcaagtcacggaagaaatatacatagactgattccacagatgtaacttcaaagttatataaaggaaataattcatttttaaagacttgtttaaatgtgggactacaatgtagctatgcaaggggaagatgaacacgaaattcaagatagctatcacttctggggaaggcaaagcatgagacatggtagggaggagcacatagggtactttgaaggtgtggctactattttttttctcctgggcacatgagtttatattttatctttataattttttaaacatattcaggtgtatgtgtctgtgtgtatacgcatatatttgtattcttctggatgtttgaaacaactttataggaaatgaaacatccaggccaggcgcggtggttcatgcctgtaatcccagcacttggggaggcggaagcgggcggatcatctgaggtcaggagttcgagaccagcctgaccaacatggagaagccctgtctctactaaaaatacaaaattagcctggcgtggtggcgcgtgtctgtaatcccagctactcgggaggctgaggtaggagatttgcttgaacccaggaggcggaggttgtggtgagccgaggtcgtgccattgcactccagcctgggcaacaaacgcaaaac

SEQ ID NO: 46168 - DNA, 1039 bp, Homo sapiens
ttactgtagctctatagtaaatcttaaagtttggtaatgtcagtcttctgattttgatcttctactttagtattgaattgtctgtgtcttttgccccactatgtaaactttaaaatcatttttggccgggtatggtggctcatggctgtaatcccagcactttgggaggccaaggtgggtagatcacctgaggtcaggatttcaagaccagcctggccaacatggtgaaaccccgtctctaccaaaaatacgaaagttagctgggcggggtggcaggcacctgtaatcccagctactcgggaggctgaggcacgagaatcgcttgaacctgggatgcagaggttgcagtgagctgagtttgtatgactgcattctagcctgggcaacagagctagactctgttgtaaaaaataaataaattaaaaaaattaaaaataaataaataaaaataaaatcatattttcaatatccacaaacaaaacttgtacagatttattgggattgcattgaatctatagaacaaattgggtagaactgacattttaacaatattaatattgaggtttcctaccattgacacaaaatatctcttcatttatttagttattttacaatttctttcatcaaagtgttgtggtttttctcatgtagatctcatacatattttgtcacattcatacctaaatatatcaattttagagaatgctaatgacaatgtgttttaatatcaaattcctcatattcattgcttatatatagcaatgtgattgactttgtatattaagcttgcatcctgtccccttactataatagcttatttgtttcagaagatttttcatcaattcttttggattttctacatggattatcatgtcatctctgaacattaacagttttatttctttcttcctaattctatactgtttatttcattttcttgtattttttgcattggctaggacttacagtgtgatattgagaagaagtagtgagaggaacatccttgtcttgtttttatcttatcaggaaaagcccctag

SEQ ID NO: 46169 - DNA, 1091 bp, Homo sapiens
attgtttctctgtaaaagattttgtttctccttcatttatgaaacttagtttggcagaatataaaagtctcaggtggcatttcttctctttaagaatactaaaaatgtttcttctgttctggctggtatgacttctgctgagaaatccaggctttcctttatagggaatatgacccttttctctagttacctttaagattttttcttttgcattgaccttggataatttgatgaatatgtgccttgtggacagtattttgcatcttgtatagtatcttgctggatttcttatatctgcatgtcaagctctctggcaaaattggggaaacctccatgaattatatcctcaaatatgttttccacattgcttactttctcttcttctctttcaggaatgccaataaattgtacatttgatagctttacataatcccatatttctcaagggctttgttcatttttttaaaattcttaaaaaaaattgtctgaccaggttgatttgaaggaccagtcttccagctctgtaattctttcttcttcttcttcttcgtttaatctgttgtgaagccttctgatttgtagtttggaattgtagtagtaacatttttaattccagaagttccgtttggtactttcttaatatagttacattgtctttcaaatcctagattgtttttctgtgttctttgtgttagatttcaactttgtcttggatctcattgagttttcttgccatccatattctgaattctatatctgtcatttcagtcatttcattctggttaggatccatccattgctagggagctagtgctatactttagatgtcattaaacattctggcttttgtattgcctgagttcttgtgctggttccttctcatctgagggagctgatgcttctttttttgcatatgctattgtttggataggactttttaattcttttttctctttagggtatggctgtggtgtatgttgtgtatgattgattggtttcaattctgagtgccttcagagggccaaggctctgcacaggttccttcattgcagatagattcatacaatggcttactcagacattgcttggtg

SEQ ID NO: 46170 - DNA, 1022 bp, Homo sapiens
aaactttttgaggcactagcacataaggaggcgccttattgggattgaggatgaggtgaatgttcttggcaagatttacttcctaactgtactgagtaattgcttagctacctaatgttacaatctgaaggtagtggggttttttggtgggggatgtaattgcatactgtggcaagaaaagatttaaaggaaacatgttgtagttttctttttaatgattggcattgctaattgtgattgagctaaaaattatgaataactgattattggttttcagcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagagggtaagttcagttttactgcattcgggtttgaatgggaaaaaaaaaaaaaaccttcacattacttctgggagccctgattctgaaacaccggagtaacaatattttaggggaagctagaacaaggagggtgctgatcactaatggtttagttgcaagccatgttccccaagctcctatcccttctcttaatagaatacagaaattcagtgtgtaacatgagaggattcctatctgtttaggtaggattcgatattcaaaactataatggttagtattaataaaaatttcgatgaaaggcaaatgcatttctggtccgttttcaccacagtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaagtctcttttctcctttgatttctatttgataaattggttatgtagcaacatgaattttagatgttttaacagtggtcaccttatttatgtttgctttttcacttcagg

SEQ ID NO: 46171 - DNA, 1028 bp, Homo sapiens
ccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgtttattcaactggggaaaaataaaactttgagcatttcccttggaactcgagatcagatcataactcatttgcctagaggcagcagaaatctgatcctgctactggagcttaaaataacaagtaaagaaaagtgttagaaacaaagctaaaattttaacatgattaataatagagaagttgggtttggttctgttgttatgattgttttgtcgtggtgcttgtgttcagttatattctctctctctctcatttcaaatactgcttgacaattcgaaaatgaaccaatgatgtgctgtggaatgtgatggttgtcttcatatagagtcacatggtttctctttttatgcagatatttataatcttcatcctatatcagtaggaataactataaggtgcactacaaaaagatgtatgcaaacaaacatgttttaaatcaggtcagatatctgatgaaaaatacgaactaatgttaagagcaagtagtttcaacatactccaggaactgagaaacaaaacaaagcaattgtgggttttgagctccatatactcttagcaagtaagggggcgtcttgcccctatatatcatcttcccggattccactccctgttgtgggaatcgcgcccacccccatccgtgtgttgtagccactcacggtttgcatcaagagtgttttttgtaactgcctctggacttgggacagtgagtaggatcaaaaataaataatgtacatgacggggaagggaaaaacctgttggagttgcttccagccagccacgctccg

SEQ ID NO: 46172 - DNA, 1082 bp, Homo sapiens
agaaatttgggacggagcaaaggtctgttctagctccgtctttgctgtcctcccaccactaggatggccaccaaatgtcccaagaaaaacgtcaggctcactgcatccctcacccactgagagaaactgcctttaccatcttttatgctggggcctctatttcaataaaaccaatattcagaattaaacagaacttcaaagcttatcttgtttgaccatcaccccctctccccagccctcccacatgcaatccaggaatatgctaagtgcagcaaaaatgatgaaataaccgtaatgtaaggttttatcaattgcttactcaaaccaaaatgaaattcctaagtagagctgtctgtgcccatgttcagcaggaatgcttcacatttttgttggagtcgaatatcaaaggaccaagaaatctcaaacagaccttccaagtggtgaggggtgaggggtggaggcagaactcagccatgattgccctacagacccaggctcctctcgggcgagaggtgcttccctcaggtccctctggttcaggatgtgccaccaccaaggttttaggcaaaaccccaattgtggagtcctcccagataaggtttcccaggcatctcctttgcagaccccagactggcctgaagagggcaaaacacttgtttcagacctcgaagatgagagaagattgagatctcagatgactgacatctcaaaaagacagtaactattatccatattccttggaggtaaattatggggcaggaacatttctctcggacaagatagatacaacccagtcctgcttcctaggactttttatccctttgcattttggccgcagagcccaagggtggggttgaggggtgtgttagaggcggagagaaatatggagtgctacctgctgagaggaaagccaaccagggcaagatgctggctctgagaacagacagaacagaataagacccctgtctgcgagcacctgtcttcctgggggaacttcagatggaagtggatgggtcatcagctgaggaatattttttgaggatgttctgtggacacactgtggagatttcaaagagggaagg

SEQ ID NO: 46173 - DNA, 1047 bp, Homo sapiens
aatatttattattatgggactgattaaatcaattatggcacagccatatgatgcaatgccatgcagctattaaaaagaatgagatcgagctgtttatggtgtcttgaaaagatgtccaagatgtattattattatgtgggaaaaaaaagttgcagaagagttagcatagtgattccatttgaggaaaaaaccaaaagtccatatatgtgtatataagaatataataattggctggttgcggtggctcatgcctgtaatcccagcactttgggaggccgaggcgggcagatcacgaggtcaggagttcgagaccagcctggccaatacggtgaaaccctgtctctactgaaaatacaaaaattagccggacgtggcagcacatgcctctgtgtagtcccagctacttgggaggctgaggcagaagaattgcttgaacccgggacgcggaggttgcagtgagccgagatcttgccactgcactccagcctgggtgacagagcaagactgtgtctcaaaaacacaaacaaacagaaaagaatataacaaataagatgcacaccacacttgactgttcatagtagttattctgtgacatgagattggagttgattgaagggtgagacagtatgggggactttcctttaacatttaaatagtcttaaacactttacaatgagagttattaattttaaaattaaaaataggcacaatggctcacgtctgtaatctcagcactttgggaggccaagacaggaggatcacttgaggcaaggagttcgagactagcctgggcaacacagtgagacccagtctttaaaaaaaattaaattaaattaaattaaaaatgtaaaatactgtttttccaaaagcacagttttaattttgttcttgttttaccttgcatttagatataattaaacattcacagaatgtagtagaaatagtacagagaggtcccacgtactctgcacacagtctcttccagtggttacatctcactgacctgtaggacagtaccaaaacctggagatccatattagtagaaca

SEQ ID NO: 46174 - DNA, 1035 bp, Homo sapiens
atcacctttacccactgtttaaaaagaaactaaggttcagagaagctgagtcacttgcccaagtcacagagcctgtacattttgagagacctaaatccagggcttctcgcttcagatggatcagtcaggcccctcccactgcttgtgctgccttttgtttacccttatataaaaacaaaaatatatctgcacatttaaaagccacatcaattagaaactcactcataaatctgctcagcggtttcccatatttcctgggtcacagtgttgtttgtcaaacaacctcgctctaattcgaggtttaatctgattctccccaggtgccctctgtctggatatttttttgtgagttcttatccagtagcagccacttgttaatctgcttttcacccttgtttttctcacccatattcttttcctttctcgaactgaccgtggatagaatccacgcagcagcattaacccccaacctgtcttctttagagacaacaagaagtggttgtgattcagtgacctctcttttgccgaataggcctcctaccacatctgtcccgtctccttactcagtccttctactcagtctccatccagacacactttctttttttttttttaaatatatatatatattttattatactttaagttctagggtacaggtgcacaacgtgcagctttgttacatatgtatacatatgccatgttggtgtgctgcacccattaactcgtcctttacattaggtatatctcctaatgctatccctccccactcccccaaccccacaacaggccctggtgtgtgatgttccccttcctgtgtccaagtgttctcattgttcaattcccacctatgagtgagaacatgcggtgtttgattttttgtccttgtgatagtttgctgagaatgacagtttctagcttcatctatgtccctacaaaggacatgaactcatccttttttatggctgcatagtattccatggtgtatgtgtgccacattttcttaatccagtctatcattgttggacatttggg

SEQ ID NO: 46175 - DNA, 1024 bp, Homo sapiens
aacctttgtacgtaatttgaactaacctctagtgtgctcacatctgagtttgtgattgccatggagtgccgagtgattgatttatcagggttttacagtgagctagtggcagaactgggaatcacaggctggtcatttcttctagggaaaagcaggagccataaacaggaaaatgggacccttttatgtaacttgggtattggtaagcaaggctgatatccaccttacaaactaagatatttttgttatactttttaaatatccttttattgtaagtaataggtgaatctgatagaacattatttaaccctcactatatagtaaatcgtatcatagaaagccattcattagccgagttctactctgcaagatttccagggcttcatttctattccagaaagaatgttttaaagactaagaatttccagatccaccaagctgacctctattccattatgtagtcacttgcgatagaaataatatattcagaagtaacctttgtcttttaacctttcaaggatgttacgttaacttgaactagattccaatcctctgtagcaattctagaagcagcctcagaacactgtcttcttccatactgccatactcataaatatcaaatttttgacattgtttttatatcatatcattatgttggcttctgaaatcttatcatttattagcaatatccaaggggacctactgataggaacacagggacttgatgacctcatggtcattgtcatccctgtgtttgtatgaaatgtagctttttaaatagttgttgacactaaaagtgaacactaattgcatcttaatgtgagactaactccggatatgactatatttttctttgcctcgtgaaaatgctcccttcctgacgctgtggctgaaacaaaatccttagcatttaaaagaaaagaactagcaagagcagtgactctgtaaacaccacttcagtcaaagtctgataccaaatatagcactatgttagatgcatgtaggcatggcctcagcaagtccc

SEQ ID NO: 46176 - DNA, 1066 bp, Homo sapiens
cccaattgcaaggcagagatgattctacttaacttttaaatttacaaatagatttgaagagcttctaaatatcaattgtgtaaatccattgataaggcttggcaccaaaatctcatctttaattgtagtttctataatccccacatgtcgtgggagggaccaggtggaaataactgaatcctgggggcagtttcccccatcctgttctcatgatgtgagtgagttctcaggagatctaatggatttattaggggcttcccccttcactgggcactcattcttctccttgctgctgctatgtgaagaaggatgtgtttgcttccccttccgccgtgattgaagtttcctgaggcctccccagtcatgctgaactgtgagccagttaaacctgtttcctttataaattacccagtcttgagtgtgtctttattagcagtgtgagaatggactaatacatccatatatgtatattttgaaattagttcttgtaaaaatacatagtttatagttagtgtgttacatctgaattgtactatttgtacaaatttgactatttgtccaaatattattaattttttactgtaaagaaatatactttctggccaggcgcggtggctcacgcctgtaatcccagcactttgggaggcagaggtgggcggatcacatgagattgggagttcgagaccagcctgaccaacatggagaaaccccatctctacttaaaaaaatacaaaattagctgggtgtggtggcacatgcctgtaatcccagctatttgggaggctgaggcaagagaatcgcttgaacccaggaggtggaggttgccatgagccgagatcacgccattgctctccagcctgggcaacaagagcgaaactcagtctcaaaaaaaaagaaaaagaaaaagaaatatactttccaattaaagatttatgcatatttttacatcaaaatgctgtatggaactagttgtagaggcctttattgttctaatgctttgcttactacctgagaattttgtgaaatttaaaaaataagcatttctaacagttttatgccaacagaa

SEQ ID NO: 46177 - DNA, 1051 bp, Homo sapiens
aacaaataaagaatctcaagataaattatttaaaaagtcaaatggaaattctggagttgaaaagtacaataaccgaaatgaaaaattcacttgagtaactcaataacagatttgagatggcagaagaacccacacccataaacttcaagatagatcagcgtgtagctttgaaaggaagaagcaaaatgttctttatttccagatgatgtgatcctgtatgtagaaaatcctgagaaatacccaccccccacacacatacacacacacaccctattagaactgataaacaagttcagttacagacaggatataatttatagatgaatatacaaaaatttgttgtatttctatatactggtaaaaaaaaaccaaaaatgaaattaagaccatttcattcacagtagcatcaaaaagaataaaatacttaggaatcagtttaaacacagagatgcaagatttgcacatggaaaactataaaatattgctaaaagaaattaaagatctaaaacaaatgagaggtattcaatgttcatggattagatgaacctttagtgttaagttcgcactttctcttaaattgacctatagatttaatacaatccctgtcaaaatcccagcaggcttttggggatagcagttgacaagctgatcttaaaatgtgtatggaaatgcaaagagaccagaatcgctaaaacagttttgaaaaggaagaacaaaattgaaacatttacactactgaattttaagttttactgtaaaactacagtactctacttagtggcattaaggatagacatgtagatcagtggaacagaattgagagtccagaaatgaacttttatatttatttttgatcaattttcaataaaaatgccaaggaaatttaatcaggaaagaataacattttcaacagagggtactgggaaaataaaacattcatatgaaaaagatgaatttggagccttacctcataccatatgcaaaaattcactcaaaatagataatagacttaaatgtaaaacccaaaactttaaaacttctcaaagaacca

SEQ ID NO: 46178 - DNA, 1351 bp, Homo sapiens
gcccttgaggtaattatggtctaatggagtgtatcagccaggatgcttttggctacaagtaacagaaaacctgactcatattggcttaaataataacgaacctcattatctcacataacaggaagttcaaaggaagggtgagctccagggttggttgataaagcagctcaatgatgtcagcaaggactcaggttattcccatttcttagctctgacatcctccacttcatcctctgactcagaaagatagccacaggagttctctgtgttgtgtgcagtataaccacatccagaaggagagagctgatcttcttgtgtcctgggcaaagacatctgtaccaggaacccctccagctatctttccctcaatttataagcctgggttgggttggtcatgtgcccatttctacaccagttgctggcaggagaagtaatcacttctggtttaaatgcttggggtgaagtagttgttgaggaatcaaccgcaaggactactacataagggatcaagtgtcacatatgcaattttaaattttctagtagccgtattttaaaaagtcaaacagttaaaattaattgtaataatacattttatttaacccaatatatctaaaatatcatctcaacatataatcaacttttaagattattgagatactattctttcatacttgaaatctggtatgtattttattcttataatacatctgatttaaaactattacatttcaggtgctcagtagccacatgggtgttggatgcacaagtctgtaggatgaaatctcaggagactgtgatttggttctttgcctatgtctccaatctcatcttttaccattcaccctgtacttatacccacgctttatgctctagcagtcctgagttaccatatttcatgctcttacatgtgtatctttgcatgtgtgttccctctgcctggcccattctctcattgctcatagggtaattttaattgttctgtcagattcagccaagatgtcactccagtcaataggccttccccaaaccaagagagagttaaaactctgcttcctttgagctctatctgtactttgtacattatcccattgttacacttatcaagctgtctcccaagatctcttcatgttggtctaccccactgggcagtgatctccttgagatacagggcagagtcttgctcacctcagtattctcagtgtttatgctcttgcacttacgaggcacttgatatgtgtttataggatggaattaaattgaatttctaagaaaattagaatgacttaggtttggtaaaattcatttggtaaaattagtgagagaaatagaatgtctggcctagtaagctttt

SEQ ID NO: 46179 - DNA, 1044 bp, Homo sapiens
gcagaaaggagactagtgtggctagagaagagtaagtgaagaggtgagtggtagaagaagccagagatgtgactgggagcctgatttatgtaaggccttgtaggccattgtaaagattctggctactatgaatgaaatgcaaaaccaatgtaggtttttttattttttgtttttttgagacggtgtctcactctgttgccaggctggagtgcagtggcgcaatctcagcttactatgtcttctgcctcccaggttcaaatgattctcctgcctcagcctcccaaggagctgggattacaggtgtgtgccaccacacccagctaatttttgtatttttagtggagatggggtttcaccatgttgaccaggatggtctcaatctcttgacctcgtgatccgcccaccccggccaacgcaggttttgagcaaaaaataaataaataaataaataaaaaccgttttgctgattaagagagcagttgggaggttattacaataatctagactagagacgaggctgttttgaatgttttggagttttttaccaatataattaggtgaagaatgatacctctttggcattttaatttgcatttctttgattatgaatgaggtcaaacatcttctcatatgcataaaatcatttatatttccttttctgtggtctgtaagtgtataacctgtgctagtttttgtgctgattcagtagtctttttcttttttttgagatggagtctcgctttgtcactcaggctggagttccgtggcatgatctcggctcactgcaacttctgtctcttgggatcaagcagttctgcctcagcctcctgagtagctgggattacaggcacccaccaccacgcctggctaatttttgtatttttagtagaaatggggtttcaccatgttgtccagactggtcttgaactcctggcctcaggtgatccagccgcctcggcctcccaaagtgttgggattacaagcatgagccaccgtgcctggcctcagtggtctttttcttactgacttgtcctcagtattttt

SEQ ID NO: 46180 - DNA, 1031 bp, Homo sapiens
taaattttcaagatacgtatttggaaacttgagaatgtagatactgctaattactattgatttagttattctgtcttccttttgaaaaatctttttatttagaaataattagagattcactgaaagttgtaaaaatggcacacagaagcccatgtactctgcactcagtctcccccattggttacattttacagacttgtaggacaatatttcaaaccagtatactgacattggtaaatgtatgtgttgtagttctgtttcattttgtcacatgtagattcatgcaagcactgcagcaaacaagatgcagaactcggccaggcatggtgactcatgcctataatcttagctcttttgaaaggcccaggtgggacagatagcttgagaccaggagtgtgagaccagcctgggcaacatagtgagatcctatctctacaaaaataaaaataaattagccagacatggtggtacatgtgtgttgtcctggctacttgggaggctgaggtgggagggttgcttgataccaggaatttgaggctactacgagccatgatcacaccactgcactccagcctgggcaacagagtgagactgtctccaaaaaaaaaaaaaaaagatgcagaattattctgtcaccacaaagctcttccttatgttgtcccttaactactcttctcttcacctctgctaccctactatctctagcccttggcaaccatgaatgtgttctccatctctatgcttttgtcatttcaagaatattacataaatggaatcatagtatgtgactttttgaatagtattctatgtttttgagtagtgttctgtgtaccacagtttgttgaacccttcacctattgagggatgttttgtttttcttcagtttttagctatacatataaagctgctgtgaatatctatgtatgggttttgtatggacataaatgtttatttctttgggataaatacacaggagtgtgatacctcagttgtgtagtaaatatatgtttagtgttctaggaaactgctac

SEQ ID NO: 46181 - DNA, 1081 bp, Homo sapiens
tttgagctatgtaactgggatatctcttggggagatgtacaggcatagttggatgtagggctttagtgttgttcttcctcattttctatttctctctttctagctcttgtttctttttttctctactttgttttcaaataagccaattcccatttgctatacttcatacactgtatagtctgtagacttgtagtgaagaaggtgaagttttttttttgatagtcattagaaaagtccccacaaacacttggagtaaactgtccatcctggaattaatcattcaaacttggttgggggtagggacatactttactttagccaagcctgggttatatgtccaacctggagaaacaggttagccccatccaaactactccgcagggtacaattattttatggagcggttcctcaaaagcaaagatttttagagaaaattatttccattacagtcagaacatttggttcagttcctagttctgatgcttttagttaagtgatcttgcacaaggctctggacctccattaatttcctcatttgcaaaacagagatagtaatagcaaatgaaggactttcgtgaggtcatcttcattcagcagacatttattgcatgcctactcattgccacatgttgtgtttgagtagagactttgaggaaagacaggcagtctaatagacttaagtttagtagaagaggaaaacgaaagaacagaatgatagatgtgccccgatggtgctatggaaacattaggaaggaactaagcaccccatccagattggggcaccaaagaagccttccaggagggatgaactgaatcttcaaggttaactaggatttagccaggtgaggagggcaaggaaaagtaatacagattttggcaacaaaggctaggaatcctgagaagtttagttcattcatggacttagaaacagttcggtaagtctggaatgagaagagtgaagtctaggcagggccccgatttgaatgtcctgaattgtccatgccacgaggtttggattttattctgaaggtgattgggagtcattgaaggattttaagctgagggataaaataattggata

SEQ ID NO: 46182 - DNA, 1044 bp, Homo sapiens
aatcgtttgtcaattttgtttatcttctcaaacaccaactttttgttctagtgatctcgtataattttttcatttcaaattcatttatttctgctctgatctttattatttcttttcttctactaattttgagtttagtttgctcttatttttctagttctttaaggtgcattgttagattgtttgtttgaaatttttccacttttttgatgtaggtgtgtgtagctataagcctccctctgagtactgcttttgctgtatcccataggctttggtttaccattcgtttcaaggaatttttcaattcccttcttaatttcttcattgaaatggtcattcaggagcatattgtttaattctcatgtgtttgtgtagtttccaaaattcctcttgttattgatttgtagttttattccattgtggtcagtgaagatgcttgatattattttaggttttctttcttttttctttttctctctctctctctttttttttttttaatgttttaagactcgttttgtgacctaacatggtttatccttgagaatgatccatgtgtcgaggagaaaaatgtgtattctgcagccattggatgaaatgtgtaaatatctactagatccattttgtctatagtgcagaataactctgatgtttctttgttgattttctttctgggagatctgtgcaatgctgaaagcggggtgttgaagtctccagctgttattgtattggggtctgtctttctctttaggtctaataatatttgctttatgtatctgagtgctccagtgttggttgcatatatatttacaattattatatcctcttgctgaattgacccctttatcattatataatgaccttttttgtctctccttacagtttttgtcttgaaatctatactactttttctgatatgagtatagctgtgtctgctcttttttggtttccgttgccatggaatatgtttctccatccctctcttttctgtctgtgtgtgtcttcataggtggggtgtgtttagatcattggatcttgtttgtt

SEQ ID NO: 46183 - DNA, 1034 bp, Homo sapiens
atgctattagcaattttcatagtataaaattttcacactatgtttgtatgcttctaatatgttttgcattgtaacagatgaatatgcagcattactgaattatgaaaattacacagtggtggtataaatgctatttgtgttatgcaaaattggctgatttttatcagactttaatattttctcattttaaccaattattctgcttttgctttttgatattaaattggctgtgctgtctgttgcacttgaattcatgcaatggtatgcaaaggccaaaactgattatcgtctcaggttaccttgtattttcttataacgactgactttccaaattgaacaggatgttttataaaatttgtgtgacatgcaatggaataggtaaaatgcaggttttctcaaaactgtcttgacttttgtcttttttgtacttttcccaaaagtaataattactagttttttttttttttttttttttttttgcaagccacttacaatggcttaattgtagaatctactgtcagctgtcttggccctacaattggttgcttagattccttctttttacttaggtcttaccaggtgcttacgtagttttcttataaaatagtttcttaatcataattatcacaatcaagccattgtacaaattattgggcctgttaagagtattagaaatgtaaaagaatattatttttaatattaaactttggcctaggaagtttgtagatgaagttcctaaagccagccattttcattcattttaagtattcttgtggctacaattgaactgtatttattgtgactatagtttaaatgagcaggaagtaatccacttgcatgttttatgcttagattttaaaatatattttggcattttttatgggaagtgaaagaaaaaagtaattaaatgtgtctataaatgagagaaaggaaaaatataggttaaaataatgtggtattagaaaaatattctgaagctataatagtaccttgtatttgcgatatagtttagaaaaccatatcatacatttaca

SEQ ID NO: 46184 - DNA, 1082 bp, Homo sapiens
ataaagaagacctaaataagtggaaagacattttgtgttcatgaattggaagactttacattgccgttaggatggcaatactgtccaaagcaatctccagattcaatgcaatctctatcaaaattccattggccttttttttttttttttgcaaaagttggaaagctgatcctcatattcatatggaattgcaacagatccaaatagccaaaaccatcttgaaaaaggaagaataaagccagaggactcatatttcccaattaagaaacttactgcaaagctacaatgatcaaaatagtgtggtactggcataaggatagatgtatagactaatagaattgagagtccagaattaatatatatgtaggcaattgatttttaacaaacatgccaggatgattcagtggggaaagaataatctcttcaaatggtttggggacccctggagatgcacatgcaaaacaataaagttggacccctacttcatgccatgtataaaaattaactcataatggaccaatggccaaaatacaagaacgaaaacttacaactcaacagcaaaaaaaagctcaactaaaaaatgggcaaaggacttggaatagacagttactctgagaagataaacacatcattaatactcaacatcattagtgatcagggagatgcaaatgaaaaccacagtaagataccacttctcacctactaggatggccagaatcaaaagacgggcagtaactggttttgaggacgatgtggagaaactggaaccctcgtatgttgctggtgggaatgttaaatggttcagcctctgtggaaaaaagagtttgacaattcctcaaaggaacacatagacttgtcatatgacccagcaattccactcctaggtatataccctgaagaattgaaagcaggtactcaaacaaatatatgaccacacatgttcatagcattactatttgcaatagctaaatggtggaaacaacccaaatgtccatcagtggatgaatgagtaaacaaattgcagtagtctgtattccataaattgtctagcagtaaagaaatgaagtacagatacatgctac

SEQ ID NO: 46185 - DNA, 1023 bp, Homo sapiens
gaagtatttgggggaatgaaccactttctcaagcccagattggcttcaaggtcctcctgcttcttgccacaagcaccaggaactctattcttttctcttaaaagttgctgctacttagtagtagttacttttctttccaagactgggtgtggagctctgtaatctgctcatgtctcttgtagccatagaatatagcctacagttaggggataagaaaaatagtaaacataaggaggttaaaaatgtgtaagaaagacttctactttcccctatgctggtataatgggaactggatttattttatatgtagccagcttccaagatggcccccaatgatcccggcatcccgatatttacaccatggtgtaatccccatacacactgtattgaggtttatctgtggaaccaatagaatgtaacagaagtgatggatcatttcttaggataggttatttataatacaaatgtggctccacctccttcccctcactacccccaaccttggattactcactctgagaatagttagctgccatgttgtgaatggcccgatggggaggcccatgctgtgggaaactgaggcctcctgccaacagccaacaaggaactgaggcctctctagccaacagcatgtgaacgagccttcttggaagcagatgtctcagctttagtcaagcttccagtcctaaacatctgtcctgctgacatcttgactgcaacctcatgagagatcctgagccagaactacccatctaagctgttccctgattgccaaccctcagaaactgtgtgaaaaaaagaaatgcttgttttgtttgtttttaaattttttttagctttttttgagttgaagtcttggtctgtcacccaggctagagtgcagtggtacgatctcagctcactgcaacctctgtctcccaggttcaggtgattctcctgcctcagcctcctgagtagctgggactacagacgtgcaccaccgcacctggctaattttttgtatttttagtagagatggggttt

SEQ ID NO: 46186 - DNA, 1021 bp, Homo sapiens
tgggaggggattcttatgctttgaataatccattgagcagggagaatagggttaaaaaaaaaacaagcctaaccaaaataggtatgcaaaatagacaactcacctcagcatatagatgggctaaggaattttcttatgattcagtgctagaatcttccttagaaaacagatctgcatacagttctatgcaccaataaatgaatgattgaggcctcagagttctatatcataaaacagacatgataattgttcttgggaaagatagaaagtatcttttgaatgtgtctctttgtgagaccataaaaataatttcagtgaagtagccaactaaagtccattagttgtatggtccatttgttttctgaggtcagtatcaggcatatacaacttagtttcataaatgatttgctttccacagcggggaggacagatctgtggctggctggaaccattctccttaaagtgttagaaaattgaatggttggttataaactgtaggttgaatatcccttattcgaaatggttgggaccagaagtgttttgggtttcaatttgtttttctcgaatatttgcatatacataatgagctatcttggggatgggagccaagtctaaacatgaaatttatgtatgtttcacatataccttaaacacatattctgagggtaattttatacaaaacttcatttattttttgagacagaatctcactctgtcacttaggctggagtgcagtggtatgatcatggctcattgcagcctcaacttcccgggctcaggtgatcctcccacctcagtgtcccgagtaactgggactacagacaacgtaccaccatgcctagctaatttttgtatattttgttggggggtatagatgggatttcactatgttgcccagattggtctcaaattcctggactcaagcaatctgcccgcctcagcctcccaaagtgctgggattgcaggcatgagccaccacactggacctatacagcattttaaataattttttgcatgaaac

SEQ ID NO: 46187 - DNA, 1151 bp, Homo sapiens
gcttcccaagtagctgagattacaggcatgtgcaaccacacccagctaattttgtatttttagtagagatggggtttctgtgtgttgatgagtctggtcttgaactcctgacctcaggtgatctgcccacctgggcatcccaaagttctgggattacaggcgtgagccaccacgcccagcactacaccagatttttaatggggcaaacaaaatcatagccatcataaaagtaaaatgtaaaattactttgacattcggagactctaccattgtattacagaaaagaagttgttaataatctttagatcaaattagaactatttactgggagcccaggcatggtggcctacgcctgtaatcccagcactttgggaggcagaggtgggcagatcacttgaggtcaggagttcaagactagcttggtcaacatggtgaaacttcgtctctactaaaagtacaaaaattagatgggcgtggtggcttgcagctaattccactggaggctgatgcatgagaatcacttgaaccctggtggcgaaggttgaagtgagctgagatcacgctactctactccagcctgggtgacagtgatggaatgagactctatctccaaaggaaaaaaaaaaaagaactagttactgggaagtctgttgtttgaaatagaagttttgatgccttgtttgttcatttagttctggtagtattcatggccgggaggaggcgggagtcacagtaaggggtacctcattaaattagaaagctctctattctaatcattatcccttaaaaaaaaaaaagtgagattctgctgattgtagttgtattaataaagtactctctaattttaaatttctattgtatttgttgggatggtaatgataattcagagctgctagtatttctaaactaaccttaatgcttccctgaagagttatttgaaattaaaaacaaaaagtctgtattcttcaatgtagtttttgaagcaagtaaacaaaaaccatcccctgtgatttttgtatacataagagtattgcctttggggttttttatgtgtgtgggtttttttttttttttaatgttaacctgataataaattagaactagcaaaaactaattgaactatgaccttctccccgtatcttctatccagt

SEQ ID NO: 46188 - DNA, 1050 bp, Homo sapiens
gttttagagacttttagctaatttttgatgaagacgttttcagtattttagaaatagggaaaatgtttattttagagggaaggggacagtgtctctttgattagaagccattttgttgctaagagtggtgctgaaagtacaattgccttgattgtaaagctttaaaagtactgaggcaaaagagtaattaccttcctcttcatcctcattcccccctcctattcatgcctccttaccacggacccttttctgttgctcaaaattcattctttgcagagatccagaacctatgttcgtgatgtcctcatcttgtctttttttcctggtctgattttccatcctctttcatgggtgatgttcaagctttccaaagtctttgaataacagtttttattgccttaaattgacaagcgtcttggacacctgacaagaaggttaacagtgaaccctattcactgaagccttgggggtcaaggggaaggaagatagaggattagactagtaggctaaaagaacatagagtataaagggaagagaatgattaccatccaagacaatccaagtttagtttcgttgtgtccaataattttgtctttgcactatagctgcatggtactcgttattacagagtatcagggaacacttatggatgcttgctgtgtatgagaggactaaaaagggagaattgaatggaaagctatgctaagattccaatctccagtcatttttgtcaaataccgtttatggtagactacctatattgtatgttatacataaatatctgatttagtttccattacaacaataaactgattgcttgtatgttcagtttatgtagttacacattaagtactgttgtctgcattaaatactatcttataataattgtaatcagagaacatattttcctcatactgtccctggaaaaaccttggtatccatattgtagattggcttttataattatattctgttttttactgctcgtttatatacactgtgttttgacctagcttgacaccatgttaggttatagactttctaactacc

SEQ ID NO: 46189 - DNA, 1112 bp, Homo sapiens
gaacaaacatcttctctccagaagattgtcatcacttttgttgctttctggctggccagcatcatttctgactgtaaatgtgtggagacaacaggatctcagtctgttttcatcatcagcctatttgtctaccttcaactaagttcaatgatggtatgggaaggaagaatatttcacaccaattcaaaagcttttgactagggagatattgggggaaggcttactctgggagcttacagatttttcaccagaggaaaataatatttctgtaagcatgaaaccaagtcaaaaatgtgttctctaaactctttccttaatatttaattctaaatcaaatatcaaacttaaacattatgttgaatttcttctttaatatttctgtaagttacagcatttgtaataaattctccctattgtcctatttcaaattcattttatcctccttccctgattttatttgtctgttcttctaacattggtgttatccaggttctttattcagcactgtgttactcttctcactcttctttcaccttcagtcaccttaagcagctaactcccagatctacagctctgggaacacttctttttttaaggcttaatttcacacccttgttgaaatacttgagtacctccagacatctcaaatttaacacaactaaacttgatctttccaataacaaagaacattttgtttttctttatcctgggttactgtccacctgtctatttttgtgctcagtttttctcttttccacactcctccctcctacatttgaaaggtagcccattcttttcttaatgtcagtgctgtagtctggttttttgtttgtttgtttttgttttgttttttttgagacagcgtctcgctttgtcacccaggttggagtgcagtggtgcaatcttggctcactgcaactgctgccacctgggctcaagtgatcctaccatatcagcctccgaagcagctgggactacaggtgcatgccaccacacccagctaattttttttttttttttttttttttttttttttgcagttgcaagatttaatagagtgaaaacagagctcccatacaaagggaggggacccaaagggggttgctgttgcc

SEQ ID NO: 46190 - DNA, 1035 bp, Homo sapiens
atcttacaattgatggcgtgtcttagattcagaggagagtagtatatttgtggttaattttcccatacctcaccaattttgggacagacaagggtaatatttggctatgaaccactggaacctaatttctcatgtcctcttctcccttttcccccatggtttctgggtgtttctgctgctttacttacagtacttaacattctgcagttattttccattttgtagttatctcaatctgtagctgccattttccctaccacttgggaaagcaggccagtatggccatgatggttttataagccagtggtgtcatacctttagcaagtgttctgtcctaaatactagtgtttcttaacaaatttgttaatactttgtcttcatttataggtgaatgcagcctcatgtgattatagctttctggattgtgtgacctctaaaaggtcatactagttcttcatatttacaaacaaaatgtgaattttcatttatctttacatgcagctctttaaatcattttctttcagctcttccatgtctacatttgggaaacttagaactagttttttagaatcacgacttcaggatttttcctgccctgtctaatgaactgttgttctgggaagaatgcaactaagggtgaattctgtttttgtgaatctgcagaacagatactacacattgcttgacctttcactgtttgtatctttttaaaaaatgttttatttgtgaatgtagtatgtactcatttaaccccccaaatgctggcccttctctctcactatttcaggggatgtgaatatgcaaggcagtttattgcctagtagctaagaaggctgggggctggcatgaattgtctttttttaatgtaataattccaccccctcagtaaaaaagcatggtccagtgaatgtcttagattgtgacttagtgatattgatgaggaagtagatgacagtcccttctgggatggaggggaggatggagcagtggtcctgtattatctatcagtgcgtaacaaacccttaaacttagcga

SEQ ID NO: 46191 - DNA, 1029 bp, Homo sapiens
tataaacaacagaaatttaatccttacagttctggaggctgggaagtccaagatccagggtgccagcagattcagtagtccagaatggcaccttctgactgtatcttcacatggcagcaaggcaaattagctctctgccttcttataggcactaatcccattcaccagttttccacccttatgatctagttacctcgcaaaggctccacctcttaattccaatactttgggaattagatttcagcatatgaattttggagggacataaatgttcagaccatagaatatcccttacagcacctaacttacagtcttaaagtttgcattttgcttacattttgaagaaatacatgacatgacataccctagtatactaatacatagtttacatagttctttcgtgagatttgtagttcaatttgttggtcaagtcaaacttcccaccttttgaaggtggcgttatcagtcattttattcagcgtatctaatactttgtgctagaccctggctgtagatttttcaccacatgctttatgacatttatgtaactcttaatttatatatatcagaatctttgaaggtagctaagcctgctgaaacctggaaggtaaaaaaatttgaattgtatttttacaagaaaaaaaatttattcttccaaagtaaaataaaaatggttggcttaaatgaaacattaactctgtcaggcttagtgctaattactgcttttcatctatggcatgaaatgcagggatcaatgagagaaagatacagaactgtattttatttcattctgagtcaaggttttcagaaaacaaatatttcatttggagtgttcatttcctgaatactagacagataacttctgaactagcttgagaaattaaaatttgattctagggtagtaaactctttgcctcttggagccaagcaggtttaaggtacatgtacatacattggattcatggtagacagcatacccaccctaaagagggcagctctatttaaagggaatagtcattgttcatttct

SEQ ID NO: 46192 - DNA, 1024 bp, Homo sapiens
taatagagacagggtttcaccatgttggccaggctggtctcaaatcctgacctcacatgatctgcccgtcttggcctcccaaagtgctaggattacaggcatgagccactgcacctggccttcaggtaattttaatgtgcagccaaagttgtagactcgtcttcactacaatgcaggaatttaggtgtgccaattatgtaaattgggtaagttgtaatacatctccttgtacctgttttagagttcaggagacatttcaaagtttaatcctcttgaaagatttaagaatcaaattcgagattggaaagatctatatttgttttgttcctacataattatagttctgtcaaagaccacccatttcctgtacatatctgagcacttattgactgtcctatcagctttagtaaaatgttttgtttgatggccattttatacaacaaacaaaatagctgtcatgagagctttttgtggagcagttttagtgaactgagtacattaagatgtggctatggggcggttccataggctcagttatgagctcagtgattcttctttaatgctggtagagtccacctaaacaaaatttaaaaatattttattatatcatgaatcgttggagttgaatatgcataaaaatctcatttaaaacgtaatctgggttggtcacgatggctcatgcctgggatctcagcactttgggaggccaaggtgggaggattgcttggagccaggagttgagaccatcctgagcaatggcaggactccatctctacaaaaaataacaacagaagtaatcttaggggcctgtatcaaaccatatcagggccccgtaccaagaatagtcctttctaggtacttggaatgatattcttgtttttaagtctttttgcccttcattggggtcattattattgctagtccttgtatctctcattctacaacctatgctgaacttatcagttcactaaaattcttgagaatcaagttgtttgacgctggcccctgggcttatatctctctt

SEQ ID NO: 46193 - DNA, 1050 bp, Homo sapiens
tactgtcacaagcattgctacaataaacactgtttaactgtgttttaaaagtcaagatgcccttcattaaaatacctctagtaaaatattatacccatttaaattcatttattatgtttaaatgacacatataattgtacatatttatagagaacagtgtgatattttgatacatgtatacaatgtgtaatgatcaaatcagggcaattaggaaatccatcacttcaaacgtttatcatttctttatgttggaaacgttcccggtcccctcttgtagctattcgaaaatgcataatgaattgttaactatagtcaccctgtagtgctatagaacactagaatgtatttctcctacctagctgtaattttgcctcagttaacctcctctggctatcctcatctccctcctaactttcctcacctctgttaaccactattttactctctacttctatgagattaactttttcagcttccgcaaaagaatgaaaccatgtggtatttacctttctgtgcttggcttattttcaaatatatacattctaaaactcttaatttaaaatgttttcctgcagttgaaaagactgttggtacccacctcagcatgcatattcgtgacatctctatcctaatggcacagaaaaaaacttaaagctttccaatagggtatggaatacattctgtggttgggcagatcgctccaagtgtaatattttagaataaaatattcacacatcttttgaataacagctttgggtctttgatagggaaaacttggtggaaggtctagactagtaggcatgcaagggggactaatctttttcacactcagtgaatatctcagtgatttaaggtagtggagtgtgggaagaacacatgctttggggtcaggcaaagtcttgactccaacttgggcaagtaaattaacttccctgatccttggtgtcttcatcaataactttaggatactgatagggaaatcaaaaggattaggtaggttcatgtatgagctggatcttatgtaatgcctgatgcatagtgatccttcca

SEQ ID NO: 46194 - DNA, 1033 bp, Homo sapiens
ctgacttgatctaaaatggtcaaactcatagaaacatagagtaaaatggtggtcgccagggactgtagggtggggaaaatggagggttgctgttcaacagatacgaagtttcagttactcaagatgaatacattctatagatctgcactacaacactgtgcctatagttaacaatactgcattttgcatttaagaatttgtcaaggtcaggtgctatggtacatgcctgtaatactagcactttggtatgctgaggcagaaggatctcttgagcccaggagttcaagaccaatctctgcaacatagtgagacccccgtctctgcaaaaaataagaaaattagccggacacggtggcgcacacctgtcctagttacttgggagactgaggtgagaggatggcttgagccccagaggtcgagactgtagtgagctgtgattgtgccactgcactccagcttgagtgtcacagcaagaccctgtctcaaaaaaaacaaaaaaagaatttgttaagaaggtaggtctcatgttaagtgttcttacaacaataaataaaatactgttcggatgacacaatcaacaaattaaaaataaatatattcaattaaccttctatattttacttaccttcactgttttagtccttttcccagattccttgctattatataatgaatacttccgattacagctttgtaacttgtttttggaggaagcagttaaaggaatgacattccccttataatagctctgattttagagttctacagtcttttaaaacccttaaaaattattcacaatagcaaagacttggaaccaacccaaatgcccaacaatgatagactggattaagaaaatgtggcacatatacaccatggaatactatgcagccataaaaaatgatgagttcatgtcctttgtagggacatggatgaaattggaactcatcattctcagtaaactttcccaaggacaaaaaaccaaacaccacatgttctcactaatagatgggaattgaacaatgagaacacatgg

SEQ ID NO: 46195 - DNA, 1025 bp, Homo sapiens
tgttctgaatgggcataaagtacctggttgacagcgctgtaaatatgtcagtttgtgactggattttgttggaggccccagctctactatataactaaattccatgctcaaaagtagaaggcaaaatttattgttttaaatgtgtgcattattttataatcttttaagaaggccagggatggttctcttcagttttggaaggttaaaaatcgtctccttttaaagatactattcattaaacacactctcttggtttagagtattcattatacctagtaatcaaaatatatatagcacagtagaggctgtctgtgtacatgtcgtagaaacccaaataagtctccagaatgattttatgaataatctgccttcagttttaaaataaacttaaaaaaaaacttaaaacttggcatcatcctgggtggtactgtggttttcttcttctaccaaaaaaaaaaatctaatatgctacagttaggaagaaaaaccttaaaaatcactactgaatgtctactctatgctaatagattttctactgtctcatatgtaactatttcattagaaagttctcaatcataaaaagggagtctaaagcaagtttattgctgtaacttatttcatacaaaggttttggccaaaataggaatatcactaaaaaattagcttgttttctgctgttctcactaaggagttagcttgtttttgtttgcactctccccatcgccacatgtccatccctgtacaccctgtatcagattcagggaaaatctgattccgagtttttttgtggtgacattaaactggaggaggaaggaagcagtaattccatgtgagacgtatcacttattttattagtgatttgtgtattacatgttgctgaaatagaaaccccctgaatattaacaataagttagtatcatactcatgaaatccaagtctaggtgcccagaattttttgtgctaattctgatctgtactttgttttttcacttgtcataaaactattgaaaatatctgggaaaaca

SEQ ID NO: 46196 - DNA, 1048 bp, Homo sapiens
tgaacaagaaatcatgaagtaattctatttacaacagctacaaataaaattaaatacctagcaatgaacaaaaaagtgaaacatttctataatgaatactataaaacactgatgcagtcaattgcagaggacacaaaaatatggaaggatattccatgttcatgaatttgaagaatcaatattggtaaaatgtgcatactacccaaagccatataaaaagtcttgccatataaagaaatcaaatcgcaatggatgaaagacttaaatctaagatctcaaactatgaaacaactaaaagaaaacattgtagaaactctccaggacattggactgagcaaagatttctgaggaataccccacaattacagtcaacaaaagcaaatatagacaaatgggttcatattaagttaaaaagtttctgcacagcaaaggaaacaatcaacaaagtgaagagacagcccacagaatgagagaaaatatttgcaaactatctacttgacaagggattaataatgagaatatataagcagctcagacaactgtataggaaaaaatcaaataatctgattaaaatgagcaaacgatctgaatagacatttcccagaagaaaacatacaaatgacaaacaggcatatgaaaaggtgctcaacaccactgatcatcagagaaattcaaatcaaaaagacaatgagatatgatgtcaccccagtaaaaatgttttctttaatcaagaagacaggcaataacaaatgctggtgaggatgtggggaaaaggaaaccttcgtacactgttggtgggaatgtaaattagtacaaccactatggagaacagtttggaagttcctcaaaaaactaaaaatcaaggtattataaaattcagcaatcccactgctgggtatataccccaaagaaaggaaaccagtatattgaagagatatctgcactcccatgtttattgcagcactattcataataaccaagatttggaagcaacctaagtgtgcatcaacagacaaatatataaagaaaatgtagtacatatacacaa

SEQ ID NO: 46197 - DNA, 1027 bp, Homo sapiens
ttagagcttcaaacaggaacaactttgcctaaagacaactttgttggggtaaatttatattttcccacgtatacgtatatcacactctaaagacatgtacactacctgaattgaataaaaggaataaaaggccgtgttttttttttttttttttttttttgagacggagtcttgctctgtcacccaggctggagtgcagtggtgcaatctcggctcaccgcaacctctgcctcctgggttcaagcaattctcctgcctcagcctcctgagtagctgggatcacaggcccgtttcaccatgcccagctaaatttttttgaattaatttttatttttatttttatttttagtagagacgcagttttaacacgttatccaggctggtcttgaacttctgacctcaggtgatcctcctgtctcaggctcccaagtgctgggattattaagaaagctctttcctttcaaatgtctacttttatatgtagtgaaaaaaaatatctacttagtcactggttagcctgcgtttgcatttaggaaacaatctcatatacatctgtaagtctctacctcctcattttggtgagactacaagaaatgaaattcttcaacctgcaggcaaaagctctgctcagaacatgaaccaaaataattcagcatatcagtgcaaaatgacctgcatgctctctctaacaggtaaagtgtggcactgagatctaccatctggtgaggttgctgtggctccttggtcttgttttaacttccagttttgcagtcctccatacctgttttcccattacctttcccccacacctcgaaatgtttgtctgaaccttgagattgtgccaccttctggagttggaggcctgccctaaatccatggtttgcactgagcagtgctcatcatctctgtatcctctatcatttcactctccccctccccctccctctcttaggatgcattatcctattgcctgcctgtcctacaaatcactggtttggataccactttcactcaaagagacttgcct

SEQ ID NO: 46198 - DNA, 1078 bp, Homo sapiens
ttgttgttgctgatatcaaaagacactactttttaacaacaacaatagaaaagtaaaataatttttaagaattatcttcaacttttattcaaaagagaaatgttcttgggcacaaacctcacttgtgagaagtttaagaatttgaacttgggacttttataattctctgcagagaggatattgaatttgacctagtggcagaaccaagaataagagacattgagaattatggctgtgtatgggtccacaaacgatttctctatgctcttcttatggctgtaagttaggtcaagttagatatatttcatgtacagtccaaaaaattttgactctataagctagtggcataaagttttatttctgactgtttcaaaacacagaccaatttctaatttctagcatttataatttataattttagcattacataccttttcattaactcatttttttaacccttcgacagaaatgtgtaaagtataaccattatttaaaaatgttttgtgattgaaagtatagccaactagttaacatttaaattcattagagaactcaaatatagctgagaataattgtattttctatgaattataatgaagacactagctgtgatgagtaaaaattgatgttttcttcctttcctgcttgaaattctatctaattcagggttttgaacagccagtctagttatattaaacaaatacagttaaaaagaggctattttttcaaacaaaaagagagaagcctgagatatataaatggtaattgttctctatagtcaatttttggctttccagaacacaatccacatactatactaaggtatggtaggtacatagctatagtacagcccctatactataggtaggatatactgtaacctgcctcctttttttctcttttcacaattccaaaaagatctctgcattaacaaaatctattaacagtgctttatccaaataatggtggggttttcttttctacaataaagaatccagagttagacaacttagtgttaatagagtatcttcatggtgtcatcagtgtcataggttcctatatatttcccgttaccatc

SEQ ID NO: 46199 - DNA, 1072 bp, Homo sapiens
caagtcattttacaagtatgtgcctcagtttcctttgaatgggtcaataagaacacctgccttattgagttgtggtgaggacaaaaaagaatgaattagcatatttaaaacacttaaaacttatattggcaattacaataatttattttgtgtcaacttgactaggctgtggtgcctagttgtttggcaaaacagtaatttcgatgttgctgtgaagatatatggggatgcaattcacatttaaaatcagtagactttaggtaaagcagattatctttcatgatgggatgggtctcattcaatcaaagaccttaagagcaaagaatgaggttttcccaagaaggaattctgacttaaggttttgtcatagaaatcttccctaagttcctggccatctggcctgccctgtagacttcagattcacaagtccccacaattgtgtgagccaatttcttaaaataaatctctctctctctttatatgtcatcaatctatctatatttatatatgtattctactggttctgtttttctgaaaggcttgtctaatatagcagcttagtaagccagatgttctctgtcctcttttaggtctatattagcacagcatagtgggtaatatgagactgtataaatatttggggcataattcaacttgcatgttttcttttttgagttttttggatatgactcttacatattagttttacaaaattgtttgtggtttgaaactaaatattctctaaaaaccatacaggatatatttttctgtatactaagaggttgaaatttacttttgaactactgtagttcagataaagtaagaattaataaagtatttaagaagtaatggtagttaaattaatatgcccgacataaaacgcatcctggacaaaactgctgaaatttatagaaagatgtaaagatataccatgtggccactagagggcatgcaacatctgccacatttttcttcaagaccaaggacttttgcctgtagacgaaagtagttatggttcagtctaagaaataagaaaatggagctccatttatatttcaatcattataattga

SEQ ID NO: 46200 - DNA, 1091 bp, Homo sapiens
gtcagagggaaggtctagggctgaaggctgttgttcagattcttttgtcctatggggtgtttccttgatgtagtcctcccacactttttctatagcagtggcttcttgagaactgagctgtagtgattattatctctcttctggatctagccacccaacaagtctaccaggctctgggctgctactggaggttgtctgcacagagtcttgtgatggcaaccatctgtggttctctcagccatagataccagcacctgttccagtggaggtggcaggggggtgaaatggactctgtgagagtcttaactttggtggcttaatgcagtatttttgcactggttgacctcctgccagcaggtggtgctttccagagagcatcagctgtggtagtatggagaggaacaggctgtaggtggggccctagaactcccaagagtatatgccctttgtcttcagttaccagggtgggtagtgaaggaccactgggtgggggcaggactaggcgtatctgagctcagactctccttgggtgggtcttgctgcagctgctgtggggaatgaggatgaggttcccagatcaatggaattatgatcctaggaggattgtggctgtctctgctgtttcattcaggttgtcagggaagtgtgggaaagccggcagtcacaggcctcaccctgctcccacacagtccaaagggccggactcactcccaccgtgcctccctccaacagcaccaagtctgtttccaggcagtgggcatgcatggctgagaacttaccccaggctacccacctcccagctgtgaaagcaaatatagctttccttcttcccctagtctgcacaccggattcacaccctcccccaagttctggccaggaggcttcttgatcagttcaaattgttacaaagtttagctgaggatttccttctccctgtggcctttttcccagtgcctctggccacccctccagaaggatacctgtgaggccaggcaggaatggcctgcttggggatccagcgagctcacagagcctttcccgctgcttcctctacctttatttttcgtttggctttccaaattgactcagct

SEQ ID NO: 46201 - DNA, 1050 bp, Homo sapiens
cctatcatatggcctatcttggagaaagttccaggtacttttgaatataatgtatatcgtgcagttttttgatggaatgttctgtagatatctcttcagtccctttgttccaaggtataatttaaatccattgtttctttgttgactttctgtcttgataagctgtctagtgatgttagtggagtattaaagtcccccactattattttgatgctgtctatctcatttcttaggtttattaatacttgtttcataaatttgggagctccagtgttaggtgcatatatgtttaggattgtgatattttcctgttggacaaggcctttaccattatctaatgtccctctttgtcttttttaactgctgttgctttaaagtttgttttgtctcatataagaacagctacccctgcccatttttggtgtctatttgcatgaaatatctttttccacccctttaccttaagtttgtgtgagtccttatgtgataggtgagtctcttgaaagtagcagatagttcgttggtgaattcttatccattctgtagtcctgtatctttaaagtggagaatttaggccatttacattcaatgttagtattgagatgtgaggtacccttccatgttgcctgtgtaacttgattttttgttttatggttttattttttaaattgtatttttttgtaggtcctgtgagatttatgctttaaagagattctgtttcgatgtgtttccaggatttgtttaaagattaggcctccttttagcagttcttttagtggtggcttggtagtggcgaattgtctcagcatctgtttgtctgaaaaagactgtattgtcccttcatatatgaagcatagttttgctggatacaaaattcctggctgataattgttttgtttgaggaggctgaagatagggccataatcccttctagcttgtaaggtctgtgctgagaaatctgctgttaatctgataggtttccctttataagttacctggtgctttttcctcacaactcgtaagttttttttccttcttcttaactttaga

SEQ ID NO: 46202 - DNA, 1103 bp, Homo sapiens
ctatttaagtctactgccttcttttagctctttgtcaatggttgcctttagctgtttgaacatatttaagacagttgatttaagtctttgtctaggaagtccagtgtctgtgtttcctcagagacagcttttgttaatttctcttttttttcacgtgactgggtcatactttttttttcttggcttgcctcataatgttttgttaaaaactggatgttttaaatattgtgatatagtaactctaaatcagattctcccatgttcaagatttttcatttgcttgctgtgaggttatagtgaattttgtaaactacttctgaaaatattgcgttctttgtgatgtgtggtctctgatatctttttttttttttttttgagatggtctctgatatctttcgcctttaccttcattgtcagccattgatttgacagagatttctttagtgtctagagctgaaaacaagcaaacaaaaaacaagcacagaagaagaaggagaggtaaggaaagaaaagaaaattttctccagtcattgcttatctctgatcatccaaagcactacacttctaagcctttcctcccaggctttcaatatgaccattgtttgccacaaatgttattttatgcaccacacagagtaagtcattcatttttctttcagtgtttttgaagaacatgtttttaggcacctctttgccctgagacagttttgagttcggtaaaacaaatgtaagttccttcattgcatcaatatttcaggaatccacagacaagtaagccaaaacagacaaacacaattccttgggaacaactttcactctgcgacttttaaaacctggtaactgcatcaagaatgtgggctgctattttaaagactgtggcatcatggggaatttggtggagtacaaataagttaattgcccaaatccttttctattttgtgttagtgtcctttcttcaagttaaacattcacttgtttgctataaacctttgactacctttcagagttcctataagattgattctgacagatttgccaatttttcagtgtttctaggaacggactaacccctggtttgtccctactgtgtcatttttgcttac

SEQ ID NO: 46203 - DNA, 1048 bp, Homo sapiens
atatcaggtactgggctaagatcagtatccattgccttctgtcatctattcttactttgctccaatctggtttccacactgcaaatctcagttcatgctaaatgtggagtaaagacagatgttattgaaatattgcctcattcagtcacctccatcacttcttatggttctgaaggtaaaggataaaattgttaagatgggcaacaagacccccaaagccttggccttccctatctcctcagcttctcctcatccccaaacccttattttgtgttccaatctgataataaccccttggatttggcgactttacctctcaccacacagctctccctgcactttctgtcttcctaaagcttttcctccagctcaccttgcgatcattttgagtagttaacttagtctcatgttttagatgtcagaatcttcaactcttttgctagttttatacctccctgtttattaccatcatagcatcatgtatctgagtcctaacagttactagcttttatcaagaatcaagcaaataaatattctgtctgtcttctccactaaactgaagctttggaaagaaggggaccatttattttattttatttttttttatttatttatttatttatttatttatttatttgagacaaagtcttgctctgtcgcccaggctggagtgcagtggcgggatctctgctcactgcaagctctgcctcctgggttcacaccattctccagcctcagcctcctaagtagctgggactgcaggcgaccaccaccaagcctgactaatttttcgtattttcagtagagatggagtttcaccttgttagccaggatggtctcgatctcctgacctcatgatcctcctgcctcggcctcccaaactgctaggattacaggcgtgagtcaccacgcccagccaaaggggaccattttatttttaacactattttgatctcagtgcctagcacagtgtctgacatgtaacaaatactcaataaatatttcttgaatgaaggaatcaatgaataagtgctaagaatatacaaat

SEQ ID NO: 46204 - DNA, 1015 bp, Homo sapiens
attcacaagtgttgattttctactttatgccagaaactttgctagagctggactttgatcagacctctggagctgaatgagaactgtactacattcaaaaggggttcagagttggtggtgctgtgacttgaagtgcacacacctatcttttctaactggtaatcctgttttctggatctcatttgcacaaaggtagacaagccgagcggtgtgagagtacaacagatgtctatgagttactggatttggggagtaagaatctgcccttggcagctaggtgcggtggctcacatttgcaatcccagcactttgggaggccaaggcaggctgatcgcgaggtcaggagatcaagaccatcctggctaacacagtgaaaccccatatctactaaaaatacaaaaaattagccgggtgtggtggcatgtgcctgtagttccagctactcgggaggctgaggcaggagaatggcttaaacccaggaggtggaggttgcagtgagccaagatcgctccactgcactccagcctgggtgacagagtgagactcagtttcaaaaaaaaaaaaatagaatctgtcccttggcttttgctgtctgccttggccacgattgtctcttatattgtactgggctaaggataaggtggaagagtatcagtgaacctcgatgtatagagcagagacttttaaagtaactgcattagaactccaatctgggtctgaattctgaatcttgtgcttctaccattttaaaacataccaggcatcatcattgaatgaaataaatttgttccagatagtaaaattaaactgtgtttccactaagcccttttccaacagtttttattataaatttggtgacatgattctacctgcagagaaaggggactatttcaacatgaacatgtcaaaacagaatgtaaacagttatttcagccttatgaaatccctgtaagatagggcagggagctatgtattattgcctttatgtttcctgtgtagaaaggaaaatgaagca

SEQ ID NO: 46205 - DNA, 1045 bp, Homo sapiens
aattttatgaagtataatgcacacaaagattttgtagaggtcaaaatttaaaacactacattgaagcctcagtacagaaggtctgaaaagtcaagcttaggatatatatatatatatatatacacacacacacacacacatacacacacacacgtacatatacacatatatgtgtgtgtgtgtgtatatatacacacacacacacatatatatatacacacacacacacgtatatatatttagttgaattaggtacatgagctaagcaaaggtgtactttaggtacttttaccaagagtaatgtgtaaataatgagagaaggaaagaattacgaaatgtactttgaaaaactatacaattatacatggaaaaagtaacaaatgaaagtaatagaataaagatgtgagagactgaggtagaggaagaaatgataggtttttttgtttcaatcatgaatttatctgagatttttaaggagatatataatacatctataaggatttaattttggattatggggaaaatactgacacaatatgagaaatattaaattcaagggaagaagaatgactgggaatggagaagatatatctagttttttgacctgaaggcgggatagcaataccacactgtgatgacaaagcaaagctactgtgagcattttaggctataatttgcatgtgggttatatttaaagatgtgcaaaatgatcaaattcaaagtctggagagaatcttggaaaaggctcacatttaggacctgaatgaaaaaatattaaaaagagccagagaaaaccgggaaattaacaggaaaagtagttggtaagaatgtagatgcagacaaattcttatgcaaatagatcaaaacccagtgctttagaccaaaaccagtgtagtcaaacttactcctcagccattcaaaaacaaatttcagaaaaaactgctatatttggaggcagaaattgcatgtgggttatagttaattttttaattgtgccctccaaaacaaccagttgtaaatgtacttaagcaattgaactaagtta

SEQ ID NO: 46206 - DNA, 1029 bp, Homo sapiens
atatattttaatcttttattggtagccatcaatgctttcaatatttgcaaaaacttctcttgtgacaatgacctccaaaaactgtcttctttatagtcttacttcattaactactatacaaatcagtcaatatttactgaatacccaagtattatatcctggcagcttgtcttttcaaacttcaaaacacggaagaggaaatattaggtgacttgttataagtcatacagcagataagtagataattagactgggtcaacagtcataaccaaatgaagccaaatctcacatatcaatgctgactgtgtacatgttggcaatgctatttaaatttcttcattgataaagagagtagttctaatagccttgtggggctggattacaagttgagtacatttttgaagagcacgttttttagtgtgtaaaattatgttaatggaaaaatatggctgatgaattaatagtataaatatattattttgcagacggatgaacccagaatagtgtgtaggagggaattactgagctaaaagatggttcatatatatatttttccttatgtccaataggtttagccaatacaaatgtttccgatgtgaaatagagaatatggactccattttatatgctagtaatgttcacaaagtttttaaagatctttttgacatttttcattgaatttcaaaatgatttatagtaaaagtttgcaaaactgaaaatttaaaaaaaagtagattctcttttttacacattattaaattttgaactaccataataaggaagtatggcttacattattaactgttcataaacacatcttaaagactatgagcctttctgaattttaggatcatttatgagttgttcatagatgagttaccatcccaaatacatgttggttaaaaggttttgtgtatgagttttgggatcatttatgagttgttcgtagatgacttaccatcctgaatataggttggttaaaaggttttgggtatgatgccctgaaggttgtatttgtcaaactttcct

SEQ ID NO: 46207 - DNA, 1025 bp, Homo sapiens
tggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatcca

SEQ ID NO: 46208 - DNA, 1026 bp, Homo sapiens
tgaaaccagattacactgctcctaattctcacagctaaacattctcttttatttccttcaatcttgtcaaattaaaccaacattcatttactgatatactctgtcaaaggattcatcagatagtcaccatggaaaaacctagtttctagttagtaaacaagaaacacaatcattaaaaggtgttgataacaaaagatttcagtcgtagtttcaggcaatagtgagagtccaatctgagagcattacttctttagtggccaaatgaactgtgcaaacaataattattcttgaaactcagtaaaagaataaatatcttcaggctaagatagtcaaaggaacacctttttcacagtttatattttggggtgggtctgaattttcttgtctgcctcactggtgacttccagcttattctataaaatttaacataaatttcagctgttttcccaagaattccttgatacttctttcctaatagaatttctttacatttacctataccactagtgtatttcatttcatcatggttgtctttcctgctagactctaacctcattaagatcactgacttctttttcatctcctgagcatctccttggcacataatgtgtgactaatacatatttcaaataaattgaacatttgtgtgcaaataggcattcatatgataataagaccttgttatgtacagagttttatccccccaaaatttatatgttgaagcccaagtttccagcgtgactgtatttggagactgaacctgtaaggaagtaataaaggttaagtgaggtctaagggttgaggccctaatccagtgggattggtggcctcataaaaggaggaagaaatgtgaaagaacactctgcatgtgcatgcagtgagagagggccacgtgaggtcacagcctctgcaagccgggaagagagccttcaccagaaattgaattggcccgagccttgatcttggactttcagcctccataactgtgagaaaacaaatttctgttgtttaagccacccgatctgt

SEQ ID NO: 46209 - DNA, 1047 bp, Homo sapiens
tgctcaggaggccgaggcaggagattggcctgaacccaggaggtagaggttgcagtgagccgagattgcgccactgcactccagcctgggtgacagagtgagactccatctcaaaaaaaaaaaaagaagaaaaaaagaaaaatttaacactatatataatagcataaaaatacttaatataggccaggcgcggtggctcatacctgtaatcccagcactttgggaggccgaggcaggcggatcacgaggtcaggagatcaagaccatcccggctaacacggtgaaaccccgtctctactaaaaatacaaaaaaaaattagccgggcgtagtggtaggcacctgtagtcccagctactcgggaggctgaggcaggagaatggtgtgaacccagaaggtggagcttgcagtaacctgagatcgcgccactgcactccagcctgggcgacagagcgagactccgtctcaaaaaaaaaaaaaaaaaaaaaaacttaatatatttaacaaaagatatgtaagacctctatgctgaaaactacaaaatacaacaacaggaaattaaacaagagctaaataagtggagagatgattagaaggaatcaatattgttaagatgtcagctttctctatattagtctatagatttaatgtaatctcagtcaaaatcatagtaggattttaaaaaagaaattggtaagttgattttaaatttcatatgaaaaggtaaaagacctaaaatatccaaaacaatattgttttttacctggtttcaatacatattgtaaaattgtaacaatacagtatggtattggcatatggaaagatgccactatagatcagggctttacagggctttttggttggtttccatgaagctctcgcacatattttatgtttattttaaggtgttttatcttttcattgttgttgttactgccagtgttggctgtattttactgcatcttcatactaatttttgcttgcgtatataaagactgttggatttttgtgagttagttttgtatccagtcaccttactacatttatgg

SEQ ID NO: 46210 - DNA, 1026 bp, Homo sapiens
tgctagtatgctttctatgattgctattttgccatgtggagaggaggttccagcccatttgaggggcataggttttgataacagaatgctcttataagaacatcgctacctcttcatgataactatttacatcattctcttgccaaatagagtgaggcaacatttctactcttggtgtatttttatgtttgttcttactcttcacttacattattttcagctaatgatgatctacttaattttggaaggttagggtaggaagaaagagaaagtaggcccattaaaaacttcattttctttctaatattccttgttaaatctgtcatgatagtacttctcaatcgatatgaacaaaattgtttctctctacctgtatcaaggaaacaactgaaaatatcctaacaaattttggaagggagggtttttaaatgatttgatttaaaatatgggctatgtaaaacatgaaatctacttggaggaagggggattcaagacatcttaaaggaatgggcattcttttccgaagttgataataggctctatgagatattactcgtattaaaagtgcgccgtcatgtgtaatgaagatgctttcagttgcaattgacagaaaactctaccttaactgttttaaacaataagaaacttaccaactcacctaacaaagaacccagaggtaagacagttgtgattgtgttgtgataaaaaccgtggatcctcctttttgtaatattttattctagtctggcctttttccctgtataggttttatactcaggcttgatcccatcatggctgcgagatggcagtaacaatgctaggcataatatccaaaattaatttacaggtacaggaaagggggcatctctttcgtgtgtctcttttaagagtaagaaaattcttgtagaagtttctctgcattccttcatatactgttggccagaattacatcacatgctgagttgtgaagcagtcattaatgagggtgagagcacatgattgattcagacttatcaagatctgccg

SEQ ID NO: 46211 - DNA, 1050 bp, Homo sapiens
tgggaaagaacgtggctcttggccagcaattaattaagccactcttttgttttggccatattgtggtggtgcataggtgtgaaatactctgtcttcactaaatagaaatattcctgtgtatccatgataattttaagaaaacctttcaattttggtgttattttcctataaagtaataggagttgtaagtgcaagtaattgaagcatgagaagaatggagaaaagttattgggataaaatgaatttggcatttgggtagctgaaaaatgattcctatcattttggtccatagaaaattgcatcaatattaacaggaagttggaagctgaacatctgtagcaggtctcttgttaaagaatagagaaagagaaaagattacttaattatgtattgtgtatactgggatatcctattgtcaaaaagggaaaataattagcctgactaatcaatttcctgcatttctcctgaattccaatttagatattcttgaattatcttcaagtagagatctctgatatcagattatatgggctcaattaggttactcagtgttcctctcatcgttcagcttcacttgcctctcattagagtagaattaactttttattcaggatatagtagttaaacagagttatgggccttgggtctaaagattgaaatcagggaaggccggcctcaacagagagcttcctttcacccattttgaccattgtcactgcttcccctcattcatcctcattgctgttgatcttagcaagaaacccagagacactattgccttgcttacaaataaggttttatgtttgatcttttcattttgtaaaagataaagcacctaaatcttaaaagggtgctttctttttttaatgaacagcagcggctctgggaatttcaaaagctctataatgttttgttcctgtggtaaaaaggattcacaacagacattgtgatctaaatacttgttttctttttcttttaatggaaaattatttccctaagattaagcataattaaaatgtagaattcttctgcacttttctttaaatccta

SEQ ID NO: 46212 - DNA, 1045 bp, Homo sapiens
aagaaagggcaaatttgctggtgctgaaaatgtgataaaaattcagatttctaggccaggtgcagtggctcatgcctgtaatcccaacactttgtgaggccgaggatcatttgaggtcaggagtttgagatcagcctgggcaacatagcaagacccttatctctaaaaaataataaaataagaggtttagatttctatgcacgacctacttgtatctgcttagattcttcactttctttctttcttttttttttttttattaatttattcctggcccttttctgtgagaactcgttttctttctgtttctattcacactttcctcttacccacttgtctacctgctgctgttccaaagttctagagtctctgagtggcagaaacacccatgggagttgctgatacttggccaaattttcttttaatctcgactttacacttactagttgccccaaccttcctttgtagaaggcacaccctagctgggcgtggtgttgcaggcctgtagttgtagctactccggagactgaggtgggaagatctgttgaggccaggaatttgaggctataatgtgctggctttttaatttcattatttatttatttggagatgggggtgtgtcttcatatgttgcccaggctgtgctcaagggattctcccacctcagcctcctgagtagctaggacttcaggcacacaccactgctcgtggctgagggtatggtgtggtatgatcaaacctgtaaatagctactgcactccagcctgtgcaacacagtgagatcccaactctaaatatatgtacacacacacactctctctctctctctttcactgtgttgagagtccaactctaaatgtatatatatgaagcttatccagtaaatggaagcagaaccccttgacatccagaatgtacagttgactgcattgtgtataaagttgttgttccccaaattgcttatcataagcccatttggacgataactctttgttgtatggttatagtggctagctttcattttgtgttccaaaccagtatactg

SEQ ID NO: 46213 - DNA, 1052 bp, Homo sapiens
tcgcgagcgcgttggagcggcactcggagcttctacagaaggtggagcccctacagaaggtggagcccgggcgggtgagagggagtcgcgggaattacgccaacgacgcggtgggcggggtcgggaataggggcggagcctggcttaggaaggggagctgaggtccggggcccagttttccggagttgcggtgcgttgtggctcagccctcggcccctagaatctgtgcttggtgtttttcttcctttcgttgtccttttgtgtggcatttgcgtactgggccgggtctgtccacactgcgcttgttttcctgggattgaatgctggtgggaaggtaaccagcggggagcgctgctggggaggcgatctagggcgattcctgggacgctaaggagaatgggactcacacggagaggcagggctctgctgggtcttgttctgaacagtagctctagcatggagcttgctgtctggagtagaaggcccttcataaacatttgttaatttaatgactgggtgatgaatcactttctgaacttgggcaagtgatttaacttgtcagcgcttcacctctcttttgtaaatgtcttctttttttaaaaagtaaagtaaaatctccgtttgtctcagccagtacttttgtaaaataccataaatttatagataaatgaaatggaagaaataaaattacaagcctaagtttttaataattaaactcagcagacatgaaattgaattatatacaaataaactctcaatttctgtatttttcttcctagggagtagtaccaaacagttcacaagactggcagtgtcctgggttatagggtcattttagtagcaattactgatgtcaaaatttttctgaaatccaaggactagaagaagcctggtatattagtttattattttctgttgtaacaaattactacaaatttagtggcgtaaaacacaggaaatgtgttgttgttagggttgtgagaagtcagacgggatctcactggtctaaaatcaaggtgttggtgaagttgtgttcttttccgtagcttcta

SEQ ID NO: 46214 - DNA, 1033 bp, Homo sapiens
ccaatgaaactaaagtgaggtaagggttctgatgtgaaaagctgagggtgtgatgaggacaagtggcagaaagttcacctggcttggtggaagggaaggtcagagaagacctcttagaggactcagtaatgtccattgaggattttaggttgaagggaatgtttgaagtttgagggcccttttgaggaccaccaagaacttcactgtgctgtaggatattgagcaggaggtgaagctagagagatgtgtaggccacattgcagagtttgaacttggggcaatgggaagccattgaagggttttaaacaacccaagtggtgcattcttctgtaaatgttagagagatcagtggctgccctgcacatcaaaggggagaacgattggagacaggcagattagatggaaggacggagttgtactccaagccaaagatgatggagagtgaattaagttagtgcaatgggaccaagtctagagctatttagaagtgagaagtgacacggaaaaaaaaaaagattgattggatgtagaacaagttggataagaatccaggacaaccccaggtgtcaggctggggcagctaggtaggtgctattgccatataaagtgttaaaaaagaatagagaaggggctagttgtcgggggaaggagttcagttttagacatgttgaactgcaaggagatttgatactataattaaggaatgtgttttaataaatttaataaacaatgaacacacattattcgcatttcccaaacaatttggatggtagatcaaaaagaatgagagtgaaaataaggggtctgtgaccactcaattaagattgagctaagagcaaggtcaagttcaaacccactataagcttcttgcatccatggtcactgactgttttcttactgttagctgtcctgttggacagtgtaacagtgagagagcatatacagattagcattgaaaaggataaagtgacatgtgtaagggttttgaaaaagtattatacaaatgcaaggcagatatattgaaataaatgct

SEQ ID NO: 46215 - DNA, 1031 bp, Homo sapiens
ctctagagcctctgatcctgtagagttggggtgggacctgaaaattggcattgcttatgacttcctgatagctgcagcagcagctggtctggggcccacactttgagagctgttggcttaactgttctgccatcaccaccgtgggaaggaagaaaccccttttcctttctttgcatttttcatcttggtagtaggaaggatattcaaggtcagttggataggataacagcattggaaaccctgtttccaaagcgcctttgtgagagacaaaggcgctatgatcctccttaattaatatggatagatgtgaatgtaacatggatgaatgaatgtcctgtgggctcagcgtgctctcctcatcctttgggacagagttgtgaagtaggcaaagccgtttctatgcttctcccccttctttttggtccctgctttcccagtctattatgctgctccctgatattgaacctcataagcttgtcccacttaggtgatgtgtgttcatgtagaaattctgccagggaagatgtgaatcaaaatagggattttagagcgtagtaccttaaccaaaattaaactgatctaatggtggcattttcttgtaccatgacaagttggttggggaagtgacagaattgctattttacccggcttcgttacctctccttacacacgtacttgaccatatctatattacttatgtctgagactggccctgttcatggaatcaaatgcatactcttaaaatattagatcagaaattgagaatcttacattataaatacttgtatgtacctgcacatatatggtacagattatatctgttcttttgccgattgagaataatgttgaagaggaatcaattatattttcaaactagttggattttttttcagtatttgtatttactatttgtttttcttttctctccatagaaactccccaacttttaaatcatttgaagaaaaggtcgaaaacttaaaggcaagtagagagatgaacagggtctttttgatacattgcctggtgtctta

SEQ ID NO: 46216 - DNA, 1319 bp, Homo sapiens
tgggtctaatggtttttaagagtatatagcaacatggccaaaatgctatccagcatatttcttacagtgttttgaaagagcattttttttcaaatccttgacagttctcagtattgttttattatcaacaaaataaaaataatagtaatagcacctaatgtctatagactacatgctgtgtgggaggcgttaaactgagctctttacatgcattatttcattaattattacaacagtcttacggggcaggtgctattatgattgatggaagaggaaacatagtctttatttaacaaatgaagttaccagctatatgatttgtaaatattttctcccattctgtggattttccttttcattttctttatagtcccttttaaaacatttttaaacttaaattttttatttaaaaaattttagattcagggggtacatgtgcgggtttgttacatggtaatgcctcatgatgttgaggtttgggcttctaatgatcctgttgcccaagtagtgaacatggtttttcagctctttcccccaactctccctctccacttctggaatccccagtgtttagtgttcccatctttgtgtctgtgtatacccaatgtttagctcccacttataagtcagaacatgtggtatttggttttccatttttgtgttaatttgattaggaagatggcctccagctgtatccatgttgcagcaaaggacatgattttgtactttttaggggctgcatagtattccatgatgtatatgtaccacattggacagtgggcaccggggttggtttcatgtctttgctattgtgaatagtgatgcaataaacatatgagtgcaggtgtttttttggtagaacaatttctatacccagtaatgggattgctgccattgaatggtagctctgtattaagttctttgagaagtatccaaattgtgttccacagtggctgaactttaggactgttatgaataatgccgctgtaagcaattgtgtacagctttttgtatggatgtgtgttttctttttattgttgcttgtttgttttttgagaagagtcttgctctgttgcccaggctggagtgtagtagcatgatctcagctcactgcaacctctgcctcctaggttgaagtgattctcctgcctcagcctcctgagtagctgggattataggcacaccaccaccatgcctggctaatttttgtgttttagtagtatggggtttcaccatgttagccaggctggtctcaaacccctgacctcaagtgatctgtccaccttggcctcccaaagtgctgggattacagccgtgag

SEQ ID NO: 46217 - DNA, 1026 bp, Homo sapiens
gtgatctccactcaatgtttttccttctggcagctagttaatctgtggagaggcactttaaacatcatttaaatatcatcttcttcctcaaaatttctcccgagctttagcatccagcgatgatttttgtctgaatctttacaaagatggtcagggtggcattcttctgtagttcttccttctctctatttattactttcttggactcttggattcctgtttttttcagtggtttataatccctgactgtccctaatttttttggcggcctgattgtcccatattggctagttggagccccttccagccagctgctgtatcaccatgacacgtctgcattccccaagtatctgcggcctgcctctcctggtggacagccacattgtctccctttgacgtgccctccaagtaaatattgtgtttcatagcttttaaatcagactgtcctttatatgtctttcaagtttgtggagaatttacactgacatatttgagtgatgagttaacaggcagacagaaacttaattttctttatagtcatttgtacctactaccatttccgtttgcaatgacatgagtcgtctccggttattaccctgcagtacatacgcactttactggctgcacctagttgacttctgaactgcccttgggctccctctgctggcatagtggtgcgtgagcacttttctggggtcatggaatggatttctctttctgcccattttctttcttttggtttgtggttttctctctcataaattattacacaaacatggaccatacaatacaaccttctttcaaacctgatttgtttgctaactgtatcagtacctttccatataaaattcataaatatttttatataattatgtcagtgtttccatatttttctattacctgaatgttctttttagcatttaaataatccatttttagtaggcatttgtattgcttttttccatttcaggtagcatctaaagtgaatgtcccttgcatgtatactattcatatgtgacttaataa

SEQ ID NO: 46218 - DNA, 1056 bp, Homo sapiens
agttctcacccggttggttcacacgagagctggctgtttcaaagaacctggtccctctcttgttccttctctcaccatgtgatgcgcctgccttcccttcaccttccactatgagtggaagcttcctgcgaccctcacagaagcagatgctggtgccatgcttctgtacagcctgcagaaccatgagccaaatataaacctattttctttataaattacccactctcagttattgctttttaataatgcaaacagattaacacagttgcttaattctttttttttttttttttttttttttttttgagctgggagtctcactctgtcgcccaggctggattgtagtgttgccgtttcagctcactgcaacctccacctcccgggttccagtgattctcctgcctcagcctcccgggtagctgggattataggcatgtgccaccacatctggctaatttttgtatttttagtagagacggggtttcaccatgttggtcaggctggtctcgaactcctaacctcaggcgatctgcccgcctcagcctcccaaagtgctgggattacaggcgtgagccaccgcgcccggccttaattctttattatgtttatctgttatctacattatttctcttcccatacatcttttcttctcttttaaatatgttgttgtctgggtccctgctgctaatacgttcaatagtaaatatctcactgtaacacttggtatggcaacactctgagctcaggaatgatgtaacggttaaatgtatgtgtggacttgactgtgccatggggtgcccagacatttggtcaaatattttgggtgtgtctgaggctgtttttggatgaaatcaacatttgaattggtagactgagtaaagcagattgacttctccgaatgtggatgggcctcatcctatcattgaaggcctgattggaacaaaatggctgggaaagagggaacctctctctgactgtcttccagctgggacattggtcttctcctgcctttggacccaggcttgaactagaatctaatgccacagtttcttctgg

SEQ ID NO: 46219 - DNA, 1047 bp, Homo sapiens
agtctacagtgagctgtgttcatgcctctgcactccagtctaggtgacagagggagaccctatcacaaaaagaaatgaattaagtaaaaaattttcttttaaaaaatttttcttattttttatttttttgagacagtatcttactctgttgcccaggctggagtgcagtggcacatctcagctcactgcagcctcagcctcccaggttcaagtgattctcctacctcagccacccaagtagctgggattacaggtgtgcgccctcatgtctggctaatttttgtatttttagtggagatggggtttcgccacgttgcccaggctggtcttgagctcctgagctgaagtgatatgcctcccttggccttccaaaatgctgggattacaggtgtgagtcagcacgcccagcctaaaaatgttctattaaaaagaagcagacctggttaatctgagaacctaactataaatactcatttagttctttttccttcagggcatgcagataaacaagcaaaaaaaaaaaaaatcagcagactcagagtagacgagaggttagaaacctctacatgccagtaaaaaatacttctcatttctgttttttttgttgttgtttttttttttttaaatagagatggggtcttgctctgttcccccggctgatctcaaactcctcagcctcccagagtgctgaaattacaggtgtgagccaccgtgcttggcccttcccactttctgagatgttcaagatcgtgtgtgtacgtgtgtatgtaggtgaacaattttgtttaggtaaaaacttccactttgtagccactaaaattctaaattgcttttggtaagatttgcccattcttttagaagagcttaggttctgagatgctattatgagaagcacttgagactataacatccttctccccacacccccaaactgggaaggagctgggagaccaaagaataacttggataaatctagcttgacggctagatgagcttgttaggacttaacttcaggacactcctggatggtggctggacagctctaga

SEQ ID NO: 46220 - DNA, 1027 bp, Homo sapiens
acacagttggtcatagtattactttataatcctttttattctgtatggttggcaataatgattgctgttttaattcaggattttagttctaccttgctttttaatgctttatattttagagatctttttgtaaaaattgaattcatcttttagtgaccacatagtgttccataactaacctatttatggtcattaatgttatgaataatgccacagttaatatcttttgatatattgtagggtacttttggtgatagtgtgtttctgagggtaaattcttagcagttgatttgttaggtcaaagggatataatgttcaatattagtagatattgacaaattatcctttatagagtttgcactatttacatttatttttctatactatgatatcctttacttctttgtcttttattgggttatttattttaacaagtttttgttatattaagaagaaattagcctttgtcatatgtcttccaaatattttttccttgtttatagtttcttttgaccttgttgaacattttttgccatacggaagttttaaagttttgtgtggtcagatttatcctccatttccgttctggcttctggactggtatcactgccatgtatcacacggtattactgccatataaataggctctgttaggcttcaagaaacaagtgatggattttattgaattcatagagaataagaaaagtaggactagccacacagttaagtttatgttttggggatacagcagtcttccaggagttagtctgtaaggtctgccctctgcagggagcttgattgaaaatctagtagttggctgttcagagatgacattccattcctctcttgcctcccttccttctctctaggtgacattctactgttatggttctgctgccttttccgccgcttgtatgactcttgatctttcttgtttattgaagccttatagcttctgctctcttgctctgcttttcgtcatctctctgtaggtcattgtggcttctgtgcccattggtaagtactg

SEQ ID NO: 46221 - DNA, 1013 bp, Homo sapiens
caccatcttggcctggctggtctcgaactcctggcctcaggtgatctgctcacttcagcctcccaaagtgctgggattacaggcctgaaccaccccgtccagtctgattttttgttttaaatgacaaatgaatattatctctatgttataagacataaggcaactgaagaaagccttcttagtgtgaaatatttatcttagatattttttagccaaaatgattttagtaaacattctgtttatattgctaactgaagaaggtcaaatgacaatgttgataaaagtgcaagccatttcaaagattaaagcagcacttcacttctatgcatatattgtgttttagtcccatcgatagcttttacaggatcaacctgtcattcaatccatccattcttttctttttttttcttttcttttttttgaaacagagtcttgctctgtcgctcaggctggagtgccgtggcagctcactgcaacctctgtctcctggattcaagtgattctcgtgcctcaccctcctgagtagctgggattacagacgtgaaccaccatggccagctaatttttgcagtttcagtagagacagggttttgccgtgttggctaggctggtctgaactcctgacctcaggtgatccacctgcctcggcctcccacagtgttaggattacaggcatgagccaccgcgtccagcctattatttttttttagaaatattcatttaattccaattttgttgtgcttagataccatctactgaatccttatatatatacatggtacaaggtatgtaaacctctgtctgttataaatattttctctcaggctgtcacttgtcttttaacttgtgctattctatcataacagagttttaatagtatatagtcaaatttgtcagtctcttagtaacttttgagttttttatcccagagagatcccatcagtacccaaattattaatgtcctgtagtttttctaacattttaattgtgtatattttctaatgttttctgct

SEQ ID NO: 46222 - DNA, 1031 bp, Homo sapiens
ggtctcgttattaatattttggttaggctagtctctccaactactggccttaagcagtccttccaccttgacctcccaaagtgctgggattatggcgtgagccactgtgcagggctgaggcttgcatcttcatatctgttggactctgtagtccttcatgctcttgctccttggctccctctttcttgaatctccactcttcccatcttgataaaccattacctctgagtctagtggtttcttaactcacttgtacattagaatcatcagggaagctttaaaaaaagaaactgatgctgactgggtgataatgatgtatcagtgtaggtttatcgattgtagcaaacattattgtggcatgggatgtcaatatgagtaagggaggttgtgcatatatggggacaggggctatatgggaactctctgtactttctgctcaattttgctgagaacctaaaatactctaaaaaagaaggtggtttttttgtttgtttgtttgtcttaatggtcaaatggtcctgggatcagaatacgtgctaagcatggcaaaaaagatgatcaacatcatttagatagtgctattcttaaaaaaaaattctttctcccctagagtgatgttatttttatgctagtgaaattcatataaacatacagctagcatatatcatctaatttaagacactatcaattgtaagccacactactaagatagaaaattgctaattaaactatgccatactgtgtgtgtatgtgtatgtgtaaacgtacgtatacacactactgatgtctaggtccagactaagaccattgcctttagtctatgaaacttgccaggctgggcagggtggctcacatctgtaatcccagcactttgggaggccgaggagggtggactgcttgagcccaggagttcgagactagcttgggcaacatggcaaaaccccatctctaatctccacaaaaaatacaaatattagccaggcacggtggtatgcactggtagtctcagctatttgggaagctgaggtagg

SEQ ID NO: 46223 - DNA, 1080 bp, Homo sapiens
ttggagcttttcttaattgtaagtcagagataataattaatgtcatgcctagttcagagaattattgtgtgactcaaatgagatgatgagcattaagacattggaaactttaggtactatatgaatgttttcttattggggcaaaccattttcctcttgtaaaggtgagcccagggacatgtctctcccccatctctatactatcagttctgatctttgaatgattgcagtgcccctcatagggttgggtaaggaccaaggcagagaatatgtagataatgcagcacagtacccggcacatagtaagcattcagttaacagctacaattacttaatggttttgaaatagatatgccaggcactaaagaaaattaattgataaatgaaataactactgctcctaagctgtggccgtggattagaatcaccgtgtctgccatgtcactgactctacagaatactgtatatggaaaaatggtttttattatttgttattttctatatttggatgacatttctgatctgaatttcaaccgtgacttctagtcctctgtatcttcttcttattctgacttgctacaatataaacttcatcctttaaagaaaaagtgaccctgttattcttccttggggtgttttgaatatcctccccctccttgcccagcttccctcaaatgtgccaacaatttttttcttttcttttctgtttttttttttttttagcatcagcggtaccatcaagttcctggactcttgaacttgatgaaatcgagatagtttctgtagggctccatttggaattgaggagcaggtgtggtctagacctaaggtccagtggtgggaggaatggaaagaagaaatggagccaaaggaaactgagggaaggattcatgtttctctggctcagtgagtgggtgggtcaaagaaataaaatgtttgtaattggttttaagcctgggcaactggagaaagtggtggtagtgttaataagagaccaggaggaacacaaagaggaaagaatatctggttttggagggaagaaggaaaattcagttttgattctgaatttgaggggggttg

SEQ ID NO: 46224 - DNA, 1081 bp, Homo sapiens
ccagcctgggcaacaagagtgaaactctgtctcaaaaaaaagaaaaaaaaaagaaaagagacggggtctcattctgtcgctcaggctggagtgcagtagcacaatcatgactcactgcagcattgaactcgtgggctcaagtgatcctcccgccttggcctcccaaagtgctggaattacaggccaccctaccttgctgaaatatttaaattctgaaggaccaaactatccccttctcaaagaacaatatgaactagcaccgttataaacttggtactgctgtaagagtcctactcctgagggcttccacccatcttattttcatacttatgaaaaataatacatgttcaaagcaaatgaatccaaacagtatgcaattaaaactcaaactctcttagcctagacccatttctcccagagcggctgttatgatcagcctctgggtgtccttccagaaatgtctaggcaggtaatgtatacaatcactttaaaagttcaaatgggaacatgtcatacacattattctgtactttgcttgttttaactgacacgtatcttggatattaaaaaaaaaatctaacatatagtttccattttttaagaaaaaagctttattgatatataatttgccataaataatcaccatatagtttaccttaaaattcacttgttttaaatgtacaattcagtgatttctagtaaacttacagagttgtgcagtgatcaccacaatctaattttagaatattttcatcaccctgtgtctatttacagccactccacatcccgtgcccgcaggcaaacacttatctatttagtttctatagattgattttattactctttttaatagcaacctgtggtccattttggaaaaatacaaacatgtatttaattgtgctttatccaagcacatttagcttttgctgatgttttattttgctgcctgcctactttaaaaaaaattggaaaagattgaaattttgtctttgagccatacttgttaagagtgataagggagttttagctgaagttgtttgtagattttccagtcattacctgtggaactaggagaagaatt

SEQ ID NO: 46225 - DNA, 1050 bp, Homo sapiens
tttttagaaatgcctccctcactttgagtttatgcttttatggttttattttttatgtttaaatctttcctcaatctggagtttgttttgataatgagatgtgaggtataaatcttaacacctccacctccaattggccacccaactgcctaacaccattcattgactaatggcttcttcctctattgatttgaaataccactgttgtcatgtactaaattcttacattcttttcttttctctttatctgtatgttcattgccagcagctaaacctagtttaagttattgtagcttcataaaatgtaaaaatgtctggaagggctagtttgctctgattactctatttttttttctgtcagtttttttctaggtattcttgccagactatttccaaacgaacattagaatcaacttatctaggtgaaaattcaacaaaaatcatgctggcagatctttttctccttctctctcctcccccctttcccctttctgtctgtctgtctctctctctctctctctctctctctctctgtctctctctcacagttagaatttggtctgtttctttattcaataccccaatatatgttcattagggttatactgtatacactacacataacagttttgttttttgttttggatattatttgataataagaattttaccacatcattaaaaaaagtttccccaagctataatttttgataattgcactcttccactattcaaatgtttatttaactctttctctcctggagtaggtttacattccattttagctatgatactgctttaagagaaattgttttaagataaatttccatagacaggtcaaaggaggtgaatatatgtaagcttttcgatgcctgttactgaatctcattctggaaaacataactgtcaatgccctctttttctcatggtaaaaaaatacataacaaaatttaccatcttaatcgtttttaaatgtacagtacgatagtgttaactgtatgtaccttgtgcaacagatctctgaaactttttcatttttcaaaatgaaaa

SEQ ID NO: 46226 - DNA, 1123 bp, Homo sapiens
gttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcactttagtaatcgtcttctggtccttggacttttctgttctgtaatgcttgtaacaatgaatat

SEQ ID NO: 46227 - DNA, 1050 bp, Homo sapiens
tggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggca

SEQ ID NO: 46228 - DNA, 1035 bp, Homo sapiens
tggccaccgcagggagctcagaggccaatctacgcaaaaggcatgcaaaacaatggattctggtcccaaaatatttctaagtaaggcatgatgtagccttttgattttttttttatcctttgacaccccagccttcagaaaaggtttttcatctctctccaaagaagtcatttcatagtgactgacaggacattctccagagagcgacaaagcagagtggccagcaggcagtggtgttaagccttgggccttcccagcagatgtgtgctgcattggtgggtgggaggcagtgtgacagcctggagaaaacacacaggtagcaagggagtcaggggggaggtacaagagggctgtggacacctggctcttgctcatcttcttggtgctgatcagctggtggtcaccatccctaagtacctcccagggagctgccattttctcctctgggagcagctgcctgaagcaaggagagaatgacctgaagggaagtacctccggccaagagtgcagggctgctgtgcctagcctgagcgggccatctctagcagatatggacttctctccaccacactagctgaaaagttttctcccttggttggcaaaagccagtgtcaggaaaaaagctgtgggtttctgaccaagaatgtgtgcgcttagctgcaaagtgcctgtcagcagctccaggcaccaacaaggtgcccttttattagacaattcctgcccgaacataaccatattgcagatgaaaattttcaatagagaatgacacaattcttgacctttctaaaaacttttcaaagagatagtcacatgtgtatatgttgcaaaagatttttgaaactgaaatgtcctccattaaatctcaagagcactcgagttttaagtctgctgtttctggtgtcacactaagacacacttttgaaagcagccctgggttctgaattagttggcactgctgaatccatgttcccccttcatcagactccaaagtgcagcattcacttgcaaaggttgagagaaaagtggccagaattg

SEQ ID NO: 46229 - DNA, 1086 bp, Homo sapiens
tcacgagttggaagagttgccccgcagaggacttgtgggaaaatgggtagagagtcgggagaccagagcagagagggccaggtgtttcctgcattggagttaagtctcatgtgagggcaatggggagcctcccaagagtgaatttctgtgtccccgcggctgttaccaagcctttgccctccactctcaggtaaagccctgctgcttgaaggcttcttccacctcccgcttccttaactctgctgacatcctgctcatttgccctttatggaaggcttgagccacctggccacaacttttctctcctcaatgctgccatcatcccggatgacatcagcctcgccatttccgatccagcgactttcacctctgccctgcctctgccctctactcccacggccataccttggactcggccatctctcagaatttttctacatagaaaatctccatccccagtatctccttcctactcataacctcctggtcttccatctcgccttcgcttttgtgtcctcggcacctgattttgaccccatcaagatctctggtttctctcaatttgtccccatcttttccctccaaccttcacacattgcccagtccagccaagaacctatggctctctctccaaaaccttgcactctccatgcccttactcactgtaaaacctggcatagggctagtccagcagcctcctctcacactcccaccccaggcttctggcacagccatcagaccccctctccagtgaccatcacaacaggatcaagctttctaacctcagctgagcctcggttgctgcttgatagacttttggtgtcctgctccattttctctcccagtacccataacagcaattccaaaccttaagcatggcaatgtcctctccactctccacagagaaacctacctgcttctgaggagagacctccagagagaagcatcagcttccccagccccacacctacaagcatgcttgcacccagcccatctttgttctcctcactccaggtagacggggtggttgttcctccttttgtctaaagctacttccattggagcccaggaccctcatcatgctgc

SEQ ID NO: 46230 - DNA, 1104 bp, Homo sapiens
tcttccagcagagctagcgtttcctgtactgctttgtagttctggctatttatggtataaactatattcaagtcccataaacagggcttttcaattagcttgaaaaaaattattaaatgtttggtgggtaccagaatagcaagattcgtggttatttggaaggcttgttttatgctttgaggccactgtggcctaccacagagctacaccgcagaccgtgaatttagcaaatcccaggaacttgcctggaagtcagaattggtcccatatgattaaaaacaatttattcaagtacccagtttcttcaagcagaaagctagaagcattgggatcgaggaagcagatgtggaaagtccagatgaagcacatattcggaagacagcatgttgtcaaagacagtataaactggattcaggactacaccatgattttccagtttaatactattgcctttaaaatagaaatagtgctgctttatattatgaaggactttatggactgattgatgtgtactttcccaactatattttcatttcaccttattaataatgtgaattgtgaggaccttttgcctggtttactctgcagactgcatttaaatgcctttctccaagaagccttctttgactcactcctgagaccaatctccatggcacccaggactgagtttgctattgcccgtaacaatgggtcctgatccctctcacagcacctgaatttgcgtgattatttgtctgctgcccccattggacttgtaaaagtacttgaaaacgtaggttctatctagttggttcttgtgctgccaaacttagtgtaatacccagcatgtcataggtgctgaatttacttgaactgttggaggcaaaaatgaggttcagaaaacttaaacatcttgcccaaggtgctagaatgtgaaccccataagagtaaagcctcaaactatcacattcagtacaatatccccaatatctagaagagtgctttgcacagagtaggtccgaaaaaggttgaatcagtgaatacaatgggtaatagaccaggacataaacccaggtctgccctattaaaaccctgtacttttttatattacatccaaaaatatat

SEQ ID NO: 46231 - DNA, 1031 bp, Homo sapiens
gaaatgataacaatacctcctcatggggttgatgtgaagataagatgaaattgtatcttttaaataataatatccctggtacataatcagtaatgaatgagtagtaaataacaatatcattgtttccattgtagtggaaacttgtgtgttcacagatctgggtgccaggaaactttggttttcttagagggagtgagatactgctcttggatatgtctgtcttgatatctaaaagacttgggtttctggtgcagcgacatgtgttctttgatgggctctgatgatactatagctcttcagctacatttttttttttttgagacgaggtctccctctgttacacaggctggagtgcagtggcgtgatcacttctcactgcagccttgctctcccaggctaaagccatccttccttctcagcctcccacgtagctgggactgcagatgtgtaccagcacactcagctgatttattgatttttttttttaagagatggggtcttgagtgttgcccaggctggtactgaacttctgagttcaagtgatcctccctccgtggcctcccaaagtgctggaattacagatgtgagccactgcagctggccttcagctacatttggctacaacacgaactgctgtttgggggtactgttgtttgtgcattgcttacctaaactattcagtgtcctgggactgagttttggaaaatggtaaagcccagtcatgtgaagccatggttctcaagcctggctgcacgctgaaatcaccaggggaggcagggaagcaccatagatgcctggattctacctagaactcagtacttggaatagttccgattgaacctggatgagcagtattgagaaccagagatttagagacactgggaatcactgtttctcagtagtcatgtctgttttcctcagctggaccattctgttctgttttttgggttttttgtttgtttgtttgtttttgagatggagtctcactcagtcacccaggctggagtgcagtggcacgatctcggctcact

SEQ ID NO: 46232 - DNA, 1050 bp, Homo sapiens
gccattctgctttccacaatggttgaactaatttacactctcaccaacaatgtattaagtgttcccttttctctgcaacccaaccagcatctgttattttttgactttctagtaatagccattttgagtggtgtgagatggtatctcattgtggttttatttgcatttctctaatgatcagtgacactgagcttttttttaatatgcttattggccatatgtatgtcttctttagaaaagtgtctgttcatgtcctttgcccactttttaatgttttctttcaatttgtttaagttccttatagatgctggatattagacttttatcagatgtgtggtttgcaaatattttctcaatgggtgattcttgatcagttttttaagctttgaagttaattatgggaatattgaatttcaatattgagtgtgtattgggtaatagtattgaatacagtaatggcgttgtggttacaaaaaacgcccttgttcttaagagcgatatattgaaatatttaggggtgaggtgttatgatatttgtgggttactttcttctttttttttttttttgttgagtcgcagcctcactctgtcgcctaggctggagtgcagtggcgcgatctcggctcaatgcaacctctgcctcctgggttcaagcaattctcctgcctcagcctcccgcgtagctgggattacaggtgaccatcattatgcccagctaatttttgtatttctagtagagacgggattttgccatgttggtcaggctggtcttgaactcctgacctcagatgatctgcctacctcggcctcccaaagtactgggattacaggtgtgagctaccatgcctggcccatgggttactttcatatgattcaggaaaaaagtgtatatgcatgtgttgtgtgtatataaagatacacagagaaaataaaatgtgacaaactattagtaattggtgactgaaggtgaaggatatatacagatgttcattgtagtatgattttagcttttctgtaggtttgacattgttcaaaaataacaacaagcag

SEQ ID NO: 46233 - DNA, 1115 bp, Homo sapiens
tgtgaggattttggtatccttgagggtgggaagcatcctggtgccattcacctgcgaataccaagcagcgactgtacttcctcaaaagcactgctgacaacccaagatccctcagatgtccttaatgaaacccttttttcaggctctttcttaccctggtcgtcctcctcttctggttacactcccattactaaataccattcctactattgtatattaacgttccttttaaaacctagtgcctagaatagcagaaggactctacatatcatgtgattatttcagagtacagtggactcttgtattcatctggacatcgtaattgtattaatgcagccaaaattatattaagtacttcagcagccccatctccctagctcttgttgagactctagttaaaaacatccctgaggccttttatcctctgaactgctgcatcacgcagctgcttgtaaagccgtctctcctccaacttgtgcttttataattgaatctctttaaatgtaaatgcagacaattacatttgtcctagttaaatttcatcttgttatttcgagcccagagctccagcttgttgagatcttattgaatcttggttctgtcatggatttctgttatgcatacttgcttgtgtctgcaacccaggtagagaggcttgaaaataaatatatcccagctgcgctaactcaaagcaagaggtactgagagaagacagcagtgatgattgctcggggatggggaaggcaactgcccattctctaagcagtaatttcctaatatttttggtggcagttcacagttcaacattatgagatatagcaaaagccatttattgctaattacatttaactgatgtctatgaaggactattcctatacattagagtgaatttgagactatctccatcattctccagccattcttcagtgggagaaaaacggtggaattaaactagtggaaacaaggctttctcatctagtcccaatccagtcgataagctgtgtttgccaatcactgctccagcacaatggccctcagtttatttttaagtctatggcatgcctgaaggaccatgttcccatgagtgacacccttctgtaaatgtggtggcacat

SEQ ID NO: 46234 - DNA, 1032 bp, Homo sapiens
cccttcactttttcagtataggctgctcataatgaccttccaaagagtaaagtatgcaaaagaggaaaaaaagagtaaatacagtggagaaacctaacaaatactactttacccagatgtgatggaaataatgctttacttcttgtggttttcttcccaaaaacccatagccccagtgtaatcaagtgaaaaacatcagaccaatcccaattgaggtgtattctgtaaaatacttcaccagtactccttgaaacagcaaggtcatcaaaaacaaggaaagtctgggaaacatcacagccagcaagagcctgagggggcataaagactaaatgtaatatggtatccaggatgagaccctggaacagagaaaggacattaagcaaatcaaggaaatctgaatacagtgtggactttagttaataatgatgtatcaatattgtttcattagttgtgacaaatgtatctactaatgtaagataataggggaaactgcatgggggctgtatgggaactccacactatcgtctcagtttttctgtcaatcaaaaactgttctaaaaaataaattttaaaaaatgtttaaagataacttggagaaagcctagatgaccttgggtatggtgatgaccttttagaaacaacagcaaagacaaactccatgaaagaggcagttaataagctgtacttcgtcaaaattaaaaacttctgctctgcaaaagacagtgtcaagcgaaggagaagacaagccacagactgggagaaaatatttgcaaggactgttatccaaaatatacaaagaactcttaaatctcaaaaataaaaaaacaacccaattaaaaaataggcaaaagacctgaacagacatctcctcaaagaagacacgcagatggcaaataagcatatgaaaagaggttcaacatcatatgttattaggaaattgcaaattgaaacaagaaatcactatatacctattaaaatggccaagatccagaacactgacaacaccaaatgctgatgaggaagtggaacaac

SEQ ID NO: 46235 - DNA, 1036 bp, Homo sapiens
ccacctcccgctcttgcactcctccctgggttcctgctgtgctggccttctcccactagtatcattgtcacctgatcactttcttgcatatagtttcccatttcctgtcattgttttttaaaaaagtctgtaaactggtcccacctcatgtatgtgtgtgtgtatttacataggtgatttttatttccggtacctttctaacacaccatctgcactcatcaccagtccttggccctcaggcattcctaactcatccttttcctattttcccttcctgaacactcatcttccttctctccactgatccatgtcctccccataaccaaggtccagttcagggccaaccactgtaactctaggccacggagtcacaaccctaactgcacattaaaatcccctgaggtgttcttaaaataatattttagctgggcccagtccttgcacagttgaaacttaaactcttgggtaagactcaagcatctttgtttttttcaaaatacccctaacccggaggatactgatgcacattgaagagtgagaacaacagcttctagctgacacagcacactggaaatgctgtggtattgataaccagtgccacacacttccacaccaatcttttcccaccttgcctacctttgttttcttaccagattctgaaacgcatacttgtaaatatctgttcatggacaagtcattggattttaacgtacaaatatcctttctctgactatttcttcttgacatctttcattgagtataatcttatctgcatcaaacagaaatggaagcataaacctgagatactggcagaagctttgaaggtacttacttcattttattgcttattgttgaagttgaatcatgtgttatttttaggggtttttttttgttattagtttttcagaggacagagtctgactctgtcacccaggctggagtacagtggttccatcatagcttactgcagcctcaaactcctgtgctcaagagatcctcccacttaagccttctgagtaactgggactgcaggcat

SEQ ID NO: 46236 - DNA, 1130 bp, Homo sapiens
tatctacatctagagcataattttaatgaatgaattgtattatagcatatgtatgtgccacttttttggggtttatctctcccatctgagtcttgagcccatcatatactaaacatcttcacttggataacctacagacccatcaatacttggtgttctccagataacatgtatcatcttctccacacgcactttttctcccgtgttcccatgtcaattgctccttattgctcagtacaggaagctggacatcatctttgatccacactcccataccccaccttaaatcagtcaccacatcttaggttattcaattccaaatttctctcaaatccattgctcctcccttgtccctacatatgtgccatttttagtcagcaaatattctagtagacattttggttgttttatgtatttatagttacaaatagcactgtggttaactgaattagttatatattgctgtgtagcgaacaaattactcccaaacctattggattgaaacaacatgcatcagtttctgtgggtcaggaatctgggcatggcttagctgggtcctccgcttcaggatctcttgcaagtctgaaattaaagtgttggccagggctatctgaaggctcaactagggataaatccacttctgagcacatatgattgttgcagaattcatttccggaagagtagttggactgaggtcctcagttcttaggtggctgtcagctggaagtggctgtcagttccttgccatgtgtgcctccccatataccagcttgcttcagcaaagccagcaagaggaaacctttactcctgatgtgttaaaaggatctcatgtatttacaatgctagggagagaatctgctagcacgacaggagtcacagtcttttttgtagcctaattaaagaaatgacatcccatgccatcaacttggctacattccctttgctagaagcaggtcactaggccagcccacactcaaggggaagggattatatcatggtctgcaaaccaggagcagggatctttgggggtcatgttagagtatgcccccacattaaccatcctgtagccaagccttgtgtatattcttacatatttccaagtgttaaacctgagaagaaatattcctaat

SEQ ID NO: 46237 - DNA, 1992 bp, Homo sapiens
gggtctgctccaaaccctagctgcctcagtttttcctgtacctggaggtaccaccagtggctattttgggcacttgtatcagtcaaactcttaaaatcccttctacctggacaatgaagaaacatcaggatgcatcattaagtattggctagactcaagggaaataagcctttacttcagagttcaggtctaaaaattaaaagagaaattcaattcaattataaaacaatttatgacttaatacttcagcatattgcaaaataaatattgcataattattccttgtaactttttatatgtattattgtctagcatcctacaatttgaaatattaacagtaatttccagttcctatggtttgaatgtttgttcatttcaaaattcatgttgaaacttaatccccaagatggcagttttgagaagtgaggcctttaagaggtgaatggttaattctatttatggatcaatggattaatgggttaatgaattaacagtttatcacaggagtgggactgatggctttataaggagaggaagacagacctgatctagcacactcagactcttttgccatgtcatgccatgagccactttgggactctgtaaagagttcccaccagcaagaaagccctcaccagatacggcccctaaaccttggacttctcagcctccataactgtaagaaataaattccttttctttataaattattcagtttcaggtattctgttttaagcaacagaaaatggtctaagacagaaaaaggtactgagagaggggtgttgctgatatcaaattcctgaaaatatggaagcagctttggaactgagtaatgagcagaggcttggaagaatttcgaggagcaggctagacaaagcctagattctggtgaaggcttagaagacaagaagactagggtaagtttggatcttcttagagactgggtaagtgatcatgaccagaattctgatagaaatatggacaccagggccgggcatcgtggctcacgcctataatcccagcactttgggaggccgagatgggcagatcacctgaggttgagagttcgagaccagcctgaccaacatggagaaaccctgtctctactaaaaatacaaaattagctgggcgtggtggctagtgcctgtaatcctagctacttgggaggctgaggcacgagaatcacttgaacctgggaggcggaggttgcggtgagctaagattgtgccatggtactccagcctgggcaacaagagcagaactccatctcaaaaaaaaaaaaaatatggacactaaaggccattacaatgaggtttcagatggaactgagaaacaaggtattggaaacatgtgtaaaggcccttcttgttataaactgacaacttggctgcattgtgtccatgtctaaggatattatggaatgtagaacttaatacacctactgtatatccacaaaaattaaaaattttaaaaattaaaatgaaaaaaagagcaaaaaaagatccatgaattaggatatctggcagaagaaatgttgaagcagtaaaacattcaggctgctgcatggctacctttaaccacttacattaagctgtgagagggaaaaattgacttaaaatggaatttataatcaagaaagaagcaaagcagaaggatttggaaaactcttagcctggccatgtaaagagtgaaaaaacatgttcaggagaacgtgctttttttttcagtgacctttactgaggagatcagtacagagagaagggatgattaagagactagaagaaagaccctgaagacattttagatatctttgaagctgcctctcccatcatgggccccagaggcctaggagggcaaaatagttttgccagacaaatccaggaaaccctccgtgggcttcctgcccagggtccttgcaggtctctgctccctgcattctagcctcatcactccttgaccaccccagctgtgattcaagtggcaccaggtatg

SEQ ID NO: 46238 - DNA, 2025 bp, Homo sapiens
aatatttgtcagatgaaaaaaagaaagaaaatgctgtagcatgagagattgcttatttgtaatatgggtgccacattttgttgccaaaaatcatttataatggaacttagagcttatagcaattgtttgagaagtcctgcatttgtccaagtggtttctaacagttaaccaggaaaacagtacctttggaagaggaataaatgtgcctttcctgcctgttcacgttttgtaattaacgtttcatttctttctatattaaatcaaaagtatcttctctagaaaattattattttctcccattgccagatttgtcagactttctaaaattataggcctcttagttttctttaacctttaattgaaaattttcacgtattcattacttctgtttaactacttggaattatttgcttttctaatgtttttcgtataaatacatgttaagttatttaggattatttccttctactgtggcatggttgtgaaacattttatcataccctgaccctcataggcatctcaatttgtatttgttgtttggttgtctcataggaaactgacatgttaacaatttgaaatgtgaagaactgtgcttttttttttttttcctaagtctgtagggcaaaagttagacttctagtgtcagtttaataccaacttgcaattctataggacttattctacataaaatttccattagaccattgtatatgttaaaagacctggaattaatcattttaaattgccataggttgttttaagtatacctttattctttaattccacctcacttggagcacttgctggggaaaataatgaaaagaggaagaagaaagatgttttctgccttttctgactctggtatgtaggatattttccaccttttatggttcactgaatgtacttaaaagtacatgatcccacgccagtgttattgtgaggttcttaaacagtgtgggaaagttaattaggttttaaatccattaatgcacagcaaaaatcccccaatgacaagatataatttagatgtattaatctattatgggaaatactacttaaggcttcattgtttggggtatctactaatatacttgttttcattgctatagtaggaatttaatcatcataaatacagtgtgccagcagttggtgagataagttgcttttaaaaaaaatgatgatgagggaatcaagcattgtggattataatgatcaaactctcaaactctatttccatttactgctaccaagtttaataaatgtcggacttcccactgtcacctaagtatatcaatattttgttttaaagaaacttctttacctgatacagtaggaagatgtaggattttccttttgtttactaagaagaaatatatctgttgacaggtataaataatgaactttgagtaaatctagagtatagtgaaatttatcaatacaaggaaatctatatacaattggccctgtgtatccatgggttctgcacctgtgggttcaaccaaccactgactgaaaatatctggaaaaaaattgtctataccaaacatgtacagatacattttcttgtctttatttcctaaacaatacagtataacaactatttacatagtgtttacattgtattagatattataagtaatccagagctgctttaaagtataccagaggatgtgctaggttatatttaaatactatggcattttatataagagacttgagcatctgctgattttgtgtctatagggaggcctggaaccaacccccatgggtactgaggaatatctgtatccatatcttataaaatatataataaatgtttaaaaatatatatatgatattttggccaaaaagcaggataatcattttaggcccatagaatgcagagttcttcaatcatttaaaatcagttccctgtaacgtttctcactttatcttttgcttattctcattaaagctaagatttttgttgaactttactttctctggtttgtaaaatgaaactcaaagtttattttctgaggttta

SEQ ID NO: 46239 - DNA, 1046 bp, Homo sapiens
tgtatgtctgtgatacactatatgaagagcttctgtgttgggtagggagaaagaatttgatggtagctattgtagtacaatatgactacaaagtgctgatgagcaatagaagttatagtgttcggaaagcaagttctttaaatcaatcctaatgtgggggaaattaatctgaacatcagcatcagctcttccctgccacttaggtctctctcctacaggaagctgtcagtttcttacctatgttgtgttctcttcctggtccttacaaggaatcctatagctgtgagaagccctcccttctttggtagatccccatttaccccaaaaggtgagcatcttcatttgttagtgctgtgcatactgattcttctttctcttgcccttaccagctttaatgctgctgttgatttctgtccttctaaccagatgtttttgttctttctggctgtcttctatcattgaacacttttcctgcttaggacctatagcatagagtgatttttcagattgtctcaagttttccattaacaagaatatcagctcatatttatgaatcacataattgataccagcttcaaagaagcagcaagctaatttagactagaccttgcagatcaccaggaacagttttgtcaccagggcattgtacaaattgggaaaaaaaataaaagcaccctatttggacagatgaagtataaaaagttgctctccaggtgcatggatcagaaaaatgtccctcatccaaagtaaggaagcctcgggatgtggcttgaatggggactgaattttagcctcatttgaccagtgtttagggtttaatacacaactgcttgcagcagcttgggttgccatgccatctctgttttattttgttttctttggttttgtttttaagatccatagacttggtggctatctctttgcatcacaatttccaaatttttgtttctaggggttcttagaaatacaccctctaggccgggtgcagtggctcacgcttgtattcccagcactttgggaggctgaggtgggcagatcacgaggtc

SEQ ID NO: 46240 - DNA, 1032 bp, Homo sapiens
tttatgataaattaacttaaaatcaaataacttccacatttctagaagatgttgttggcacctttttcccgcacttcccacaacatgtctctaatatatgcctgtccctacctgcaaaccttgccgctgtatcataggctactctctctctctctgcctctctgttgaatgcctttaaaataccctttccagaaaaagagtgaaaacgtagcatagagaagtgaagggggcagggctgtcagagccatactgtgatatttgttctcattgtacaacctgaagactttccttggtctctactttccaaagaaaatggaaattgggggtagagtgaccatgttgactgccttacatacaaagggctttgaactcagcacagggaaaggctctctttaaaatgttagcttaatgaatccatattctaaggcctctccaaaaaagttcttaatactgtggcatacaatgtgagttccacatatgatccttcaacttgaaaacctctgtgacactcaaaatgtaaaactcttcacattatactccaagacttttcataaacacagccttaacccataacttccattttattcatgatttccaaatagaaaaaaaaaatggaaaatctcgaggaagacagtgtgattttaaagatgttcagaattgcattctttttggtgcatgaggtcttgtaatcccattggctccatggctttctaaggagggtcagttttctgagttctccctgtggacttctggagtttcactgcctctgcccctggggacccgctatgagattagatttttactttcacactatgaaccaggaacacagtgaggcttgtctacagaaccagtgagatggaaagggaccaggaagaggtggcacttcagtgcccacacagagagagaagggatagagaacagattcaggattgggcagtgcaggactcacaagcacgagacctgtgtccttcaaagggttttctagtgaattacctacttgggaatcacttaggatgcaagataaaaatatag

SEQ ID NO: 46241 - DNA, 1050 bp, Homo sapiens
tgggttggttccaagtctttgctagtgcgaatagtgccacaatgaacatacgtgtgcatgtgtctttataacagcatgatttatagtcctttgagtatatgcccagtagtgggatggctgggtcaaatggtatttctagttctagacccttgaggaatcgccacactgtcttccacaatggttgaactagtttacagtcccaccaacagtgtaaaagtgttcctatttcttcacatcctctccagcacctgttgtttcctgactttttaatgattgccattctaactgttgtgagatggtatctcattgtggttttgatttgcatttctccgatggccagtgatgatgagcactttttcatgtgtctgttggctgcataaatgtcttcttttgagaagtgtctgttcatatcctttgcccactttttgatggggttgtttgtttttttcttgtaaatttctttgagttctttgtagattctggatgttagccctttgtcagaggagtaggttgcaaatttttttcccattctgtaggttgcctgttcactgtgatggtagtttcttttgctctgcagaagctctttagtttaattagatcccatttgtcaattttggcttttgttgccattgcttttggtgttttagacatgaagtccttgcccgtgcctatgtcctgaatgatattgcctaggttttcttccagggtttttatggttttaggtctaacatttaagtcttaaatccatcttgaattaatttttatataaggtgtaagaaagggatccagtttcagctttctacatatggctagccagttttcccagcaccatttattaaatagggaatcctttccccatttcttgtttttgtcaggtttgtcaaagatcagatggttgtagatgtgtggtattatttctgagggctccgttctgttccattggtctatatctctgttttggtaccagtaccatgctgttttggttactgtagcctcgtagtatagtttgaagtcaggtagcgtgatgcctccagctttgttcttttggct

SEQ ID NO: 46242 - DNA, 1070 bp, Homo sapiens
aggaccaacatcaaattccatctgagaatcctgtcgcttgtctcatttgatgctctcagggaggttggtagtgtgagtcaggatttaaccacccgacactgctctgcactccgtagcattgtcatactcacttgggacactagcagagctgtaaccagttctattttacaaatctgcaggctaaatatgcctaattcgctgtggtttgaggaaaagagatatatcatggctatgcctaggactccatgtgggccaatcctgatgaaaacaaccacaggacaagttggcagtggaaatgtcctaagatggcacagaatgaagttgattgccatgaaaatatgttgtgctggtcattctcaaggagtcaggcgttcagtctactgaaagtgaaggaaaggcatatctagcaatacttcttattttattttgaggagttctgcttttaataacattgtcagcatgcactaaatcattgtctctcaaggttttgagcagctgtgatgcagagggaaaagcacagggtgttttgtgcgtattggatgagataactgacctcatgcagggctgagaatacaacaggtgctttttacatgcacccactccctcatctatgccctttccaatggtccccatccacactactgtttttctgcatgatatgaaagttaagatataaatatgagagtatgtgagtatgtgtttgtgtttaagagatgccctcactctgtcgcccaggctggagtgtagtggcacaacatagatcactgcagcctcaaaatcctgggctcaagcaatcctctcacctcagcctcctaagtagctgggattataggtgtgagccactatgctcaaattattgtgttttaataagtcatcattcattttagaccagtgattttcaacatggggatgattttgctcctaaggggatatttgttgaagtctggagacatttttgtttattacaactcagggcaggaaatgctagcccctcaaaacaaagaattctccagccccaaatgtcagcaaggccagggttgaaagccctgttttagagcatgtattttaca

SEQ ID NO: 46243 - DNA, 1023 bp, Homo sapiens
cacagactgctcacagtctgatttaatttaaatcacagactgatttaatgtttaatgaaatctcttagctaatgtatgctaacactgaatggtgcttcaatataaatgctcaaagttggctttaaaaaaaaaatcaaaactcttcgagagttctactcttcctgtaggctgcctccatgtgcctggggacacaataccatagttgcaaagtgcccaaaagagcccctgccattgactgagtcatctcacatctctgaattatcttctgtttcaacttgaaccctccttttcagagaacagatattcccttttgcttacttaatagttaatttcaagtgttcccctgctctgggttggttattctatagtaaaagtctcccctgatcacttttgtgacttgaatgaggttcatgatttattattaactaactcctcagaatatacatatagttgtttcatttctcatctatgttatctgttatctatttagtggcttatctgtgtcacttttaaatctctgaataattttcttctgacatccatcaaaagatacatgtaaaagaaatgcaaactaattttaatatggatataaatgaatgaagaccattgacagtcatatgtactgttttgaattttcttcactttgggcttgaggagttgggagctgatagttccagagctcctgcctcatgcattgtgagaggcacattgggaggttatacaagttatacacgcaagcagttcatgtgcagccccgcagagacagcccctgagggctcgctcattgctgagttcaagggcaggggttaagtatgaggggaaaacagctctgtacataatttatatgaccacatttctagtccttactggttatctttctggataagaattggaatgaatagcttaaagggagcacttactgtgtgttggctgccatgttaagaactgcccttcatcctcactgtgaccttgtgtggtagtactttattatcctcttttgtggaagtgacaactgaggcctag

SEQ ID NO: 46244 - DNA, 1063 bp, Homo sapiens
tatgaaaatgcattggattcacattttctgtccatagattcttaaacaataaagaggtaataagaatgcacaaaaatagagaaaatatgacattttctaactggtatgacttcattatttactcaaaaattatgcttagaaacagttatatattgtctaagcttatacattgtagaaatgtaacagtagatttttgtttaagaaaactgaaagtattaaaatgttatgtgaccatagtacatattgctatacttgttttatatgaattatttttgtaccagataaaattatttttcatacttgtttgcttttaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttga

SEQ ID NO: 46245 - DNA, 1048 bp, Homo sapiens
tgttatttttttctttaaagacaccagtgggaatgctccatctcctttgtgtcttcatttcagccattttctctctgtctctttttacttctttcttttattgcttttcctaatttctctttattaagttttcttatcatctgttcttttattggcaccttgtaatttattcttcgttcctgacataattttgtcttttatttcccccccatttctttcctgagttcagtcatcttgttttatgtacgtattttggtccatttgtgctcttagtttctatatcgctgatgtaacatttttttcagtattcacaagtttttgtttgaaaatatttaattcggattcgattgatattcattttattccccttcattgttggttttgggggagagactttacagcaaaaagaaaaaacaaaaccattttattaacagcgttcgatgttttgcagtagttttgtgtgaatgtggtctacttttttctattttcacttcgttttgtgatcagggttcctgctttctgaatttcttattttgccagttgtgcctttctgtgcattttcttttatgaatacctgctggttgtagatagagttggcttgtcttgtttatcattcatttctgcagggtccttaagttttcactctttttttttttctttttttcctttttcttttttttgttattattatactttaagttttagggtacatgtgcacaatgtgcaggttagttacatatgtatacatgtgccatgctggtgtgctgcacgcattaactcgtcatttagcattaggtatatctcctaatgctatccctcccccgtccccgcaccccttagttcctacttttccttcacttgtttccaaggagtaccatctctgctatcttatttgattctccttcagaatcacagcttctctgaggctgcctggtcaggttctgagtgttttctagccccttacctctagccaagactatgaattaccaagtgctgatctgtgctcagtgtttttgtttttgtgtttattgtctcagtgactcttttc

SEQ ID NO: 46246 - DNA, 1025 bp, Homo sapiens
ggcttcctttaaaacaaaattttaaaaaatgctttaatcaggaagaaaaagcatcaggaagaaatttagcgtgtgggtcttttgccctcctttccactcctgtcctctttcctataatgtgggccccaagataggagtttctgaatagtcttcaagatgtaactctgtgtctattattttctattggaaaggagacaaaattagggttgttttataaatggtgccacagtttttagtctgacagcttaaaaagctttactgtgctaggtacagacttcagagtgtgatcaagccagtggtgagttattttagtcttcagaagtcagtggaaaactggacagtttagaacacaaatatatgttgggtttttttttccctctgtgaaactcagggaaataaatttgcttttttcttattttttttggtcctggaattttcttttctcagaatgttataatagaaagaaaaatggactttaaaatcagaattgaattcaagttctgtgtcatttgtctgtaattttgggcaaattatttctcatctctgaaccttaagttcttcatctttacacataattttttcaagtaccttttgctgcttcccttcaagcttcttttatttcagtattcccagtgttctttctcgttttcactgtattctcctccaaaatattatcctaacttttaaagtatttcttgtgttgtttcttatctattctccaaacgaatgttttggttttttaaaaaaatgtaatatggtacagacacactgggaagcaatttcatagaatagtctttatgaaaataatttgatatagaaattaggtaatttaggtgagaaatgttttttactgggtataggcataaatcttgggaaaaactctagggcagggggtgaatcctgaaatgacagtctgtttctaattaagacgtttttgtgaactaactattctataattaagacttctaagacagttataactactttgtacagatatttgtcaaatattttcagaagatggctga

SEQ ID NO: 46247 - DNA, 1063 bp, Homo sapiens
gaactcagattatgttgaaagagctcatctgttttcttgttatttctctttctacattgacctcattttttcccattcgaggaaactttttccacattggttcaggaatggctgttaggtgacggggtttgctgtaggcaactccaggtttaatttgataaaacttaaaaaaataaggagaggccgagtgtggtggctcactcctgtaatcccagcactctgagaggccgaggcgggtggatcacctgaggtcaggagttcaagaccagcctgaacaacatggtgaaagcccgtctctagtaaaagtacaaaaattagctgggcctggtggcacgtgcctgtaatcccagctactcagaggctgaggcatgagaatcacttgaaccctggaggcggaggttgcagtgagccaagaacgtgccattgcactctagcgttggcaacaagagcgaaactccctctcaaaaataaataaataaataaataaggagagtgctctttgtctcctaagctgttgaacataaaatcccaggaacagatctgattggcctaacttaggccacatatctgtctttgcacagatcaccctggccagggtcttggtcctatgcccatgcatttatgtgtgtttttggctactgtgattggtattccaagtagcagataccttgttagaaggtaattctgctctgaccagaagagaggaacggttggcaccagacaaaaactgatgtctattttgtctatgtaatggttgttttaactttttctttttacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaaggtaacatctcattataataatatttctatattaataaaggttttatgatgctccattcaagcatgtttatttattacagtatgacttacttctcccttcacagaaattaaggctgtgtcacattactt

SEQ ID NO: 46248 - DNA, 1993 bp, Homo sapiens
ggctaacacggtgaaaccccatctctactaaaaatacaaaaaaattagccaggtgtggtggtgggcgcctgtagtcccagctactcgggacgctgaggcaggagaatggcatgaacctgggaggcagagcttgcagtgagctgagattgcaccactgcactccagcctgggcgacagagcgagactccgtctcaaaaaaaaacgaacaaaaacaaacaaacgaacaaacaaaaaaagattgttagaacctatcaggttgattttccaatccctaatggattgagactactgtttaaaaaatgctactttagggaatatacctagaaatagaaaacctggattatgggctttgctgatcttcagctttactagatatggtcaacttcctgttgtcagtgattgtactcatttgtctctttctgttagtgcttccaacaatgtctatttttggccatttattccttaataaaaattttaggatcactttgccctgttcggtgaaattatgattttggtaggaattatgctgaatttgagattagagagagttgacatctttagaattttgactcttctcatctatgtctgtggtatatcttcccaacttttcttaaggtttccttttatgtgtaattatagaagtaaccttctataatgcttaccataaatatttacataccttttcctagttttattcttaggctctttataatttttgttgtcattataaataatacctttttaaaaaaattacattttcctagctaattattgttggttaatgttatgttgcccttctatccagcaaataaattcctaatagttcccatattttgtagattttctgggctattttctgtgtagtcatatcttctccaaatgccaatttttgtgagttttttctgcagattttctcttctcttgtgttcattatcattgtttgtcttaatgttgagatcttcagaacaatgttgaataatatgggcaatagaaggaatcttaatcatgtttctgactttaatgcaaatgtatctaaagtttcatcaagtattagatatactgtgaatttgtataagtagcctttttcttgatactattatttctttctattcctaatttgctaggaatttacactatgaatggatattaaactttactgtaaatttttttattacatctagtaagatgatcattttttcctcatcaatgtaataaattttatcgatcagtttttctgtcgttagatcatcaaatattccaggataaatcactgactctggtatataattcttttaaaatgcactgagaaattgatttgctaacattatttagtgtgtgttagtgacattaatagcaagattatgcttaaaaattagttgagtagctttctctcttctattctttgaggtagttgtagagggtgggaatttgttctcaaaggttggtaacactcagttgtagtaactcttggagaattttgaatactattccaatgtgttacttcttgctttatctggataatctatttcttctgaagtcaattttggtaaatatttttccaaaaaactgtttgatgtagatttttcagtttattattttcaacttgttcaagttattctgttatacttcagaatctttatgtgtctttagtcattctgcttcttccttaatatttttcatttgtacttttccttctttctcctttagacagaacagctagaagtttatccttattttttcgtagtgttttcaaagaaccatgatttggatttaaagacctctgtgttttgttttctgtttcactaatttttgcttttatattatttccttctgctttgtttagatttttctctgacatcctttttccagcctttcacatagaatggtaatttattgattttattttcgttttgttttgttttgagacagagtcttgctctgtcgcccaggctggagtgcagtcgtgcgatctcagctcactgcaacgtccccc

SEQ ID NO: 46249 - DNA, 1307 bp, Homo sapiens
ccaggtttttcactccaaatgcggaatttttgcagtatacagtcatcaaaaacaacacctagtaaatctgggaaacaaaacaaaaaagaaaaagaaaaccactagaacttatttttgtctgacttagtaaagttacaagtaacatctattaataccttatgttaatccaattactttctgtcagttattgaagttgtgattaattttgttagagtggttacatagtgcttgctacactaggatattagtcaaaatgggaagtttttccatagaggttgtcttcttgcttaagaaaactaaatcaaaatcagatactgaccagtatatacattttctctcaattttagattttcttccatttgtgtgtgatgattgttcaggaatattttggtaagttaagtttttatgcaggatttgggagtaattttagtgtttattaatatgaggttatttctgaaaagtagaatgatttaaaataattgttactttagccattgattattgatattcagtatagttatagactctgattacttctccatatatatgactgatttttaaacttccaaaagtggggttatgtatgtgaattttatataaaagttatatttttgtcttttaattacaaggagaaaataatattcacaatataaagaatatggtaaagatccagttataattattgctctttattttaattaataaaatgaaaagagcccaacctataaatgccttaaaataggaatcacagcatttgactacattacatgccaagtaaaacctgggaattaatgaagaattttggaaaatggattttccttacagttaaactttaaaatgtcaagcatttaaattataaaatagagcactgaaagaatgaatttttttcagaatgtaattcagaatgatttgttggaagtaaataaaagtaatgtatatttttaaattatttggaattagagcacttttcacattttactactgatgatcttttagaaataaaaagagctgaaagatatgtttatattttcatgcaacgtaaacgtaatttagggtggtgaattgtttttactcatattgaagttgaacatttgtgttttaaaacttttgagactatagatgctccatctttatctgacatttcagttttttctcatattcaaagttattaatgtagtatgagcataatgtatcttaagtatactgaacattaaaatatcgcaaatttctgcagttatctttaagtatgttatttaaataaacacttgctattattatttaagccttgaacacagaagcagggagtc

SEQ ID NO: 46250 - DNA, 1007 bp, Homo sapiens
ggagttgggggaggtcaactcgcccaactagtgttcacgtggatgtgtgtccggaagaaggcccttccttagcttttatcaaattctcaaaggcatcctgatcctcagattattccaccaaatggtcatcatgctctcccagctctgtcattccctgattctcattattattgtttgaacaaacatttacagattattgattttggtgcttggaccacataagggtgtaaactacagtcttttacacggaagacctttccaactagtaagctgcattttagagagaattagttaataatatggcaatgggctctccccattgcactgagagaccttgggatatacctagtccaaggtgatgtggcattggcttcaggatgccatacaccttgaaaaggcaagtttttgaagcattagaaccacacagactgctcagtcgttgttactaggtttcacacactacataaggtagcaaacaggtttaatctccccttggaacttcagtcattggtatcaagtgcctgaattaccgtgtcaaagactcttgagatttagcccagtttcagtggagttccataattgattagtgatttctactgtgggaatgcgtgataggacaggtgacacaatcccttctaggttcttgttacttatagccatctatctatctatctttcaccactggctgtaataacaagccagtgtgacttttttcatgtggaagcttagccatttgggttttgactgtgaattatgtgtgtctatgcctgatccttcgctagtgagtccaatacacattatatgccattcatgacatagttcattttcctttccagctatatatgtctttagtgtcaataactgagatgaggccaggcctatctgtttgggactagtggaaagcagttaagatttagactacgtcaagtgtatatcctaaattttatctaccttctggagggattgaaggatggtatcaggtgctgggaagttgtcttgacttaact

SEQ ID NO: 46251 - DNA, 1028 bp, Homo sapiens
tcccattcctccttttatcttgtgtaaaataatttttagtatgccattttgattcttctgtagaattttttactttttcttatttttcagtgactgctaaaggtattatatttcagtgaaatataaacttggctccaatatctctccgtttcctccctctttctttgtgttgctattgttatctattttacatatatcttataaacctaacaatacagtgcaataattatttctttatacagtcttttgtgctctaaagaacttaagaaatgggaaaatatatttcatagattattttatttaatccacgtgtttactatttctggccctcttcatttcttcctggaggttgatgtgatcatctggtatcacttcctttcagtctcataatcttcgtttagtttttcttgtaagacgggtctgctagcaacaaattctcacagtctttgtttagctggaaatggtcatttttgaaagatagttttactgacagatttttttcttccagcactctgaatgtgtcattccactgccttctggcccctattatttctgataaaaaaaaaatcaacctttatattgtttccatgtgcatgatgagccattttgcccttgctgctttcaagatattctgtttgtttgactttcagcagtttgattatgatgtattggggtgtagatctctttctgtttctcatgctttggcttcattgagctttgttgacttgacagattaatgttttatatcaaactttggaatttgttagccattatttcttcaaatactttttcactccctttttctctcccttctccttcttggactgtcattacttgtatatttgtataccctgtgttgtgcaaaatgtctctgaagtgctgttcatttttcttcaattgcttttttctctgatcttcagattgaaaatttctattgatcttcagattcacagatttatatttcggtcatattaaatctcctgttgagcccctcttgttaatttttcagttactgtgcttttcaactc

SEQ ID NO: 46252 - DNA, 1031 bp, Homo sapiens
tgggcggctgcctccacgatgccactgctcatcgaggggcagcgagtgcggctgccacagtccgccggggacctcgtccgagcccacctgcctctggaggaaacagccagatgtatcagaggtcagtctgttcaacaactgggaccccagggccttctgtatgttcagcaaagagagctcgcagtgacctccccaaaggatggctccgtctccattttgggttctgataatgccactacttgtcacattggggtcctgttgcacacaggttatggcgccacctgcttgacacattgtgatggaaccgacaccaaagctggggtccccttgatcatgaactccataaagtctttttccgactgcgctcaatgtggaagcctggaagtatacctcgtgggaggcttcagtgatgtgggaggcagttgtcacaaaaactcactcattaacttcttagtgaatttgacaggcaagaagatgacattcacttagtgatactatgattatgtgtgacagaattaaatgaccaggaagaaaacgaataacactttctaataatatatggcattgctgtcaacttaagactgcaaagatttacagagcctcctttcttttttttgtttgagacagagtctcctctgttgcccaggctggggtgcagtggtgtgatctcggcttactgcagcctctgcttccagggttcaagtgattctcctgcctcagcctcccaagtagctgggattacaggcgcccactgccacacctggctaatttttatatttttagtagagacagcgtttcaccatgttggccaggctggtctcaaactcctgacctcaagtgatctgcccacctcagcctcccaaaatgctgagattacaggcataagccaccgtgcctggcctacagagcctcctttcaagatcgaggtccagaggagcagctgcgtgccgcgtgagctttagcaggaggaccagtgattagcatttacgatgcaaagacagaacaacttcgtataggactgtactcctgga

SEQ ID NO: 46253 - DNA, 1023 bp, Homo sapiens
attttgtttaacatgtcttttaagaaactgttgtggttgtcaactgggttgtcgtcctaaagtatgaatctgttatatattaactgaagttgctaatggctacatttttactgactcatatgggggaacgaatgaagaaccaaggccaaacacaaaacacaaaaaaacccaggaaagtagaactttagggaggaggcgatctgagaggtaaatggctgaaatgctactggatttgtgtttctggaccatggctcctaacaccagaaagaagggccttttctggggtaggagtatttcttaagaggcctgggaagaatgttattgccttgagctaactggccttatgaagaggaccttaaactgaattgccaagttattagtattggtattcatagactttggagggtagcaggacaattttccattttatcctccatttgtttgagtggtgttacctgttctctcaggaggatatgtattggatgggggagcactgtgtatggaacttctcacaaaacagggctgtagctgtgcctacacaaaagaattggtcattatgcaaataaatgccatcttagtcagaggcaaagccagagtgcagtttggagctaataagaatcaatataatctagcaagagcccaacaatcctataattccattgtacagatgcatgagaaaaatcgtccctctggacatgctgccacctggccatgcttcctttccctttcatctttctcattgaccaatgggcttggagcattgagaccacaccctattctgagttctagtgtggccctggttaactctcctctggatcagttgcacatctgcccggtagatgactggatgtgtttagcagtggttgccaggatcgtgctgatatggccccaaccccacctcccaccctgcctgtgatgtctgaagaaaccctacagagcaaattggctgtggccaagaaaacattgagagaatatcagcatacaaacaactctggtgtaggtacaagagcaaaaaaggagaaa

SEQ ID NO: 46254 - DNA, 1058 bp, Homo sapiens
ccccattatttcaattagatcaagaactcaatttgtgaagtgtgagtttttaagataacttgactaaattaaatgcatcatttttactaatattttatttactaatattgttaattatatgtaatattcgtaaatgtcctgctaaacatattcatgaaatatcagaaaatgtaaaataacactgaaatcttttccaatatccaaattgttccacatcatgatgagcagtatactttatgatttttcttatttttaagtagtattttcattattatgtatgtacaggataagcagaattcagaattaaaaatctatacttcccttcagatttttaaattaattctttagttgatatgtcttaatgaatgactattggccccgaactttgtttctaaatatttgaactgcatacttgaattaggcaaggggatatctttgctcagtttgccgcctctgcattctgaggacatcttgctaaattctctcttaagtatcctataaaattgatttgtttattcattgtagtggcagcagctggtagatctgaaaagagagagcagtaattaacagtagcagtggaaagaaaatgaccacattgcttttttgctaacagacaaatgagcctaccagagaaaatactgtggttcgaggagttggtgtaagaaacccaggggatatcaagtagcaatataattagttatagtcactgtctatgcaaagctgaaataatcagttgaaaagtgaaaaatcgttatcagtaactaacccagctagtttgtctacatgctaggaggaaaaaaaagggattgagatttttttcacactgctcaattgattcatgtttggaacatgatatttattattgttttgttccttggggcaaagaattagaaaacctctacagcaactttataggggcaacaacgttgtaaattcactcactgtgttgtttgttgattggttaagtgatttaacatcgggcaggttaacttagacctcaggagaaatatttttacaactaaatgagaaagacttccttagagagttccgtctcacct

SEQ ID NO: 46255 - DNA, 1049 bp, Homo sapiens
caagatcaaatattttaagcacttgaccttgatttttttctaaggccttattttttccaaagctctttaaatattgcttattgctcattaaatcataaagaaagcctcaagtttagactaaccttttttatattaatcttttacttcttctttattttcttttttttttttgagataagagtcttgctctgttgcccaggctggagtgcaatggcacaatctgggctcactgcaacctccacctcccaggttcaaggaattctcctgcctcagcctcccgagtagctgggattacagacgcccaccactacgcctggctaatttttgtatttttagtagagatggtgtttcgccatgttggccaagctggtcttgaactcctgacctcaggtgatccacctgcctcccaaagtgcaccccgccttaatcttttacttctaataatcatcttttaaaccaagaggaaattttttaacaatagccaagtaaagtgggaaacctgtatgttggcagatagatcaattatgagaatttaaaataatcatactttctcaaatcatactttctcaaatctgtgcatagacatcaaagaaatatttattagtttacttaccattaggcagtaaacaaattcccttataaaagagacattatgaaaagactttgaaataggagtcattttgcttattcagaggagaatgcagcccaaattcttgcaggtccagtgttggttctacaggacagcatttcaaacatggtgtttaatctggaggaaactaaagattggtgaggtattcaaaagggaaagagccaagtcaagaataaaagagaggataaagataaacagttcaagatcaggaaaagaggccatttgttaaagttacttgtcaccttgaacagctgttattggaccactatacttacaataattttcacctaagaactcattctagagtttacctggtgtgtgacatgcatctaagagctatcatcacattttcaggtcaaatgatagatcagccacaggtatataatttccttctccccaa

SEQ ID NO: 46256 - DNA, 1018 bp, Homo sapiens
tagaataacaacttgtggagaaaaagaagaatacaaataaggatatagataatctagtaatacacctagctcactataggaataggtattacttattgaggtggattataatgtttgcatattttaattttttaaaaaaagtatttgaatgggcatagcttcaacccaatttcatgcattcagccaccctctcaaattagttaccccagtgtgccactggctctcccctcctactgctcctcttccttcccctcctccctctcttcccttcttttccccttttctttccttctctctttctcaattgcactatttcttgaaagaaaaatttacaatccttttgtcttttccacatcctcattctttcctttttataattttgttgcactcctcaccacttcactagacctatttcatgaaaggtaaattatatagtcatcactaaattgagtctttatttcctatcttactggacttcctcatagtatttaatactaataattactctgccattaatatttgttctaggcaactccttggtggtaggactattcattttttcctatgctggtagagtacctagctcatagtcttcaataaaatgttgacttctagacattagagtttaggattttcccctcaccgtgttaactttttaaactaattcttgtgagtttacatgaccccaccaccaccaccacgttcttaacttcctttattatttctacactctttcctggaccctcgttcacagccatggctttagctttatgactatgatgtgctgtgaaactcagattcacaatttccacccacttgctagacaaattgatttgaattttttttagcttcccagattcaatctactaaatttcaaactcaccactatcccttccctcccctcgaaattcctcctgaattatctaatctatttaatggcactagattctcttgtttacctatcgattaaaacttcacaagttcttggccttctccttcctttgacgcatatgcccca

SEQ ID NO: 46257 - DNA, 1045 bp, Homo sapiens
cttctttctttcttttgcaggagtttgtggtaacttgagattcaagacaagagctgttatgctgtttcctagctaggagcaggcttgtggcagcctgattcggggctgacctttcaaacccagagggttgctggtcctgcacatgagtggaaatacactcatggggaagcttccatgatgcacagtatctgctgttcttcagtcctttgtctttctttgtcattcagttctaggcctttcctctgcacgctcaatgcccagtaaaatttcaggattaactaaagaagaggagaaaaagaagaaaagattcttcttaaaagtttctaatgttattttccttctgaagtctgagcccatttctggggggagaaaaaaaaagcaaatcagaaaacccacggtttttctttttttctttttttctttttttctttttttgctttaaaacaaagggaaaaaagagtttaaacaaaaaacccacaattgaacttccaggaaagtgtgaagacccaaaacagctttgtctccaaagaagatagctctctgactgctttggatagtctcctacgcaccattttgtcaggtgggagatttggaatacacatgcaggacgttagactgttgggacagccattttccaacaaccaaggggccaaaatatctgcaatatagtaacagccttaataatacatccatttttcgttttatacagctgttctcagctatgtcctcagtgtttcatcgcatttatattcatagctattttcaaacacgaccttttaattgtttttgaagtatttctaaaccccttctttccaccttactcctccatcattgtgataatcttcccaagttgtattaggccattgccccaggccttccatgggtctgtcaggaatattcgttacaaagcagagcaagaagcagtatgtctctgaagtggattacagtggcagttattttacaaggatttgtgacactagtaacatacccgtgtaaccctttgagaactatcagaccagctttcagagtcttaggattgtcggtc

SEQ ID NO: 46258 - DNA, 1022 bp, Homo sapiens
ttgtaaaatgatcctaaattattgttttgcattatctgctaggagagggaaaaatgcatttatgttgacaaattcatacccgaattatgttcctacaaaagagtgtaataaaatttacattccattaacattttcctgaaatgagatctctctgaatcctatgagtctggcatataatataggtgcacagaaaagcatcagtgggtgaatgaatctatgaatgaacagactaagcaagaaaggaaagctatacccaaacaatgaacaccagttgtttgaacgacagcattgagagaataagaaccacaggcagatactagcagtaacatttgaatttcaattctaccacattcaaacacagtaaatgtgactaagtcaattgtctttgaataatatgatacccaatgctctgtcattgcttaaattgagtgacaattcatactaaatctatggttaggacattattatagagaacattgtaatatgtgatataaaagacttgagggatttaagcacaacaatatatgtatataaatttactttatagctacaaaatgctacatgacgtgtagttatttctacatgaaaagcaactacttctcagaaaactaatctggttgctaggtatgtattaatgttacttaaatcacatgcaggatgtgatcccattgtcctcaggattttaagttattccaaattttatttattattattatttgagatgaagtctctctctgttgcccaagccggagtgcagtggcactatctcggctcgctgcaaccttcgcctcctgggttcaagcgattctcctgcctcagcctcccgactagctgggattacaggcgactgccaccacgcccagataatttttgtattttttagtagagacggagtttcgccatgttggccaggctggtcttgaactcctcacctcaggtaatccacccgcattggcctcccaaagtggtggaattacaggtgtgagccaccatgcctggcctattattattattttgtgaca

SEQ ID NO: 46259 - DNA, 1050 bp, Homo sapiens
actgttcagttttttcttagaatcacctcttaatcctaaccaaatggagaggagatagagtgctaaaataccccacagcatttatctattgctaaataaaaaattaccccaaaatccagcaacttaaaacaacaatttattatctcacatggttctgaaggttagaaatccaggagcagcttagccaggtggttctggctagagttatttcatggatatccatgttggccggggctgcactcatatgaaggggttggaaaattcacttccaagctaactcatatggctgtagaggaggcaggggtggggggaggaggggagagagagagagagataagatggaagtcatggatgtatcgtatgacctcgccttagaagtcaaataccatcacttctgccatattttgctgtggcaaactgataaaaccctgatacaatgtgagtgtgagatcaggaggtgaggatcactgttgtcatctcggaggctggctcccacatatctctttagcttctcaactagagaaaccaactgtacacatagtctgatagggctgcaggttgagaagacctattccatcctatctatccactaagcactggagaaatttctactaatcacatgtttggtgatgatttctgatttttatttctagatatggactgtactattttaagtatttatatatttaaaattagaaatctgttcaaatttattctgtcagtcttttaacctacaagtgaatattaagagcatcagaagttttcagggcaattatggtatgtgttacaatcaagttatatatgaaaggccaagtatacacagatgtagagggacagaattgacctgggaatttggagaaggcttcatggaggagatgactttgatttttcttttaaaatattaacaagatcttgcacaattgacagaggcaagatagaagatatatattaggaaaaaaaatgctgagtttcaacaagttttagaagacagcatgcaaagataaactttgcaaagctacaacactaggggaaactgtaattcattgaaac

SEQ ID NO: 46260 - DNA, 1049 bp, Homo sapiens
aaatacaatattggaaaagtaatcagagactaatcacaaagcttgttataaaacacacctgcaggattgggtaataattgaaagacattataatccctcccttagaagcatatttaaattcttcttctgtttcttctttcattgtactcatcaggcaagtctctagttctttgtaaattcagctatacatatatcctgtgcttgtacttaagtaattgaacatacctgaaaaaaaaatttagtgattggtctcactttaaattcatcgtcataaatctcagacactcaactctgctgaatagtctactccttctatggtacgtttgctttcttagtatccaaaatgattattttataccttcttctcttcccataaaactagtatttctctcaaagtcaataaacgttagcaatgttgatgatgatgatgatgatgatggtgatgaagaaaatgataaaaataacagctatgacaaccaaggttgatgatgttgctgttttgtggtgtcccctcctgttatgttatcaggactttgatctatacttacttttttctattcttgtaacatcagtttttcttgtctatactcaggttgtttccattgacatataaccatatattctttgccgttaaattattaaggggaaattgtatttgaagatgcctattaatattttctattatttataagcactcagcaacaattctatgtggatttttaaatatttgaatcagaaaatatatttcacaggttaaaaaaccctttaaatttgtaaaacattgtaacaaatggacagttgatttcaaacattctaattaggaaatcatgttgataaatgaccatttttaaaaatttactcaatttaatttgtagctagaatatacagtagtgctattctgtgtcagaattgatatatgatatatcactctgtgcaagattaaccagagtgaaatggcatgttcctgggtcaagtcggaggattgaggaccagtctctcatcaaaggcaggttattttctaggccaggtgcggtggctcacgcctgtaa

SEQ ID NO: 46261 - DNA, 1726 bp, Homo sapiens
ttttatttgttcaagttcaaagaaatgagtgatgctgtcttttaaaagcaatggattaaatttttgagaatatgtttattctcactgtcatttagattatacctttatttgaagaacatactaactaaattggattttgttactctaacagatatttggaattggtaatgaatttaattagatagaggcccacttaccagttcaaagctactttttatccattaatcatcaacttttagcattgtctcttaaaaaaaagcattaagtagtttcggggtaagggtaatcacttagatcactctcagctaaataggtaataagaggaaacagtggaaggagggaaggtagtaagacataaaaactagtttctataacttagaaaattatatttagtgttaggagtttcaactcattctcttttatctatttaaaataatcaagatgtactcagtatggataatgatataaccaaaaatatattaataattgtggtgtgtcatttactcttaaagttttatgcagttttcacatctgtgttcattgcctgttgaactctagagcgttaagtggatagacatgaaggcactgtgaactccttgaggtcatgtgtagcatttttatatgtgcatttttcagaagttctttcttcaggttctcaaaggggttcaaaacccattgtcaattaggcattgaaactattgtcactgtatgttaaatattaaaaaatagagtaatacttaaaagaggcttataggtttttgttattttttaatttacaagtataatttcttgttaaatgttcatcctttcagccatgtgtttctgttgcatatttggtggtgtgaatggattaaataatacttatagatttccatatttagctttttatgaatactagtgagtgaaaaaactgtttaattatccggatgctagatacaacttatttcattagcacttcagaaagtgatcgttatctcatagagtttgcttctcccaatcatatgatttctgttatgtatttacctttcaaataggtattgatttattaacatttttctcatcctgcaatttgggtacataacagccagtattatttcaagactgtttgatctgtctagctaggagagtagctgcacctagtggcgagggcccctcacctggtgttcacacgggttaagtatatggacatcaggctactgtgaactctctgaagttgaatgcggtatttgtatatgggtatgttcttagggtcctttcctcagattctcaaggggatccataatcccacaattgattaagagttaaagctactgacactgtgaactaatataaaaagtgaataaaaattaacacagagaggtttgaacgattttgctaacttctaattttaaaatataattttgtattaaatgttaatctctagcaaagcaggtaattcttctagaatagttcttttttaataactattgattgtctttcaaggtattattttcaggaagcagcatctattgtgcaatggaataagaatggactttgtatccaagctgatctaacttaaaataatatctcctcaaaatactagttacgtagaaccttagggaaattatttagcatgtctgtgtctcagtgttctcatgtgtaaatctaacatcataattcttacccagtactactaacacgaggattacagataatgcttacaaagcatctagtgaatatcaagtca

SEQ ID NO: 46262 - DNA, 1040 bp, Homo sapiens
ttctcttattaattctagacaattgtagtgtctagttgttccagagcagtattaagtaatttttgtgatactaggcataatgtcttttattctgactaagggaaatggagactcatttgttttcagttgtcaattattaacctaaaaaagaattaagatactagttactttctttaggataattcattctagaatctttatatattgctattaaattaagattgatggtgaggacatagcatgaccagcctgacaagaattgaaatttgttattgtctgtttttctatttaacattctctatttccgtcttaatttttaatggattggttgcttcctcctatcacaatgataggaggacaaaatttgttttcaaataaaaccagaaaaggatagttgaatatttgatggaatatgagcattttattcaagactttcattcaagactcttcatttcatgatacaaaaagccaatttgaactaccttaagcaacataaaaagtttattggaaattgctaatgtagttcagagattgttggatggagtgcaccaggaaagtatggggcagttgcagatatcttaaacgtgagaccttgatttggttctctgcttgcctgttggcatatgggaatgctagcaatttttgcacattgattttgtattctgagactttgctgaagttgcttatcagcttaagatgcttttgggttgagacaatggggttttctagatacaggatcctgccatctgcaaacaaagatagtttgactttctctcttcctatttgaatacctttattcctttctcttgcctgattgccctggccagaacttctaatactgtgttgaataggaatggtaagagggtatccatgtcttgtgccaattttcaaggggaatgcttccagctcttgcccatttagtatgatactggctgtgggtttgaaatatatggctcttattattttacagtgtatttcttcaatacctagttcattgagagtttttaacatgaagggattttgacttttattgaaggtct

SEQ ID NO: 46263 - DNA, 1045 bp, Homo sapiens
ctggtagttacatgtatgctgtagcctaaattaagatggaaaagaataggtttcagtcttctatatgacactattctatagaaataaaatgtctaactataaaagattgggtgatcaaggcttagctttgggccatgtctgactctggaatctgtctttggattcctatggcttaaaatacccgtatgaagagaactgccagtttttatctccagttggcatctctcttctcagctctagcctgtattcccatcgtctgcttatccatcttactgtgtacaatgacagatgttctgatctgccctgtctcagtgtttcctctgacactacttcccaccactgtgctggtatcacctaccacatgggtgttcaagttaagagtgggcaccaaatccccagttttctgccccttactctctacttctaatcaattgcctcatttcctctaatgtatatcttaagtctttttatttctgatgtctattttgggttgcaaccctattttaaatcttcgttatctctggtcttgacatgttatattatttataacatggcatgcaagacctctcattatcagcctcacccctttctctagccctgtagctcagagttcatcttctgctcactgtgatctagtacagtggttctcacattaaagatggctgtccactcctaaacattaatgaaaacccagaatcttctattatggtttatatccatctatatttatggtattagataaatctaagagaatttttaaatacttatttagaaattcattaaaaatgacatgtcataaataacatttttatgaaaaaataattttacaaaacaaaatagtaagaaaggtggcattgttttagatctttccagatactttaaatatctggcttaacaaaaaatagctagattctcatatctcctatctccttatgcattcacacttctgatgttataaatcacaaaggctctggtaaactcaactgtcaaatgcaagtgaatgagagtaaaaaggcaaataacatcttattaaaattgtttgatt

SEQ ID NO: 46264 - DNA, 1050 bp, Homo sapiens
tacaacatatgtgctctcctgtatgtatgttatccttcaataaaaaggttttaagatctataagggccagcattaataaaactgttctctttatatatcagatggttttcatcactttgaaatatcttatttttttaactcaaacattaattatcacctaatgaacacacttctgatcgagataaatacctgccgactgccactgagagtagaaaagcttgcactatgctgattataacatttcactgtcaccaactggatttgaccctaacagatcattgcctcattctttattgtcagaaagaagcattcaaagacaattatttttcaacccaaatcatcatttttgaaaaatgttcttcacagttaggttgacttatagccaaaacctttgtttagcaaatcaggtaatgcagtttgttatcatatattttgcaaataaccgagcttggagggggtttcacaaagtcccacaaatatttctgaaatttaagattgcaaggatactttttggaatttatttatcattatgctgaacatttgatttaatatgctttgaatgtcctatgctaaaattattttgaccatggtttattatcaggggaatcagccctcagtatgtcaacgtaggttcttttctattttccctaagtgtcggccggtctgagaaataaagggaaagagtacaaaagagagaaattttaaagctgggtgtccgggggagacatcacatgttggcaggttccctgatgccccctgagccacaaaaccagcaagtttttattagcgattttcaaaggggagggagtgtacaaatagggtgtgggtcacagagatcacatgcttcaagggtaataaaagatcacaaggcagaaggtcaaggcaagatcacaaggtcagggtgaaactagaattgctaatgaaggtccatgtcccactaggcacacattgccattgataaacatcttagcaggaaacagggttcaagagcagagaactggtctgacaagaattcaccaggctggagtttcctaattctagcaagcctgg

SEQ ID NO: 46265 - DNA, 1031 bp, Homo sapiens
aacaaccagatctcgtgagaattaagagtgagaactcactctttactggcaccaagccattcatgagagatctgccctcagagcccaaacacctcccaccagggcccattaaaacattggggatcaaatttcaacatgaaatatggaggggacaaatatccaatctatatcaaagaccttacctcaaaaatacttgaaggcagtagcatctccaaggatcaatttcttttttaaataggtatatgtgcctaggtgtgataattattttcaatgtgctaaagctatttcagcccaatgacttttctgtccttaatattaaacctggctaacattcaattaaaattttaattaaattaaattgtaattaattatattaaagattttttaaaaattaaattttaattaaattaaagatttaaataaaattaaattagatttaaattaaattaaattaaaattaattttccccatatcctctccaacacttgttaccttttgaatttttgataataatgtgacttaatattaaccctgagtttcacataaatatagcttgagcaaaattgaatatagatttaaatgcctcatagtaattcataagatattggcggtaaaatatgtatacttagagtccacgatgactcagcttttctaatttgaattattttgggatgcccatttatatactccatcaaatagcatataaatttcaaaagagaaatagccatttaatatacttgttccataatacctgattgtcttatactgaatgttcttaaaatgtaggactgctttattgatatgttgtcaaatggtgtacgaagacaaatttacaagcaacaatttctgacaagaaaaatttacttaacttcacatatatcatacaatttaaaatttgtgttcagagtataattgtagaatatagaagactatgggacagtgaatgtaatatggactttggagtcattttacctaaattcaaatgccaatttctctacttctcaaagaagaacccagaagaagctgagttg

SEQ ID NO: 46266 - DNA, 1049 bp, Homo sapiens
ccactctcttaaaagtactttttcatgtttatattaggatgtcagtatatgtgtgtgcgtctagtgtgcatgcccacgtgggtacacatacttgtatgtgtatctgtgtgtagtatacatagttgattcccaagtatccttgtcatttatctgattagcatttattccaaatattttctttcttaaaaataaaactattattaatagttgcaatgataattttaccaatagttaaataaaataaaatagtattgttgttaatagttgcaataaaatatgctaggttgggttggtacacctacactttgtccttctagcttctggcacagtctcccctaatagtgtagggacacgtagagtaaactattttcacattgatatgtgtttatatttgaataatgaccaacaacatctgtctctcttttccccagctggttccaagcataagagtttaaccctatttttcaataagagcatacaacctgtctctaatgaaaacaaagggcaataaaagctgagtaagtagagtcaaagacattttccagaaaggccacttgatggaccagttagttgggtcatgattcatagcttgagttgcaaaaagaaaaatggcacacaagtcaatgaggtccattggaaacaggacattataggttaggcatatgtgaaatttgtgcaggaaatatttcactgcagatttatcgaagatagtgtttgtgcccttactatttacttactgcatggtataaattcataactattttgcttttaatagctattttgtttcattttgccataaagtttttgacactaatcagttcaaaaataaagtgcatgttaaatgaaaaataactactgaattttgctttctcaagagatttcctgttgaatgtgccacttgcacgtaatctttgacatttaccatctgcatcatcagagaagcattgaagaccgcataaaaatgagagatacaaatctgctgatgaatcatcaatatctatgtcaaaagttgttacctaatttaacaagactgtgcctaaagatgatga

SEQ ID NO: 46267 - DNA, 1663 bp, Homo sapiens
ggacatgtcatctcctatgataccagtgccttttcctgtaatacttcctgaaggacttgcctgaggctgttttacagttagcttttcttcaaatcagataagtaggagtacatgctaaaataacaataacaaatatagtgtagtatgtaaaccagtaacataattgtatattataatcatctattatatatagtacagtaaatgacactgtactttatagcacatgtaatcatctcttatatacagtatggtgaataaataattactgtactgtatataatagatgatgattatatattccataaagatacatgctctacttttatttggctagcagtgtggtaggtttgtttacactagcgtcactacaaacatgaataatgcatggtgctatgatgttatggcagctaccatgacatcaacaaggtgataagaatttttcggctgggcactgtggctcacacctataatcccagcactttgggaggccgaggtgggaggatcacctgaggttgggagttcgagactagcctgaacaacatggagaaaccccatctctactaagaatacaaaattagctgggcatggtggcacatgcctgtaatcccagctactcaggaggctgaggcaggagaatggcttgaacccgggagatggaggttgtggtgagccaagatcacgacactgcactccagcctgggcaataagagtgaaactccatctcaaaaaaaaaaaaaaaaaggatgtttcagctttattataatcttatgggaccaccatcatatatgaggtctgttgttgataaaaatgttatgtggtgcatatctgttttaaaccaccacagaaagctttcccctttttccccaatataagcattttaatgctgtaaatttcccgcaagaactgctttggcttcacaaaaatttcatatgttatttttatttccattaagttcaaaatattttctagttccctttgtgtcttcctttctttcccttgaattatttaaatgtatgttgtttaattgccaaatatatgaaaattttccagttatttttctatttgctgattctaatttaactctgttatggtctaagaatatatttccttttacatttgtaatgtcttgttttgtggctaagaatattgtctatgtttgtgaatgttctaggtatacttgaatgtatattcggccatcattgggtgtattctataaattttaattaggtcaatttagttaataggatttttatattttcagtatttctgcttatttttcatccacttgttctatcagtgattgcaagaggagtattgaagtctttgggtatatgtgtctatttctcttttcagtttttattagatttttgttttatgtattttgaagctttcttactaggtgtgtacacatttaggatttttatttattcttagtgaattaagctgtggtaaatatgtaatgaccctctttctcctcagtaattttctttgttgtcagatttactttatgcggacattaacatagctactccacctttctttgtttttagttttaatggatatttaatagttctacatattttgggggtatatgtggtattttaatacaagcatataatgtgtaataatcaaatgaaggtaaataggatatccatcacctcaa

SEQ ID NO: 46268 - DNA, 1044 bp, Homo sapiens
tcttggtcttcaaaagtcctaggttgctatcctgggctgagttccttagaagcaaaacctgagacagggattcttgggcaaagatttattgtggaagtggctccagtgaaatctttaaggtaatgaagaaaataggataagacaaggaaaaagctaggcaaaaaaatcagctgggtttaaatgcacatttaaacaaaattggtctgattcttacttaagtttggactcctttgaaagcatactatgacacatgatttaagcacaagtattaataatttgtctgggagttaatcccaggaggcacaactgaaggagaagaaggaaaagaacacttaaagaagtgggttcaactgatgccacagtgagctccagaataaaaatggaacccacagttttatttttgacaaggacaagggggaaggctttttgtacctctttattagtcagtcactggctactggctaccacttggaggaagggtgtaacctctcaggcatttctgaactaggctgctcctgttgctaacaagcagttttcaaaagggtgcagctgtgagctggtgaccattggctcacaaaaactgggggaaatgtgcacctgcacttgcttgtcgcaggggatctgtgtgggttactgacagctctcctatggccactctgccatggcaacttatcactcactggtcagactcctcaaggccctggccttctgcaaagctgctcatctccattcatctctcaagactccccgtgcttcattactttatgttcatccttattgcttctacatgaaaatcaacttttgatagtgtacaaaacaatttagctctcaatccccttctaaaataaggccttccttggcctaccaaaaggctcataaatgtgcttagccagccaatgagtcacttgctagacttgctctggttcttgtataatttcatggaaaagcggagagagaccttgaaatttcagccttcccctgtccttacccatttctgagtgtggagctatagtttatcactgaaatgaaggcctgtgttagcag

SEQ ID NO: 46269 - DNA, 1019 bp, Homo sapiens
tgattgggtatgtgttcttggagatgtactttgcaattctctgatgactaatgctgttaagaatcttttatatatttattggccatttatatgtcgtctttggtaaagattttattcaaattatttccagacttctatttttatttcttattgttttaattcaacttttattttagattcagggggtacatgtgcagatttgttacatgggtatattgcatccattagtgaacatagtacctagtaggtagtttttcaacccattttctcctctctacctcccccctctagttgtccccagtgtctattgttactatgtttatgtctatgactacttaatgtttagctcccacttataagtgagaacatgtagtatttagttttctgtttttgtgttaattcacttaggactatggcctctagctccatccatgttgctgcaaaggatataatgtgtcagaaaactaacaaaggaactatggacttaaacttgacacttgaccgcttaaattaaatgcttggccaaaggtttttatggctgtttagtatgccatggtgttaatgtaccagattttctttatccaatatgccattgatgggcacctaggttgattccatgactttgctattgtgaatagcatggtaatgaacatatgagtacatgtgtctttttggtatgatctattttcctttaggcatatacctagtattgagattgctgagtcaaatggtgattctaagttccttgagaaatctccaaactgctttccacagtggttgaactaatttacattcccaccaacagtgtataagcattcccttttctcacagcctcaccagcatctgttgtttttttactatttaataatagccattttgactggtgtgagatgctatctaatcttggttttgatttgaatggctctgataattagtgatgatgattattttttcatgtttgttggccacttgtatgttatcatctttgagaattgtctgttcatgccctttgcccattt

SEQ ID NO: 46270 - DNA, 1025 bp, Homo sapiens
tgctgaaccatgggcaggtaccttcaagggctatcccagtgattagcccccaaacttgtaaccaccgaaagggttcttcttgcctgctgccaacatgaagccaatttaccaaaacaggagaattacaataaacagttcaattattgagtcagctaaattagagaccatagttttatggttactcaaataaacctccctgaaaattcagatgttagatttttttaaaagatagattggggagcagggggctatggaatgagggatgttgattggttgggttggggatgggatcacaggaagttggagctgtcctcttgtgctgagctggttcctgagtgggagccacaagaccagatgagccagtttactgttctgggtggtgccagctgatccatcagaatgcagggtccaaaaaatacctcaaataccaaccttaagctttacaatagtgatgttatctgtaggagcaattggggaggtaagaaatctggtgccctctggctgcatgactcttgagacataatttctaatcttgtggctaaatttgttgtttttccaaaggtggtcgggtttctaagcaaagaggggtttgtggtggggaggggctgttactatctttgtttcactgttaaactacaaactaaattcctcccaaaatgagtttggtgaaaaaccaagaatgaccaggcttggaggttaaagataagatagagttggttaggtcacatctctttcattgtgataattttctcattgttataatatttgcaagggcagtttcaatactattattattgtcatcatacagaggagaaaaatgaagcccagaaattaagtaacctggttggggtggggtgggcaaaattatggctcatggaaaacaatctttaaaaaataaatgggagagaacaaaaagataaaagtaattgattaaaagtcaaattattaggggtctgatatttcacccttcttggaagataacaggttgatcattttgtcatagttttatggatggtaggagacgt

SEQ ID NO: 46271 - DNA, 1048 bp, Homo sapiens
agccaaaatagattctccagtagagccatttttttttttttttaaccctgaaagagcaggttctacaacactggccaaaattttgtttagccattttttgcatagatttcattatggactcaacccttccagcaacctgtagaatggaaacagttttcaaaccaaggccaatgaaatttgaggagaccagccactaacactgcatgtttaaactcaacttgtattctaatttctagaatatcagtatctgagctctgactggattgaacttcagaggtcatttaatgtctcatccatagatcttgaagtggacagtgacttgcctaagtggacataagtgcacagtggcagagccagagctgaactcagatttagtgacctctcatctcaggccattctctgatttggtacttgaggttggtattgcttctctgcaccacacttgactccagtgtgtgataattctgactgattttgattttataactgttaaaaaagtatgcactatggagtgtaaatgaagaggaaaaagtagaaccacttaagtaatacattacatttgaaggaaaaatttatgtgaataagttttaacataaaatcttaaaaatttatgggtcttaagtatatatttttggatatttatgataaattgatacagaaaacaggcaaaaataacatatatagtatgattccttttaaataaaatgagtatcatatagaaactagactagagaatatattccaaattgttaataatggctgggtctgagtattatgggtaattacaatttttttccattatatctgccttctattctgataacaaaaataaattttaatttgtattgcatttttattcaggagtgaataaatagtttagataaatttttgagcaaaattagagtattttgaaaatagctaaaatttgttagattttaaagagaagactaaactgtgattaataccttatctcttactaatttaaaatattcttatatattcaggtttataatttataaaaataccttaagaaggttaatattctcta

SEQ ID NO: 46272 - DNA, 1035 bp, Homo sapiens
atagagcagtgtcatgatcttggtttgagtttaaaaacacaggggaattttagacccttggaggaaacattagatgctgggaggctggtaaggagaccagtgtgagtgaagaggtgatcatggtttggacaggggtagtagtggtgatggtggtgagaagtggtcagattctggatatactgtacatccttattagcagattctgtatttgcaaaccagcctccttgctaaagtttatttgtaaccccaaaatcaatactcaatgtctcttacagtcattcacagaccagcatatgcacaaagtagcgaaaaatctgcctgctgtgcatgttccctgctgagttctaataagatgatgctctgccttctcatttcaggtctcatgttgtaaacaagtttccttttcgtggtatatttagtgcccatttttcttcatttttgtcccttttgttggtaataattgctatttaaaatagccccaaatgtagtcctgaagtattatatagtgttcctaagaacaagaaggctgtgatgttccttacagagaaaatactaaagccagatcagccttgttcaggtgtgagttatagtgctgctgctggccgtgagttctttgctaatgaatctacaaaatagatcactgtgtctttaaacagaaacacacattaaacaaggtatacgtggatcagttgatgaaaattttgtgaacaaatacgtgtcagaacataaccctgtatttcccctaggggcaatgattccatattagctaattcagtatttatagtgactttatagaacataagtactgttaacaatgagaatcacttaattttaaagacagtgacaggatatgttaatggcttgaaaatgggttatgagagaaagaggactttaaggtatttggcccaaacgacagaatggagttgccatttgcttatgtgggaggagcatttttagtgggtgagaggaaatcatgtttgatctaagtcacactaagtaagaaatgtctttagacatccgagtagaggtcataag

SEQ ID NO: 46273 - DNA, 1056 bp, Homo sapiens
ttaaggcaaaaggcaaaatggaatgtagtagaagaaaatttaacaattctgactttgggaacagtttcagaatcaagggcaactatgtatattttttaaatcctcactttgttttatatatatatacacttctatatattaactgtttgtctttctccccctttctctactgttttatatgatatgtgttggttggaattaacattatcatttattgtttacattataaattatctatcaaagaggggtcatgcctgagctacaaaataaatgaatattactcagacattgatacagcaatttatgggaatttttgtctttcttttttgggagagaatttgcatgtgtctttgttagtataagatatagttttattatgttatttggaagtgcatttttgatattattattgtttggaaggttaatgatgggccaaagattgtgaatggacactgaatatccaaagagtagaaattaccagatattgttacagttccatccctgacattttaaactttctctatactacagcagcactgagcctggaaactgctttttcccttgccagcagagtgccagctagattctgtcaatggaagtctcaagcacacagtttagaaggcagcagaagcctgctttagaagagctgctactgttcttgcttgcagctgtgggcacttcctgagaatctctcactttggcattgcaggcagttgagaccattggtggaagcttttccctgcatttggcctctgttcttttgaatttccccaaagagttcttcctaacatttgcccctcccacttcctgatggttctgtaataattttttttgtgtgttaaacctcttcctatacaaaatagctggagtggctttaaaaaaattaatttattttaataattattattttttagagatgggtctcgatatgttgcccaggctggacttgaactgaatttgagtaagcctcctaccttggcttcccaagaagctgggattacaggtgcctgccactgtgcctggcttggagttgacttttattttcctggctatact

SEQ ID NO: 46274 - DNA, 1051 bp, Homo sapiens
tgatacaaaatcaatgctaaaaaagaagaaggtgagaatggatggtgagtaatccctagcactgtctgccacttggtgaagggaatgaaatatggtagagggaccagaagagttaggacaggaataggaaaaggtggggaggaagtgttatgaaaggcttaaaaaagagatgggttaaaagcatgaattatcagctgatgaggctattattcttaagtggaagcaaaaatgggagctgtgtgactgatcaaaagacgcattaaacacaataatttgtgttttatttattcattcagtaatttctcctttgaggatgcatatgtagtgtttaagaaatagtatagagatataatagttcttggcatacctacttgaatcatgaatgaccttgaacactttggaatagaatttctaaattttttgaacatgaaattttcctcactggaacagttcatattttcatgtgtggtgtggactttatcaataatatatcatgtgattttatttctgtgttttgacttacagtttctactgcctgaatccaattaaacttcagcaaaaacattcaagccaagtgccatgagccagtaaatccaacactctaacacagttaatgaaaattagaattgcatgaaagaggtttctgccagacatttagaaatcatgattcctcagtcattgaatatacagtatctctgtcagccttttactataagacagataaaataacaaaatgttgtttataaataatatgtaccctttcttttatattccgatatcttccatttagtctactgaaccaagtcaaacacgaaattcagataactccaaaagggaaggctaagagtttctgataatacttctagtaatggaatagtttgaagatgaaaatatttggatagataaatggttcttagaaaagccttttggagcttagtatgaacatgactcatcatttggccaatgggttaattctcatgctctaaggtctgattgccaccatttttttttttggcatttgactgaatgatttaccttatctttccatttg

SEQ ID NO: 46275 - DNA, 1028 bp, Homo sapiens
gttgctttcacacatcaccctgttttactgtgtttattgcagttgtcattgtgtgaaatggtcttgtttcaccattattgtattttgccaagtagagcactatccaacagcaagatgacagtgttgaagtttacttaatgtttccacaattcattgcatcattttaactacatggatatcttaagtcctccaggtctacttcctgtccttaacagtgaactgtattatgacatcatgcagagcccatggtgccagcagtagccctgctggtaatgcttgcttatgattgccgaattgggggtcagcctgtcctgtgtttgtgttttatttattatcttctgcgtgtagctaggggatcaatgtgtgatcttactccattgtaaaagaatataaactgatgctgtgtagtacaaaacttctcattcaggatattgtttttctggtatcaagctgaaatgtaaatgctttgttttatggagattaatttaaaaagtatttgtcagaagtattcaacagtgacctttagagttgaaaggaactcaagtatttcagagggataaagttgagtatgttattttctccttccacaattcagaaactgggtaaaataacacaaaatttacttgtccgccaagtcctgattttcacatgttagggttaacttatctcaaggtcttttttgaatgacatgcttgcagatgtttttcacatttttttcttcattcctttgcaagctcagcagctgtacacttgcaagctaagccttgttccctgaatatgccaaagggctgcagaggtagaatcagctctagctaatctaacctccagtaggaatcattttggggaacttgacacctaatgttgctctggtggtgtttagttcatgtccatgacatccctgtgactcccattttcctatcacactctctggacacaataggccacatttcctatctccccttttcttcagtttccttctcatgactcctttgaggactgggcatggtctcaaatggaagtttggcaaa

SEQ ID NO: 46276 - DNA, 1024 bp, Homo sapiens
ccaatatgggcagcaacacagtgcccagagaatttataaaaacaagagcaagggcattgccttccagaaacatatacattctttggtctgtaacttggttttctggaaatcagtcctagaaactcttcaacaaaagcatattttaactttaggccttggagctgcttttacttgcttccttgggcatccatagctggattttctcctagatatgtccatggactccattccagtcaggtcttatcatgcagggcatgatagttgaggcacagtgaattgggagccatgcgattcttagaagatacataggagagaacagcaaaatttgagtgtaggctaataaaacacggtctcaccaacagcaaattgttcagcatatttgccaaagattcactgtgtttgaaaaatgcatcctctccttacccaactccatatgatatctcattcccttccagcttcatctctggctctaggtttgatcccacctgtggaatattgccttctcttctcctttagattcttgacctaactactccccagaattactgtgatagctttctcccttaaattggcaccgatttcttcatgctacttcattttgctgactaagactctcatggataaaggggaagtctgccatcataagataaatattatattgagtgtcaatctgtagactaagtctgagactcagttgttcctgctattgattgattctttcagtcaggcttcagtctagaaaatggaagtcccctatatattccaagaatggagggtctagtaggaaatttgaggtttatagaatcattgacagacaggagaaaaaaaggcaagaaagtcaccattagtacatcactgaagcagtggttcttcaagctcacttggaagccactgcaaatctcaggcttctccagaaatctcttctgcaactgtcctgatatgtagcatttaagtgagaggtttgcaaagggccactttaaagctgcagtgaatctcatgtctgctcatgcatatggctgcatct

SEQ ID NO: 46277 - DNA, 1013 bp, Homo sapiens
tcatcttgctaactaccgtatcatttcatgttgacctagcatccttttcctttagtaagattgccctaataaaaacaaagcaatcgagttccaaagtaagtggagtctatacggatctgagggaggctgaggtaccagaataagtttgtgaaacactaatttaggataacaaaatacagttcctgatagctgttgtaaattttatgtaaacaaatgcaattaacatgagaaaaaaacaggagtaagcagtttctaggtttttacagaatagcagctacagggcaagtattgttctagaaaagtcctggtcaggacacctaaagcggaataaaaaggagtgtggtttggccatatagatcacttgtgcttagacatttataaagccaacaaaacagaaacaaagatatgttgcttctaatgagaaggggcatcaatttatggctttgtgtaagaaagactaaccatattagattgtggccttgagaatagggagagtatcttattcacccttttttacctagaaagatgttcactttaccatccctgtcaggtgcaaagtgaacaactaagtaattctaaggaaaactacagagtggaaataatgaagataaaatgcatcatcaatctattaaaaaatagatacaagagtttataaagtttagcttctgattattgaccatttcctttattactgcatgacacacaaaaaagccaaattcattttttaccaaattgggataaagatacatttgggatgatttaatttaatacacaacctatgtcacagcataaataatttgatgtatgaatggagccaggggcaccacaaaaatacacgcagacttttttttatttttattatttaagagatagggtctcactttgttgcccaggctggagtgcagtgatgcaatcatagctcactgcagcctcaaattcctaggctcaagggatcctcctgctgcagcttcctgaatagctggcacttcaagcatgtgccaccatacctggct

SEQ ID NO: 46278 - DNA, 1088 bp, Homo sapiens
aagtgtttttcattcatccatgaattagctcaaattctgtatgtaacaaggagaaaatatctttggaagctttaaaatgatggtattttctaagttataagaaatttaagatttgcaaatactagaacaatcaattcccttttattcccttaaaacctaggtgaacttgattcactgtctagataatggcaggttttgccaaagtagactcttatgaacagcaaggtagaacccttcaaaaagactggacaccttcatttggctgtcgttttcacactgttcatctgcctagttctagggtttgtattaggttctaggtttacagggatgtgcttttaagaaggtcacaatttggctgttggggcaatggaagtaaatggggaaacataagaattactgtactgtggagggtgctataatagatttagggacaaaacatgattgaaaggaagatcacccctcctaggggaaggtaccaagaaggcatcttggaggaaatgacatttgacctggattttaggggatgagtgaggttttggcctcaatctggatctattggaaaaactctatagttctttgccttcaaagttttcagattttctttcaagttgctgtttgtcttctctgatgtgttctattttgaaatatcaaattaatcatcagaaaatgcttgtcaatgaatgaattgcatttgctcaatatacacatatttattttcaggtagctttgaacacatggtaaggaaatacattcatcttttcactgagaactgctcacctaattgcttggtacagtcatgttcaatgatatgtagttgattaaaaaatgacaaatactgtgaccagctgcccttttgatgtcaaataatgtggaagattgaacaccatgctgatccattagccatttccaggtctggctcttttcaagttatgtacagtcattttctctttcagagagaatataactttttaaagctttattctttgctcttagcttatgaaagaaggaattcacacttcaagaggttgtctgtacctaattgtgatttattaattgggtagattagttcagggtataaatagacaatg

SEQ ID NO: 46279 - DNA, 1050 bp, Homo sapiens
tgattaacccattgattgtctttttgccttttcaagtgcagcaacttagacatttttattattaccctgtaaattcttcagacttgcattctgtggcattggctatgtagtctacattttgtaagctcttttaattgcttctctgaagtgtggacttattttgagagaaggtcacagtagttttcattaatccaatgttactttcgtagtcctatgactttgatttaaatacaaaattccattaggtttgcctatttcatcaaatgaatgttttccattttgtaaggagtctttcctttataaaaggtcagccccattgatgtagttttggttacattgctatttttgtgggccataagtagacaatttcatagcccactaaggatgggtaggggtgggaggggtgatgactatgcagtctgtaaaccaaacagtcccctgacttcttatatttcttgttccttaattattggacattttcttcatctcctgattttttttggaaaaggatgaggtcttagggatcaagtagaattttaaatagttaactttgctataattgacattttaggttaaaatgaacctttcagataagcatagaacaagctgtgcttgtttcaaaataatataattcaactttaacttgataaaaatatattgagactaaactatgaactggaggttaaaaatatacatggcttcttttattcaggagtttacggtatagcagggagataacttctaacagagaagatctgtttgtgttttgaatattttagaataacagaatgtgaatacttactacagtggtagtaaacaatcttaattatttatttaggtccctgtcttcgtatcctttctaaagttctttgaacgttactctagcttaaataaaaactggaactatgtgcatttggaaggacttgtgtagggtagcttccactttaaaaagacatactagtacaagaaatgcttagagaagaaccaaatcaatcaaggttagagtgatttccacaagtggactgataaaatagtgatgacttggaggaa

SEQ ID NO: 46280 - DNA, 1042 bp, Homo sapiens
cagtatcatccttctagctttttgtaagtatatttattgttaactatagtcatctgacattgatatagaacactagaatttattgctcctatctagatgtaattttgtattcatttaaaatttaaaaaattcacattgatacatgatattttacacattaatgggtacaggtgatattttgctacatgcataaaatgtataatgatcaatatcactttgagtatttctcatttctatgtgttgggaacaaatcatcatctcttttagctactgtgaaatatacaatacatagtttttaactataatcactgtatactctactttccaatgagagaatttatacattttatctaactgtatgattgtactcaattacctacctctcttatcgccctaattttttattctttagcaaatccccctctgttgttccccccctcctacccttctcagcctctagtattttctgttctactttttacttctgtaagatcaacattttttagcgtccacatatgaatgagaacatgagcaggctaactcttcctggcttactttacttaacatagtgtcctccagttctatccattttgccatgaataacagaatttcattttttgtggtggaatattattccagtgtgtatatataacatgttttctttatccattcatctgttattggacattgaggttgatttcatatcttacctattgtgaatagtacttcagtaaacatgggggtgcagatgtctcttcgatatactgatttccttccctttcaataaatgcccagtagtgggactgctgactcatatggtagttctatttgtaatttttggagaaagcatcatactgttctccatagtggctctactactttgcattcccactagcagtgtataggagttcccttctctccacagtctcaccagcatttgttattttttgtctttttgataattgccatactaactgtggtgaaatgatagtgcattgtagttttgatttgcaattccctgatgattagtgacactgagtag

SEQ ID NO: 46281 - DNA, 1018 bp, Homo sapiens
tttgtataaagtataaagaaggggttcagtttcaattttctgcatatggatagccagcactcccagcatcatttattaaatagggagtcctttccccattccttgcttttgtcaagtttgttgaagatcagttggttgtaggtgtggggtcttctgagttctcttttccattccattgatcaatgtgtctgtccttgtgccagtaccatgaggctttggttgttatagtcttgtaatttagtttgaagttggttagtgtgatccctccagctttgttctttttgcttaggattgtcttggctacttgggctcatttttggtttcatatgaattttaatatgtttttttcttattcgataagaatgtcagtggtagtttaatgggaatagcattgaatctttaaattactttgggctgcatggccattttcacaatattgattcttcctgtccatgagcatggaatgtttctccatttgtttgtgtcctctgatttctttgagaagtggtttgtagttctccttgaagaggttcttcacttcccttctagatgtattcctaggcattttattctttttgtagccattgtgaatggaagtttattcatgatttggctttctgcttgcctattgttggtgtacaggaacgttagcaatttttgcacattgagtttatatcctgagtcttcgctgaagttgcttaatagcttaaggagcttttgggctaatacaatggggttttctagatataggatcatgtcatctacaaacaaagataatttgacttcttctcttcttatttgaataggcttatttttttgctcttgcctgattgtccggccagaacttccaatactatgttgaataggagtggtgagaatgggcatccttgtcttgtgccagttttcaaggggaatgcttccagcttttgcccattcagaatgatattggctgtgggtttgtcatatatggctcttattatttctaggtatgttccctcagtacctagtttattgagag

SEQ ID NO: 46282 - DNA, 1131 bp, Homo sapiens
aaaagttttctttttcccaagccactgcttttaaatgtattctgtccaatttctcttcttatccttaaataacatctcaggcaaatctcataacaatcaattcacttgtagttattagaattcattccggtatggtttaaaatttccaaaattccacattggtggttctcaaactttagtatgtatcaaaatcacctgaggttggggtgctttttaaaagtacaaattattgggtgctagccccagagttttttattcaggtctgtggaaacacctgagaatatgtttctaataagttcctaggtgatggtgttgctgctttctgggaaccaacatttaagaagcactgctgcaaccaaaaaagagctcgtatagccaagacaatcctaagcaaaaataacgaagctggaggcatcatgctacccgacttcaaatgatactgcaaggctacagtaaccaaaacagcatggtactggtacaaaaacagaaacatagacaaattggacaaaatagagaactcagaaataagactgcacaactacaaccatctgatctttgacaaatctgacaaaaataaacaacgggaaggattccctgtttaataaatggtgctgggagaactggcaactggctagctatatggagaaaactgaaagtggaccccttccttacactttatacaaaacttaagatagattaaagacttaaatgtaaaacccaaaactataaaaatcctagaagaaaatctaggcaataccattcagaacataggcacgggcaaaggtttcttgacgagatcatcaaaaacaattgcaacaaaaggaaaaattgacaaatgggatctaattaaactaaagagcttctgcacggcaaaagaaactattatcagagtgaacgggcaacctacagaatgggagaaaatctttgcaatctatccacctgacaaaggtctattatccataatctacaaggaacttaaaaaaatttacaagaaaaaacaaacaactccattaaaaagtgggcaaaggacatgaacagacacgactcaaaagaagacatgcatgcagccaacaaacatatgaaaaaaaggtcaacatcactgatcgttagagcaatgcaaatcaaaaccac

SEQ ID NO: 46283 - DNA, 1049 bp, Homo sapiens
cagctggatcttgcactcaggacttctgccctctgctcctcaaagaactcattagtcactgttcccactcccaccctggcaccaaggaaaatgtggatgtttccacctttcccacccaggcctatttagggcatacaacccttcctgaatttcctgcagtacagttgagatcacactgtagcctctaacaagcatttaccagagattcagcgatgacaacagagaactacaatataatgagtaacagataaccactccatagatgttgcatgcatttccgagtgtatacagcccattctcaccttacaggagaaccaggaaaagagaacaatttgggaaggtctcttcatttaatttttcccacactgctgcctcttctatctttggcttgtttcttcttctcacttaggaggaagtggttctcagataattgactaatcacttcttcatggtcgtgaactcaaggacttacctgttatgaggggagaagcataataaagattacatcatgtgaacttttgaaataaaatgcccgaagacataagagagacccttaccactgtcacactcaaaaggaaagcttagtagctacagagatttaaaaagcaagcaaacaagcaaccaagcaaacaacaaagacctgaagaaaattccagaataatcctcaacctgtgctttcacatgctaaattttcataatgagaaagataaactgtgtatcttgtggtgtcagtggtcagtgtggtgatagtagttgtggtttgggctgcttttttccttgtttattttttccaaattttatttgggaaaatttctgctgtttccattgtgaactaaagttacatatactggatgatataactttaactcctaagagtatgtttggctatgtttttggaattaggtattatgcatgccaccttgtggccattattaagaaaacacctaacatgaagacgagaaacaggatcattagtgagagcagcttgagcttggagcagtactttcccaagtctgtttctccaacagcatccttagaacccttagaac

SEQ ID NO: 46284 - DNA, 1050 bp, Homo sapiens
ctattattaaacacagatcctgagggtgaatgacagcatctgtgagatttttgagtcagttctgaagtaggttctcagccaagttaggcagacatagaaaagtaattataaaatgcctaggcaccagccccacctagagttgatgcttagaatgaggtagatagtagcagaaggagcagttttttaagccagtgagctttacagtgggggaaggggcagaatggggaagtcctttattctgagctcttaagcatgccaggagcagatgcctgattttactgtgtggcactttgtggcccagaaactttccagattctgtattttcctatctggttaaatgtaactgtatttacctgtgtttcaaagcctgaatgctttatttattctctacttaattttcttttccagtttttcctaacaagcttccctagatttacttgttctcacttcctagacgctatttgtattcttccttcttctctagttcattggaaatttctgcttctttgagactgaggttatattccacttcttctgactacaccaccaccatcaatctccttctctgaactcttggatcattacttcaacctgaaacaactcatcaggtatctataaaggtggttatttgagttcctgtttttaggattccaaaatgatgccaagatatgtaaaatgaaatgttaattgcattttttttgagggggttagaactatgtaagtcccaaaagagacaaagagtttagctcaaagctatcagatgttggaatcagaagtttggcttaggttaataaaatgttttgctgtttaatttacaaaatttttcaagatcaggtccctggagggaaaatagcaaaaggaattcctgatagagaaaagttgcaaaccactaattgtgtatagatttggtattttgttatgtgtagtaaagtggttgagagtatgatctttgaagtcaggcagacctgggtttgccactttctatctgtataactctgtactttgcattatctttgggagtcttggtttctcacctagaaagtgagtcaa

SEQ ID NO: 46285 - DNA, 1021 bp, Homo sapiens
tgtgaaccaattaatgggcttcatcacataaacataattaaggaaaaaacatatgatcacctcaatagatgcagaaaaggcatttgaaaaaattcatccacacttcatgataaaaagcctcaaccaattaggcatagaaggaacatacctcaaaataataaaagccatgtgtgccaaaccaatagccaatatcatactgaatgaggaaaatgtgaaagcattccctttaagaactagaaacaagacagggattcccacttttcgccactcatattcagcataatactgtaagtcttagccagtgcaattaagcaaagtaaagaaataaaaggcatccaaattggaaaagagaaagtcaatatatctctgttgataatatgacctcatatctagaaaaccctcaagattcgataaaaaacgcttagatttgataaatgaattcagtaaaatttcaggatagaaaagaaatgtacaaaaatcagtatgacttctatacccttatatgatcaaggtgagaaccaaataaaaaaggcaatttcagttacaataactatgaaaaatacaaaatacctaggaatatatttgaccaaagaagtgaaagatctctacaaggaaaactacaacaggctgatgaaataaatttttgatgacacaaacaaatgtaaaaacatctcatgcctatagatcagaaagttactataattaaaatgaccatattgcctgatacagtttggctgtgtcccccacccaaatctcatcttgaattgtacttcccataattcccaccagtcacgggagggacccagtgggagttaatttaatcatgggggcagttatctttatgctgttttcccgatagtgagtgagttctcacaagatttgatggttttataaggggctttcccacctttgctctgcacattttgctgctgccatgtgaagaagcatgtgtttgcgtccccttttgcgaatgattgtgagtttcctgaggcctcccaagccctgtggaactgtgagtcaa

SEQ ID NO: 46286 - DNA, 1053 bp, Homo sapiens
agggcaggaacaaatcgcaatcgtggaatgtcatcagttaaggtaggaactggctattttcacttttgtggttcttcagtggcttcaggccatctggatgtatacgtgcaggtcacagggtatatgatggcttagcttgggctcagaggcctgacatgtttatccagtcaattaattaaaaacctgagtcctagaaaaagagaacaaaaaataaacagggaagaaatgatcaaaataataatttaaaaatttttgctagggcaggagtcttcatatttaaagggcccaccaagtaaaaagacctacattaaggcacatacatcattaaaagggtgagaacactaacactaaagggaagattctaaacgttttcagagggcggaaacaaaaattaaagagatgggaattagaatggcattgaatttcttaacaatgttactaagtcattgttatcctgaaatataatgaagtgaaatttttccaatattctgaaggacagtaacttccaacttagaattctatagtcaaactttccgtcaaatgtaagggcagaataaaaacattttcacatatacaagaatgaaatactttctttccatgtcattttttttttttaaagaaagctcctagagaatgtgttcagcaaaacatgggagtagcccaagaaaaagaaagacatgagatccagaaaaccggaccaggaaattaagaagggaaactccaggatgagagaaatatggcagaattggagagcaacccattttcactgaacagggagatggcagacttcaagagaaaacagtagttacagtaattgaaatgatagattatctaattttgagtatttgagaaattatattgatagatgtttgatagatctaatgaactatgggataaaattggagaatgaattgtaaaaaaaaatacaagtaaaaaaaggagacaattgttaattccatgaaaattacatcagaagggagacaacatttctctaaactgttttgtggtggtgaaaaatgtagaacttttcagaacttttgaaatgctaatatg

SEQ ID NO: 46287 - DNA, 1023 bp, Homo sapiens
acaagtaaggaatgtgctaagctaaattttggaaggagttagccattacggcctaatgaccaggaagctattaggtatgtagatcgttagtaaccatgcatagtaataataactgctgtctctggagtgtgcagagactagagtaagcactttaccatcatcaaactttaatctgcaaaacagtccttataagatagagggaagagcatcatctacttttcgtagatgagggaactgacggacagagaggaaattagctggaggtcacatagcaagtaattggttcaagctgagtcttaaagctgttacgacatcacattgcagtacaaatggcttatattttaatgtgtgacgttttgagaaatggtggtgtagggatgattgggagctgatgcaaaagcatagacatctgataaaatttgacaggctagtattttattatttggataagaatgtttattcagctgacatctctaccctgtcccattgagtatactacatatgtttgtgtctgtacataggtaaccttcaaatacacacagtcgtaagttcttgtgaagttttaaatataaccaaatcacttattttggtggaatcgtgatatgattaatattttcaccaaattcccagaattcatccataaagtaaaaagctaaagaccaactcttcaggctcttggcaagggaactttttaaatgtggatgccaaagagagccatattcttggagaaactactgcttccttgtctactagaaatatgctcaacttttagaactagcaggtgctgtagatattattttgttgatagatttctgttctcttacagaaaaaagatcagtatcagtaattttagactttaattacaacaaacatataaaaacggtgattaggtctaagtcagtagctccccttgtctcagcacccatttggggtcactgtcctgtgtttctctgtttagaaaatcaattctcaactagatatatgcttcagaaacaattctgaatacaaacgtacattgtccat

SEQ ID NO: 46288 - DNA, 1053 bp, Homo sapiens
agagccagaattatacatggattcagaaaaattctgtatttgcaaaatcttcgtacagaagtgaaaatgatatactgtaggttagatgaaatttattgaagatcatgtaaagaatttaaatagaaaatgtgaatgggaaaaagcaaaatttctagattaatatcattttatagaatgtatgattcataatatgtaccagttactgtgtaataaaacataattatttgtagctcttaaagtttctgtataaacgaacccaaaacattttaattttttaatgatagaaattggagatcactttatatttgtagtatcgttatattcagtcaatatgcctctagcctaggtctctgacaggttactttcctattttccagtttttgtactagtttattaaattactagagtgtcagaaatgctttaaaacttctagaatgtaatgcttcagacgtaatgattttcaatgatctcttcacattcatcactagtcttttctttcttgctctcatcattacactggtaaagagaaaaaggcttatgtaggtatttgaaattctagaacatagtgttttttgatcactgtgttatcaattatctatgtatgaatgtgtctatcatatatcaaatgtaggtattactaagaataacccatgttggagtcatagccagcatttggttagcttctagataatacagttttgtatttttttgttcaagattgatcttaccaagtattggggctcaaatttatcagtgttctcaaaacaaaaccaaaatacattgttcaagttctagaattttaatacttaaatctatacttgagggaattgaaggatgtttatactttttattcacttttaaattattaagttgaatttttatttatattttgtaatgtcagtttatttgtaaatatgtattgaatgcctacagtgaagcaggcaagatagacttgtggatataatgatgagccaaaaaaagttacagtttctgccctcatggcacttagtggagaagccagctgttaaagaatgacactaataaagttagaac

SEQ ID NO: 46289 - DNA, 1051 bp, Homo sapiens
attaacatggttcccctcccaggagagagcagtcctacgaatgattaaaggccaggttccgagctaagtaacttatctagatcagtttcttaacatcccgttatctaacctaagctttcaggcaccgtataaaagaatctggctgctttcagccaaatcctgttccgaaactgatgtaaaaccttttggccttccaaggtttgcatctttctacattttttcccaccaccctgactgaactcctgcaaatatgaaagcaggccagccctggtggctcacgcctgtaatcccagcacttcgggatgccaaggtaggcagatcacttggggtcaggagttcgagaccagtgggaccaacatactaaaaatacaaaattagctgggtgtggtggcaggtgcctgtaatcccagctgcttggaagactgaggcttaagaatcccttgaatccaggaagtggaggttgcagtgagctgagatcccacctctgcactccagcctgggcgactcaaaaaaaaagaagttgaaagcactgatctcacctcaagaaacttcaccgacataactacaaacttgcatagtattttaacagaatcacatttttccctgaagcctcttgaggaacctccctgaggaagtacataaatcttgtaaataatgactctagctgcaaatagtgagctattcttaattctagattatacttgaggatagaggagtctgataagttttcactactagtagatatatttcatggtcttggagtttttagaattagtcgttgattcctctttttgttcacattgtcagttgtgtttaacctaaggttgtttttgaccaagttcaacataatttttttctagattcaatttttgattgtatcaatgtacatgacgactatacaacatccctaccataagattgttgaatccctcctaattcggtgttaactgggacaggttatttatcctattaacccatattcgatgatggcaattgataatacaatttttaaatatatttagttatttgccttaatagagtcctataccta

SEQ ID NO: 46290 - DNA, 1033 bp, Homo sapiens
agcatgacaaaagcaaccactgacagagcccccaaagttgaggaagagagagagtagagaaaacagtatcttgacctctccctgcttccactctcagatccccttcctgtgtcttaccactggcagatccaaccagaagccaaagggaaaaagtgctccatttatgtagtcagtaagagtaaatttctggagcaaaagcaaggtagaaaagggtaagcagattaggggtaaaggcgtggcacgaaatgtggaataatcacaactcctcactgctggtgagccctagtgtttgcttttggtcctgctcaacatttttaaccacttgggtaaagaaatagtgccagaatatcagactgtgaatagcaaaaagctgaaatctgtgattaaccaagaagttttctgtctatcaagatgcaaaattatcttgacagatagaaatctacaaaataaaagtttataagaaaattagataagtttcccagttaggataataaaaagctttttttcaggacaatgggaggggtgggaaaagtgcttgataacaatacacatcctaaaagatgtgaatgtcagttgatgatgggtcatgattgcttacaaagcaaatgtaatttgaggttgcactttcattggctgctagacatctccagctgcctattccacatgttcctcaaatgcagtttgccaaagcctaatcctgttaccttcccaatctccctgtgaaactgtttgaactcctctgttctttctttggttatcggtatactgcccacagggatctcagctaggagccttggaattatcacatttctccttcccgtcccatgtttaatgcatcactaaatcatgctgattctatctcaagacatcacctgaatacccaattttatttctgtactccattgtccttgcctttttcaagccccactgtttccagtctctagacttctataccagctttctcattttcgtgacttcagtccagtctccctacagctgtcagttaccttcagataaacaaatgggcatttgt

SEQ ID NO: 46291 - DNA, 1011 bp, Homo sapiens
cccaagagttctaaaccagcctggacaacataagactccatctctacaaaaaaaaaaaaaatagctagtcatggtggcatgcacctctagtcccagctacttgggaggctgaggtgggaggattacttaagccagggaggtcaaagctgcagtgagccgtgattgcaccactacactccagcctgggcaacagagtgagaccatgttaaaaaaaaaaaaaaaaaaaaaagagagaaagaaagaaaagaaaggaaagaaagaaagataacagtaccacaattataaaagtttacttgcaacatgtggaaggaagtactgggtagtggttagcatttttgtagttagagatcttgatttaaattcagactggcgcctgatggtagtgtggcctgtggacaacttacttaaacttttctgtctgctcagctgtaaactctctgcctggaatggtgtctgtcacacagagggaatggaattaatgtttgttgaatgaatgaataaaagactcatacaacatgcataattctttcctaatgggattgtggtaaggatcaaattagacaatatctagtagcttatgactattagaatatatcaaatatatctggaattgaaactggcctatatgttgggtaatgtagagttacacatgcaaagggcagcttttcctaggcccttgacacgtgttctaagatccaaagttatacctgggcatgtgtggcctcagagcttctgctgtgttgtcacctcatggatgggtcatctgtacctcacaatctttaacacccctgccctgtggattattatatacctcatcccataacagagtgtatagatgaacgatgtataatcccatatacggtgattagggaattattactaaatgaaaatgagagaaagctaacagagggtgagagggatgttagggtatcattgcctggaatccctttgcaacacatgcacctcttgaccctcactacaacatccttctcttgccagtccagcacagtg

SEQ ID NO: 46292 - DNA, 1045 bp, Homo sapiens
aaagaaaaacatcattaacattttcgtgtttatttttctctttgcattttattgatatgtattttaatataatattgagttaatgatttttgtgaccttcttttacttgaagtaatgaacatcttgttattacgtgtattacaacatgacttttaatgactgcacagtcagctgtagttttccatctttgtatcttttttattctgcttagaactgggtcttagatatatatagaaggcatatgatacatgttttagtacaaataataaacctatagtatgtcagactgtatgaagaaaagcttttcaacttgtgttccagaaattatgtacaataagatatacatttttccccccttgagagaagattcaaggcctctgtgtgtatgtgggtgggagggtggaaggggggttacaccagattctcaaataaattggtgacctctccctaagatatttgggaaccattaaaagcagttcctaatttagggacagtgaagtcatgaaaaagcttgcatatgtgaagatgcttctgtgttgtagacagacattgacctaaccatttctgtcagtagaaatctctttaccctgaagccctctctagctgttagggtagggtctcagcactgctgcggccttcttgttcttttttttttttttcctccagtagcaagacttttttcagtactctcagggttgcttgagagaccctaaccagagggtcttagccttgacattaggttcaccatggcggtttctggaaatatttttagtattcattcagtaaataattggtaggtgcctagtatgtgcctgctgctgttttaaatgctggaggtgtagccgtgaataaaagaaagtctctcccttgaggtggtagcattccagtggagaaatagcattctaggtaaatcatggtgtaagttttgctgataataagctaattttcatttataacattttttctgtgtgtttggcagagtgttcttaatttctgaaaatccgattaaaaatggacattgcattccaacttgtttataaactgg

SEQ ID NO: 46293 - DNA, 1070 bp, Homo sapiens
ttggaacagtttcagtaggaatgctaccagctcttctttgtacatctagtagcattctgctgtgaacccatctggttctgagcttcttttggttggtacattatttattactgattcaattttagaactcattattggtctatgagcagattcaatttcttcctgggtgaggctcaagaggctgtatgtatccaggaatttatccatttcatctagattttctattttatgtggatagaggtgttcatagtagtctctgatggttatttgtatttctgtggagtcgttggtaatatcccctctgtcatttctaattgtttttatttttatcttctctcttttcttcattagtctagctagtggtttatctattttattaattttttcaaaaaactaacaactggattcattgatcttttgagagtgtgtgtgtttatgtgtgtgtgtgtgtgtgtgtgtgtgtgtgtgtgtgtgtgtgtctaaatctccttcacttcagctctgattttagttatttgtcttctgctagctagcttcggggttagtttgctctgggtttgctagttttttagttgtgatgttacattgttaaattgagatctttctaactttttggtgtggtatttagtgctataaattcccctcttaacactgccttagctgtgtcacagagattctggtatgtggtatttttcttctggctagtttcaaacaacatctttatttctgccttaatttcattatttatgcaaaagtcattcaggagcaggttatttgatttacaggtaattgtatggttttgggtgaatttcttattcttgatttctaattttattgtggtgtagtccaagagagtggttgttatgatttcatttcttctgcatttgctgaggagtgttttgtgcccaattatgtgattcattttagagtacgtgccatgtggcagtgagaagaatgtatattctcttgctttgaggtggagagttctatagatgtctattaggttccatttgttccactgctgagtacaggtcctgaatatcttcattaattttctgcctcaattatct

SEQ ID NO: 46294 - DNA, 1064 bp, Homo sapiens
acttcctgaaacaaaatgtactatgcatgtttgcctcaacataaagtaaataataaagcttggtatgtactgcttttaattatttgctaacttctttttgttgcatcttaatgtactttttaggatccctttgtccattcttcttctgtttccaaaaactgctgccactctggatggacatcttgtccctagggatacaaatgttcccttttgcatcaatttattctttgaaaaattatttctgagcattttcaatgtgcctggccctaggctaaatgctggaaatataataatgaacagaaccaggtttccgctcaggtatatccagtgtacaacatagcaggatttacaaaatgtttatgatacaacttaaatgttgcccttctctgccagtcatattccttcaattattcaataactcattgatttatacatgtataaaattttcattttgcacctattacatgccaggtacttttgcaaaaactgtgaagtaggtattaggtttacacaaatcacaatgtagaaacaacactactgaatcttataaaatgaaatacgactacttggtttttcaatttttcattgagataactaatttttgaagaaattaaattatgtttttaaagaatatatttctaacatttttacctgataaaaatacttacagatttagtattcccttcaataatttcttcttctggtggttcgagtttgagatccttcaataagaggaagaaatggcagaaaagaaaaaaaattatatcatttaaaacaatgccatatattcaaatcatagttctctcatggctaacattgaaccaaaagaacttcattatcttaaagatgaaataatactgatttttttaaaactcagctgttccaataaagactctttgtacttatttatcaattgtaagaagctgttttagacgtgttcaaagtattgctttaaatttacttcttgaatgccattagagagcaaagtggaagagaaaggtacattaaaacagagagggaaagggtaggaaggtaaacgaaagaaaaggaaacagaatgactaa

SEQ ID NO: 46295 - DNA, 1061 bp, Homo sapiens
aatctctgggagtggggcccaggcactgctatttttaaaacctccctaagtgtctgtattgtgcaggcagagctgggatcacttccctataacaacttaccaatttttaaagagaagtcctattgttcattgcacagctccaatttcttgaatattttgtgatattagacataagtgacaatcattacaaacaactagatttcaaaaaaattagtaactcatgcatttccaaaggtatatcaaatattacagggttgtcaaacacattaactacttacaacaggccctgttcaaatggtaatggcatcagatggtgcttgtttttaatggatcacactggattggatgccaactgtttcctgtaacaaatcctattagcattatagcaattgtagtttcaaggcttccctcaagatccgcctgtgggcttctcatggaattttagatatcaacattagttcttttcaagaattggtagtgaaagtataaaagtgcaaatcaaagtaaggattggcatgaatcataaaagtgcataaacaaaaacaaaacacaaggtaaggatgatctagaatatgagaaaaataacttccacagtaataccagctatgtagcatgagagaattaaacccctggtctactgttttctattccaatgggtttctcatttcatgtcaatagctactatttgttgaataccaatgatattttagaggttaggtattcagtatattcaacaaatattcctacttttgttggactaaccaaagcacatgggtttagtattaataactaagtagggttaatttctaccaaaataatgatggatatatccttttcacaaaaatctgcagggacctcttggttggacatttgtgattactaactcagataattaggaaagctcatgggctttcctaatgagatatataaatacatccacctattccatcataattcttttcgtctaaaggcaattcttacgtgatcaagtgggatggattgtaaaaataaccagaactcttcactaccctcctgaactcatgccctttgactaatttgac

SEQ ID NO: 46296 - DNA, 1819 bp, Homo sapiens
gaatttgattaactggtacaactgaaaaattgaatgtagacagacacactggcataacatctataccatatatattccatatgggtgtagtgattccctgaggctcattccatctgatatagtctacattttgataattccagtaaaagaaattacctgaaaaatcagcaataagaagtgaacgaagaattgtatgaaacaaaccaatcttgcaaagtaaacagagaggctgaaaatctatcttacaggaaaaagatgctctcctttcctctacttcacagcaggagctgatggagcaatttattgtggttattgagagaatggaatttgcagcaggcggcacaaatctatccactctctcactcccccacagcctgtttccctttccctggggctgttctagtagctcgaggtcattttcccaacacccattaaagtagtgtttctgaacctaaaaaataaacttgtgcgccttttttataaatataaaacatgcactcaatccctggagattgtaatacactgaaatagactttatcttctctgtatcctcattaaaaagagtttactgagctctattttgggaagtttacactgtgaacggtgtatatataggtactgtttgcatttttctttttttttgaaacagagtctcgttctgtcatccaggctggggtgcagtagcgcgatctcggctcactgcaacctccgcctccggggttcaagcgattctcctgcctcagcctcctgagtagctgggattacaggcacatgctaccatgcccagctaatttttgtatttttagtagagacggggtctcatcacgttggtcagtctggtctcgaactcctgacttcgtgatctgcctgcctcggcctcccaaagtgctgggattataggcgtgagccactgcaccctgaatttttaaatattcaattttattttcaaatgagtgggctcttaaaaactacacatattcccacctttgcaagtcttgagtcactgaagtaaaaaggactaaaatggggttttgatttgtgccctctgagtctggcgtgaaatagaataataaaaataatcatggaaacacagcatttcctgtgttcttgtttcaaaggcactactggaagatgatgagctgttagtggcactgaggaagtactgtactcatactctagagaggaggtcagccacccagacaaccaggaaacagtagtaaacgcaatagtgacttcagctcacgtcttcagtggatgggaagcattgtgctgagcactgcatatggactgtctcactgaatcctcccaaccatctcatgagcctcttgaggaggaaactaaggcttagagccagtgagggtctttctcaaaaccacaaagctagtaaaattccatgtttatttccagagccagacttcttagctagagaaatattctgctggggtatgaataaaatataattaattgaacactgagaggaaaagcaaaacacccagagacatgaagtatctgtttatgcacacatgtacacacacatacacaaacacacacacattttctaaaaaccttcccaaagcaacatttgaagagcattatgaaatatagtttaagcaagctcataaggtagggttagacttggttgtggaagttttctaaaagcagatgaatttggacctgggctctgaacttgaggcagtgcatgggctggcagagacttgcagctgggtgcacatttctgagaggaagaatagccaggtctgaggcacagtggggaacaaacagattatatcagaaattctatctgtgcatcaccgaggca

SEQ ID NO: 46297 - DNA, 1098 bp, Homo sapiens
aggcaggagaatcgcttgaacccaggaggtgaaggttgcagtgagccaagatcaagccactgcactccagcctgggcaacagagcgagattctttctgaaaaaaaaaaaagaaaaaaaaaaaaagaagttacatgtagaattcttaactcagtacttggcttattgtgtgtgtgtgtgtgtgtgtgtgtgtgtgtgtgtgtgtgtgtgtgtgtatgtgttgttagcccaatagctaaaaggaaagtatcacttttattgggcgagtagctatgaaagctaagccttaatggtgtctaagctaagaagcaaagctaacagaaacaaaaggaatggggtgggaggaaaaccagaaaagaaatggagggaaaatgcacatatctattaaagcaatgagaagcagcaagctaataatataagtattaatggtggtggtggtgatgatttctacatgtattgctctgttccagggtctaatttaagcattttccatagataagccattttaccttcacaggtactttgggggtcatgtggctacactgtccattgcctccccaaatagtactctcctcttactaacatgactctgccactgttcagtttgcaatacacccaatgtaccactcagtgttggactgagaataccctgataaccttactcctctctgctggacacttgtttcctagccttcccagtggccagcaatgaccatgtgacttgaattctggccagtgagatgcaaggggaagtatgctgggaagcagggactctgggaaaacatttgcatcttcaggatcagacatgagaggagagcttgttggttctccctttttcttcctgactgtgggccatctggtgaagagccagaaggcacatctgaaagacagacctgggatctttgatgacagcattaagctgtagaagaaccttgagattgttgcctctgacttctttttgagaataataaatgtacttataatataaatgactgttactgtgcttactctagattgcagttgcaagcattcctatttgataccggaaggtgctgttgtcatctttgtgtatttatttctccattgtttacagataagga

SEQ ID NO: 46298 - DNA, 1075 bp, Homo sapiens
tcaaagacttatagtttcaaaggaatttatactagaaaataacatggctatacatttttatatgtattgtattttcattagcaaggtttataaccagaacagatttttattattaaaaatatttaatttctgagcttgttgagcagagtgtagatagtatactatctacagatagttctataggtagatagttttagtcattctagtgttgaaattcgaaaacagatgtcttctgtctaatactttcactactattttatgacttccctaagattttgtgcttgttttatatttcttagttattcatttgggttaaaattttatttttcaagtattttgaaatcattgtttacatgcaaatatgtatttttcataagaaaagttagctgtctgtatcgcataccaaaactatatagcataaaacttgaaccacatttttccaaacagtctcttctttcttgatatatttaacttacataacaaagaattatgatgctaataaatgacacaatgttgctgtattactaaatggtactccaacttatcacaggattgttcacttttgaaaaaccagtctataacctgatacgtggatagagattctataggttacagccaaggttgtttgatgcctatatactaactttttaactaatgcaaagatagtagtcatagggctgtgagttgggttggggatggagtagacattgttgaagaataaacttcactcacagttacttaaaaatcacaaaacgctgatttaaccctttacagtatacgacagtttacaaaatctgccctatgaagtaatactctaaaagtttccactttattttttctttatcataacagattcattttcacaatattattcctttatgcatatgcttttttccacatattaggattttgtcactaaaaggttttaggtgagttacaatgtagcaaagcatttagcattaaatattgagaatattagtgaactttgaaaattgagctaaaattcacatgaattgataaagttatagaataagttttgaaagagtgcacttagtaaatataccaaacaaaaata

SEQ ID NO: 46299 - DNA, 1041 bp, Homo sapiens
atgagccgttttgttatttgacagttctagttactttaatagtttctatggtaacatgcatttaaatctgtaaacacctggtacgttcacagtatttggtttgataaactaattagtaaaaactgtattcaatcaattgataaattaactttttcttttatattacaggaaaacaaccaaagttttaagtagcattttaagaacagatgaatttaagtttggacatctgcaaatgaggtggatctagcaacaataactgtaatggactgtgacaattcaatttattcttaattttgatggttggctatttgacttctctaaaaatgagaaagagctattttaaaatataaagaattttctaatcagtttcagctttgcaggaggtttcctgcataaattgggaagtaacactggaaagtaggaatttggttagtgaagtgggaagactgtatatttataatttgcatactacttgcaattttttgtttttcatcacttgtaataatggaatggaaatgtaagctgtaaagactctcaaatataaaatatttgctacagtgtatatatggtacataattgcttgttgcttttaaagttccttctgttgttctgcttcccactgatttcataccagctcatgaatggatcattacagtctctccagaggcttagaatgattcagaatgttcaatgcatagttctcaataaacaggaggcagaatttttaatgggtatttcttttcagatatatgattggtctctaggtttttgataataatatggtcttaaattcataattactagcagagattgataatttggaaacaatggtagtgaatgaaactgaagttgaaaaacggctgctacttatgtcactaatcagaccatatgaatagcagaagttgagcaatttcaaagtaaaactgatatttttatttccaaaggaatttagacatttgaaaataattgacatacattaagttttaattcgataatttcttatatatggatgaacaatttttgggtttaagcttttaattc

SEQ ID NO: 46300 - DNA, 1076 bp, Homo sapiens
gaaagggtacttctctgacatctttgtggcaatgtatgcatggtctgttaatgggctatccattctgttcaattagtctttttatacattataacaaatcatctcatgtatttttctttaacatgtctttgctattcttagccctttatatttctgtgttaccttatcaaattccatctaaataaatacacataataaatacatacatgcatctcttaggatattcattggaaaggacatggattttgtcatcagacatggcttcaaattgtagctccattctgtgtaccggtagttcgaacttggacaagtcacttaacctcattgaattgctgataaggatgataagttttgcaattgctgataaggatgataatctctggctgttaggattaataaaataatgcatgagattactgagtatgatacctttctctcattatgcttttagtaaatgattcccattctttgtggtctctacttacatttgactggaatttaacttcctattagagttttcgtaaatacctttatataggtaaaggcagctaggactcttctgaaatgagattcagaatataggtatactgagaacagttcgaatgggagataaacactactaccttctatctccatttttggtattctaattctttggaattcatagtatttttttcctcaaattataatttttaaaaaacattatgttgttcatagtttatattaatatttcttaaactccctaactttagatctctagccaattctttttaaagttaattaaagcaggaattaaaattttttataatacttctcatgcataaatattaaataagaaaaaatgtacttgatgtttcaactttcccaccggttcaaagatctttgggatatgtaatccatggtctgtaagaataaatgtaaacttcagtgctatataaactatagtcactttttcatttgtagactttccatctttaataacattttattgtgtaaataaaagcttgacatacactttttaaaacaaacttgtacattagaattcattttacttgtgatttacacattaatacata

SEQ ID NO: 46301 - DNA, 1051 bp, Homo sapiens
tctggcagagtttagtgtgtgttaatgtaaaataaaatcttgatgtatgagcaacaaattatggtgttacatcaggctgccattttgagaatataaaaattgtcataaagatatacttagtctggtacgatttataaatgcctattatgtgtagggacatatactcacgagaatccttcagtaaagtaacttcttagcagcattagtttataagtaagcttagagttttatcctagttagttaaaatattctaaaacaaaataatcagttgagactcaacattagtgtcaaatttcccacaaatgaaaatgtgattatgagctatttaatgattacgagatatttcccccggtacatccctctggtattatgactataaataaaaattgtgtgctgctgaatatttaagtatcttaaatagagaaattaataaacataaaatcttgatttattttttatttttaaagatttgattatatctaacaaatgactttcaaagttcaaaagcggcaaatgaatcttacattttttcaccaagtacttgagctcaaacatgtttctaatgcacttaatatttttttaaaaatgagatgaagcttagtactgtttcacaaatgctgaaatcccaccaccacagatatcctgttgctcattaatattactccaggcattacagcttgtgtcattattgatttcttctgctgaatttttcaagcttttgagacctctggaattcttgtccttaaaggcaaatattcagatgcctctaacatgaaagtcactgtcacatttatatccttatcactttctggttgttttgtatggtgactaattttaacagtagtggtttttctctaaaacccaggcaacaaataagttaacaaaaattacatatttgcaaacatttcaacttgaaataatcacaacagagcagtagctaaatactattctttcccaatgtctttatattatgcaaattaataaaacatatttgcacttttacttttttaccaataggtggcattgacaattttaacttttaaaatatatc

SEQ ID NO: 46302 - DNA, 1055 bp, Homo sapiens
atcatgtgtttcagggatgggttttggcaaatttaactttcttcttgtccttaaatatgattgtcactggttatgttttttttctttaaacattattgttatttacagagaaatgagtactctagggaagtctatgaaattgttttttgttttttgttttttgttcctgtatggaacagtgaaatgttttctactttcttttaaatgtagctctggggagtgtctctgaacaagtgttactgattttgtaggtctgtgagagaatattgtagaacccaaagtagaaaaagataatttttattataaaattatgttatttctttcctaaaatattagggaaagtaagtagaaaattctgatttctattctttgttaatatgtaaacgtcatttatagtaaacatttattcttttaccattctgtggtgggagatgctgaagaaaggaatgtgatcgtttgttttggagccatgtaaacgaaatgaacactcttacagatagagagtagaagctaagagccctctttaaaactgctcaccgtggtgactcgtaaagacacaagcacttttgtgtaggaagagggaaaagaactgttagataatgctttctttctttgagactgcagaatggattaaaattattaagatttaaagaaaataattgtgttaggatgattatcattgctgtctttcttttctcagagctttgatatcacagcttttcgatctaatttgccttcagtattgtgttctcacctgttatgctacttttctggtttaggatttttcttgcttaagaaatcaaaccaaataatctttgcttttgtgtgggtaacatggttgttttgtttcccattttgtaccccctactatctcaaatgatggatgttaagtatgaatccccttcttatatgccattattttaatgtaattatgctttacattactctcagtttaacgcttctaaactttcaatgcaaaggccatgtagttggattaatatgtatttcctcctcccccaagggttaaacattattctctaaaaataattggttga

SEQ ID NO: 46303 - DNA, 1009 bp, Homo sapiens
taacttactcccccatcaggctcttgtctctctattttgttctttttcctcctcttctttttcctcctattgctttatttatttttttgttactcccacttcccctccccctcctgctcttcctttctctgtctgtgcaaccacgtgcttcaaatctgtgtatctggactgccttctctaacagttccgtgtgagtgttagcagaatgaaaaccagatggaccagcagttcccactgttatctcccagccgactctggcaagcctccctttttccctccctccttggcatgacagaaatatttgcctttatttagggagacttgtatttgctgctgtacctcttccctcagctgcaacataagtgggaagctatttattcccttgttgctgaggttggttgaggtgagtagaatgtgcaaatgaatttaactgttgaagaagcggttttaagcctgcctaacttctgtatttttctagaataagtgacttactggttgtagcaatctgaagacaagtttttaacaatagataaaggtgaaaatgctcttcatgtgtgtctctaccatcctttcactcagaacacttttattcactatagggacatccgttgttattcagccagaagtatagattcagaaatggagaccctgatattgctgttaactcatcaataataataataacagcttattgtgcaaatactcttattagaatgatgattattttcattctcttattgcatcttccctaaagtgatatcaacattatttcaacttttaaatgttgtgttttattgcaacccaagtgttaagcaattgctttgaacaaaagtgaggtagatttggaattgttatagtagtaatttgggtttttctttttctttcaataattgacctttaagtgattttgagattttctcactgtggttattataacatttttaaaggcttgttctttcttaatagttacttcacttttctaaaagcccaagtgtgagatatttgtgtc

SEQ ID NO: 46304 - DNA, 1047 bp, Homo sapiens
ttgatataaaagcaaatatactatgctgggtattatttgaacaaatagagcagttttggagtgaacatttgtaatagaattcattgtaactaaaattcatttttgagtaactttgaattgtttataaacgtggcagattagtatgtgtgcatagattttgataatttgcaatgtggagagatataagtggagaatttattagagatgaaagtcctgtgaaagaaaatatgatgaaaaaaattctgggatttttttttttattgctgtgtatttgctccacctggtggattttgttgaaagtgttttaatccttgttaatgaaaagaacactctttagacaatttctctgaactatagggaaatcttttgttttatttttgttgctgtgtaaaatagtttaattcctatctaggtcaaaacatttatgtgtcatttgttcagttctttcaatgcattgaaagtaacttttttttttttcaaaatataatacatgctcattttagaagatttgggaaatacagaaaaataaaaaaatagggaataaatattgtatataatttcaccacccacaattgcattatttttaagaatagacattatcagaagagaaccagtttgcatttgaatttatttaaagatatctggaatgttaaatattatgccaaagtatgatgatgatgattattactataattatttttggacaaatactatccttagaattcccaggctccaaaataatgaatataatcaagttcatcaagaattgcttttattaagctgcatgtctacagaaggcaaaggtagtgagattaaaggtatctcatgtattcatagggttgttcatagcggtggtaagatctgttgtttgctgggctcacacagattgctttctctgaaaatcttaaggattcagttgtgctttgatcatcttattgttttccttaggttattctttttttctcctgcagtctctcacagctctgtaacagaaggtgaagttttgaaaacagtgtctccatatgcaagggatttggagaccttttt

SEQ ID NO: 46305 - DNA, 1061 bp, Homo sapiens
ttgttttccatgtggcattaaaaatttacttctaggccaggcatggtggctcatacctataatcccagcactttgaggggctgaggcaggaggattgcttgaactcaggagttctagaccagtctgggcaacaaagtgagaccccatctctacaaaaaaattaaaaattcaggcgagtgtgatggcacatgcctgtagtcccagctacttgggaggctaaagtgggaggattgctcgagcccaggaattcgtggctgcagtgagcgatgattgcaccgttttactcctgcctgggcaacagcaaggccctgtttttaaataaatgaaaaaatatactaacaataataattactcctaatttttttttcctctttgtaataatattaggtgtatagaaatatggggttcaaactcaagaagttgggaaaacagaaatcacatactttacattttagaacacctggaatccattgggctcttagagttttggagttgtaatttagaagcagataaagcaaaggactatccatggctgaacagtcggcattgtgagtgagaatggcctgaggtggcgccagagagtctggtctgcgtagcaagtttgaagcaggctggggtctcctggagatgggcctctgttagggcagaggctggggggcaggagggtgggaaatgatactaaaggggtatgccaccagcttgggtggaagctggtaaaatgagaacgctgttgtgtttcccacctggtgttttaaagcatacccaaggtacacacagtgcttggtcctctagaatgccatttggagccgttctcctgtaatgcctgccattgtagggaccagacagatttgggacacctaggagtggtagtctggcctgaggagcttgctatcataagccattgaggacaattctaagaagggtgtagtatttgacatattaaaaagatccatatgttttctaaaagatgtaagaggaagcagcttgggaggaaagaatgacaggaaactttttttgcaaagagtgcctgtttatgttcatgcatatcatggaatgggata

SEQ ID NO: 46306 - DNA, 1026 bp, Homo sapiens
aacagaattgtgcagaaaagttactcacattgccatcttccagaaataatcatatttaacatctagatgtatttactttcagtcttccccgctgtgtgcaccctcccccactccactatttgagtacttacacaacctatacgtgtacatatatttatgtatcttggttatagcattgaaattttttgctttatcatttgttaataaaattgttagtatttatagtaagctaaatgtttccaagatccagctgattgtctttaatgatctttgcttactgcaaggcaattcccaactaagaaatatctagtaatgtattttaattaatcagtacttatttaatttttaaaccttaaagagcaagaaacaactgattgcatcacaaaagaatcataatgtggcacataaactacattgattttttaaaaaatagaacctgcttgttttatttacatcagaatatgttcaccgattttaatttctaggaagtaatttggtctcaaaaaataatagctacagccttagtaattccttttgagactgcttttagaaatctttcttcccttgcatttgttgagttcctaccttatatgtgtatgattgtgctggacccttatatttcctagtttgtaagaattacatagcaatactttttctattcatagtagtgatagtagtggtctcatttttaatcatagtaggtgaggaatagacaataaatattgtgaatgaacaaattctaagtttgtcaaatatagcaggaaaaatgagaaaatttatattattaaaaggaagaaaaggtgtagaagtttgttgatttggtaaaataattcaacaatatttgtttcattaatattttttaactattctattacataaggattattcttcactgttgttttaaactatgtgtgctaataatggcaatactgaaatttcagaacagcgaaacaaaatttgaataatgaaacaaaccactttgttttgaaacaggattaacttgtgtgtaaaattccataaataata

SEQ ID NO: 46307 - DNA, 1044 bp, Homo sapiens
tactaagtatttgttatcttggtgtaatttaccctttcacacattttgcatagtctttaaataacaaaactaagcattaggcagacattgagtcaaagaaatttgaaccatacagagagtgaatatgaaaaaaaaaaccagaagggacttaacatatttttatgttaaagaaatttatgaaaatataaatctattttgactatgacttatacatgacaattgttgccatcaagtaggcaactgatgccctttacagtgtttagaacaaaactagtcctttatacaattttcatgaaaatgttaggtttctgtttgatcagcaggtgctgttgagatgaaagccatgtgtaaattttcagaaggccaaaagtgtcaattcagaaaaggaaagtgataagagaaaatgcaatcagttttcctgttttcaatttgtgcgggatttgaagagctgttttgttaaactgctacatctgctccaatatgaatattgaactacttccactaaaaataacaacctataatttggaagctactgcagtcttttgttaatgtgagtgggttatttaaaaacaaaaaaacaaaaaaataaaaaaaaaattttctattctgacaatctcttgcctaatgtgcattttcatttgttggcacttttatcctcagcagataaatggtagtatgcaattaagacctcatcttgtttgactataaaagaggtttccataggtgaaaatcctggtaataaaaaggggttcacacaaaacaaaatttattttaaaataacctgtttaaatacatgtattgaaaatcagatagttattccttacattctctaatactacaatttttaacttactgccggactgttgtaacaaagttaacactgttcttgcatactgagcattccgagatttattttacctttaatatacctgcaaatgtaagtttaaactaatcagggatattttactaacagggctttcagaataatcttttccatgcttaaataaaatgattaaattatgcttgagtgcctgcatacaaaag

SEQ ID NO: 46308 - DNA, 1034 bp, Homo sapiens
atttgttctgtagtattgtttaaatctgtgtttttttcttgagttttttgtctcaataatctatccatttttgactactattatggtattgctttctatttcttcagttccatggctgttttatgtatttagattctttgatgttgggtgcatatatatatatatatatatgtctacacacacatatacatatatatgtacactcatatatacatatatacttgtgtatgtagatatgtatatatacatatacatgtatgtacatatatacacatatatatgtatatatgtatatttatttatgtacacatatgcatatatgtgtatttttaaatttataatcattatatcttcctgttaagttaattcatttatcattatgtaatgaccttcttcatctcttgtaacagtttttggtttaaattctacttagtcagatataagtatagctactcctgctctttttgggttacgatttgcatggaatatctttttccatctctttactttcggcctgtgtgtgtcattaaatctaaagctagtcttttatagacagcatataactgaacctttttttatccattgagacactctatatattttgattggtgagtttaatatatttgcacttagagtaatttttgatagtaagggctttttattgtcattttttgttaatcgtttcctgtctgttttgtatttcttttgttcctctcttcctcgcttggtatcatctttgcaatttgataatttttgttgtgatatactttgattctttctatttatctcttctgaatctaatattagttttttttatcttttctgtatctattattagttttttttctttgtggttatcatgaggcttccataaaatgtttaacagtctattttaagctaataatagcttaactttaataacattcaaaagctccactcttactttttctcaaattgatttttagccttgtttcttgtaccgacagtgttttgtgtatgatatcagtttttgatattagtatttcctgtctgaa

SEQ ID NO: 46309 - DNA, 1015 bp, Homo sapiens
tcccattttgtagattacctttttattttgttcattgctccttatgccatgcagaagatttttagtttaatttagtctcctttgtttgtttttgcttcagttgcatgttctttagtgttacatccaagaaatcatagccaagaccaatgtcaagaaataaaaatgaattaaaggcaaatataagacataaaactactagaaaaaaagaagggggacattcattctatacctaaaaggcaaatataagacataaaagtactagaaaaaaagaagggagatattcattctatacctaatttattgagaatttttatcatgaaatggtgctgaattttattttttgttataccttaagttctaggatacatgtgcagaacgtgcaggtttgttacgtaggtatacatgtcccatggtggtttgctgcacccatcaacccgtcatctatattaggtatttctcctaatgctatcctttcccttacaccccaccccctgacaggccctgttgtgtgatgttcccttccctgtgctcgtatgttctcaatgttcaacccccacttatgcatgagaacatgcggtgtttggttttctgttcctgtgttagtttgctgagaaagatggtttccagcttcatccatgtccctgcaaaggacatgaactcattattttttatggctgcatagtattccatggtgtatatgtgccacattttcattatccagtctatcattgatgggcattggggttggttccaagtctttgctattttaaatagtgcttcagtaaacataagtgtggatgtgtctttatagtagaatgatttataatcctttgggtatatacccagtaatggaattgcttggtcaaatggtatttttggttctagatccttgaggaatcaccacaatgtcttctacaatggttgaactaattggcactcccaccaacagtgtaaaagcgttcctatttctccacatcctctccagcatgtgttgtttcctgactttttaatgatt

SEQ ID NO: 46310 - DNA, 2171 bp, Homo sapiens
agtatctgtttttctatagggtaaataaagtacaaaagataactgaaaaacagttgtgaagaccttttgctgccaaaccttcaaataatacaaagtatttcctttatcaccatccacttccctcttattttttattttagttagttctctttatacctagtaattgacatttataataacataagatctgactaaaatgtatgctactatataattttaataccatatgcttattaagtattagagcagttcagttatgaagctggtgttttagcaattccaactgatgtttaaacaggagaacgttttttaaacaggaattatgttccacactgtatgctacttgtattctctaaacataaaggagttacttggtagtaatgacactcctgccactgatgataacaccatatatttgcatagagcgttctagtttacaaatattgacttgcccagtgttgctcacaggtcagactctttagacacagatctgattctaaggctacaaggttatagctcatttaaggtttttttgctattgcccactgaactgtgctgttcttgccggaatcaatcatttccttcacagataaaccgtgcaggtaacctctataagcatgatggaaacctatgacaaggaagatcatgaacaaagagtatgagtgaagatgtgcatgttgatctaagcagggggtgaggtaatcagtaggtgtggaaaagatggaaaccaggcaagtttttaataaatatgatcttatcattttgttaattataacaaaataagcaatgtagagagaactgggctgaataagaacaaggcagaaaatactcaagcatggattatattagtaggcagtagtcaaatacacattttccttcatccctgctctcctaagataacccagaaaggagtggtcatatactttggaggatagccatatagatacttatcagtggcctgtgattctttcctccagccccattcttcctagatgattggaaaaacacttaagggagcattaagaggctctgattgctactcagtgatatacgtcagtctgagaggacagggcctaggtaaaaaagacttgtaacgatgattcacaatgacccttactgtcacttcatgtaagttatagagggctcaggtataccaggctggcaactgatggataaacggcattatgctaaaatacaattttggatttcatattaaagtatctctagatacccaggaataccttagaggaggaatggcttctgaccagggctgggacctactcttagttgttagtgtccttatgatagttgcaaaccagaaaggagtcaggttttcttgagtgtggaaactcctagagggaaaactgaacgaagagtcgatgacaagccaatacacccatttttaatgctcaagaagtaaactagccaggcacaatggcatgtgcctataatcccagctacttggcaggctgagggaggaggttcccttgggtccaggtgtcccagaccagcttgggcaacatttggagacttctgtctcaacaagaacaacaaagtcaactagctaaattggatgtaatgactaacagtaaagcatccatcttgtttgattaacaaaagagatctttaacgaaaaggttttaagaacattttcgcaaagaggaaatgacagctctccagcgtataggatattcaataaaggatgtaagagaactgtttatccatttgaaaattaaagttatatatccatgtcgtaccacatgcaaaacacagctgccagctaaatatttaatgtttaaagtattttaaaaatcaagaaaatataagcaagtatttatataacctaggggatgaaaacctttctaagcatgacaccaaggaagaaaccaaagataagaagatggatttggcaataaaaagaaaacttagaggtggcaaaaacactaagcagtaaaatgagaaaatacatttgcaacatactttctctttaatttgaagggctaattttctcaatataaagaatttttagaaattagtaagaaattccaacatccaacagaaatataggttaaggaaaaatataatttactaaaggaatgtatcgctaaatacatttaaaaagctcagcagtaataacacaaatgatactgattttttacctattattaaaa

SEQ ID NO: 46311 - DNA, 1141 bp, Homo sapiens
ccttctttctctttaaaaataccattctgatttagttccaatgtgcatttttcctttaaccaaaacttcaaacccaaccaacaaaagcttttgttgtcacaggttccctctcctaaaaaacaagctcaagatcagtctttttttttttagttatctcaaggtataactacttaaaaaactttcttgaatattcgacttcatctccattttctttttaaacaaatttcttttccatttatttatcaacaaactacaattgagcttttcacctcccactaaaattgctcttcctcacatcaccaaggtctttttttcctcttcatcctcactgacccccttcctgaaacttaaatgctactaaactctttcattgtcctggcttctctatttctttacatctccttttctactacttatacctaaaatatttttaaagggtttcctttaggccacttattatatataaaaacaatgctgctgcacacagtggctcatgcctataatcctagcactttgggaggccaaggcaggaggatcacttgagcctaggagtttgagatcagcctgggcaacatggcgaaaccctatctctccaaacaaaaaaacaatcagccaggggtggtggtgcatgcttgtagtcccagctacttgggaggctgacgcaggagaatcacttgagcctgggaggcagaggttgcagtgagccaagatcacaacacgccactgcactccatcctgggcaatagagtgagaccctgtctcaaaaaaaaagtttctctgaaagatcttatctacactgttaatgactacccttcaactaatcccctgacaagcataccctgtgatagctgtattcatgctcccaactatctcctgctctagaccagcactgtccagaagaactttctgagatgatggaaatgcttgctgttctgtactgtacagaaacgtagccactggccatgtgtggctactaagcacttgaaatgtggttcacgtggccgaggagctgaatttttaaattgaactttaaatagttatatatgcctaatggctactttactgaaccgtgtagctctagattagctattacaatgaaagacattatcttttacctagaagaccaaactataagcctggg

SEQ ID NO: 46312 - DNA, 1030 bp, Homo sapiens
agagagagagcatttctaaattcagttatcttccttgcagtattgatggagtaaaatacatttgttttaaaaaagtgttttttttttaaattatctaatgaaatattttatttttgacctgtgaatagaacaaatgtaaatagtagaatgtgaatctggttttcttttgcttgcaaattgccattctttttttttttcaaatttaaaattacacatgctgtttttttctttgatggggagaaagaactcattccctgagttcattcatttttgttgatgtcatcggtaatcttcaagacttattgaagtagagttgtatttggggaagatacattttatattcacttttttttttctttctgtagtctacctcttttactcaaactgtataaggaaatagtgactgattgttcaggtttggcattttcattgctacctgcctgcagaattaatgccctcttccttgtctaagatattactgtgttaagtgtcctgttaattataaatagttcaaaatggacagactgtcaacttgaaatttacttatgtaaaaagcttaggtgattcttagggtttccatgttcataactttacaaagctttataaaaataaaattgcaacttaatagagctaattaacttgtatttgtataaaaagaaaaaagaattgcagctcgatattgtgaagtttttcaataacttcattaaaccatatttatgatgggagggaccagacattctatagtaataatgtatagtgctgtgtataattccatggtttcttcaacatcttatcaaccaagtaaaattaatacaagatacgcaaaagatagtaaaataagaatctaattataggtgcaaggggactcaggcttatgctggaagaatctgacaagtggtatagtttgtttttctaggaagaatttactgatgagtcacataacttgcatgtaatattaggttctcattttttagcttcgaaactgtgtccatgcaaagactctataactgttaagacttgtgtggttgaa

SEQ ID NO: 46313 - DNA, 1033 bp, Homo sapiens
tgatcagtatttttgtgaacttgtatcttgttttcatttataaatgttgaagaaagcaggaaccaggtaattattaagcttagtttgggctaaggtacttcaaaaataagacttgctattatgtgtacctttttgtctgcaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggccaagaaagacaaggccattgaaggccgagaatccttacttgtttctacgaggtttgccttacctagtaaatgaagatgatgtacgtgtctttttctctggtttgtgcgtggatggagtaattttcttaaaacatcatgatggccgaaataatggtgatgccatagtaaaatttgcttcatgtgttgatgcttcaggaggtcttaaatgtcatagaagttttatgggttcaagatttatagaagtaatgcaaggatcagaacaacagtggattgagtttggtggtaatgcagttaaggagggtgacgttcttaggagatctgaagaacattctccaccaagaggaattaatgatagacattttcgaaaacggtctcattcaaaatctcccagaagaacacgttctcgttcccctcttggattttatgttcactt

SEQ ID NO: 46314 - DNA, 1024 bp, Homo sapiens
ctccgagtttgctgcagagccgccccctcccggcgggggcgctgacgtcacggaaaagccccgcggcgggtcggctgggctggttataaaccgcccggccgcggcggctgcaggcggcgggcaaggacggcgggcacagcgcagcactccccgctcgttggcccgggtatcccagcgcggacccacgcgatacgctgacgccccgacgccgatccggccgagccaagtaagggggacggcccgagacggagaagggagagagtgggagtttcccagcccgcagaactttcgaagttgagaaaagaacccctggaacgtgcgctcagcactgggattttctggtaggggtcagagcttcaagtgcaaaggatgtcgcttctcatcagcaggttccttagttcaattcggtagaagggtcacctccctctacagatcgagtggtcagagagggcagcccttaatgatgctttatgtatttgttgtttgaatgtaagtctgccaactgaggtgctgcttttgagactaaaaaaccggctggtcgtcctggttagtggcgagatgttggggtacggagtgtgggggtgagggtgggagaggagtgtttgtgcatcttgctgattgcaacgtaagtacttatactttatcaccagtagccggaaaaacagacctcccggctaggggaggcagtctgcaaagggaaagttgtagagaagttgttgaatatcatttaggggagtcttcagccttctgatttgcttcaagaaggggatctgagaatggtggctcaggcctgtgatctcagcactttcggaagccgaggcaggaggatcacttgaccccaggagttcgagaccagcctgggcaacatagtgaggccactgtctctaccaaaaaataaaaataaaaataaaaaaactagtggacgtggtagtgcaggtctgtagtcccagctacttgggaggctgaagtggaggatctcttgagcctggcagttggaggctagctacagtgagctatgatcgtg

SEQ ID NO: 46315 - DNA, 1069 bp, Homo sapiens
atattctctttgcccctttttctctttcttcttgtttaattctgacaatgtgtatattaatccacttgatggtatccaacatgtccctttggctctgttcacttttcttcaacctttttttctttctgtttctcagactagataatttccattgtcctgtcttcaagttcactgattcttttttctgcatgctcaaatctgcctttgaattcctttagcgaacttttaattacagttattgtacttttcagcttcagcaattctttttggtatctttttaggttttctgtctctactgatatttccattttgtttatcatcatttttttgactttctgtacatcttcctttagttttttgggcatctttgagacaatcgttttaatcattgtctagtagctcttccatcaggtctttttcaggaacagtttctgttgatgtattttttttcttttaatgtgctaaactttcctgtttctttgtattccttttgatatttttgttgaaaactggacatttgaatctaataatgtggtaactctggaaatcagattctctggaaaactccttttgccagggtttgctgtttctgttattgttgatttatttatttttttattgtggtaggttgtctctttaccaaggatcatcctgaatattaaacttaaggttttctcaggtcttctctgagcttgtacccttccctggacatgtgtggtcactttctcatttttctgatgcagttgtttttgaaagtcatagtctttaaagtctggatccaaaaaaagacaaaaaagaaaagtgaagaaagaaaaaaatggtgctggccttttaaatccattgaaagtcacctcagctggagggggaggggcttgcaacaatgagaaggagtgaaatagcaatggtcacctgccgtttgtctgcaaatctgtgatcagaagcagctatcagtaatctgaacacagatccctagtatttggagaacaacgcttgttttgcccattctggctccagcaagctgtgtaagctgctccagcaacacgtacacagctctcagctatggttaaac

SEQ ID NO: 46316 - DNA, 1045 bp, Homo sapiens
ggtggaagggacaaggagtctctcttgggcctcttttataaaggcattaattccattcatgaggactctgccctcatgacctgatcacctccccaagaccccacctcctaatatcacattggtaatatggtttcaacatgaatttgggaaggacacaaacattcagactatagcaaccccttatccccttctcaggccttcagactcagactgggacagcagattttgggacttcttgccttctataattatgcgagtctattcccataataactctctatatatctatttatctctggacaattctgaccaatacagatgtataccattgtttagcatctgaatggaacaaaattacaactgctacatttgtttaaagaaaatctataggaatgtcaatctaatgcttctgtctcttacataaatataatgatgctaagtaaaagtttagtatttataaacctctgtttattatgtatgcagtatagccattatggactaatataaataaatgagataagataggatcaatgattttctgaagcagaccaaaatgaacacgtgaaaatcaggtgcttgaaacatgtgataatctacatttatttagctctttacagataagtggtttgctcctcacaacaatgctgagagttgaacagagcaaatactctattatctccgttttatagatttaaggcttacagagattaaataattattcaagatcattcagtgacagagctgaaacttgaacaccagcccctcttttaactcaaaatctgaagctctttccagtgcactgtcctgccttttctatgatttcaccatgccaggttcctgagacagatgtatatgtgagaagaaaaatgaactaatgtgagtgtttcatatcatgttctcttttcaagtgaattaattaaagaattgggttttggattagggtgtgtgaatttcatgagatctgaatcttatgtttatcctttcacagaacaatagacatggtattttacaattgaagcagttgatttgattgaccaccctttct

SEQ ID NO: 46317 - DNA, 1043 bp, Homo sapiens
cttcacttaccatttgtgtgttcccttgtaatttcctttaagagctttttctttgcattcagaacttggctaactaatgcaagagtcctagcttccagcctgtcttggctttcaacatgccttcctcactaagcttaattctgtctagcttttgacttaaggtgaaaaatatatgacttttcctttcacttgaacacttagtggccattgcaggattattaattagccgaatttcagtatcgttatgtctcagggaatagggaggcccaaggagagggagagagatggggtaaccaacagttggtggagcagtcagaacacacacaacatttattgattaagattgctatcttacatgggcataagttatggtacatcaaaacagttacaatagtaacatcaaagatcactgattacagataaccctaacatataataatgtaaaagtttgaaatattgcaagaattactaaaatgtgacacagacatgaagtgagcatgttttggggaaaagtgtcactcatttgcttgatgcagggttgtcagaaaccttcaatttaaaaaaatcacaatatctgggaagcacaacaaaatggggtatacctgtattgtcttgaggtgttaaatactcagttatgtataatcaaggatgaattcttttaatttgttagtgccatacctgggtagctagctgtacatctaggattcatgaacaggcagtttgggaccaaattcgtcagtgaggaagtagccaactagtaataagtaaaaatggtatttcttggccccatgtatatagacttcatgcatgaggctttatatacaacttttttttttttttaagagatagggtctcactatgttgctggactgaactaaactttcaatatctatcttgcatcgtatccttttcaggcataaagtacttaaaaaacattgataaagggcaggtaattctgcctgtctttttaaacaaaaatttatgtatgtatgtatgtatgtatgtatgtatgtatgtatgtatttattttattcacatagttc

SEQ ID NO: 46318 - DNA, 1269 bp, Homo sapiens
agaccagtctgggcaacataatgaggccctgtctctttaaaaaaagaaaagatcacccatctccctgtactctgatttaatattcaccagacaccttctgttagtggtttgactttccctggggacgttctttcataggacagaatgcacgtgcatagactgattggtctaaataggcaggtctcataggtcaatacattttcattctgacttattcagtctcttaatttggttaatatgaataatttccctagagcttaagcatattcaagtttctgaagatgaaaaactgtatactagaccctgggcctgtggtcctttgatgatctttccaagttgtaggcagagctaacctaaagcagccagcagctacttctttctcctcatatgtcccagtgatagaaatattttagagttcctagtatttttaatcaaatgactacacctaaatattgctgtattttgacagtaagccaaattaaaattagtactctgtgcccagcatttttatacatttcacataggattcactgcccttaaagtgtttctagtattactaaagagggggtgcaacacacaggaaaacatttgtgaagtataaaaaaaagtcattcgatcttaaacaaccctggggttaggggggctgacccctgtgtgtgctgttgaaaatccctttataacttgtatgacttttgactcccccaaaactgaactacgaatagcctactgttgaccagaagccttaccagtagcattaagtcagttcacacatattttgtatattatatactgtatttttacactaaagtaagctataaaaagaaaatgttattaagaaaagaatgaagaagagaaaatatatttattattcagtaagtggaagtagatcctcacaaagctcttcacattgagtaggctaagaggagaggaggcagaggaggggttggccttgctgtatcaggggtggtggcagagatgggagaaaatctgcatataagtagacttgcgtagttcaaacccatgtgttcaagggtcaactgcatatcattaactgctcaattagataaagtcaaacctgaaatgtactgtgtaaccataaaggttaaaactcagtgcaaacaaaggctatgaataatcaggtataatttgcactgggtcctcaagtgtttataggattgggataattgagcagcaaaataaaaaagtattccagacaaggggtttaggttgaacaaagtttcaaaaacagtgataaatctggtaaatatg

SEQ ID NO: 46319 - DNA, 1051 bp, Homo sapiens
tgtcagcagaataaagaagagaattgtattcattactaatatttacaattcccctattttctacttggggcttcattttccctaccatcttcagcccttttggaaggaatggtcaggatatgattattcttactgtgtcatcgtcattttttccttcatgtgtcgtttatgcatgtcacagctctctgaagttaaatgaagagagagaaggagtatgaccaaaaacttgtacctccttcctatactgatagggtggaaatatgccccagaacaacagagaggagaaaactcctcctcttctgttcttactgtgttggggtggggaagactatccacctttaagaaattcctcatgatttgacttccaatttgtataggaggattgtattaaccattatcaaaagcgatttttaaaatgatctgtgctttaaaaaaatgattttgggaaatgctaaatgacctttttattttttgaatttaatcacgatgataaagacaaaaggactagggtcaaatttcatagttatacccccaagattttctggatgcccaatgaatgtttgtcagtaatagtgaagtggaaaccaaagaataggaaaactagtgttgaatatttataaaatgccatttttaaaggaaaaaatgagtcagggaaataggaaccatactctgaatgattttcatatctttggctgtttgagaagctgagtggattcgttatacttgatttccagtgctgcagttcagatttctttactggcctttgatcttgagatcactggagccagaaaagtaatgaaaaaaaaaatgagttagctgaatttagtaacactgagttagaagagaaaaagactgtttcttcttactgcttaaggatgggggtcagtattgcttatttaaagaatagttgcagatataaagtaaaaatgtttagcactagaagggagaagaaaaataaataaaaaagaagagtgagaaataaaatatactgaaaagtactgaagataagaaataaaagtagttcccttcctcacttgaaaatcataatttt

SEQ ID NO: 46320 - DNA, 1027 bp, Homo sapiens
gccaaagtattgatctaaaacagccacctaaatagtagccgtaatttatgttggtaatttttttctctataccttgaaatggaacacatatataaaattgcatattggttcttaatttctactaagaagaaatacaattaactgacaaactacagttgactcttgaacaactcaggagttaggggtgctgacccactgtgtagtcaaaaatctgcatataacttttgcagaaacttaactaataaactaccgttgactggaagccttactgataacataaacactcaatttacacataatttcatatatgtattatatactgtatttttacaagaaagccagaaaaaagaaagcatgaagaaaaccataaggaagagaaaatgtatttactattcattaagaggaaatggatcatcataaagctcttcatccttatcatgttgagtaggctgaggaagaggaggaagaggaagggttggtttggttgtctcaggagtggcagaggtggcggaagaggtggaggagatagaagggaggcaagagaggtaggcacactcatttataacatttattgaaaaaaacccatatataagtggactttcacagttcaaacccttcttgttcagtggtcaactgtatacttatgtattttggtaatatccttaattcccttggactttcttaactttaaaaatataaaacatacacttctaaggtctttaaaaatataaagtggcataaaaatacatggtcttactaataatatctctaataacatttaattttaaattatataacagtaggtctgtaggataacaacttttactaaattatatgtattatatcaagtgtttagtgtttaatttttttatgatgcagggagctatttttgttgaggacttcatttactgacagaatcataaaatacagctcagtagatcttgctgattaaatataatacaacaatatattttaaactgttttgatatctgaaaccaataaaaatcactcaactcttagtgatgag

SEQ ID NO: 46321 - DNA, 1039 bp, Homo sapiens
gcccaggaagtggaggtttctgtgaaccaagatcacaccactgcactccagcctgggtgacagtgagactctgtcttaaaaaaaaaaaaaaaaaaaaaaaatcaagttttctttggcgcttttactacagcatgtcgatatattgatttagagtacaatcatgttgcttaatgacaggaatatgttctgagaaatgcattgctaggtgatttcgttgatgtgtgaacattgtggaatgtacttcctcaaacctagatggtatagcctgctacacacctaggctgtgtggtatagcctatggttcctagactgtaaacctgtactgcatgtgctgtgctgaatactgtagacagttgtaacacagtggtatttgtgtatctaaacatatctaaaaatagaaaatatacagtaaaaatatggtattaagatgttacgggaccaccatcatatatgtggtctgtggttgatcaaaaccttgttgtgtggtacatgactgtatactaaagtgtttaataatttctagtaagtgtgagtgggcttatttcaacctcttttattttactctgttaaattgttcatgttgctttttttttttttttttttttggtgggggccaggctgtgagagaagagggaggagtttttaaatgacctgggtttatttaaaatattgtaacagccccgtaacttagtacctcctattaaagaaaatattaaatggattcttaattcttccagcacagtcaacacttgtgttccatgtattttgtagcattttacatattaaaattcagtagatttattttttgctttaattttattttcatttatttatttatttttttgagacggagtttcgctcttgttgcccaggctagagtgcagtggcatgatctcggctcactgcaacctccgccttctggtttcaagcaattctcctgcctcaacctcccgagtagctgggattgcaggtgcctgccaccacgcctggctaatgtttgcatttttagtagagacagggtttcaccatgttggtcagg

SEQ ID NO: 46322 - DNA, 1039 bp, Homo sapiens; identical to SEQ ID NO: 46321

SEQ ID NO: 46323 - DNA, 1063 bp, Homo sapiens
ggaatatataggggaaagtttgctagtacaatggaatgtacacttggctttctatctgcaggtttcacatctgcagattgaactactgtggattgaaaatattcaggcagaaaaataaataacagtacaacaataaaaagtaatacgaaatttaaaaagacggtataactgaggtaggagttgggctaatccccagttttggggctcacttgtcctgtatcctaacaactatttacatagtatttacattatattagccattgtaagtaatctagagatgatttaaagtatatggaaggatgtgtgtaaattgtatgtgaatacaaacattttatataagggacttgagtatctgtggatcttgatggggtagggggtgtcctgaaaccaatcccccttggatactgagggatgactatacacttaagccaccagacatcttgcatatcatagacaattgtttggggtccatgagctttaattacaaaatgtaatgctgggagaacatagagaagagtgattttgttttttaaatgtagacttgattctgtagaaatatactacatttgataaatatactaagtatatagattatttcatccaatatattagtaatttagatagtggatagccactttcctatctttctcttatccatatgaatgtaatggatatgttgttacaacttatgattttctaaactagctgtgatttataatgacatcctgagaaaagtcagtgaaactcatttctaacgaataccagatttcttaaaatagtcaagtatttttcttttgtgtatgatgagatattaacttggtgttatttcatttttttttttaaggagtcattctaccctgttctatctttacttatgtgaaaatgtttaaactatgagtttttttcatgtgccttcttttggagtaatgtcaacttttaaatacacatgtttaaataacttagagtgtaataaattgtgtttaatatatactgtagataatgatggttaaatgctttgttaacacatgttcttttaaatacaagatactactttgtactgatt

SEQ ID NO: 46324 - DNA, 1049 bp, Homo sapiens
agataaggtattccattgaagctattatatattttggctgtgtgatttaaagacatgtcttaattcattttgaatgtcctgttctggaaaaaatttctttcacagtaaaaatcagaatgaacaaaattaaaattttatgtattttataagtattgttattttagtattcatggaaataaaacctcaattcttaaagcatacatattaaatttatattaaatctctaatatgtatgttacttaagaatttctatttttgctggggttttgttgagaagggatttttaagccaagttgtagaatggggtgggtgtaatttcagcagtgaaggggaccatgggtgtttgaagtcaagagtgagacgctggaaaaaagacaaaagaatgggaaaaagtggattgagtatataagcacaaatgcagtgctaagccattgattttaagtgaatgtagagagagtcaatttgggctgtagtatcctggactaggaaggacatctccctggactaggtagggtagctgctgtttagctccagcagaattttcacatgcggggataaaccagaaatctgcattttttaatgaggaatcttccaattttaaaatgtttgcaaataacacaaaatgcttttaaaacattatacagacaacatgtgagtgggcctcactgagccattgggcttccactttgtggcctttggagtagaccaatggttttccaagtatgggtcctgaccagcagcatcagcatcacttgagaacttgttagaaatgtaaatccatttccaagtgaattagaaaccctgggggtgtcagcaatctcttttaataaaccctttagcgattctgatgcatgctaaagtttgagaaccagtgaaacagagtattttggaacctcgcttggtgcctaaatcatactagtctcaaaatttttgtcgaagagtagttgaaagtgaactgagggatataaatttggatgatggttgataccagattatgaattacattaaatactttttttttttttttttgagatggagtcttgctttgt

SEQ ID NO: 46325 - DNA, 1045 bp, Homo sapiens
gtttttcactctcagacagcacagtgattcttcataaaactctatgactacaccaacgagcattggcaaagaacaaaaaattattcgatgtcttttaccagttccataaactggcagtgattcatagcatttacacatatattcgtaatattcttaacaagtatatccatgataccttttcatagtctgctttagaaagtcctgcatagtattttccacttaattctgcatcagtagtatagcttcttttaatttaaaaacttgtccattctatttttaaactagaaagataattttattgtaatataatcaaacagtaataaatatttcagattaatcatcaattacaatttacataggttatcactaatttgtgctgtctgcattgaggactaagctctgatttttttttttttaatcttgcctaaattcctatctaaggggtctggggaatcatgctctgtaaaccatacattctcatcagatggttttatttaaccctgtatatcatgacttactttccgatctgactctggcataacatggaagaaaataaaaatattttaccccaaaacatgtttctctgccatatcttgaaatggtcgtgcaaagccatcccttgtgggaaaaatccacattctatagagaatccactttccccttgttttccttccttcctttctagatccaggagataatcaagtaagagccaggcactcttttaggtctgataataaacaatatacaacctgttctctctgaagtctgctatctgagagcttcctctgcacaataaaacttggtgcctacaatcctttatctttacctgaacatacatttcctttctattgatcccaggtcttcagataaactcaaccaattgtaaaccagaaaacgtttatagcctggaacaccgcccccgccgccaccccgcccccgccttgagttgtcccgcttttctgaactaaaccaatgtatttcttaaatatatttggttgatgtctcatgcctccctaaaatatataaaagtaagccatacgccacc

SEQ ID NO: 46326 - DNA, 1045 bp, Homo sapiens; identical to SEQ ID NO: 46325

SEQ ID NO: 46327 - DNA, 1005 bp, Homo sapiens
aagtttcaaatatgagtacgttttcctcaaaataattcatgcaattcattaagattaatgtacttaagcctaagtgtggtggttcatgcctgtgatcccagagctttgggaggctgaggtgggaggatcacttgaggccaggagttcaagaccagcctgggcaacatagtgaggccctgtctcttaaaaaaaaaaaaattaatgtacctaaatacattcttttcataaaactatctaaaatactgcagatacaactcagctgttattgtgggtgctgtgcttcaaataaatggtgttattcagtatttatctgcttacaactttgacacttgtgaataaaaaaatcaagacaattaaagtggtaaaaacaaattttattcagtaaccactggcaataggggaaagagctgagctccatgatttgtgcagtcatgactgggccttttaaagggagaatgagggagtacggaaggggagcaactgagggctcaagtagcgtcaggaaagtgaaaattacaaagggctggtgctgtggtttgaatgtttgtttttcccccacatttatatgttgaaatcctaacccccaaggtggtgatattaggaggtagggccttttgggaggtaattaggtatgagagtggagccctcatgaatgcgattagtaccctttaaaataggcccaagagatctcatttgttccttctaccatgtgacgacatactgagatggcgtcatctaagaaccaggaaatgggcccttaccagacaccaaatctgctggtgtttttatcttggacttcctagcttccagaaccacgagaaataaacctgtgttgtttataagccacccagtttatgatactttgttatagcagctccaggctaagatagttggtcattgtaaatgtgagtgggtcaggtgtgcctgctcgctgacagttatcaaaattaggattctgtccttccacagagactgggacacagagatccaaaccttcctgatgat

SEQ ID NO: 46328 - DNA, 1005 bp, Homo sapiens; identical to SEQ ID NO: 46327

SEQ ID NO: 46329 - DNA, 1098 bp, Homo sapiens
aagataaagtcatactggattaagatagaccctaaatttaatgactggtgtccttatgaagaaagagatagaaacacagagggaaaaagaccatgtgatggtggaagcagagattggaataaccacccatgattgctggaaaccaccaggggctagaaagaagcaaagaaagattctcccttagaaccttcagagagagcatagccctgctgccaccttgattttggacttctggtttccagactgtgggagaataaattctgttgtttaaagccacccagtttgttacaggagtctcagaaataaatacaggaagccccagatctcttgggtattcagagctatatagtttctttagaaaaagagaaagtttttttattctttctgattctttctcattctgaagaactgtgagaggagactatgccatcttctgttatctgtttacctgaatctccttcacaaaactgtgacatgcaaaggcaggaatgttctcttgttaaggttttaaatcaaactatatagatttaaaaatgttttgtgactgaacaaagagatcctgagaaacttacagttttctctagttgagtctcttggctgtctttggcttcagagtgcttcagggaagtcaagtagccacaaagaggctattggaacattatagtttgcaggctctggtaatatttgagagaataatttcacaagtgttttggaacaaaagtcatgctgtaatggatatgtgatgaatggaaataggccagtggaggaagtgaatgcgagtaagtatgtaaataaagtttgtaagtaaataaataaattcggtagtgaaggaagtagtatctcgaggaatggtagggggctagagagttttgttgtgtttttgttttaaggtagtatgttgtaggctgagaggaaaaaggtagtgaagagtggaagattaaaggtataacaggggagtgataaaaatctttccccattggagaagttagctaaatgtttcttaagtgggtcttaggtccttggagatggttgggcatattctcaagggtttataaattctcagataagttagacttttgtgttttcttttaaatgata

SEQ ID NO: 46330 - DNA, 1091 bp, Homo sapiens
tatatatttgtttcttttagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacaggtaagactgctttttattgataaggtttatgcttgaccaatagtattacagtattctttaaatgatgttttaagaatgaatatgttatattagaaaattgttgatgtaataccactacattgttggtagttcaggttttttgttgtcataatttatctttagtgattggattaataactgtgtgattaaagtgctttatagtagatgtatgcttaagactgttgattataaacttggtcaaatgtgatcttttcctcaagaaccaagattgtgtttaaagataggatttatacattttttttctaaaaagcatgttaataggactaaaattggagagttgaacttgaaagtagttacttgttaattcattagagtctggagtacttcaaatcagagttgaattattatgatacatacttgcatgaaaaccaagcatttaacaaatgctccatccctctattgttgaactgagttaaaataatgattatggttctttttgtatatgtaagagaacactatttgttaggtaactaaaaaaataattaagatggttcatagatgtttatttggtcttgtgaaagccatcattagactgtatttttccaaattacattttattcatgttttggttgaatgaacagattcagccagccggccccatctgttgggctacagaatagtaactgccatccttatgataccagtgcaaatcaacaaagtgccctaagcaccattttgaaggaagttcttggacttcctgatgattaatgaattttacctgtgaatgggtttgtatcttgtccggacagaaaggaattctgtatttacctaactggccattatcttggtgccatttatgtgctcctcataacttttcaaaagctgtgactggtgtcagaaca

SEQ ID NO: 46331 - DNA, 1033 bp, Homo sapiens
tgagccactgcgcccggcctcttgtttcatctttagttttccactccagctcaagtccctcccttcttattttgatgcaaattccaggaatatgctttcatttgtaaatttttagaatatgtccctaaaatataagagctttttaaggccgggtatggtggctcacccctgtaatcttagcactttgggaggcctaggcaggaagattgcttgaggccaggagttcagaccagcctgggcaacatagtgagaccccatctctacagaaaaaaaaacattagctgggtatggtggcacatgcttgtagttccagctactagggaggctgaggtgggaggatcccttgggcccaggagttgaaggctgcaatgagctatggtcgtgacactgcactcttcagcctgggtaccagaccgagaccccatctcttaaaaaaagaggtgggggcttgttaaaaaaacccaacatagtgagattaccattatctcacctaaaaatatttaagtattgattttagtattgagaaatttaacaagaaaaagagcattttattatgagaatggcatgttatgatttgtttaaaaacttctgatatgtttaaaatacactataattataagcataatttttcattctgtcatatcattcagttttagtagcataatttaaaatagttctaaaaacaagcaataaaaattagattttaattaattagttaattttttttttttagatggagtctcactctgttgcccaggctggaatgcagtggtacaatcttggctcactgcaacctccgcctcctgagttcaagcgattctcctgcctcaatctcccaagtagctgggataacaggcacttgctaccacgccaggctaatttttatatttttagtagagacagtgtttcaccatgttggccaggctggtctcaaactcctgacctcaagtaattcacccgcctcggcctcccaaagtgttgggattacaggcatgagccaccatgcccagcagatattaatttatttttaaat

SEQ ID NO: 46332 - DNA, 1078 bp, Homo sapiens
aaagaaatatactaatggattatagcccattgaataatacaggagtcagaatctatactaatatatgtaaataaatgaataaataaataaatgaagattaaactcttccttacagtggaatgctaaagcatagaagtagaagtaatgatggtgttagagagtctcaatggatgccaaaactagtgggtaaatgttcaatgaggaaataggatatttgaatatattcaagtatctcctcacaacatacttaaaaaaattacaaagggaaaaatactttggcagacaccaccttaatcagtgatcaaagttaatacctctggtaatggaacaaaccgatattatgtgcctcctaatatgatgaactgttgtattcttgccccaaattcacaatctgaaactaatcatagggaaacatcagacaaatccagattgagggatattcagcaaaataactggccttattttgaaattttgaaatttcaagaccagaaacgatgaatgaagttagagattgaaggaaactaaaggaacatactgactagatgtaatgtgtgatctaggattggatcctgatttggggaaaaatctataacagacgttattgcgataagtgaccaaatttgaatatagactgtggattagatactggtattataccagtgttaaataatcaattttgataattttactgtgattatggaagagagtctttggaaacacaccttgaagtatttagaggcgaaggagcatagcgtctgcagtttactctcacgtgtgtgtgtacacacatacacagagcaaaggaggagagggaaatggaagaaaatgtaaaccaatggttaatatgggtaaaggtatataggaatactatttttggaatgttaccatgaatttgaaattatatgaaaataaaatgttgcaaaaaagaaaatttgtgaccttcattagttgacttactttaatatctgatcagatataaaaaatataaaaaaaatttatcaggtttttttttggaaaatttatttactaaccatgaaatttattaagatgagtatttatggccgggtgtggtggctca

SEQ ID NO: 46333 - DNA, 1095 bp, Homo sapiens
attatgtttatccatccattcatctatttgatgcatgcttgggcagtttccacctttttgctatggcgaataatgctgctgtgaacattggcatccaagtttctgtttgtgttcctgttttaattcttttggattataactagaaatggatttgctgggtattatggtaattctgtgtttagctttctgaggaaccgtcaaactgtttttcatagctgtaccattttacatcttcatcaggaatgtgtgatggttgtagtatctacatcctcaggaacacttgttattttccatttaaaaaatttttttattattggcatctcagtagttgtgaagtggtatttcactgtggttctgatttgtatttccttaatgactagcaatgctgagcatcttttcatgtgcttattggccatttgtatatctttggaaaaatgtctatttaaggtctttgcctggtttttaatggtgtctttttttgctgaaaaaaccttctaatttttgactgctttttttggtctgtatgtgtttgttttatcctatatttctttcccaagtagattgtttagcacttaccaatgtaaaaattctggcacactgtaaggagaaaacataggcttttgttttcttaataaggtttctttctttctttcctttttaaaatacagctttatttaggtttgatagagtttggatatttgtcccttcagaatctcatgttgaagtgtgacctccagtgtttgaggttggcctaatgggagatatttgggtcatgaggggcggatccttcatgaatggcttggtgctgttttcatggtaatgagtgagttttcgctctgagtccacatgatatctggttgtttaaaaagagtgcggcatctcccccctccctcttttgctctccctcttgtgattgagatgcagtttccccctttaccttctgccctaattataagcttctggaggctctcatcagaaacagaagctggcaccatgcttcctatacaggctgcagaactgtgagccaaaataaacctcttttctttataaattacctgtctcaggtattcctttatagcaatgcaaactaataca

SEQ ID NO: 46334 - DNA, 1622 bp, Homo sapiens
attctggtcattgtcctgtatgttgaactaccccttctctatctccttcacaggaccttcatcatttctactctccgataatactaattataacagataacattgagtgcttactatgtgtcaagttttgttctaagtgctttacatatttcatttaatcctcccaacagtccggtgtgtaagcatgattatggtaccccctcttaaagatgaggaaactgagacacatggagccaaagtaaactgtgcaagaccattagaaagtgtcagtccacatttatattcaggcatttgctttcaaagttgtgttcttatttaccacagtgtagtgccaagtacttgtggctatctggtgtattacagttgtcagcttggccttaccattttacttggaaggactgaaactaataggtgttatagaagttgtagcatcacatcagggctaccaaatggctttatttctaggacctggggaaagggctcagacagcactaattaattaattaatttattatggacaggacaatatgaacatacagaaccagtttaaaaagctataagggtgcaatggtcttttggggggaaatgtactgatttctgcattttactttgtatcaacaaattaaatggcttgatggatgcccaaggtcatatgtaagtagcagagttgggattctagccaggcagcctggctggctccagagtcagtctgttttcttaaccactgctctgtgctgatggttgtatgcttgcattatcatttttattagtttacaaaataggaggattgaaaaatcagaaatcatgtattagatgtagaaggatttagggtagtaattcttcgcatttagtgttgaaagaaattttagcatctagttcattctttattttataaatgagaaaattggtgtctagagagttaaatagcttccccaaagttaagcatccctgaaatagcagaatctgaactacactctggtttccttcatttctactgttgatgtttctaactactgtattttttaagtgttcctttttaaaaagtgtcagaattttcacagtattagaggggagtctgactaatgtagagaacagaactgattacatttcatgatgtggacatcatatttttattaatgctatctagaatttattagtttaagaaggctcattatcttatttcagttgagctatagtcactaaaatctttagttttaaatttcagcttctattgttctatttcatttgaccattaagtaactgagtctaagtgcaaggcctaacatccatgtcgtcctgtgacagttaccgttaatcaatttcaaacttgtgtcagttatatatttagaggcctgtagtattctgcttacccattataaaaaggaaattagtttaatgaagttattttggcatgacttgtttggtcagaatttgtactgacttctggtattggtaaatactgcttctaaagcagtcaaaaaccatctgtttcataatttgctttaagattaaagattatactaatagagatctattttgtccttgaataagaaacagaagagagtgatctctcctactcattcctcaaactatataaaggctggttatatataaaatattta

SEQ ID NO: 46335 - DNA, 1025 bp, Homo sapiens
gaaggtttgaataagaagtgaactggattattttaaaacattgttattcataacaatgaaatgtgagtacttttcttagctagtttgttatattatcccagaagtatgatagatacttgcaaagttagcagaattggagtacaaaaaaactgaaatataattttgggtattataaagattatttttgctagaaacctgaaagaaaaatgttttatggcatgtttttgttttaatagtggaaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgctgaaagtaaagaagtggttcctcaagatggaatacctccaccaaaacggccactcaaagtatcacagaagatttcttcccgtggtgggttttcaggcaatagaggaggacggggtgctttccacagtcagaataggtttttcacaccacctgcttcaaaaggtaactaattagtatgtattttctaatgggttagaatattggaatgttaaaatattgaatgaaagtgatttagatggaagagattcagataaacagttttcctgttgctgcagttgagccacctctggactagtggtactgtttgcagagtactctattggatagaagaaagaaactttttttcaatgaacctttcatgcattgtacttttaataatgagtttagaagtcttggctaattattccccccggccttttttttttgagacaagagtcttgctctgtcgcccaggctggggtgcggtggtgtgatctcagctcactacaaactctgcctccctggttcaagtgattttcctgcctcagcctcccaagtatttgggactacaggcatgcaccacaatgcccaactaatttttgtatttttagtagagatgggttttcgccgtgtttgccag

SEQ ID NO: 46336 - DNA, 1034 bp, Homo sapiens
aaggaaagacctggctactattttctatttcctatatggcatctggaactggtatttcactttttacattggagtgcttttctagaaacatttttggtgatagaatataggagttatggtatagcttctgggagagttttgagtttgtttgcagtaaatggcagattgtatttgtgtttattctataaacaaagtttgctgtcattcttttggggtgatagtaattttataaaggcaaatttggaagttgacagaattaaaatttcatgttagaggaaaaggcactcagcaaaatatctccccttgggtttcattcctttagaaattaataaattttgtttatactttttttgggtgggtgtgagaggcagtggcagagataggtgaataaacactatgttacattaatttataagcagtctattttgtaggtatgtacattttttttgagacagagtctcgcaccgtctccaggctggagtgtagtggtgtgatctcggctcactgcaacttcctcctcccgggttcaagtgattcttctgcctcagcctccctagtagctgggactacaggtgcgtgctaccatgcccagctagtttttgtatttctagtagggactaaagtagggatggggtttcaccatgctggccaggatggtctccatctgtcgatctcgtgatccacccgcctcagcctcccaaagtgctggtattacaggcgtgagtcaccacgcccagccctattttgtaattttttaatgttgtaaattgttataaaaattcattttaattatatagactatttaagcatgtaaacatctaaatttgcataaaccagataactaagagtaggcatttctttcattttaaaactaaattgtttaagctgggcgcggtggctcacacttgtaattccagcactttgggaggctgaggtaggtggatcacttgaacccaggagtttgagaccagactgggcaacatggtgaaaccccatctctacaaaaaatacaaaaattagccagatgtggtaat

SEQ ID NO: 46337 - DNA, 1047 bp, Homo sapiens
taagtaatcgattccatttttaaggttttgctttcaaatattcaaaagtatcagagcacactttttttaaaaagagcttatttgaaaaaaaaaaaaaaaggtccctgctactattgctagatacagagaacgattctgtgatcttgaaagtgattagtattttagactgcagatgcattttgttattactgtccttcttcgacacctggtgtcttctattaccagaattgcattttgttgtctaaaacatcctattactctttataaaaatcaatatgagctatatggcttgtttataaaatgtgaatgtcaaattagctatattgccatctatgttagctaaaattatgattctttagacatattagctttcatttatgaaagatccattacaaaaactaaggttttccttgcacaaattgatatttttctttttttttatgacagaattgttggccacctgtattatctggggggatcagtccttgcattatcattgaaacacctcacaaagaaataggaacaagtgatttctccagatttacaaattacagatttaaaaatctttttattaatccttcacctttgcctgatttaaggtaagaaaaatttcagtaattttatttcaaagatataaagttgtgctgatttaatacatggcactattttgtcttttgctttcataaagtagaaaaacgtgtaaaaattgtttactaatatttaatcatatgtcattttatctgagagtagtgctggttgcaaatgatatgggtatttaaaacactgattctataaaattattttcatttgcttgctgagtactataaagacttaacaggactgaattagttttttgttaagatagaaacatttttacatgtacagctttttcctttaaaatttttattcgtgtttcttgcagcttcaactcaaaggaagcttttccaattgatgtatcaaccctatttatttcttaccaaacttaataaggtctatacttaattcttttttctagtccatgagtgtaactaagaggtacagcttata

SEQ ID NO: 46338 - DNA, 1085 bp, Homo sapiens
tcactggtatgcaaacagatttgattttgcatcctatcatttaaaaagaaattatgtctgcaccccaacataggcatacttaagtaatatacatactcctgtgctaacatgtatactagaaaacaaaaagatgttagaaaaataaaagtataaagacaaatcatactgtccccatatcccagtgacttttccactttggaaatgattgttatgaagtttaagggttggatactagtcagttaaaagttttaagattatagggtaatttttaaaaatataaattagaatcattggcaaggcatggtggctcatgcctgtaatcccagcactttgggaggccgaggcgggcgggtcacctgaagtcaggaatttgagaccagcctggccaacatggtgaaaccctgtctctactaaaaatacaaaaaattagctaggcgtgatggtaggcacctgtaatcccagctactcgggaggctgagggaggagaattgcttgaccccaggaggtggaggttgcagtgagcctagatcacaccactgcacttcagcctgagcgacattgactgtctcaaaaaaaaaattaggattattcaatgttgtcatcatttccactcctaaattctgaaatgctttctttggtagaggtgagagtgtggagccacagctagtagagaaggaacagtaggacctgcagcctccctggttttccaggacaagtcattgctgtgtgtggcaggaatgccttacctcaaataacaaaacagtgtgaaaaacgaatttgtgttacatttaaagtttgtaaagcaatgagaaatgtgtgtatcataaagagcatctttaaatttttgctaaaatattagcctcttaaattctctaggaaccccctcccccgcttttttttttcctttcgctggtcgttatttttctaaacctatcctgaaatcatgtcaattttcttttgtatggttgaagacaactagatcacttgataatggttttgctcaggtcacattgtgacaaggttttaatgtagtcctactttgcagaaggaggccaagaagatgggctgtctagaaccccctttaa

SEQ ID NO: 46339 - DNA, 1032 bp, Homo sapiens
aatatttagttaaatgtgaagtctgaaccctttatgttatttttagagcatccgctcccccatttatcacagatttttggaactggttttcatcttatttatttgtccatctaataattggatttatttttctactaatattatttttaaattacaaaagaattacatccggttgtcaaaagtgcagatattataagagaaggacctcttaccctctcttcgtccccagttccacttctcaaaggtaaccactattaaccaaattgtggaatagctttccagacctttttctacactaggttttatactattctgtagttaaacgtaattttttttgtttttctagtagagttaatgtatgtttagattctttatctagaattaatttccgtataagatataaagataatttttttcaaaagtatagctaatggtcccatatattttaacaaatagtctatctatttgatttgaaatgcattattgtttgtataataacattttttagtttattctggatctgtttctcatcttcattgagtgtgcgtattattctgttttcacactgctgataaagacatacccgagactgggcaatttacaaaaggaagaggtttaatggacttacagttccatatggctggggaggcctcacaattatggcagaaggtgaaaggcacgtctcacgtggcagcagccaagagaagggagcttgtgcctggaaacccccctttttaaaaccatcagatctcgtgagacttattcagtatcacacaacagcacagcaaagacttctccccatgattcagttacctcccacctggtccctcccacgacacatggggattcaagatgagatttgggtggggacacagcctaaccatatcattgtgtctgtgtatttaatctattttactgttcatgggcatcttaatacctgtttaatatcaagaaatttggatttataattatatttggttctaataatatttggagttataatgaatatgacgatttttttttgactgtgtg

SEQ ID NO: 46340 - DNA, 1023 bp, Homo sapiens
atgtgtacttttagccaagttaacaggctatggtaaactcaatctctgtttcaaaattcacttgaaagttaggtgatttttagcattctcacctactgattaagtgaaggaaaggcattgtgtgctttgaaatttaccaacaaatttctaatctcagaggaacagtagttagtctgtctaaatagttgtaaccttacctcttaaaaggtgaaaaattagggacttggatgtttaattctaaaatgatcccaagatttaaccactgaaagaagcaaacaagggaagagctggtctttgcagaaatagttttaagtgtgcatattagagcactaatttgtttctctctttcaaagaactggatgaattgcctccattgtctccaatgcagccaatttcagaggaagaggctattcagattattgcagaccctccattgccaccagcttcattcacacttcgagactatgtggatcattctgagactctgcagaagttggttcttctaggtaagtttgactaaactacaagtactttttgcatgtactcttcattactttttttacttttttaaattaacaatttaatctatactaagtagtatacaaacataagcaaaagtctaatagcataaaggcttctagtgagaaaccgtattccctgcctcatccttggtgatcttgcatcctattccccagatgcatctacttaacttgtatcattctttctgtttgtgttcaacctcctcattttaaaatagttgtttgtagtgctgttgtttggttcatcagttttagacatcatttgatctcttgtatgtacacatgtacttttcctgtattcttttcaattctcctaatataaattacaattttagataaatcattagtcagtagttaaattatgactataaatattgctatctgccctaacaagaagtatgctatcattatttaccttcctgtacaacttttcatttttccggcagtaatagttgccttgttcttcatttgatgaattgttttg

SEQ ID NO: 46341 - DNA, 1080 bp, Homo sapiens
ggccaaggtggtctgaggaggtctcaaggagatgtacctctgcaggccaggagggcgaggtttggttggagtgagtgagaggcatacctgcatgacctaggagagcagtggcatgagaaagtgtcacatctggctagaggatggcgcgtgccacatacctgagatagaggaagcacattaaaagtaagtcatggacagaggcctgggtgaggactaattgtggtgagctggtatagcagtttattgtttgatatagtagactgcagagaatcattttaggtttttgaccaggggagtagtaggaaaatttagcccatctccagtggagatcatagaaccttagaagtaagggatttctggaaacatcttatccaatatcccatttttacttaggccagagaagtgaaataacttgctcaaaaggtcacccagttagaaaagagcaaatctgtgtctcagatttatcctttaccttgtagtccgatgatctttctttcatatcacagtcctccaaaagatattagagaaaagaaaataaaaagaaaggatacgtaagaagcagcatcttgattggaaaaacccgaataactatttaactattttatttattttagtaaatgaggcagaaaaatatctagagaattcataaaggaccaagtgatttcttaaaaatagtgttcgaaaaaagtgaaaaactaattctaattaaatcctattaatatcccaaacctaccctgggaaatgggtgctaggctaaagctgaattactgaacaaatgaatgaacacctaaatttgtcttttttcttccagtaaatatcttacaagtattatttaaggaaaacattttcttttacagattcacctttttggagttttgctggctattttaggaaacttggtgatcagtatttctctaaatattcaggtaagaaaaaagcttatttttctaacactatagattgatccagggacacattatgactctcatgggcattgggcacttttgtctttgtggctcttttctccataaaaattataaaaaatatatattttatgacctcattggtataaacacaaat

SEQ ID NO: 46342 - DNA, 1029 bp, Homo sapiens
ctgggtcgtgatggccattcagtagacaggcttgctgtgcaagtccagaacttcagaacagcagttggcctgcagcctctgaggttcagcagggactcagtatgatttctaagggtttcctatcctcatcagcttcccatattctggccttcctgttgctcttgggagcctctaaccagaagaagagtggaagggggagcgatccaaagattatttctatccctaagcactcacccccactgactcactcatctcctgctgggattctaaagccaggataaatgggctggggtaaggtttgactttttaagaaaacttttagcaactgctgcctgcttcttattcaaatttggctgatgattattgaatacttactatgggctaggcattgtgctaagtgctttcacatatctaatctcacacaattcttataacaaccctgagagggagggatgaatatccccattttacagatggacagattgtagaggtagagaatgctggaaaatgaaactggagagccaccaacactttggagacagacctgagttccagtctctactttgtcttttactaactgtgtgacatgggaaagttactcaatttctgagccttgatgtccggattggcaaaataggcattgacttacagggcagtgacaaacaaatgaataatgcatgtgtagttggcatgctgcctagcatacagtgggcatgcaataaattaggcaatgatgactcttggaaagataggtctagtagacgtgtgtggggcaaaactggggaggctgatgttggacatgggagtcaggatagaaagccatgggttttatgtgacagtctcagctgaagccaggtgggggtgggtggagcaggaatagacagatagatcagtaaaacagaatggaaagctcagaaatagatccaccataaaatggagcttagtttatgataaaggaggcgttataaattagtggacaaactgaaccattcaataagtatgttggcttcctatgtggaaaacaaaaac

SEQ ID NO: 46343 - DNA, 1030 bp, Homo sapiens
cctgaaaatcaaaaaccctctctcttgagattgcaaatcggacattagcacatccaatcctgatagatatgcaactgctttaagaaacaggagctttgtgcaaggaatgaggaggtcagtgataaggacagttggactcattcacattgttgccctgctgtagctgggaccacctccccgggagcacaacagctactgtaaggttggcaatcaagttggctttgaaactgtttatacaagctgattgctactagaaacctaagaaattcacaggaagttccatgcaaggaaccagagaaaaaggctttgagctgtgttagcggctccatttgaaggtttcaggggtggtatgcagcaaaggcagaggaaagatgttgttagatgaggcctgaacaatggagactgtttgcaactctaacgcagccagatgtctgttctagtggccaaccacctcactgccctagagacagtagagggtagagaggaggttagctaggatttatgtatttaattcataagtaggaatctgttactggcacaaatattttcctgtgttgtggtaggaggagctactatcgcaggcagcacctcgggagcaatagaagctagcttggataatgagaagcacttggatcaatccttgcgggagatagatcagcaacttttggcaaagagtggctgtgcaatttgagagctgattttaaactggaggggccttttgaattccctctgttgatgtggctaatcaagcccaaggaacagaaagaggcaaaatggcagcttctgcaagcaagatggaataattgagtttaaactagggcagtggggtggtttgggggctgctgtgtcttaagctgagaagcaagacgaatgggagagaagctcccttggtcccactcagggaacacttcagatccagcctgggacttagtacaccctgatttgtccctcgaggagtgatgttggtcacacataaggcatttctcaggcctcagcataaatgagacagtgtcgcccccctgggtacatt

SEQ ID NO: 46344 - DNA, 1028 bp, Homo sapiens
agtatcgtgaatgtaactgaagctagtgaatcagggtttcatcttgctgaaaagctagtatcattgtatatattgtcctgtagatgataaagttttttctttggtgtaatgaacttagatgactcatttctacagacttaaaatacacttagcttattttagcagaaatagttttatgttcaaagtatgaactaatttggcaaatacaaattggagaagaaagtgtattcaaatggatttcaaaataataacacctgttattcggggcacttactatatgtcagacactttgatgaacaaccttaaatacattacttaccgctgttatatttttcctccgcttatttactgaatcacctccccagtgttcaaaatcatgctctactcactgaaggatgtgcagttctgtaacaaattatataatacattaataagatgttttttaacttagtcacaggaaatcttttcaaattactgattagcattcaataggattgctattttcatttcctatcctgtatgttaaagattaatgattaaaataaatcctgaaaatgctaataacattctaagtagaacatcattaaagaaaaataattggagttatatcgcattactaaaccattattaggcataggcatttaattagatatttcatcaaaatgcaattttggagtaccagggtttttttttttgtttttttttttttggcctgaaagactaggaatctggaatctaatgagaactatttttctttgccgtttgggcaacatgatgggacctggacccaaggaagttttacagaccctggtcgggcagtctgatgccactgagtggtgacttccagggagtcagtcagttttgccctgttccatacaaaccaccttcaacctcagccaactaccttctacttccttttggggtcccagaaagactccaagaggggaagcagagaaccagctcaattcttccaccaatcttggaaaaacaattcctacttcatgctcttctcacactggaccacatca

SEQ ID NO: 46345 - DNA, 1083 bp, Homo sapiens
taatatataggcaacaaaattgtataactgactgaatatgagaatgaaagatccgggataattccaaggttttttgtttgaacagccaggatggtgttgcctataactgaactggggaagactgtgggtggaacttgttggctgggaagttcttctgcatccaggtgggcataccaaatatacgattgtgtgtccaaattgggagttcaagggagagttctaggctggaatttgtggtaatcagtatatagatggtatttaaaaccatgagactgaatgggatcttcaaaggactctccaaagaaatgagtatatatagagaagaaaaggggtctgtattcatttcccatggctgctgtaacaaagaaatgagtatatgtagagaagggaaggggtctgtattcatttcccatggctgctgtaacaaattaccacaaattgagtggcttaaaacagtagaaatgtgttgttttacagttctggagccaggaatccaaactaaatcttaacggggctaaacctgagttgtagcagggccacaccttctctggggaaatttgaactaagtgttatgaggctaaatcatgctatcagcagggctacaatccctccaaatactctagcagagaatctcttttacttttcagtatctggagctgcattcgttgagtctttggttctttctccattttctttcttttttttttcttttgatggagtcttgctctgtcgcctaggctggagtgcagtgtggtgcaatctcagctcactgcaacctctgcctcctgggttcaagcagttctcttgcctcagcctcccaagtagctgggattatgggcatctgccacttcacctggctaattttattattagtagagacatggattccattccaagatggccaaataggaacagctccggtctgcagctcccagtgtgattgacgcagaagacggtgatttctgcatttccaattgaggtacctggttcatctcactgggactggttggacagtgggtgcagcccacggagggcaagctgaagcagggcagggcatcacctcacccaggaagcacaaggggt

SEQ ID NO: 46346 - DNA, 1050 bp, Homo sapiens
cacttaactgaacacttgaaaatggttaattttgtgttatgcatttttttgcataaaaaatgcataagagaagaggggaaagaatttgcacagtgtcactgttgtcatagtctgttgtcaaaatatgtcagaagtctagtcctaattcataagatatggaaataaatttcacctcatgatggaaggaacagcaaagttacatggcaaagggtgctatgagatggaaggaattattacagtatactttgcagacaatctaatagaaagggtgttaattaaaattcaacagaaattagaatgttgaatttaggaaatcagagttcattaatgattttgataatgaccattgcagtactctactttcagatttttcacatacacacaatttttgacatgtagccttctactgtctgtcttagactcattttagttttgtgaatctatttttccaatggctaactcctgaaagtaacttttggaaacatttttagcccctcatagattttgtagtcattctatctggaaattccaaaatttgttagaaaacattaagctaatttaacaaatattttactttggattgtgctaggcactgtgggtaaaaataaattatactgatttattaagaggacaaggtatgagttaatgaagtggtaaattgtaatccagaacaataactcagacattgccatgtggttttgaataagagggagatttgatgaaggctggagttgtatatgaaattataatgtggaagaggactttgtctaagcattgataaatggatagcagaaagagagaaggcaggaactacaaggaatgatgtgtaataaaaagcttagcagtaggaaagcataatctgtgttgggtggcaatgaaatagagaccttcaagtctgtggtagttaatctggaaaaatacgagagataaaatggaaaagtagatccagatcagagggtgaaagcttgcaaggttacagagtctgaatatttatttaatagacagtggaaagccactgaaggttttaagttggaggatgacatgatgaaa

SEQ ID NO: 46347 - DNA, 1042 bp, Homo sapiens
tctgaggttacaggccaccatgcctagccaagtcctcataatttcttacagctgaaaatgtacaataacaatagcaatgcaggcttaaatgcaaagaaaaaaagcccaccaaaaacacctgagtttttaaaatttactttctttgagaaatttgaaataaagctgaaatgatttttaataaaattctgataatgattttactaaacttctgaaatgtttctacaatctaaacattccagacctttgcctaatcatcagcttaatttttatttggtctgggtattttttaattcttattttatttcactttgttctttatgaaattaattatgttggccttgaatctgaccagtgcaaatttattatatggcttcataaaaaaatcatacttcaaagaaaatacttccttaaatgtaagaacttataccttccttatgttctttgtttacctaaggaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttgtaagtacattttaattcttcaatttatgttttctccttctatattttatcatcaaattgagaagcatagttcatatgtatatgaactgtgtgtatgtatatacaattatagaccatatgttaatattcattatacagccatatacatggttagagaaattgtgaaactgtagcttgcttatagaaatgtacttgcagagaaatacttttttatagttaaataaatcatagctcaaatttaaataaatattcaggactccttaaaactaaaatgacaactattttaaaagatgttttcaataatgcaaatatgagatacttctgacattcagtaaactcagttgccaaaattaatgaagcaaaggtatttatgacatagagtttgagaatttgcttcaatttttaaagtata

SEQ ID NO: 46348 - DNA, 1024 bp, Homo sapiens
aaagtgagactctctttatctctctctctctctgtctaaaaagaaaaaacatatatatatttatatatttattatatatttatatttttacaatatatatttttatattctttaatatttttatttttattaatatgtaatatgtatttgttctttactggttttcctaaatataagtatagatatgtatatttgtatacatatatttgaaaatgtgtataaatatacatacacacacacacacacacacatattttttttttttgaggaaaaccagtaaagaacatttacttattctcattcctttacatggtaaaaagtaaattttatttaataagaaatatttcagataaaattatttaccacaaattgaaaacttgtaaaagaattgattacttgttatgtctaatttttcctatgtaatcacaattaaaacaaattcttatatagttataactgtgtaaatactgttcacttatatcatattatcattacatgttatttctttttgtgattttcagaaccaataattgtctccgtttttgttactgttgttgtttttacagttttctaatcactagtttgttcccaaatgctatattcccaaactctctgctggatctctgagctcctctgtgtatgttcaaacacaatttattaatgccgtacttttttttttttattgattcatcccttcaatagtcttctgtcctttactaatcggaactaattcctctttaggagtgttgagcagctgtcatcctaagacttcctttcaacatcaacctgtggaatgtcctcttttttttcttctgtaatctctttatccctgatgctgtcttctgtctttcttgttttacttccttatttttatgtatcatatctcccagtagcttcctgacagcagcagtttttttcagtcattgcatatctgaccgtgtctttattgtacatttacccttaattgattgattgattgattgggtgtaaaattttggattgaaaataactttcttttataatt

SEQ ID NO: 46349 - DNA, 1039 bp, Homo sapiens
gagaggaagaagttgttatcaccataaatgggcaggcggatgttgcagtgagccgagatcatgccgctgcactccagcttgggtgacaagagtgaaactctgcctcaaaaaaaaaaaaaaaaaaaaggtgtgcttgcttccccttcaccttccaccatgattgtaagtttcctgaggtctccctgaaacagaagctgctatgcttcctatacagcctgcagaaccatgagccagttaaacttcttttctttataaattacccagtctcagatatttctttattgaaatgtgagaatagaccaatacagaaaatcagtgccaaggagtagggcattgctataaagatacctgaaaatgtggaagcagctttgaaagtgggtaacaggcagaggctggaagagtatggagggctcataagaagacaggaaaatgagggaaagtttggaacttcttagagacttgttaaattgtgaccaaaatgttgatagtgatatggacaatgaaatccatgctgatgaggtctcggatggagatgaggaacttactgggaactggagcaaatgtcacttttgttatgcattaacaaagaacctagtggcattttacccctgccctggggatctgtggatctttgaacttgagactgatgatttagggtatctggcagaagaaatttctaagcagtaaagtgttcaagaggtgacctggctgcttctaacaacctgtgcccatatgcatgagcaaagaaatgatgtaaaactcaaacttgtatttaaaggggaagcagaacataaaagttgaaaattttgtagcccagccatgtggtagaaaagaaaaacttatttgagggtgcaaaagccagctgcagccattttcataactaaaaggaaggcaacagttgagacttgggaaccccagcctagattttagaggagatatggaaaagcctgaatgtccaggcagaagtctgctgtagggctgtagctttcatgagaacctctactagggcaatgcaagagggaaatatggggttagagtc

SEQ ID NO: 46350 - DNA, 1049 bp, Homo sapiens
ctttgatcccctcaggtttgataacttgctagaatgactggcagaattcaggaaagaactatacttagaatgacaggtttattataaaggatgctaatcaggaggaccagtcaaatgaagagacccatatgattgtctgagagggaacacagagcctgtgtgacttccttttgtagaatcaggacatgtgaatgtgtttgccaaccaggaggctctgctaagcctagatgtacagagtttttactggggtttcattaagtagtaatgattgattaaacctttggccatttgtttgagctcagtctttagtatccactcaccagaggtcaggcagctaaatatactaacctgctaattacatgcttattctttctgctgaccatcctgtatcctgaagctatctaggggcttcagttggcatgtgtcaactccttagcataacaaagacatttatatctctggaaattccatgggcttttgcagcctcttggaaaagagcttcaaaagtgttcagaacactgcaaaagagaaatgttgtgttggacttccagggagcctgggtaaagagatctgattaatactctatattgccattcccttccccttttttttgagttctggagtcagtgtgtggtaatgttcaaccacccatcttaaaccatgaagtaaattggaaggtggagaccacatactgatggcactacagcagtatcatactagcctgatactgcccatttatggagataacagcttcttcaagcagttctcttgcctcagcctcccaagtagctgggattacaggcacccaccaccacacctggctaatttttgtatttttagcagagatggggttttgccatgttggccaagctggtctcaaactcctgacctcaggtgatccgactgcctcagcctctcaaagcgctgggattacaggcatgagctaccgcacccggccacaaacatatctttcatggctagagcaggaggaagagagaaagggggaaggtgctacacacttttaacaaccacatcttatgataactcac

SEQ ID NO: 46351 - DNA, 1026 bp, Homo sapiens
gcttgattttcctattatgtctctgttattgatttctaatgtgattccattgtgcttggagactctactctgttcagttctttaaaatttgttgatgtatgttttatgcctcagtatatgttctctcttggtatatggtccatgattacttgaaagtaataagtactctgctgttgttgaggtggggtattctataaattttgttgatggtgttgttgatttcttctgtatccttgctgattttctgtctatttgttttatctcttgttgttagaggatattgacatttctactgataatggtgaatttatctatttctcctttcaagttttagtttttgcttcatatattttatagcttgttggttggtacatatacattagtgcttgttatattttcttggtgaattatgtctcatcactatgtaatgtccctctctgtctctggtaattttctttgctgaagtctcctttatctgttattaatatagccacttctgctttggtttgattattgtttgcatgttatatttcttccatcatttttctttcaacatgcctgtatttttatattataagttagtttcttatatactacatataattgagttgcattttaaaatctaccttttcagtttttgccttttaattggcatatttaggcgatttacatttaatgtaattattaatatgttatggctaaagttttgcatttttttaatttctgttttctttttttttacttcctgtgggttacttgattttttttaagagttttcttttgatttatctatagtgtttatgaggatatttctatgcaaaactttttggtggtttattttagtattattctatatgtacataaattatcacaaggtactggtaaagctgaggctttctatttttacattgtttcagttattttcatgattgttcattgaagcatttttttaaagactcttaaaatatttgtcagatacttctgacatgtctttttttggtgttgacttttatcttttttgttttt

SEQ ID NO: 46352 - DNA, 1053 bp, Homo sapiens
attttttcatctagcacaactgcaactcttacccattaagtaaccactccccattgcttcctccctccagcccttggtaactaccattctactttctgtctctatgataatttaactactttagatacttcctgtaagtgtaatcatagagtatttttctttttgcaatgggcttatttcacttagcataatgtccttaagcttcatctgtatttagcatgtgattttcttcctttttaaggctaaataatattcaattatatgtttataccacgttttgtttatccattcatcgtcttcgttcattttttggttttgtttttagtatagattatctttcctttttacccactaaatttctttatctctaggcttcagcttatttagggacataaaccatttgcctggtttgttctttggaagtcattttattttttgtttttgtttttatttttatttgtttttttaagctacttcctaccgaaaggatggaagtcattttaatggttatattttccacctgttttgcagctatattgctaacttatgtattgctatgttaattatacatctagaaaactttgagttattttattagttttcttagatatttaattgattggaagtgtttttaagaaaacttggagtttgctagttaaataattatcaacaatgtagctaataaattcttttctactagcatgcaaactctacactgcatcggttcaaattatagcacctaatgctgcctcaaggcttgtgacattataacttttcaactgagcaatgcttaatttgttatgaaagtaaaaaaaaaaaaagttaagtaattccatcaaaattgtattgctgacatctgtttctgataaaattttagtaatatgataagaattaaaagcattgtgtgatactggtttctgagtctcatgatagtaaactgtagaggacttgtcttttgtgaatcatttgtatatgtaaggtgttattaagtccaaatggaaaagaaatttggtgctgagagacattaaagcaataactgagtttctttttgac

SEQ ID NO: 46353 - DNA, 1049 bp, Homo sapiens
tatttatgaagtattttcaagcttagcaaacaattctacataaattataatctttaaattctcacagatagttaaccctatgagatccgataggaactgtgattgccattggacagatgaagaaatgaagacccagaccggggtagcatctgatcactcatattgcaatccaggattgcgattaagtgctgatccccttttttttggtggtggttaaattttcataggactttattagtgaagtgatttaagagtcaatccacagcagaatactactaaaatctttcttcaattagatgggaatcagtagaaagaaatgggggcaggtttggtatgtagatatattcattaatgaatatagacttatctgagtggtgtgttttcttttcctttgcagagtatactgctgataactttttgggacttggatatgtcataataattatagtaataataacacctaaacatgtaaaaagtttttattgtgcatgaggcaaaagtgtggtacgtgaattctagtcttctcaacaatcctttgaacaaaaggtactatttttgctgtattttatatataaggaaaagtttgttgtaaaggagaaagtattaaagactatgtaacctttctcctaccttagaaatacaacttgtgttctcattgttcagttcccacctatgagtgagaaaatgtggtggttgcttttttcttcttgcaatagtttgctgagaatgatggtttccagcttcatccatgtccctacaaaggacatgaactcatcattttttatggctgcatagtattccatggtgtatatgtgccacattttcttaatccactctatcatttttagacatttgggttggttccaagtctttgctattgtgaatagtgctgcagtaaacatacgtgtgcatgtgtctttatagcagcatgatttataatcttttgggtatatacccagcaatgggatggctgggtcaaatggtatttctagttctagatccctgaggaatcaccacactgacttccacagtggttgaattagttttca

SEQ ID NO: 46354 - DNA, 1033 bp, Homo sapiens
aaggttttaattaaagtagaattgactcatctttttttgatgtgcctctgagaaggaaatttgtaacacacttcagttgatggttggctttctctgactttgattaatcactttcaaagtaagcaatagatgagtatagtaattttataattatatgcaagtgagattattttaaactaactgtaaaggaagttttatattgttcaacattatataatgctgtatatttttcttttactattaaaatacatgtagtaatctgaaaaaagattttgtattatttttataaatacaatttaatggaaactttaagctagaaatattagtttcaaagacatttatctattaatactgaaactttaagcttttttgaaaactagttgatgaaactaataaatattggaaataatccaactggtggagctgactgtaagttatgattccacactagtgaaccaacttgtgcctccctgaagcactgctaaaaataaaactttgaactgtctgaaagatttgaaatgacaatggaatttgattattcacagtcaagataaaaggactctcctcagtgcaagattaaatgcccctaaaagtttaagaagttttcacctgtcaaaactaatacaaagagaaattaattctgtttaaattaataatactgaagaatgtacacctcatcttacctgtatctagaatcctcactgggtaagtatttaatccattctgaaagaatcttaaacagttttattaagaagaacataaccaatctgcaatattacctatttaaaaatttcttatatgttcatttcttaattaaagcttttaacaaaagtaagtgtattttgtcactgaaactgtattaaacaactgagaaagtgtctaatactctaatgtatttttaagcattgattaacttttatatggtgagtcacttgcttcatcatctcttttaagagtaaaaataagtgctatttaatggtagaaaccaagtatttatactcttttcattaccaaaataagacacaaaaattaa

SEQ ID NO: 46355 - DNA, 1325 bp, Homo sapiens
ggacactgatatatacatgtgcagtagggaagcatacttctgttgccagcttcttagttactggggtaggcagaattgttctccaactacctgactccttctgcaacctcttgtgctgatggtattcatataaaatgtaaaaaacattttcaaatgttttgcgaagttttgagaagaaaagttctgaaaaattcctaggagagggaagaaaaagggtgaaggcagaatgacaagtacccatatttggagatttggtggaaggagataaaagagaccagagagtaagagaagaattaggagagtttcagccaagggagaaaatagttttaaggaggttgtgattgatgaccttttacaaatgtttgtcctcttctctgtctccatctccatctccgtctccttctccttccttcttccttcttccttcctcttcctcctttgtctttcttcttctttcttcttttttgcctttagtttgggtagtatgaataataggttatcagattggaggtcatggttaactttcaggagtgtaattcagtcaagtagcaggctgaagtcaattcctgggggatccagaaatgaagttcggtagccaagaagaggagtaagttgggtggcggtgggggcggggggtgggggtgcggtgagatttgaaggtttgagagtccagggaagattttaatggcatgaggagacttagtctgattttagaatgagatgtaggacccagaggagaggattaaagatgtaaggagtagggccaagggcgacagataatgaaacaaggccccagtcaggtagcagggaatgtgactgaggatttaagtctagtcatcaaccatggggaaagtagatttaagcatactatgtctataacctgctcctgccctggacatcaagtgttacatttgaagagctcactgcttattaatgcagaagcagtatcaagcattttatatggttgccagacttaggcagggccagtgggttgaaaggcagtaatactttgctaggcaataattggtttaggggtgctggttagctgtagtggtggttcagttgcttacaaagtatttagaagcctctgagcaactatattctgatctgccttaaaaataatttagagtgaagctaattactgaaagaccttaaccagcttttaaaaatattgtggaaataagcataaattcaccattttaacatttttaagtgtacaattcagagatgttatatacacatttacactgttgtacagccgtcactaccatccatacacagaacttatttttttttacttttttattgtggcaaaatacacttaa

SEQ ID NO: 46356 - DNA, 1030 bp, Homo sapiens
ctgcctcagcctcccgagtagctgggattacagatgcgcgccaccacgcccagctaatttttgtatttttagtagagacggggtttcaccatgtttgccaggatggtctcgatctcttgaccttttgattcacccaccttggcttcccaaagtgttgggattacaggttttgagccactgcgcccggtgctgctttgcccatttttaaattgggctttttgtttaacctctctctagtactgacctgcttgttgtttctatgctggtgaaggtgtcctactcctttaactttttactgcctgtttattgtctttccagttgtccccatatcactttctccaccccaattataatacacagtctgagtccctttgtatgtcttctttgtaatcactatattgagagatctttcaatcagaatgcttttcactgtttctatgcaaatgacttagttgtctaccaagtagaggattatttttattaaatcatatatatgtactttgcattatgcaataggtgtgttctgaagaagttgtgtaaatatttaataattgtaaatcagcatttcatattctttggaaattattttttaaaaatattttttcacagtttgtattatttaagtttccatttttattttagggtacatgtgcaggtttgttacaagggtatattgcatggtactgaggtttgggcttctgctgatcctgtcacccagatagtgaacatagtatccgataggaagtttttcagcccttgtcctctccactccttccttccttttagagttcctagcgtctgttgtttccatctttatgtctgtgtgaacccagtagtcagcccccacttataagtaagaacatgcagtgtttggttttctgtttctgtgttagtttgcttaggactatggcctccagctgcatccacattcctgcaaaggacatgatcccattatttttttatgcctctattctgttccattggtctgtgtgtctatttttgtaccagtaccttgctgttttggttacag

SEQ ID NO: 46357 - DNA, 1047 bp, Homo sapiens
tttgagaatgggtctttcaaaggtgttaagtctgaggtcatttgttttatatgctttagtttatcagtttgtcagagattgattatttcttttatcattcctgggcagaataaggaatatttggaatatagatgttcaaggagaaattttctaataagaagaactattaaaaacactggatttgtttgatggcaaggagttaaccaaatttgttagtttccatacaactttttcttccccccaaagaaacttgtagtatatgtaaaccgaatcttcactgtggtagacagtaatgattatctgtttagtaaagggaaatgatgatgtacacattgaaacatataaagcttttaaacaggagagggataaaagtgcttataaatttatattcagctatgagattaaaattagtgagtagtggcaaatgggagtaagtctaatcagaatgttaagtgaaacaaatttttttaaattaaaactcagtttattttataaagttaaatatgaaaccaccaaattaattttgatcagttagataaatagaatagttaaaaaaatttagttttgaattcagttaaccacatacttttgaggagatcagtcttctctttttctcaggcctttaggaagtgagtgtgagagagagagagtgtgtgtgtgtgagtgtgtgtgtgtatatatatgtgtgtgtatagatatatatatatatatatttttttttgagacaaagtctcgctctgttgtctgggctggagtacggtggcagtcttggcttgctgcaacctctgcctcccggtttcaagcgattctcctgtctcagctcagtctcccaagtagctgggattacaagtgcgcaccaccatgccaagctaattttttgtatttttagtagtgacggggtttcaccatgttggccagactgatcttgaactcctgacctcaagtgatccacctgcctcggtctcccaaagtactgggattataggcgtaagccagtgcactcagccttaggaagtatgtatatatatgtatatattttaaatcagg

SEQ ID NO: 46358 - DNA, 1579 bp, Homo sapiens
cgcccaagtaaatttctctttttcctcatattttgtatataggcaatttcttcacagtccagttctttggacagttaatcaagtgttgcctcgtgcatttccaaacataatatagtttatttcctatttaaataatatcattatttaacttttcttgtgtttgtgagctgtcttacaaagtagagtattgaactgcaagtattggaagctgttgagatcatgtaacagatagttttatcactggtaacaagtactgccttttgttttccttgaaatgacaggttcacttggttcctttttgagaaaatgtctgtcaaatacccaagtctgtgtaaccttagttttctgttagttattcttcaagtaaaaatgatgttctttgaaaagagccttgtagtttatttagcttgcagctcagtcacacaactgctttttttcagattattgttgttctttgatatgtggggaagtgctttatgcatattttccattttgtcaatgtagaatattaaaaatacatattcaagtgtagaaatttaatagaattaataaactttactgtttcatcaaggtttacagtagttttgtggggggtatagtgagggcaatgaaagaaagagctgtccaagagagaaaaattgttgagggcccagctaaaattggtaattgggaaagtatagtgtaattaatcctggtttgtgggccttcctatggtagtgtgctctgctgtgcagtagaatgcattatggccttgatatggagggtttgggttttaatgaatgagtgtcttagaaggatggggctatagggaatttaaggatgctgctgagagacagttcaaggggttactaacagggcacagtctggaaagaaaagagagagtgtaaggaaatggggtgatcaaagaataggtagtgttctccatgcttgctgcatagccgtcatgtggggagccctaccctaaacagattaaatcagaatctcaggaggttagagaggagataaagtggtagttaagatatgagaaagctggtaggatatgacactatggtaagtgagtgaaatattgaagttttttaccaacatttttttttgtactgtagtaattttgtgaaataaatattttatcctccattgggtggattggatgaaatggataagattatgttatttaagatgacataacttgtcagtggcagaactgagatatgaactcagtttgttctgtgtttttgcctagacaccaaagaaatatcctctgtgttaatatcccaactcagtgcaagtggaggagcggctaacaaaaataagacattttaaaaccatgtaatcacaatattataattactgatttaaaatctgaaccctctaagttttccagagtagcaggaaatatggtaacctaggtaagatttcaatttttaaagttttgttttccagccatgttttggtagacatataggctaatgaggtaatcaataatctacaaagttgccacaatgagacaaagatgtgattgacatgaagaccccacagctgataacaggcaaaaaacctgatagttattttaatataagta

SEQ ID NO: 46359 - DNA, 1050 bp, Homo sapiens
atttctctacttctttgccaacatttgttcttttctgtcttttgataatagccgtcataatgggtgtgaagtggtatctcattatgtttttgatttatatttgtcttatgattggtgatgttgaggatctttccacgtgcctcttggccatttgtatacctttggagaaatgtccatacgagtcctttacccatttttgaatttgatttttttattgttaagttttaggagttctctatatattctgtatattaatgtcttatcagatacgtaatttttaaatgttttctcccattctgtgggttgtctttttactctgttgatattgtcttgggatgcacaggtttttttttttaattttcatgaagtccaatttgtctgttttattcttgtgttctctgtgcctttttggtcgtatctgagaaatcattaccaaatctggtatcatgaggtttttgccctgttttattttttcccaagagtggtatagttttaggtcttatgtttaggtctttgattcattttcaattaatttttgtatatggtgctaggtaaggattctacttattctttagcacacggatatccagttgtgccagcactgtttcttgaaaatactgttcatttcctattgaatgttcttgacactcttgttgaaaataatttgattatatatacaagggttatttctgggttttctactctgttcctcccatctatctgtctgtgtttatgccaatatcacattgttttgattactatagctttgtaataagttttgaaatcaggaactatgagaattttagctttgttcttctattttcagtgttgttttggggccccttgagatttcatacaaattttaggataagtttttctatttctgcaataaacatcattgggattttgatagggattacattgaatctgtaggttgctttgggtagcatgggcatcttaaaaacattaaattttcttatctatgaagatatgataggtttttatttattaatgtcctaaaattttttttcagcagtgttttgtagtttt

SEQ ID NO: 46360 - DNA, 1005 bp, Homo sapiens
tatttaaagcttgattttaatgccacttcctctatctgttcctaattaattgcactcctttttggttatgtttcactttgaaagagctttttatgatcatttatgagtctctaagtctgtatttcctgctagattggagccccatgaggttaggttagagatttaaaaaaaaattaaatctagagtaggtgctcaataaataatttttcagtggatcaatgtttcctagtgcttcttggaaaatacttctgaattcttatgtcacttttacactctggtttacattctggttatatatgtgctgttattcacagcaatattgtaacccctggggtaattttatatttggtactttattgttttaatttgcctttctttgataattagagcagtttagtagtttccatgtatgttaattagctcttttttttagttttgtgaattttatattcatttcttaggcctgtttatttattgagattttattgtttttctgaaggttttatatgagctctatgttctaaataaataattatatatattaatatcttgctatgactatttttttctttttaaaaatttatttagttttttttagagacgaggcctcactatgttgcccagcctggacttgaacgaactcctgggctcatgtgatcctcccacctcagtctgctgggtagctgagactataggcctgtgccaccataactggctatttttctgagttttctaaggttatgtagaaccttgtatgtattctaagcttatgtattttaagtttttgtgtagacaaaactaataagttctcataattctttctttgctttttttgattagaaactatctttcctgcttagtgatttgaaacttactttggttttcttctaagtatttttaaaatgtttaaatctttgatttatatatttgttttagcagaattaagcatctgttttcaataaaatgctcataaagccacccattaatgtactcagggtgaaagga

SEQ ID NO: 46361 - DNA, 1122 bp, Homo sapiens
agttctcatgagagtgtgtagcacttcccccttcatcctctctcccgctgtgccatgagaattcggtgtttgcttcccctttgcccttccgtcatgattgtgagtctccatggcctccccagccatgcctcctgtacagcctgtggaactgtgagtcaatcaaatctcttttcttctaaattacccagtctcaggtagttctttatagcagtgtgagagtggatgaatacagcagttttatttacattttggttgaatggaaaggttcaaaacacatttattgatttaggcccagtgctgttcactagaagtacaaataactaataaatgttgctgtcttgcattcttcacacactagatgaggtaataggtatgtaaaaagccaaattctgttttgcaaagagttagagttctttaggaggaaaaaaggagatgcacatagcctaacaatttagaaaaagtttcattggtgagagaatccgttagcacagtggtcctcgacctttttggcaccagggactggtttcatggaagacaatttttctacggatgggggtgatagtttcaggatgaaactgttccacttcagatcatcaggtattagattctcataaggagtgcataacctagattccttgcatgtgcagttcacaatagggtttattctcctatgagaatctaatgctgctgctgatctgacaggaggaggtggagctcaggcagtaatgcttgcccacccgccactcacctgctgctatgtggcccagttcccaacgggccatggaccagtacccaggggttggggactcctgctttagcagattcttgaaagaataggagttattgaatataagcttcaaaagggcaggtgtttttcttttttcgttcactgttttatctttagctcctaggatgggtgctcagtaaatattgagagagtgaatgaataaatgagtaagtcagagaagagagggcaaagaacatcttggaagaggaaacaatgatatgctcaaattttatttctgtctctaaatatccagtgttgtacccctaggttacccaaagaagaatgttcccagcatgtggtctaaatggatttacttttctcacaattaattactc

SEQ ID NO: 46362 - DNA, 1205 bp, Homo sapiens
acagtaagtattttaaaattgttttgctaatatcatttctaaagattgatattttagaatctgactagttggtattttgttacacagaaaataatagcatgaaaaaagaaaaggttttaagtggtgtaaagatatctagtaggaggtgtgagaaccagccacatatctttctgtaacaaatttaggaattacatgattgtttaatttatttattaggataatttttggtgtgtcacagagaaactaccatggtacttctcttcttcatttggaatcagcgtgtgtgtgtgttgtttaataatgtgagtttcataaattatggctagaattttatttaaagtttataatattcatggtatttacgtatcttaaattttatgtattataatttatggctggaatatttgaagaaattatatacttctgaattaaaaaaaaacatttttgtatttattttcccaaatattgtcaggatgtgtgaaagtgatagaaatatatatatttctataaatttagcttagtgaaatgtattgtttaataaaagctttttatggttatgttttaactctaactagaagtgctatttacaaaattgtttactttaagctagtaatacatctagtttatttggacaatttgtatggaccaaagtgacctttttttcttgaataggaagagtaatcagtgaaataatttgtaattctgtagcagtaacattattatatgttgtcagccatgtttcagtaaaatacattcagaaaaaatacttcagtcaatttgtagttaaccagaatcattttaaagtttgatttgggaagtacactgtaagtttattttactaattttttttccctgttagagaaaagaaagtaaataggatttcttttaagggaagtgaaacagaagttgaaataatccctgttttgacagagtagattaagtgatctgtgacattctgctaatgatatattttagaatttctatggtgcttaactagcatttatgtaaatcagatgattcttgagtggcagaaaaatgcttcagtggaaagtaattatatcccagttagagaattgttttaaactcatttcagggctaaactcagtgcatttggtatttaaagttatcaggtaggaatatgaagtagtgtgtgaaatggaaaattttaaacatctctattttcttagttttaagtgttaatgtta

SEQ ID NO: 46363 - DNA, 1022 bp, Homo sapiens
caaggtttatttgctggaaggagggtggatgtgggaagaaaattgaagggattaggacatacaccgttggaggatgcgttttggccaaacgtgtagacaagttctcgcattctggtactttcacaaagcaatggtaaagtactccctagtttgctgatgaggggcgggggaagggatggtcaaagagaatattgcggggaaccataggattgcagtctgacgtgggatttagggaagctgcgggaataaccaaaatgaagacagaattgagagttctagagacaaagtgaaaataactgataagtaatgaattcagagttgtaagggtcggtgttggttttattaggctgtaatgagtataaaatattacctttccgtataatagcttacaagctaacaaagtcaagaaactcaaacattaactcggaaaatatacactgggcttcaaggaatcgcataggacatgctccccaagttttgcccagattgtcttatttttggttatcgctgaagaaaacacctacaactgcattttgaaactagactcctggccaggcgcggtgatgcatgcctgtaatcccagcactttggtaggccaaggcctccaaattgcttgagcgcagaagtttgagaccagtctggccaacatggaaaaaacccgtctctacaaagataatagtaatacaaaaataagctgggcatggtgccagtagtccctgctactcaggaggctgaggtgggaggatcacttgagccccagaggtggaagctgcagtgagccgtgatcacaccactgcactccagcctgggcgacagaatgagactctgtcgaaaaacaaaacaaaaaatcagaaactagatttcttaaaaggttattaaatacccacccatgcctaaagctctttcctggaattcaaaattaccatttcttgaaagagcttcagtaactgcaacagaaaagaggcctgaggatgccaaggtgtttaggtttattttgtgattgaaaataaggaaataagttt

SEQ ID NO: 46364 - DNA, 1034 bp, Homo sapiens
aaaaattaagttaaaatactaaaataattcttgtctatccaaaatactctctggaaagtcaattgaatcgaaattaaatcacttgcttggaatacatgagtctaagtggaactgatagtacattccacactactaaattagcataaaaatgaaatatgttgcttattattgctttttcaaggaatttgaatttcaggatgttcaacgttatctgaaataatgccaaaaactaagtagaaaaatttctaggtaatgactaatgcttggtgtcaattcaatgctgaaacttttaatgctaaaattctgagggccctgcatatcctttcacatttatagaatataatttcccacctaaaagagtaagtttaaataaatacaactgaattttatttttggaccctttgatgtagtttgttttggtaggaaaaagaaaaagagaaagtaagctcaactgagaaagcctttctaaatcattcagggtgtgatataatggaggctgcattgtcgtgatataagtgttggctattcttccacaaactatgggtgctgtaagttctctctcaagattatctgaattaactgaaggccacaaatactgtgcaattagcatgaaacaacctcttacaatagagggaaacctgacacattcataaaaagctggttggaataaaaattgtggctgaaaggtaatccttatataaaaaaatcttacttgtaatacctattgatgcatcaattctatgaaataatctatcctaaggtaataattacagatgtgtgtaaagaatgtatctagatgtatgtttatcccagtgctattttaataaaaatttggcagcattaggaaattggtcaaataacacagtaaaaataaaaacagctttcctttattagacattatgtgtcaagcactgggctaagtgatttttaatattacttattccttaaaacaatcttgtaaggtagacagatgaaaaaacaaatggaggtacacagaggctgagtgatttcttcagggccagagtgttgggaag

SEQ ID NO: 46365 - DNA, 1029 bp, Homo sapiens
ttgctgtgacacagagaatgtgaaactgctattttgtcaggcagtgttcctaaataagcatttcagttgcactacatatatgtgggttacattccaataaaccttatcatatgttgagaatatcgtaagtcaaaaatgcatttaagaccctggaaaacccattagaaagtcaaaaaaattgtaagtcaaaccatcataagttgggtaccatgtgtattaaggaaaaaaaatcaagaaaatattaatggttgtttataatcttaacatatctgctttaactttgaaattttcaaaatttacagtgagcatgcattttataatcagaagatgttaataggctaatttaaatttgttagatttttaccatttttaagattatgtttaaaaacctgtatgagagaacatatttggagacaggaacaaaaatatggcttggaacagaaacagtatgtggctataagggttaatggcaggggggtgggggcggtggtgggcatagaattgagaaggaaaaaagcagaatttgttcaatgcacacaagcaatgagagtaaggtgtggtatgcccaaaatggaaaagaggctattcagagtggtcagggagcttagaggagcgtaaaggagagtgaaacttggagtccaggtagcctgaactgtgctttttctgtggctgagggtgagtgatcaaggtgtgaagtctactagtaggaatagacctcagttgatcctcaaagatggtgagtattgagagagtgtttatctctaacttagcctttgtgtttctcttcacagaatttcttcaggttgaattacctagaagtttgtcactgacttgtgttcctgaactatgacacatgaatatgtgggctaagaaatagttcctcttgataaataaacaattaacaaatactttggacagtaagtctttctcagttcttaatgataatgcagggcacttactagcataagaattggtttgggatttaactgtttatgaagctaacttgatttccgtgttttgttaaaattt

SEQ ID NO: 46366 - DNA, 1050 bp, Homo sapiens
gaaactctgctgggaattatctgtacctattccatctttacttgaaaaaaaaaaaaaaaaaaaaaagacttagtcctctttctgttcaacagtgctagtaaatattgtcacatgctgtttttattgcatgcttattttagaagtaccatacatctggatgtcagacatctaaaaaacaaattaaaattagaagacataggtacactgctcttacatttagtattttgaccatcagcacaaaattactggattttctccatattttaagctgtttgagaagtgacagaagaaacctaattttagctgaataacagaagcaaaaactgttatttgaccatgtagtaggttttcctcttgggaagtaagtgttttctgtgtatgcaaactttttgccctgccttcttcatttccagaatacctttctaatgatgtgtaaatcatttaggcagataggtggctattagatgctgctgaagtgtttatggttagatgtttattggtgggatattataaatgtataattcttgaagttgtagtgtcaggatacttaacatgttttacgaatcctgaagcacttctgaaggtaaaaggttcttgtctttccacagttaaaaaactggatgtagtaaggccgtatggcttaaggatcacagagtaatagcaactgaaaagcatcattcattcatttaatactaagcacttgctataaggtacacattttgtaaagcactaggttatcttacattccatttcagctaacatttagtacggtgccgggtttgttaggcaggtttaacacatgtcaatttcatattattcttagaacatctatttgaggtgagtggtatcatccatattttgtggtcctgatcactgattcaggaatatatcttacctaggatatgataacaaaaaatagctgagccaggtcttttgactcccaagttctcttctttatacatacaatactggatgttttttgtttgcatgtccagatctactctcattcagccttctctaccctgctctgtgccccaggaggttgacctc

SEQ ID NO: 46367 - DNA, 1077 bp, Homo sapiens
taaattcagttttctcacttacaaaaataggttagattagaatgctagagtcactagaaggataggtttcacagccacataaagttggtgcagcctcttgagaagagcaagtaagtacatgagcacagggacctttacatgactagtttttttgtctgtgtgaaataggtccagaatttgtagccttttcactctttgtatcttcttgacttacttaaaagactcactctgttttttgatggctgctttttcaaattagtctttggattactgtctcccaggagttgactagttaaatatctgatacatctaatttaatagtctgttttagaattgtagttaaactgattatgttgcttttgtttttttattttttaatttttttctatttcatttttttcagagacagggcctcactgtgtcacccagggtggaatacagtggtgtgatcatagctcactgcagcctggaattcctgggctcaagcaaccctgccacctcagccttccaagtagctaggactacaggtgtgcaccaccacacccagctaatttgtgtagtttttgtagagatgggtttcaccttgatgcccaggctgctcttgaactcctaatttcgagtaatctgcctgccttgtcctcccaaagcgctgggattgcaagcatgagccaccataccatgcccagctgattttgttgcttttgaattctcagtaagaaaaccgtaacagagataaacctttatgattgtttacctgctgtgtaattattacctagatttttctgtctttagaaaatactcccttttctttccttatacagttaataatatttcctttgtacgtgagtttttaatctcattttcgggagacttgtgtaaagagaagctaatttgaatactacatacccaaagggaaacagacacattttgcttattgtgcctcttggttcccaagagatattattccatctgagaattaccttatagtttgaagaaaattttaaaactaagttctaggatctctaccaaacacctcttacagattgcactcttatctcctatgtacatatatcattc

SEQ ID NO: 46368 - DNA, 1061 bp, Homo sapiens
ctaaattaagttattctaatgcataatcacaaatgagactatgtgaaatgtgcagaagtataggagctaatgcaagctctgtgatggcagggaccattttctttgttcactctttaagtcttagcacttagcataagcctgacaataaaagatgtcgaataagtatttgctaatagaattaaagtatctacaatctaaggtatttattttataactatctcttcagcagtgttgtccaatagaaatacaatgtgagccacaaatataatttaaaattttctagtgccacattaaagaagtaaaaggaaacaggcaaaattagttttcataatgcatttaagccaatagatctgaaagattatcatgagtgactttacgtacttttattcatattggacagcgtagctctaggggcgttttgtatgacatgtttctttctgcagaacttgtctttttgtagtctttttctaactgattgatgtgtcttttgaggccaaatacagaattgcatacaccttcgaattggagttattgagttggattgaaagtcaggctacctgtcttctctcagttttacatctccgcacaaaatgactttgcgcgttactgtctttcccaatgtataatcctgtaatcccagcagtatggggagctgaggcaggcagatcatttgaggtcgggcaagactagcctgaccaacatggtgaaaccctgcctctactaaaaaatacaaaaatttgctgggcttggtggcaggcacctgtcatgccagctactagggaggctgaggcaggagaattgcttgaacttgggaggtagaggttgcagtgagctgagattgtgccactgtactccagcctgagcaacagagcaagacaccatctctaaaataaaataaggaaggatattcatcatctttttcattggattagtataagttaattatgcctttgaaacactctgggctactcagacaagactgttataaaagagatcctctaattattagtaactagtcagagcaaggctcagtgtaaaaaacaggatagaagttcccatga

SEQ ID NO: 46369 - DNA, 1049 bp, Homo sapiens
tgtttttttaatgccctttttgctctttcttcttccacagtgccatggaaagccattcactcctcaatcccaacctgcagcaaggtgaaggagtcctctccagcttccgaaccacgtggcaggagtttgtggaggatctgggcttctggagagtattgctgttgatcttcgtcattgctttgctgtctcttggcattgcttattatgtgagtggggtgctacccttcgtggaaaaccagcctgaactggtgcattaaaggagctcatggaagatgaggcaattaattgcctgtttcctggcttccaatgtttgttctcagtttctcagaatttttcttagcgcaaagcagtgagggcagtacatgttctttttgcatttttaattattgtaatccttttagataatgatgtgttcatttgaactaactacatactatgatcaagtatattgcatcctaacgctacctctgactcaacctgactttgtaggaaagcctacacgtagccttgtttgataaaaacacggaagtgactagagaatggaagataaaggaagaagctaggaagtccttgctatcaaaaccttatcctaatataggaccaattgaagtattcaaaaagaaaaacagtatcttatatgattagtttttgttggtggttttgttttcatttatttttgcaagagccactttttatttactttctctagggataagagataaaacttgaagtacttttttcaaatcttgtgtgcaaattagtattgttagcatctatttggcttattttagtatttttaagtctagtcacaaaccaaacaaaacttttgaaaatgagctatattttgttcaaagataattgatttgatcttatatttatttgtttttaggataatttttgatctttttgtaaactgctttgcttgttaatatctgtgaaaaataaatgagttcattttgttcactttccaattttcccgagtatcctagtcatcaaagataacagttcatcagaattacagtcagaaaatcctttttctactgaatagt

SEQ ID NO: 46370 - DNA, 1528 bp, Homo sapiens
tctatgaaatataaaaatgacaaaagcaattttaggtatctcatttatacaccatagaaaaataaagtgaatgtatttctctggcattccaagcaaagagttttattggactggtcacttgctcacctttaaataaaccacaatagctagggaatgtgatatgttacatggccttagataataaagactgacccctccaaagcatatgagcagtgaagagtagtggagttgggtaccagtggaacaggtaggaatggagtctaggtagacaggggacatctgaggaaattaaaaacacatagttgattttcagtcaaaataatatattaaattcatgtttgggcacctggcaataactgatgttaaaaaaaaaaaagcgccaaagtatagtcagaatagtaaataggataaccatctctatagagtacaagcacaaagtaatgagtgaggctgtagctgttttggaattggccaaaatggaaatcatccaatatctgatctcagacgaaaaggaattaaattacaatttgataacagaaagatagccggaaaatcactgaatacttagacattaaataacacatttctttttttttttttttttttttaagacagagtctcactctgtcacccaggctggagtgcagtggcgcgatcttggctcactgcaacctccacctcccaggttcaagctattctcctgcctcagcctcccgagtacctgggactacaggtgcacaccaccacacctggctaatttttgtatttttagtagagacggggtttcaccatgttggccaggctggtcttgaactcctgacctcaggtgatccgcccaccttggcctcccaaagtgctgggattataggtgtgagccacagcacccagcccaaaatgttttcaaaagacatatatgatgaagactgttatccaaaatacacaaagaactcttaaaactcaacaaaaagagaggtgggtatgggtgctggctgaggtcactcagtgctgaccatcctcttctcaaagccatgtctctaagacatcatggtgaaggtgaaggccagagtaaatagatttgggccatattgggcacctggtcaccagggctgcttttaactctagtaaagtggatattgtcaccatcaatgacccttcattgacctcaactacatggtctgcatgttccagtatttctacccatggcaaattccaccacaccgtcaaggctgagaatgggaagcttgtcatcaatggaaatcccatcaccatcttccaggagcaagatcctaccaaaatcaaatggggtgatgctgaagctgagtatgccgtggagtccactggcatcttcatgaccatagagaaggctggggctcacttaatgggggagccaaaagggtcatcatctctaccccctctgctgatgcccccatattcataatgggcatgatccctgagaagtctgaaaacagcctcaagatcatcagcaatgccttctgtaccaccaactgcttaatcccccggccaagcc

SEQ ID NO: 46371 - DNA, 1029 bp, Homo sapiens
ataagccaccatgcctggcctgccagttgatgattatattgaggtttctaggctatgagattattagcttaaacccttacatgatataaaacaatgatagctactcttgaagaggatgtagataagataggctttggtatgattttaatattaaagtgttaaaagttatgattagttttaaaccttattcttgtaacgtctttaatttggtagttcatgattgtggcttaattttagtgtaatacccaaagtacttgttaaaggtgaagatgtggggttcttttaggaggatggatttagaagatctagcctggagtatagggtatctgcataaaactgataacccaggcagtttacacttttaggttttaatttctaaccgatcattctctgtggactactgctagagttagctttctaagttaaacgtgtggttatctcattccatgctaaacaaacaattctattaaccttcgggattaaataaatctaaacaaaaccctagcttgtgacagtggcagccctcaatgctgatgaagcctagtgatgcttctgtacctagaatgcttttcgctttggcttcttgttttgaaactcaagataatacaaactccaccctcctaccctttagcatagaacagtgcatccagtggggatcctgatcattttgtattttgcctcacaacagacataccctctcaggggctgatgcttcattacaatttttttttttgaaagattttcttcattgtgttaaggcagagaaacaccatattttttcaaaattgtaatacaaaatggttcaaattttgaggttttaaaagagccggctattttgagacacttgaagtcaaatctataaagttcacacactagttcacacaccaaaatctagtgccaggttgggttcatagctttatacgttaggtagctgattgattggaagtcagtatttgttgtgagattcgaagataagtcatattcatctgttcctgaaatgtctgctttttcagatagagcaaactttaa

SEQ ID NO: 46372 - DNA, 1404 bp, Homo sapiens
tttttttttttttttttttgagatggagtttcgttctgtcgcccaacctggagtgcattgacgcgatctcggctcactgcaacctccacctcccaggttcaagcaattctcctgcctcggcctcccgagcagctgggattaacaggcccatgcctgccaccgtgcccagctaatttttgtatttttactagacttggggttttgccatgttggccaggctggtctggaacttctgacctcaagtgatccgcccacctcggcctcccaaagtcttgaaattacaggcgtgagccactgcgccctgccagattttgtatagtaatatatatataaaatgacctgtcacaggttggctttcatagttttacctttcctttttgggtggtgcccttgggtctctactactgtctttcatcactcccaagaaattgagtagtgcagccaggatcaggaccagggattggcaaatgttttttgtaaagggccagataggaaatattttgggctttgaggactgtgttatctctgaaatgatcttgttccagtgttaccatgtcaagacaaccatagatagtatgtatacaaatgaacaggtatggctgtgttccagtaaaactatggataaaaacaaccacattgcatttggctaagggctttaatttgctactgacaagtgatagtcctggtcttaatttgtttttttaacatttacagattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgtggaatagctcagaatgtcagttctgttttaagtaacagaattgataactgagcaaggaaacgtaatttggattataaaattcttgctttaataaaaattccttaaacagtgcacggatttgctttttttcaaagtctttataattgccatgcataaataggtaatatcttaatggtgctgagccgacataagaatcttttatgaaaaatgtactgttaagttcagggggtctattggttttatgtaaaaggcacaagacaattcctgtagtgcattttatgagttaaggtttccatacggattattgaaacaatttgttacatgtatttgttacatgatcttaatatttcatgtaca

SEQ ID NO: 46373 - DNA, 1050 bp, Homo sapiens
ggatgtatttatttagataattaaatttcaatattgaaaatccaatcaaattcagtatctaaaatctttaaaagtttctgtgcagccttcacttctgtcagttctctgacctggctagggtaatgcatatgtgtagtttgcccttaataattgggtattaaggaaaaattgtgaactcaatgggtaaatacaagatgattaagcattaacagggtttagttatttgattcagtgatttataattgtctaaattgtaacgctctttttttgctcctcattctaccattacgttaactttttttttcttttttttaataggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacaggtaggttttagaaggcaaccagaaccatgaaggttttcgtatttggtcatttctagtgttttttgtgcccctcgccccgcaaatgtgaaacattaagaaaggggaattatgattgagtaggaaaaaatgcttgagtgtgaagtcctggtaaatgttttgaaaaagtacatataatttattgcattatttgcttttttcttcaactgataaactcatgtgctttttttccctgcagactcagaaccgtgctgcatactatcctcctagccaaattgctcaactaagaccaagtcctcgctggactgctcagggtgccagacctcatcgtaagtcttttttcttttaattaaggttggggattgagttaaaaataacacattgggtaaatcagctcttctatgtcaatgttaggttaactattgcatttcacataatttgtggttatggatgttcattttt

SEQ ID NO: 46374 - DNA, 1603 bp, Homo sapiens
tgaaactaatagcatagcgaagaccaaccatattttgtggagagataaggaaattatttttattttactttttattctaaagctgggttagagataaggaaatttagatgactagggtgagattatgtaagatggtttttccttctgctttgctgtgtattataatatgctatgacacatgtgctacctttttttcttcagtgatcgttgttctttttatatttttgagacatggtcttgctctcttgcccaggctggagtgcagtggtgcaatctactcactgccacctctgcctcccgggttctagcaattgtcgtgcttcagcctcccaagtaggtgggattacaggtgtacaccaccacacccaactaatttttgtactttagtagagacagtttcaccatgttggctaggctgaactcgaattcctggcctccagtgatcatcccaccttggccttgcaaagtgctgggattacaggtgtgagccactgcctagcccagtgatccttgttctgaattactactgttatattcagaaaaaattaagttttagtgtcattttgttgaaaatgctgcagttatgtcaggctgttgtgtgttagagtacacgattgggaagtttaaatttttattctaggagatggcaaagaaagcgcaagcgccactttaaaatgacgatgaaagctttttaatttgatagaggtctttttattggcatggtacacatgcacttccactcatttgtattgatgggagtgatccctttaaccctaggttagctagagaagagaagtgtgtattaaaagaagtggttttttttttgtgattgtagttagaggcttattcatatatttcatggtgtcatatcttaaattatggccctatttctattttgtagtgtgctttttattagggattctgaatattctcattaacagtaacaaaaccaaccatcaggcttacttaatctgaactttataaaatagaatctaatgttatagtccttgtatatcttattagatttgttggacgatttaagtctcgtaaagaacgagaagctgaacttggagctagggcaaaagaattcaccaatgtttacatcaagaattttggagaagacatggatgatgagcgccttaaggatctctttggcaagtttggtaatgtgtcttaattaaatttttacacacaaagctctgaattagtgctcagtgttaattttagctattactttatactaaaaaagtcaataaaattagacttacatggtactttaaaatatttgtggttatttgaattaagctgctggccatctattacactacaaagtagtataatgcaaataaatagaattctatccaggttaaaggttaatagcattagattagcacagtaaggtatgactaagtaattagaacagattttaaaatattttactacattaagaggctggagatatatatgtgtgtgtgtgtgtgtgtgtgtgtgtgtgtgtgtgtaattagagatcccatgtcatcagaagcatatatttgacacagccagcctacagtggaatgcagtctcatagaacaataaagctggtcagtctaagtaacat

SEQ ID NO: 46375 - DNA, 1372 bp, Homo sapiens
agcttgtagataaatctgttgcgtaatgtcttttatactgcttattaaacagattgtatgtgaaggaatttggattttgataactaggaaaaaaagtgctttagatttaatggcaattaaggcgagagattgcgtcaagaatttattaattattagcaatatggaattcttttatatgtgagaaatttcgggggcttctggtatttgtctttgctttatacaacttaggtcccacactagtgtgtgatacttgaaaggtctagccatcttgaagcttaaagaggaagcgttcaactgtgagaccatgtgtcctcccactccagtcaccatagtttatataatcttaagtagccagcaaaaattttgaagtaatattgactctgaaaatgtccttcctgcagcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtaagccaaaaatgtccgatacacatgtttacattgttgagctacatttagtttagtgcttgaaataggaactgtgcagtaatggatatctttatttcacaaatatccaggttagatggctaacagattgtctctcaacactgaacaaatgttaaatcaatagcaaataaagaaaaatgggtatatgtttttccctaggtggtttgtgatgaaaatggttccaagggctatggatttgtacactttgagacgcaggaagcagctgaaagagctattgaaaaaatgaatggaatgctcctaaatgatcgcaaagtgtaagttataaatatctagctaatcatattttgaatcttatttttaataattccaaatccattcattttaagttaatatttgtcagggagaagttagatgcacataagataaaagaataaaaacattttaaagatgaataacaaaaattcatgtagttgtactggagtgaaaattaataagctaatcttgatttttacaattgaattttctacacagtaagtgtaacatacaaataacaggtttaatataattaacattcatgccaaaaggaaaacagaagataagtaaacagaaaaatgtagctttttcaaaatgagtgcattagtgaaaaatcaggaattcagacaaacctaatattcataattcttgaggtactggttaaattaacccattttataggtgaggaaactcaaagtaatttgcttttatgtactgtaaaatgagagacatacattactcaca

SEQ ID NO: 46376 - DNA, 1052 bp, Homo sapiens
aacttaggttactgatcagctcttcactgtgtaaagttgatactgattttggaagcagaatattgagtgacacagagccagaagttgtaaaactgcactgcaggtttcctgcccttttgctctgtaagcagtaactccaaatgtcacttcataacagttcttgtcaaccttaggcaggatgtatcaatgcatgtcagatgggggtagataactttggggcaggttatcacaacctaagagttggtggagaaaacatgggaatgaattctagagaccacaaaatgaaaacttgaaagtgttactctttctcagcttaacgtttttaaatccaaaaaacaatttttacatttcttgggattcgaagagttgaacttcaggttgccgtggttacagtgtacagtatatattatcagtctgtaccagtagaccagtaccctaactactgaaaagaatatggcagttttccatttgtctagtttctgtatgtacaatttactatccaattaattacttaagtggatttcttgttcttttttaaaaacttattgctacattgataggcagaatagcttctgaaagtgaccagttttcaatttcataggaagaggtgactcattgaaaaatagctcaagcaaagtcagctaaaaaaaaaaaaaaactagggaagctgagtaggtgtggtcaattgataatgagctaacagctgattatcactatattctagaaactggaactttcatttataaaaaaagaggtggccggaaaattcatcctgtcaataacttttaaatttacattggcatggaatttgtaggaattgtttcagggcttaaaagggaccgttttccctctcttcggggactagtctttttatttaaggatgtgttatttcatttagagcctttaatggtacaggtatacataattcaatcctttatagatcctgaaattaattgtagattttgaaattttctagcagtattcagaaataactaaatcagttgttaagaaaatcagcgatctaaagtgaaattgattgtatgtgtcaagag

SEQ ID NO: 46377 - DNA, 1031 bp, Homo sapiens
tttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacggtgagcgccgggctccgcggtcggccgggcgggcgggcggccatgaggctcgggcggcggcggcgggcggggtaggccggcgggcccggggaggggggcgggagggcatgtcaccccgcgacggccggcgggaaggcgccggggtccctggagccgcgtttcccgagccggcggggacccgcgctgccggcagccacacgcccggctacttcctcctttgcgaccattttctcggcctcagacgctctcaaactttagggtgatgacgcgccgggagggtgggtgagattcggttcctccgcggcgctcccgccagtggccccgggattctggggcgttgaacgctgagctccttccgtgggtaagaggtggaggcgctcccaccacccggagctcctgccggcgccccagcctggggaggaagtgcagttctgtgctcgaaaaataccacgtgttgaaccctgtaacctcgcaggcccgaggcctgctt

SEQ ID NO: 46378 - DNA, 1052 bp, Homo sapiens
aaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgt

SEQ ID NO: 46379 - DNA, 1049 bp, Homo sapiens
aaaccagactcaccccaaagccacttatgtttataccatctcccatagttgaatgaataatacaatttgtgtaacaatgaaacttttgaaaatcctggtcatttgtttcttaaaaccattgtttttaagtggaaagactcacttgactattttaaatgcaagtgtcttccactgtttgaggcagatctccacagagcaaccataggtggtaaaaagcattgtattcaaaggacaaaacacttttgcagctaagagaactttgaatatgaaagtatgaatgtggtgtaagacagaggttgctatcctaaccaaaacgttcttctgatttccggccagtaattttattttatttttatttattttgagatggagtcttgctctgtcatccaggctgcagtgcagtggtgcaacctcggctcactgcagcctctatctctcgggctcaagcagttctcctgcctcagctgggattacaggcgcccgtcaccacgcctggctaatttttgtatttttagtagagacagggtttcaccatgttgacgaggctcacctcaagtgatcctgccaccctagcctcccagagtgctgggattactggcatgagccactgtgcccggcctcaggccagtatttttaaatatcggttaataattgcaggaaacatcatttcaggttgacttttctcacctttaacctctttatatagcacagtgcaatctggccctactgccacttcatctgggttatctgtagcttgagttgtaaaaaaaaaaaaaaaaaaaattgggggaagaagttgggttaaaactgttcacctacccagcattggaacataatgggtaaacaaaaagttggagttaccatttaaaagcatttttcaaatttatattttatatataagtaggtgctatataaactaatactttttttttgtaagaatggatttggaatttagctcagctgaaaattgacttcaccttgattctcagagtgtacttgaactttaaaggaagtggggtagtgagaatgggtggttggggtttttttgc

SEQ ID NO: 46380 - DNA, 1030 bp, Homo sapiens
gaaaccctgtctctactaaaaatacaaaaattagctgggtgtgatggcatgtgcctgcagtcccggctactcgggagactgaggcagaagaatcacttgaaccggggaggctgaggttgcagtgagccaagatcacaccactgaactccagcctgggcgacagagcgagacttcgttctaaatacggttgaaattgtgacacttagtgtatacttccttatattatggtgtgcccactccctcccctttttacttcagactttatttcagtcatgattgctttcattgtactattgtaggtgaacgaaatttaggaggtttatttctgtgttgagcaggatattctctgaagttattgcatattttgaaagtagctatcagccctttcctcccttccattctctacttggtgcacctccatgtttttttctgctttgttgtaactgctgcttcctttttcttttgttcttttattcatttttttctattcttcctacattgggttttatcttctggcttccaaatctggaaaacttggatttgttattcttcggtcagtttgacaaagcaacatacttaattgcctcttttatgttaccattaaattaattctgtgaactctgacttcccttagaattgaaaaagaccacgtgtacaaaaatccggttagatagtagaaataagttctagtattcaatagtacagtagggaaattatagttaacatttatttattctaccaaagtagctagaagaattgcagtgctcctaacacaaatagaagatcaatgtttgaggccaggtgcagtggctttacgcctgtattcccagcactttgggaggctgaggcaggtggatcacctgaagtcagaagttcaagaccagcctggccaacatggcgaaaccccattggtactaaagatacaaaagttagctgggtatggtggcacatgcctgtaatcccagctactcaggaggccaaggcaggagaaacgcttgaactcaggaggaggaggttgcagtgagccgac

SEQ ID NO: 46381 - DNA, 1047 bp, Homo sapiens
aaaacacaccccatggtgcaaaatacccattgaatcttttttaaggtatatgccttaagattatgattactttgtcaaaggttacaaactaaattattttgccaaagtgctttttaaataagctgcctctgtttatactgaataggttgcttcttcaaaggggaaaataggatcccagctctgtaacttgtaattttttttcgaatttattttcattagttggcttcttgtgttctagttggcaagcccaaatctcagcacatagcacggtggtttgagtgtatagtggcaggttggctattcttcaggactgaggtgaatgtacaaatacttaatgattgagttcttgttcataattttggggtttggtctaaggacccttagtttataaattctctgattactttttaagaaaaaaagtgatcttgaatttaaagaaatgtaagggatagtggtggggtgggaaattcattatgttagaggagatttcctggcattggaagggagattttgaaattaatgctgtagtgaaacacaagaagattaaggtgaggaggaggctggtcatagttttgtatttgaaatgcctgtcttgcctcttagttagtagaattagtaccataatctaggacccttgacttcttaacaagtttactctgccttgcaacctcacactctcttccagttctctctgcaggatttttcttaggttcttctttgttcattacatagaaacctggagcttatccatattaggaggtgcttagcctgcccctttgctgctgtttctgaatatatgtgtttagttcagcactcacatattttaaatgagcaatctcttaggttttcagagaagtagaacattgttgtgtctcttacagcagaatattcattattgaatgtagtgtcaacctgaatttctatcaggttttgtcttaactatttaggaatttggtaaggtaatacactcttgatgatgaagactttctgaaaaatagtttttaggatgttgagctattaaaatatcctccaagatagttttaaaat

SEQ ID NO: 46382 - DNA, 1074 bp, Homo sapiens
gacttttggattaatttctcaaatttttgattccaaaataagttactcttggcatatttatattgaatgtgtgtgtgagaatttttaagtcagaatgacaggtgttctgatatcaagtaagttttaaaagttagcatatagtttattgaaattctaataagtttcttagaattttttgtagaattcctggttccctattgtgatttcattctagttcccatagcttttgctttactcttgacagttccacatagagaataaacaccgctcaaggttttaggggacttagaactgctgtcagtttcaatatactcaaagccagcattccttttccttttgaaactgcctgttctttataactacccaattttagcatgttttctagacttaatcacacgacatgttggactcaactttgacttaattttcagattacaagctgttgatgtttcccatatcattggttccctatcctttacattcacgctgaattgtatagttcccaggattatactcagaaaagtgcacattgccaaataggaaaatgatactgtatggataaacttgatgtgcttttaatggacaaaagctaaattataaacatctttttactgctgcttgtggtcattcacttggacttgttactcttatttttcctttttcagttctatgttgcatgtatttcttattctaatctttctaaaatgctgatttcattccatctatttgcttgatccttgccagaattccctgcaagaggcttttagctttagtttggtcgtctcactatccctgatacaaactgttgctaattaccatctttatggcctgagggtttctgcttcattactcgatttaggacttattttaatcttgattatctgtctttcagcatcagaagattggctctgttcttttctccttgaaaacatttgtgtatttgtaaagtacactgaaggagtatatgctttgatatttagatggcacaaatgtaaattttggtgtgggaagaacggtcgtatcagcagttctctcttttttattatgtgtatttctatgtaaccgatcattcac

SEQ ID NO: 46383 - DNA, 1016 bp, Homo sapiens
gcattagtgataaccagattttttatattgagcacctattttataatagctatgaaaataaactttcttcctacaaaaagcagctaatctccaaagttctgagtttttctgaagagctctttagtaacccattctggttatatgtatttatctattgtttaaccatttaataagcaaagagcttggaccatgttgcatattacaagagtaaatagagcattatggcgggaagtggtcactggcatgctcttcacaatgtggactttgcattatgtaaaagaacttgggtttcttctcttccacgtgttaatttcaaactgcaatatgtgaactaatgcaatctgcctttcctgccagatgcttagacaaaagctctcttggtagttggggagggactcaacactagtacctctttaaacctgaaagatggcagccaaaaattgggtagtttttatcttgcacatgatgaaatgaataccaaggaaatacagtctaggaagcctctttcaaactcaaagaagtatgtcgaggtgaataatggagctcaagatactgagtcaaactagttttaccatttaatagatgcatggcctgaggaaatcactcagtccctctgagaaaactaagctcaattaaataggaataatactcatcccacagggttgtggggaatgagagtcaggtaaagcaccttgactaccttctgtgtcctgtttatcttagcttttcagttctatttaaaagtgtgagcctgcctataatagtgcaggggtctcttaacttacagtccatgaatggaatttcgaagattgaagaagcctttaaaattgtgtatttttgtggggcagaaggtccatgccaaccatcaaattttcaaaggtttcattttaaaatttaaaatccactgctgtaggcagagaatgactttatataggaggtctccgagaggaagcagtgtaaaattgtgtgtctaacatttataacagttggcaactgcagttgagtaatcttaatag

SEQ ID NO: 46384 - DNA, 1377 bp, Homo sapiens
tgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactggtgagaatcaattcagtctggcttcattatactgtagggtccctatgagtatcagttacattactcttaactttttgtttggtttttcttttccttctaaacattgtgtgttccaaatttaaaagtcttcatggtgtcatgactaaaaagatgttaagacaattatagatacgtgtatgtaaaataattgcaacaatgattatgaaacagttcagttttgttaaaaataacagactttagtattgtattttatattaattgaaaatataaactaattgtgttactgttttacttatggttagaatatttgtagtagctctatagctggttatcttaaatgtacatctgtggataaaggaattttacatactttaggtaagagagatgtaataggatactcattgtagaaatagtactcttctcaggattagccgctataatgttaatgtaatgagtcaaccatgcagaaaactctggcgtcacaactatgaaacctcttcctgcattgaattcttgaaggtaaattttgaacactcacaaccatgatgaaaggttatgaacaactcaagcttgattttccagtttgaatcgagtattttaagtattcagtacttactgtgttgaagcactgcgcttaaaagaattaaactacattttggttaattttaatctgtcatataaagtagggctttttgatcaagaatagtttaaatttgaggataaaccagtagagaatccaaccaagctggcagtttttggaataatatttaaagtggttttactaaatggttacacttaaccagtatggaagggctctgatatacaaagaggggcagcatctcgatttttctggacagattactgaatctggaactcagtatggaaatccaggtttgttacttactatatgaaccttgtttatggaagaagtgctataatgagcaataggataatgtctgatgtggttgtgggtttggggtttttgttaaagttgtgatgatactatcatttctttacatttgtatttactaatggaatagcatcagttcctaaactgtaattttctcaaatgatacttacttgacactgtctttttaaagaatagtgattttttaaacatgcttatttgggttcacagccacaaactcaatgaggcatctgtcttggggcat

SEQ ID NO: 46385 - DNA, 1051 bp, Homo sapiens
aaccgaaataaaagagccatagacaattccatcttttaggtccacatggcagatctcaagtcaagcattcattttctacctgtgtggaactttaattagtttaagtgggaggtctgtgccaagaaacaggcaccacatcacagttggaatctgcagagcagattgttttctcttaataatgctctttcaaactcaatcccgcttgcagttttgataccaaaaacatgtgtgttaaacagctacgagtcgtttccgggtcattcgcattaaccatgagctctcctgacagtcttgacccataacagcagacctctgtgtttgaagtgctgtataatttacaaaggactgcacacacatcgtcacatgtcagctgcacacttagcctgctaggaaataatatcgcccccattttggtgatgaaaaaattgagtcgtggaatggttaagtgacagaatgaactgaaactggatccagtctgtctgtgttgctaatgtaagatgttaaagaactgtctatggttaaaagagaatgagtatctatttttaacaatgtgctaaatgttcttttcttctttccatggtccaagattgtcctaaactttgatttgatataattattttccacaatcctctaagtcaggctttgaaattcttctctgcctctgggtcttagtttgctttgaggtaaggatggccagtgtggatctttcttatataatctctaggtcttatattttagtttcctacctgaaaatttgtgatgccacttttaatctacgacggtaaaggaaaacaatttctcttatatgctatttaagagttaggtatttaagattaaaggaactatgtataaatatcacttatccagaagtcttctgaatatttcatttctcatggaaatgctggatgtttttaagcaacattatccattataaaacaattcaaaaagggggaagaaaatcctacaaagataacaaaaactgtgaggttttttttgtatgaagtagccaattttcacaaaaagtgctgttagcggtttataacactgctag

SEQ ID NO: 46386 - DNA, 1030 bp, Homo sapiens
gtgtacaatactttattaaaatagcaaatgagagagaaccagagttgcagaccgtatagtatataggaccaggcaatacttgaccaatgatgttttgcatgttactgcattacctttgtttgaatactagcactttttcctgaatttggtaggttaacccttgtatatttccttgatttctagtggagcaggaatattttaactgcatttgttagccagatacagttactattttgtgaattgtccattgcccatttatttgttggggccttctgactatattcaatctgctatccacagtaaacttggaacaactgagagttgccaggaaacaccagataactagagttatgaaacctgtaacttattttacacagagaacaaaattgtaggctctgtctgaaccacttgctggaagccttaactatcagataaagtataaatccacagtttgcatttaaggcatattttttattcaagactattgaaatatgttttttattgttacctgactactatgaagaaatagtatttttattagattaagtcagtttagtaagttacagtaacaaaataacctttcatgtttgggatctgtcttttattaggttctattatttaatatttatgtatgcggattttcatagtaacaaaatagactgtatttaagccttgctttgaatagccaggaacatttctgatagcaacagagtttcttacttaaataggatagaaaatggccaaacataagaatttaaagctgtagtcgaatgacccagtgagaaaaatggaaaacacctaagttcaaatctggctctgctttttcctttctcattttggacaggttacttcacctttctgagttgcattatctttagtcaccttataaaatgcaggaactggccaggtgtggtggcacatacctgtaatcccagcactttgggaggccgaggcgggtggatcacgaggtcaggagttcaagaccagcctggccaagatggtgaaacccagtctctactaaaaatacaaa

SEQ ID NO: 46387 - DNA, 1052 bp, Homo sapiens
agggattctagttaaaacagaaattgatccctggaagaaaaaaaaagtacatggaaataatcggtatttatgtgagtatcgggctcagcaagaaacagttggcaattcaagttagggtaattcaaaagaagtttggcaacaggacaatttagaaagttatggacaggaaaccataggaaatagtgtagtacatggggctaccaattaattacagggctgttaccacccctgcttaactcctcccttaagcttgagggagcagttaaaccagagggagagaattatgaataagatgtgatcttcatttagagcgagacagcaagcctaaggcaacttcgctgagaaggagccagaaaataaatactctcaccttgttcctcttgcctcctatctccttcagtggctccccattagccaaaaccaactaggagcaagagggcaagggagcttgatgccgtccttacagatcagcctccaggcgtagggtggaaaatggatctggacgacatatagaagatgtgtcacaaagagtgttggaaattattggtactttcctcaaagaattacaagaaagagatgagctcaggaaagaattagtgagtttgtaagaaaaaccaaaaggaaatcagactcaaaaaattaagtaccttgcaggctgaaaaagcaggctgattgtaaacccccaaaataagagttgggattgagaaaaattcttttttttttttgagacagagtctcactccgttgccaggctggagtgcagtggcgcgatctcggctcactgcaacctccacctcccggattcaagcaattctcctgcctcagcctcccgagtagctgggactacaggcgttcgccaccatgcccagtgaatttttgtatttttagtacagatggggtttcaccatgttggtcaggatggtctctatctcttgacctcatgatccgcccaactcggcctcctaaagtgctgggataacaggcgtgagccaccgtgcccaactgagaaaaaatcttgagataagaattcatcaagacaatcttggcaaagg

SEQ ID NO: 46388 - DNA, 1035 bp, Homo sapiens
aaaaaaaaaaaccaaacaaccaaactgtgaaaattgggtgttctctgtagctaacatttatacaagaagctgcacacagaaaagagactagaaagtaataatggttccatgagggagatgggattatgaatttattcatataaatatttgagtctgctttgctgttttggaaagtgccccagactgagtttatgttttcttcttctgatttcatatatttggtattgttcttctaaatattagttgatataccaaggactgtgggacaaaaaataagaaatcgtacatttaggactcactgtatgtcaagcacattggcaggtatatttcataaactgaccttgtaaatgttttggttaaatttgttttgagattttattataaaatgttaatacttaaaaaatgttagaacttataactttatgaatgtctaaacatcttatgaagtatcttaacattaatagagtgaatataattttttaaagcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaagtaaggcatcctttttgattttggtttagataccattttcactctgtttttgtgatagtgatttatgtatatgaaaagatagattgctgatatttctctttttgttctagcaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcaggtaaattgctaccaggtaacagattctgattaatccttc

SEQ ID NO: 46389 - DNA, 1141 bp, Homo sapiens
aatatgggagcatattcaccctccattagattggaggtgagaagtactttttagaactgcatctaaaatagactgaatccaggtgcttatgagcactatctgtaagcttttatttagacacccagactcattcttagcttagctttgcttgtaacctactgcactagtggtttcaaactaaaggaggtgatgatacagaggtagctgtggtctgaacttgatgtctagaaatagccttcatatcattttagaattcttgatgggttaccaatattgaaaaatcacaggatttacatttaaaatccagattttaattttagaagatctggtgaaattgggcctcgtaatctacatcccaaaaacattagactggtctttacaattcattgcagttctcactacttagagtttgttgctccaagtgctagtgatgccatttagtatacagcttctgttatctcttttacacacagcctccttcattcatttatattacttcaagtgtaggcatttgattctgtgacctcttcactttgtcaggatctgacaggtagagtcatcatcccgcaggtagggatgaagtgtgtcatgattagtctttatacctacctcagtgactagggcctaccacacagtagacccacaagaaattttttattgaactcactctgccttttgctataagaataactgacagatgtaacatacaatgatgcagagtaaacttttctgcttgtaacacaactaagtagtattgatactctcagtgtgagagcccatctactatagtctggcaggttggagataagagtttcctgtagagtagtagctgcttctaactaaataatttgctgttacttgaaaccagtgtatatgacagcaccgtacaacagaatatcttgattttagttgccctttgaaagtactctgttctttgttcttcagggagactttgacattttctctcaacacatattttgtataaatttccctatgttttggaaagtttagtattaagctcctcatgaactggagcttgctgttgatgaggtgacttcagagccatagttagttccacaatcaaagtggcctgtctcacgtgtagtggatagtgaaaatagttgtttaggtgtgttttctt

SEQ ID NO: 46390 - DNA, 1033 bp, Homo sapiens
tgtgcaatttacaatgccttcttctgtaatacctcctgaaggacctgccttaggctgttttagttaactttaaaaaaaatagatagaagaagtacattctaaagtaaccaaagaaagtatagtaaatactttagaaatcagtgacctagttttatcattatcgaatattatactgtacataaattgtatgtactgtacttctatatgattggcagtacagtaggtttgtttatgccagcactgccacaaacagtatgatttaacaacagctacgatgtcactaggcaataggaacttttcagctccattataatcttatagtaccacagtcatatatgtggtccatcattgaccgtaatgtttttatgcagcacatgactgtactaggtatctttttaaggtagaactaatagatttgctaatggctaaatgtagggtatcaaatagacgaagcaagagggttaatggttttggaagaatgaagttgtcatttaccgagttgaagactatagaagtgaagaagattcaagggtttggttttagacgtgaagtttaagatgtctcttctgatagaggaagtgaatgtgaagacattttaatagatgtctcttctgatagaagaagtgaaggtgaaggttcaggaatttggttttagacaggtgaaatttaagttgtctattagaagattatctgacagattcctggaccaagaggagatggcaagtagaaagttagatgtgtaagtctgactaagagagaaaggctcaagctggagaaatttacttgggagttgtttatttagaggaattatattgaacaagatcatggaggtggtgaggagaaaaggtccaaggactaagtcctgagaatagtctcaacatttaaatgttagggtgataaagaggaacgagcataagagatcgagaaggaacatccacagggttggaggaaagctagaatgagttgtgtcctggaagtcaaatgaagagcacatgtcaagcaggatgttgggaccaactgtgtcaagtgatgt

SEQ ID NO: 46391 - DNA, 2143 bp, Homo sapiens
aaagtcagcaccttcgtcacattagcttcatttcaagtgctcagtagccacttatggctaatggctgccgtattggacaccgccaatatagaacgttgccattttcaagaaagttctgtcagaccgaaggctgctttaatttaattaggagatgggaggatttcacgggctatatacttaagtttttcagttgattactgaaaacattcactgactgtaatcactggctgtgtgggtcagttttctctagcaaatgagccttgaatatagatgtcagtagcaaagctcagagtctgtctgggttgattttataacttggtgatcattgaagaaacatacaaagaattggattcctttaacattaaattagttcagtgaatagaatttgtatgttgattttatataagctattgctaatgttcattgaatttgcctatacttccaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggtaagtgtaaagaagttattcagcaagtgaatattggaactgactccgtgagtttattatggagtttgaaagcaaaattccttttgtgtcatgcaggttgtcaaaactggtggaacaccgaaggttcccgactgtttccaaaggactcctaaaaagctttgtatacctgaaaaaacagaaatattagcagtgaatgtagattccaaaggtaaattttgaaacttcttcagctggcatatcctatattccattaatacttgttcaggaaatgggaatatgataaaataattcagggcattggcatttttttgttccctatctgtaacattatggaatggcatgtatctgtttgaattgacttacaagtgtggccagagaagttaaaatattgtagatgtttattagagataagatgtataacaatttttcttctcatttatgtgcttctgaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggtagaggctcatttttgcttttgaaaagtgataggacaacaatggcatttttgtgaggttagggggtctggctctggttagcttatcaattattcaaaaacctagaatatttagcacatttgaatactaggtttcttattactattactaaaatctaatttggaaataaatatgcctgtaaaaatcagatacattttttgattaggagtcaaactttaccattttcccattattataggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagaggtaatttgagtattgaaactactgggcattttaattcacaaaacaccactaaatagtcttgaatagatcttgcaacaatcttaaatagatcattcattgcccctttcttccctaaaagagctaatggtctattaaaactacatagacaagtacatcagtgattatcgtgtaatttaagtgtttgagcaaggcatgcataatgttgtaggagcacaaaggggagagatataaatcatactgtgactgtaccaaagacttctttaagaagcgatacccggacagatcagataggccccttagacacagggatggagttgggaggtattatcccaggcaccaagagcaacctttgtgaatcttattaataagttgggagaaagtacttttttttgatatgaccagaattctggtagggatcctgtgggtcagtgagtagcaactgaaaaggctggagaggggcactagggtgtttgtgtgttcacctaacgctacctaaacttcagcctgaaag

SEQ ID NO: 46392 - DNA, 1024 bp, Homo sapiens
ttggttttttttttttgcataaccttctttgaatagaaagatggtatttacagtgttgactatttctgttgtttttcagaattagagttttaaaaagatatgtgaaattcatgatagtaatagaaggaaataattgccactagctagtctatctactcacttttgttgagactcttattattgtaaattgattatgtcttggtcacaacttttgctcaaaatttgtaaatttataaacctagacttactgccacaccatggatagaattttttcaaaaattccttaaaataaattttatggtgttaattgctttgcaatttaggaaattaaaagttagactttaatagttatgtgatagttttcttaaaactatctggcagatcttcctttttaaactctggttagatactataattttgggagtacaaaatacattttacgctatttctttgtacttgtttatactggtgttaatacaattaaacattaatggttacagttgttcttcactgtgaatttatttgaagtacagattgatcagaaaactccaattcataaagcagtagcttaggaaattgttgagaaacttcacttatgtatccctttaaagatagtctttcttataaatttagatgaaatctataaagtctcttttacattttctttttggtacttaccattttgttgttgtctaagaacgacgacggtcaacccctgcaccaaaagaagaggaaaaggtgaatgaagagcagtggtctcttcgggaagtggtttttgtggaagatgtcaagaatgttcctgttggcaaggtttgttcaagatatctaaaacttaattactaacagaattataatgatattggttatccagggatttgtggttgatatctgagtcctttcttcagggctgttttatttatcatcttcagtggtatctttagttgcacccctgcatctgatgcagatctgtcttctcagtcgctgacagatgaagagattatgcctctctttgagcatttgtgat

SEQ ID NO: 46393 - DNA, 1053 bp, Homo sapiens
caccatcttcttttgtttcttacatttaattataagccacaaaaaatcatgatcttcgtgtgtacctctggtcatctaccacatagtaagattgggatattggataaataaaagatatctccagaaaaaatgttcctatctaagatggagatactgttggtatgtttaacagtgctgtcttgaaggccattggttttcggagcatgacctgaggttagtcccctgacagagttttttttttttttttctctgtaagttatttactcctaaacccagttaaacttcagacactaatgtctacatattcttttttaatttaaaagaaaaattattcatggaaccttctggctagcaggaaacagtagtcttctgggataaagaaacatctataaagttatggagcctatcatgaattaagggaaaaagttatttcagattgtaggaaacagacaagaagtgtaattttttttttcacattttactttttaaattataatgccttttagtttcttctctgctgtttctgctctgttttttgtttgtttgtttgtttgtttgtttgtagcagaatggatgggatatttgctgcatgaaaatttaaagttaatgctaaatttttagcaaacatgttgaaattattccttttccttaatattagaaacaaattttcttttctttttcttttttttgagatggagtctcactctgttgcccaggctggagtgcagtggcatgatcttggctcactgcaacctccgcctcccaggtttaagcaattctctgcctcagcctcccaagcagctgggataacaggcgcatgccaccatgcccagctaatttttgtatttttaatagagacggaggtttcaccatcttggccaggctggtcttgaactcctgactcatgatccacctgccttggcctcccaaagtgctgggataacaggcgtgagccaccacgcctggcctagaaacaaattttcttaatgaagacctttaaggtggtgctttttcagccttattgattgggtaagattatactgggaaacctag

SEQ ID NO: 46394 - DNA, 1095 bp, Homo sapiens
gatcataatgtgatcagtgctaggctgaaagtatgagtaaagtgctataggggttctgagtggtaaatgaccaataccacctgagagatctggcaaaggcatcgcagaggagatagcatttaagcagcatttttaaggtgaggtgggcattgaccaaggcacaaaggtattccaaacgtatctgggcatgggcccagagtcacaaaaggtcatgatgtgtttgaggaaccatgaaaaattcagaattgctgctttgtggtggggagtaggagaagagatgggatggagatgactagacagtttgccaagcaagaagttaggatattgttttgcagcaattaagaagtcaacagagtccgtagagaagtgacttgatgtgattggtggggttttgctttgttgtatttgatttgttttaaggaggtgaacattactggcatgatgggagaaagcaacaggaaaaatcaaaagtcggttatgagaatgctacagttgttcaaggaaattgtgaggatctcaaccaaagcaggggtatggggagagagaaagagaagaatctgagaggaatttgagatcagtttagacatgggaacctgggagcacgcctcatctcttccttttctctcatcagtcaattcgattgtcgtgtctcccattaccaggtgggtggtgatgtcattcatagagataggaactacagggaaggcacagctttgcaggagatggcggattcattttagggatgtcattgtgctttttaagacagctgtaggtaagtctggagatatgagatttacacatttaaaagcatgatgctctggtagatgaagtcactgaggctgaaggtgaagcacaatttgaatacagggagaaacacagaatcagtggcagggagtgcatggtagtaccagggagatggagggaagaccatgcatggtagtgccagggagatggaaggtaggtggaagaccagtagagaatggtgacctatgaattagggagagaaggatgggttccagaacagataatgaacagaggcaaatcatttgaagagtttaaagagaagatggactgattacgtacattgagcattga

SEQ ID NO: 46395 - DNA, 1147 bp, Homo sapiens
tactgcataaacatgaattggtagtgtgcatcagcaagtacagaagctcgtcaaaaggatgacaacagcttttctaggtttattttttcattttactgaggaaactatttaaacagttttttatttagccagagattgggctttccagtcaagtgagaggagaaaccatggaaatttgatgtatattgatttgagaatcattattggttaatgtattccaaactttttaaggggggaaatggtttggaaaatcaaattgaaatgaaatctgtttgcattgggagtttgaaggtttcagccttaggcgagtacggtaggaactgagagtaaaatacctctctctaggtcatatgatctccaattattagattcattttgaagagaaaagacactgccctaatttaaaaagctgaagtgacttgtgtgaccattttctttaagatgtgattaagtacagaaggcaatcatggttatctagatgacttgatttaatcttcttgatgttcatgtttggacagtaagagaagatgtagatgtcatgccctttctaagttgttttctcataagaaaaaattaacttatttaaatagcagctttctcttggacaaggtggttgatagtgctgaatattaatgcagtactatctcagcaaatgaatgtttatttcatgtgaagcactttgaattctaaactctgaattttactttttgtgtaacagtgttggtagttaagtctgataggtctttcatgcaaaggcaagatgtgttcattttatttcatttaattaattaatttatttatttttgagacagagtctcgctctgttgcccaggctggagtgcagtggcgcgatctcggctcgctgctacctctgcctcctgggtcctggttcaagcagttcttcctcaacctcccgagtagctgggattacaggcacgtgcaccatgcccagctaatttttgtatttttaatagagacagggtttctctatgttggccaggctagtcttgaactcctgacctcgtgatccacctgccttggcctctcaaagtgctgggattacaaggcatgagccaccatgcctgaccaatgtgttcattttatagttgtgattagaaatacataggtggctttaaaaaattatttt

SEQ ID NO: 46396 - DNA, 1736 bp, Homo sapiens
tcggcctcccaaagtgctgggattacaggcctgagccactgcacccggcccattatttatttatttatctatctaatttgagacagagtctccctctgtcacccaggctggagtgcagtggcatgatctcagctcactgcaacctctgcttctgggttcaagtgattctcgtgcctcagacttctgagtagctgtaattacaggcgcccaccaccacgcttgactaagttttgtatttttagtagagacagggtttcaccatgttggccaggctggccttgaactcctgacctcaagtgatctccttgccttagcctcccaaagtgctaggattacaggtgtcagccaccgcgcctggccttattttttattctatttatttctttttctcttatgttatttacatcattatagtctcatggatatttgttttattctccagtttataacccatttctcttattatgttgctcaaattgtcttaggcttaaatcctcttaaaacttggaaataaccaattataatagaatgtatgacagaatgactaaagtaggatggtagaattttgtgactttgttaataaaaatatacaacaaatataataatgtttgaataaaacctctgtagacctactctgaagaagattagggctaattttaagactttaaaatgcagacagaatccttagttttctgagtccccttacccatttcttacactccccgtaaacccctctttgtgcctctgttctctctgccagaacagactgtgtaagcgttctttaagcattaggtccatgattgcaatactgtaaaatgtcatagtgcctcctgaccaacttgatgccagtgatttgtttacttatatttgagtttgcagatgtttacaaagtataagcagttaaattctgattgtttctcttgggctgtatgaaaaatctttgcagtttgttgaaggtgaaattgtgattaagttattttgtaaatcaaattttttttttacagtcacacatattttcctttatagtaaatgtgtttccttgatttgtacattgctctttttttttttttttcaatttctgtgttaattacaattaactttagagaagcttgcaatttataacatgtattggggaatctaggacaggcaaatcttgtgtcctcaaaggggagtctttaaaccacagatttaccaaatacaatgcaatatgaaagagactgtccccagagaccttggtcctcactcctgtcctgcagagtctaggcctgctcacttttgctgctgggagttgtcctggatcaggaagtgaatagtctctttgagagccacatttttaaagagtttgggattattggtacagttttttagcatggattttttttttttttttttttttttgagagacaggatctccctctgttgcccaggctggattgcagtcatgtgatcttgacccactgcagccttgacttcgcagcctcaagtgttcctcccacctcagcctcccaaatagctaggactacaggcatgccccaccacaccctgctaatttttgtatttttggtagagcagggttttgccatgttgcccaggctggtctttaactcctgaccttgaacagtctgcctgccccaacttcccaaagtgctgaggtaacaggcatgagccactatgcccggccagcatggataattgagaattgatcatttattttgactgattatttttaggaatac

SEQ ID NO: 46397 - DNA, 1038 bp, Homo sapiens
tttataccttgattcttgaatggccagattttctgaaaatacccagttaatgattagattatgctacttcagtcaccacgtgtttgaaggctgatcacagaaaactagaagcaatgtaactagtttcaaaatataattaaatggaggaggaagtgtttggcttttttccctccagaccacaaattggtaggtaaagtaaaagttagatttgaaaattgggcctgggtgtggtggcttacacctctcagcacgttgggaggccaaggtgagtggatctgttgagtcccagagtttaagaccagcctgggcaacatggcaaaatgccatttttactaaaaatacaaaaatgtagctgaatgtggtggcgcatgcctgtagtcctagctacccaggaggctgaggtgggaggatcatctaagcccaggaagttgaggctgcagtgagccatgataatgccactgtatgccatcctgggcaatggaaatgagagacccccgtctcaaaaaaaaaaaaaaaaaagaaaagaaaagggttgtgggggggataccaaaatgattactttctttgcgtttgtgttttcatgctgaactaaatttattttagaatgtgaggaaagtttttagttgagtacatcctttagctatactaaatatagctcttgtctttattaaaatgttatatgtgctcttttaatggtcctaggcacacagtatatgataaagaattctgaaaatagcatgtaataacatgaaattttatttcatgtgataaaactgaaaaatttttgattatatttaagaataagtattaccggttatactgttgccaaatagtacctttcttaaagatgaacatttttttgtttagtttaaggatcagtaaagtatagcctgcatgccaaatccagccaccccagtttttattgaaagacagccatacttattatctgtggctgtctttgtactataacagcagagatgagtagttgggacagactagcctccaaagcataaactatttatgatttggccctttaca

SEQ ID NO: 46398 - DNA, 1040 bp, Homo sapiens
gttatcaacagatgtaacccacataaacaaaagatttttggggtcttcagtagtttttaagagtataaggtggtcttgagatttaacaagtttgagaatcaaaccttgtaagaggtgaagaaaggaagctgctgaggcaactgtgttaaataatattatatgcattttctaccacaaccaaaggttctgatttactttcagagaaaaccctcctaggctgggcatgatggctgacaccagtaataccaggtctttggcagcccaaggcagacgggatcatttgaagccaggagtttgagaccagcctgtgcaacacagcaagacacctcccccctaccctcacccaccccactcgtctctacaaaaaataaaaattagcctggtgtggtgacatgtgcttgtaatcccacctactcaggaggtgaggcaggaggatctcttgaacccaggagtttgaggctgcagtgagctatgcttacaccactgcaccaccactctgtctgggtgacagagcaggactgtgccccttgggaaaaaaaaaaagaaaacagaaaaccctcctataaagagctagaaagaaatgaacatatatggtctttgctttcttgaagcctaaattcttttgttcctggtaacatttttagttcctgtttggccatcacaacagtcttactcattggttcctcattgttaaactcttaagtttcctgtggtcaactgtgagatgaaaaaaattaaggacaaaatggggagttttaaatatagctaattttgtgtttatttattgcaagattatggccttactggcattttttgatgtgaaaatgtagtgatttttttttctgtgtgtgttgtcaaaataattatattacatctctcattttcctaccttcaccatgaaatcccaaagttggagtaccgaagatcagggttaaattcagatacaagcattaaaaaatggatttttaaaaatgtgtctgaaaattgagtgtctaattcaactttcaggcatataatgagcaagtttttcatacacagat

SEQ ID NO: 46399 - DNA, 1033 bp, Homo sapiens
gatcacaccattgcactccagcttgggccacagagggatactaaaaagaatatccataatttgagaagcatttaaaaggtatataagtaggaggttattttggttggcatttgtggctgttttagtaagaagaatgaattattactcattttccccccaatgtcgatttagtattggtcactttaatggcactgtgcatttagagtatggcagttctcggagtgtggtctgtggacctccaagagtcttacaggggctctgaggtcaaaactgtctttataataaaacggaggctttttcaccattttgacatctgtgctgtggtttaaaagcagtggtgggtaaaatactggctttttggcagaaatcaaagcagtggcaccaaactgtacaactaattgtcattgtattctttgcttttcttgtacttgtaggggaaaaagccagtttcacttcaaagtgtccttgatgaaacagtaggagttattaactgtattaaatctatacctttgagcataagatcgttttaaaacaagcccctttcttcatggaaaccatttttatttgagactgactgacaaataatggttattcagacttggatatttaacagacattttcttgaaaatgaacaagtaagcctgttaatttacagaaaacaatgaaggtatttgtttctggtgataaatttgaactttcaagcaaattttagaattttgggaaacttgtacccattactgtgagtttgacactgtagattgatagtaacattagcaaatgtgatttttgagtatctgtgtcagtcaataaatcagtgttttccaaatgaccagtgtatcctggtccagatgacaaaatcatacttgagttattcaaagttcattaataggtttcagatttccacattgctctcaacctttaagaaatcacttgctgagttttggtataatatcaaagaataatacctgtggttatctggaaaggatattaaaatgtacctcacttttccgtaacttttctatctagggccagc

SEQ ID NO: 46400 - DNA, 1036 bp, Homo sapiens
aaactgataactaaggggaatagttagaagttcacattaaaaaagtttatatccctttatgaagttacaatatttatttagaaacttcattttcttctttgaatgcatcttgaaggtgaatgttcttatttagggtaacatgaatgcattatatataaactggcatttatcatcttcataagcattaataaaagtgtaagtcctccttacaaactatgattcaagaagccaacagatgaaacttacctcacaaaaaccatcttttgttttgtctttctgtgttttgttttgtcttttgtgtaatttggggtcatttaacccaagagtaaagtcagtcagatgtttgctacttggcacagatttatttgggtaggcagtaagtgagaaaagtgagaccactgatttagaaattgttgatgcaaatttaaataaaatgtggttaaggcttgtgactgagcattggttaacagggatcaatgtgcaagctgaaatctgaagtataagactgtgatcagattgcttttcaccaaagaaataaacttgtagcaattctttaattcttatatgtcaaacccggaggcctatagttgctaagctctgtgtccaggctggagtgcagtggggcgatcatagctcacttttacctcaaactcctggactcaagagatccttctgcctcagcctcctgagttgatgagattacaggcatgagccatcataaccagctgctacaccattttataatctgaacagattcaggggctgggtgcagtggctcacacctgtaatcccagcactttgggaggccgaggcagacagatcatgaggtcaggagttggagaccagcctagccaacaaggcgaaaccctgtctctactaaaaatacaagaattagtcaggcatggtcgtaggtgcctgtaattccagctactcaggaggctgaggcaggagaatcgcttgaaccagggacgcagaggttgcagtgagccgagatcgtgccattgcactccagcctgggcgacagagcgagactccg

SEQ ID NO: 46401 - DNA, 1043 bp, Homo sapiens
gcctcagcctcccaaagtgctgggattacaggcgtgagccaccacgcctggccagtattgtacattttttaacgatatgattttaggcacagtggattattatgctctttaaaaaatcctttcagttgattaaacaataaggaaattgggaaaccatttttagacgaagagaaaagacaggaaaagcagtttgtcactgttgagctgtgccttttggaggaggtttctatgttctagatacactctcttgggttctagggtagagatgactaagacttgctctacttcaggaaccttagctctcaaaccagtgtcctctggttccccaagatcttactagcgagtgttccatgttcagcttcaacttgggaagcataagattaagcataaacaggccttttcattgtagggcttattggaggcttaatggaggtgtatgaattgtgaatttctaagagggggctgtcctaagcaacagtctccaaacttgaaatagtatgcttacttactgcctccctaaacagacccctacttttgtgaatattttaatccttgtgtgtatttatggtgttttagagtgagtagtgagttccaaacctagttgagccatcagaattactgtggatgcatagacatttttttaaaaaaattttaagttggtaatatgttcatgtggtctaaaaataaaaagttgtgcccgtaatcccagcactttgggaagcctaggcgggcagatcacgaggtcaggagttcgagaccagcctggccaacatagtgaaaccctgtctctactaaaaatacaaaaaaattagccaggtgtggtagcgggcgcctgtaatcctagctacttgggaggctgaggcaggagaattgcttgaacctgggaggtggaattgcagtgagctgagattgcaccactgcactccagcctgggcaacattgcgagactccgtctcaaaaaataaaaataaataaataaataattgtaaattggcatacagtgaaaagcctccctccctcttctgtttcctggccttctactt

SEQ ID NO: 46402 - DNA, 1050 bp, Homo sapiens
attgtagctatgatgatggcgaccgcgttttacaaacatttgtgttctcctaacatagtgattaattactaggacaggtttgagatggtggcagttacaaagagcatctggctggagatgagtttagtgttcgcatatacccctactcactcctccaccatcttcccctttcagaaaccgagagaggaggtagctgatgataccaataaacttgttatgctttgagatgtatctctgtaactagcaagtgatttccaggcatttttaaaaaaaaaaaaaagcacggcaaaaaaggcagcagtattggggaagataattagggactggaaggtaggcagctcttcttcatagtctttcccaagattagctctcttactgtcatatccatgcactatctaaaaggccaagttgtcccccaccgctacccctaacccccctgtatctactgggagaagatgagagtgggcgttgagatggggtgagatgttacttggtcagtaatattagtctgtaaactaaaatattaggctgtaaactaagtcagtaaactaaaatattagtctggaaccgcttgttgagtctgttgagtcagcgtacattgagttattaggttggtgcaaaagtaattgcggttcttgcaatttttttttttttttttttcctccttttttcaagaccaagtttcactcttgtcacccaggctggagtgcagtggcgcgatcttggctcactgcaacctccgcctcctgagttcaagtgattttcctgcctcagcctccctggtagctgggattacaggcgtgcgccaccacacccggctaatttttgtatttttagtagagacgggatttcaccatgttggcccggctggtctggaacttctgacctcaagtgatccacccacctcggcctcccaaagtggtgggattacaggtgtgagccaccgcacccgacctggttcttgcaattttaatggcaaaactgcaattacttttgtaccaacctaatatttattataagacaaagaactggaagcattttctggtggat

SEQ ID NO: 46403 - DNA, 1073 bp, Homo sapiens
gagtggtgcagtggtggggtctcagctgattgcaaactctgcctcctgggctcaagtgattctcatgcctcagccttcctagtagctgggattataggcgcacaccaccatgtctggctgatttttgtatttttcatagaaacggggtttcaccatgttgaccaggctggtcttgaactcctggcctcaagtgataacacctgccttggcctcccaaagtgctcagattacaggcatgagccaccatgcctggtcgagagctgattggtttataaggcagttttccctgttctcgtttgctttctctctccagctgcaatggaagacttgtctcttccccttctgccataattgtaagtttcctgaggcttccccagccatgtggaactatgaatgaattaaacctcttttctttataaattacccagcatcgggtatgtctttatagcagtgtgaaaacagactaatacagaagtatatgttaactttctctgctgagcatgttggtgcttgcctgtagtcccagctacttgggaggctgaggtggaaggatcatttaagaccagcctgggcaacatagggagatcctatgtccaaaaaaaaaaaaaaaaaaaaaaagcatgttaaatttttcatcagagttgacagcttctcaaatggtcagtttttgttatatacattgttgaggctgtgtgttagaaactttcagattcatgaacattattcaatgttctttgtagtttgttccttttattgtaatatagtctctatccctattaatgctttttcgctactgatacctgacttttttccccttaatctttgacttgtaatatgtgagattaatctatttgaataagtagacttatttctgctctctgaattttatattttctgatccatttactttgctgtgtgtgtgttttgtttttgtttttgttttttttttttttttgagtctagctttgttgcccaggctggagttgcacgatcttggttccctgcagtctcagcctcccaggttcaagtgattgtcctgtgtcaatctcccgagtagctgggactacaggcgt

SEQ ID NO: 46404 - DNA, 1026 bp, Homo sapiens
gggtatgtagtggcattctaaagaaatcttaatgccacttccaaaaggaaaactccaaaaatcttttgggtgtggggcattattgttgaaataaatgtgtagcttgccagtatgattaatacgaagaagacacatctgtttgcatgtaaagtttattggaaatagggcttattatttcatagctgtgcctaagagagtattttgatattatttgtggtcagttttcaaggggttattagtcatatgtgccatttttcttgggtattttgcagtttttattgaatatgtgatgaacttgcaggatcttttgtgtgaatgtgaaaaagagcgtgtgttttacacatgttttatacatcacatattttgtttctaatcaaaagaggccttatatctgaaagccttcttgttactcataagacaaggatgtgagactagacagtttttaagggtctgcctaggtctaacagaggggaaggaataagttctggatgggaaagttggtagaaatgttagcgaagtgtcaaattaagtagaattagtttttagattttcttgaagccaagacaaaaacaatggctaaaaaattacaaagctcagtgtatcacagaggagcttttccttccttccttccttccttccattttttttttttttttttttttttgacagagtctcactctgttgcctgggctggagtgccgtggtgtgacctctgcttcccaggctcaagggattctcatgcctcagcctcttgagtagctgggattacaggtgcatgctaccacgcctggctaatttttgtgtttttagtagaggtgaggtttcgggttttactgtgttgcccagactgatctcgaactcgtgggctcaagtgatccatctgcttcggcctcccaaagtgctgggattacaggcatgagccaccacccctgaccaggaactttttgttaatcatggtttgatataaatgttggagaatcttttacattagagatattttaaaaacctaatggactgtgagtttta

SEQ ID NO: 46405 - DNA, 1037 bp, Homo sapiens
atttcctgcctcagacctgctcttctgctttttttgtacttactctaataggtatttaggagtagtgggcagaaaatagagctttctaagctcttgccgtctggttagtttaactgaagaggagctcttaaaaaacatgcccaggtcttctgtattgctcccccaccccttccccctttatttgattttatttttgacatggagtctcactctgtcactcaggcaggagtgcagctttatcaagtatatgataaagcaaaagcacattgatgatggcatatcaccttctgagtttgaaaatgtttgtttacctttgatttctaatggattaagagtgttgctcttgttttttggaaatgctgtttattaggtcctagtactgccacatgctcaatgagaaactttttaacttctgttttccaggaaacccattgttctgtgtattagactgtaatagatattaccttgtgacttgacactgctgaatagaatgttttgagatgtttcatcaaaactttacaccaaggacgattttaggattttattttatagctgaggaaactgagggccggagtgcttagattagttaagtggcaaagactccaccctacattaacttagccttattgcttttcctttgaaaagggtagaggaagttacttgtttttctatgtgtgtgtgtatgtaattatatattaatgtgaacacacactgtttgtgtgtatgtatgtttgtgtatatatgtaattataaatatgaatacactgtgtttgtgtatatgtaaacaggtacgtgtgtgtgtgtgtatatatataaatagatatatgtgaaatcattaaaagagtgtttattcagcaagatttgggggcgtctgctgcctgtcagttctagtcttgggtgtctggtggtggtgtttggttcatgaaaaagagacagttacaggacagtgtgacaagtacagtgaaaagggaaagttcaggattcttcactagaagcaccagttcagtcttgggcaggggaaaagcttacctgaagaa

SEQ ID NO: 46406 - DNA, 1052 bp, Homo sapiens
gatttgaagacatagtttaaagaaaactttgcctttttagatgtgattgtaaattgatgagatataggctgggcataatggctcacgcctgtaatctcagcactttgggaggccgaagctggctgatcacctgaggtcaggagttcgagaccagcacggccaatgtggcgaaaccctgtctttttactaaaagtacaaaaataagccgggcatgatggtgagcacctgtaatcccagctacttaggaggctgaggcaggagaatcacttgaacctgggaggtggaggttgcagtaagccgagatcgcgccattgcactctagcctgggcgacagagtgagactccgtctcaaaaaaaaaaaaaaatttgatgagataatatatattatgtagtgatttaaatttttagacagtctgatgtggtggtagatagaatgtaagttggagtaagcaggatcgtgaatttgttctttgtatccgacactaactggccatatgatgatatgaccttgagtaaatgatacaactcatttgtaaaatgagagagttgggctagatcatttggtctttttttaactcctgtttccatgcccttgtgattgtggtagggaatagctttttttcatcatatacctgtttgccatttatatgtcttttgggaaatgtctattcagaccttttgctcatttttaattagattattagattttttcttgtagagttgtttgagctccttagatattctcattattaatcccttatcaggtggatagtttgtaaatattttctcccattttgtgtattgtctcttcacttggtggattgttttctttgctttgcagagctttatatttttattttttgagatggagtcttgctctgttgcccaggctagagtgcagtggcgcgatctcgcctcactgcaacctctacctcctgggttcaagtgattctcctgccttagcctcccgagtacctgggattacaggcgcccaccaccatgcccggctaatttttgtatttttagtagagacagggtttgaccatgttggc

SEQ ID NO: 46407 - DNA, 1476 bp, Homo sapiens
aggattttgtcactgcctaggggatgcagaaacagaaatgagtgacttctgtagtgtaggttggcaggccatggtttgcaggtcagagatgacatgtggactgattttgttggcatctgttcatctttctgctacttttgagagctgagagctactgaagagtacatacgacacttgcctgcagagacaggagtcagtactgtagtacagtacaggaattagcagccaccccataccatccctgaatgtttctggtttcatgaaactctagagtggcagggactcgaggacagttggtattttgcttttctctagggtctctctgctcttcagagggctctgggaatgtaaaagcttcttcaattgacatgtagattcagtctttgtcttcctttggtcaattttaagacattattgagaggtaatagcattttttggggatcggggacatgatatggttaagcttttttaaagtagaaggtttttcggacagttgaattgaaattattgtatgagtaacataacctagtcaaattgtagtaaaatcatggattgtggtggcttttcccagttaggaggtctcttgatttaaaacagtgcttctcatgggatggaccgtcatcaggagcagcaaaacttgaagaccactgagtaaaaaggctcttttaccctcttttctttgtcttaacattgattgatgatggcaaatagggccaaacttgccagttcttcactgcctccaaccttccttttccccttagacttacaggttttatacctgtctgtttgagaatagggtattttcctgttccttgattttgtgtgtctctctctaagctagagtagtttatttttgttcgcttctttttttttaaccacgaaattggaaaaatttagattaagttacataaattctaggtcctctacacaactgtgagatactgaaaggatagctttttaaaatgcatttcggtgcttgtaaggtcacagtctagttgggagaaatgaggctcatccatagatagtagcactatgaaagactgctacaagaggtagagtttgggctgtgtaaatatttgccatgctattgcttgcacagagtttgagaacagtgttagattagtttttcttgttgagtaaatgcttgtgtgcttctcatgtgcaaaaagtgtgctaggccagggatagctggtgtgtttcaattgccacaccaaaccgtcctgaaacttcgggttgagacgtgtttggaactttttctggctcagggagaaagcttggagaagagtgaggttatagattagcgagctcagggagtggcatcaggtgggtatgccatgtattgtttttctacctttctttttttttgagacagggtcttgctgtgttgcctaggctgatcttgaactcctgggctcaagcaaccctcttgcctcagcttcctgagtagctgggattacagacaagtagctaggatta

SEQ ID NO: 46408 - DNA, 1026 bp, Homo sapiens
cgaactcctgggctcaagcaattatcccgtctcagcctctccaaggtgctgggattacaggcatgaaccactgtgcctcgccttatttatttctttaaaattagagacatggtcttgctgtgttgcctaggctggtctcagactcctggcctcaagctgtcttcccaccttggcctcccaaaatgctgggattacaggcaggagacaccatggctggcctgaagtttttcttggcttcaatttatcacaatgtttttcataggaaaagtccactgataataaaaacctagatttttcttgacagcaaatttttgtgttaattaaaaaacatactagtatatgtaaaaagattatattttagaattccattaaatgtaatggttgtattctagattgctagttataaagatgatgatagtggctagtcgacaaagcactgtgatgaatggatcagtagataagtttttattttcttccccatgagttcaggctccatttctgtgatatagaagtgtcgagaacctgccgtttcaagaaattggctctgctccagcatgaatctgctgttcagaattcaggcgatgaggtattccaggtctttacttgaattcagataccaggtctacctcacagacaacctggaactccagagatggccttaactgtgtctccaagactcttacttagggacatggtggaaattcatttgggtgttttccgtgacagcctccttgttatgaagtgagaagtggaggaagatggttttttaagccttaagaaaagctaaatttgagattaggaagttaatttgatggagaaagctaagaaagcccagacaatatggtagggttattttaatttctaaatgatgaaaacagagttttatatggaaggctttggggagaggggtattagattgttcagctgattatctgttctcttatgttgtagtagtggctttgtttcttgtccagaagtaattcgaacttgtccaattattgctctgtaacatcatctgcctctaca

SEQ ID NO: 46409 - DNA, 1048 bp, Homo sapiens
ggttgtgtgggatggagcatcatattaccaaatcagtgaaaaatctcaccatttgattattgagattgttacctaaaagcaatactaaatgcattatgccaggtgcggtggctcatgcctgtaatcccagcactttgggaggctgaggtgggcggatcatctgaggtcagaagtttgagaccagcctggccaacatggtgaaaccccatctctactaaaaatacaaaaattagctgggcatggtggtgcatgcctgtagttgcagctactcaagaggctgaggcaggagaattgcttgaacctgggaggtggaggttgcagtgagccaagattgcgccactgcactccagcttgggtgacagagcgagactccatctcaaaaacaaaaacaaaaccaaaaacaaacaataaaaaaccaatactagatttattgtattggaaaagtacagtctggcctaactaaaatgtttaaatgaatttgcttaagtaagattaacagcagggtgtagaatagccaagcaaaatagaaaatcaaaacaaaggcagagcaattttataaatcaggatatctgtgactgaatcataggcctaggaataaacagacacttgtgaagaaaattacaggatacacaggaatacgactaggaataataggtgaaattaggaaaggtcagggttttttcccctaacaattagaccattaggttatttaggaaatagtttccaaaggaaaatttaattgctgaagactgagttacatggacgtagatcttataaggtatattaaaggaagcaattttatgttacaggaggatgtacttaatgtctcccctccctcattttatcatacatatttattttgttttttgagtctcgctcttgcccacgctggaatgcagtggtgccattttggcacaatcttggctcactgcaacctccgcctcccgggttcaagcgattctgctgcctcagcctcctgagtagctgggagtacaggcgcacgccaccatacctggctaatttttgtatttttagtagagatggggtt

SEQ ID NO: 46410 - DNA, 1032 bp, Homo sapiens
agtagtaagattagacaggcagaatggtactgcaaataaattgctcagctgaagaaaacttggtcctcaaaacagtagtgttttcttcaaatacgttttctttctttacccacatcctcttaaaaagtcaaatattttgttcagcatcatagtctgatgtctcaagtgtctaaaatgtacaaagcataaaaaagtatctttttttcataatttgtgttttcagacttgccaataatgaataataatgatgccaggatgaaattgacaaatacaggtggggatggctggggtggaaagaagaggatgttggctgtgacttcccagaatgattacaaggtgcctggcacagaatgctgggccctcaagcaaatattcattgagctgaattgaaaccattcagtgctcagatactttggacattttgatctcctttccaatggatttcttgagttagtactacgttcctgcttaaaacattgtctcagagaaacagtaaaacaatataaagaatgtggttcgtcgagcttgaggggagagctgaaaggcctgcctcactaatagcctggaaagtgcctcactaatgagctgaaaaaataggcacagagatttacagtgtttatgcagggatacaactactgagagacagctgaggtccacctgatgggtcttctgacttttctttaaagtccagggctccattccacttcacgtggcttgtattccagaatggttctgctgtctcagacatcccagccttcaggcagtgtggccacctgtcttagtgttttgattccgttttcccctcaactgctctttccagggctcctaatgggtttatgcctttttttcagaggctgacgctcttaaccttttcttggtactaggttaggataggtcttcttaaggtgatgtggttatggcatttattgtccttgtcctgaattattcctcaagatgcaggttagttacgaaacaaaccagttcttattgcttgtctgtatgtggaattttcctgtgagatttgccttttgg

SEQ ID NO: 46411 - DNA, 1052 bp, Homo sapiens
gcccgccggtctcctccctcctcctcctcccgtttgcccctcccccgccgctccggagcggagcctgcgagacggagaaactggggcagaagtgaagatggcggcggcagcttctcgctagtgacgcgcggtgcgggctcatctccttcccctccttcctcacctcccctagtccggaccccgtccgccgccgggaccagaccgtccccgtagcccgcagccagcagccgcccctctcctcccccggccgcccctctcccaacgcccgtctgccgctggccggcggcgcgcccctggtcccggccgcctgcctcgcactccgcgctgtcgccgggggagcgggtggcgtgtggattcgccctcctgcccgcccctccgggccgcggacacacgcccggcagggaggcggcggcggcccctgcgtatttgcttccctccatttggggactgggaggcggcggcggctgtgggttttggggaggggtagagggctggggggcgggcgagagcgggagggggccgccctcgagtggaggacgagaaggaaagcaccatgacgtccatccatttcgtggttcacccgctgccgggcaccgaggaccagctcaatgacaggtaatagggctggcgggtcggcgggcgcggggggaggggcgcccttccctccctcccctcccccacgggccgtgccgggcgggtgcgggtgtttacgcgccggccggccagctggggtggggtgcgggggtccttactgcctcctgctaggctccttccggggcaaacttctcatcccgggggcagggggccgcggggggagcgcggtgtagacgggactcgcggtgtagactggagagcgctctgtaaacccccttccccctcccgcaaggagcggcgttgaactcggcggagatgggggggtggtttctggctcccggggggcaggcggtaattactgcccggccaaggcccgaggaatccatattagtcaaagttgaattgagacagacaatgcggatgggggatggtggaggtaaaaagagagggaagaggag

SEQ ID NO: 46412 - DNA, 1050 bp, Homo sapiens
cttgagcctaggagattgaggctgcaatgagccaagatcacaccactgcaatccagccttagcaacagagtgagagcctctcaaagaaagagagagaaaggaaagaaagagaaatagagaaaggaaagaaagaggaaataaagaaagaaaaagaaaaagagaaaagaaaaaaagagagaaaggaagaaggaaggaagagagagagagagagagagagagagaggctgggcacggtggtgcacgcctgtaatcccagcaccttgggaggccgaggcgggcagatcccgaggtcaggagtttgagaccagcctggccaatatgttgaaaccccgtctctactaaaaatacaaaaattagccaggtgtggtggtatgcgcctgtaatcccagctactcaggaggctgaggcaggagaattgcttgaacctgggaagtgaaggttgcagtgagctgagatcgtgcaactgcactccagcctgggcgacagaggaaaactctgtctcaaaaaagaaaaaaaagaagaaagaaagaaggaaagaaagaaaaaagaaagagagagaagagaaatctactatgcaggtgcttttaggttttctccaagggtacctaaaagcagcagctgagggcgacagcttgtatttcttatgtctgcaatttagtgccttgtactgagtgctgcccactgcagggactaaatgttgatgaccatagaggacacctggcaaatctagatgacagctgacatctaataagcacttactatgtaccaggcatttttctaagctctttcaatgtgttgcctcatttaattctcaacaatagcctgtgatacaggatggttattatccccctttcacagatgagaacactaaggcccagagaggttaggtcactccacctagtaagtaggagaggtaggagaggtaggatttgaacccagcaatctcagcctgagactgagagctttaccacagggcttcctagtagatttagaaggtgagagatggaggaaacttgccagcccatgttcggggaaggcagggccctgctg

SEQ ID NO: 46413 - DNA, 1048 bp, Homo sapiens
gagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcatgttttactttggcttctatctgaaatagaggtaaaattttacatatcagctttatgtgtattaacaatcttgctttattagaaagaaaattgattctgctaaaaaatgctggaagttatatatagaacagtgaaattttggtaaagtccagtatatatgtgagcactgtttccaggacagccttttctagacacttcagttcactagcctcctaacaatttaaaacccggactaaatgaatagattgacaaattaagctagatttattccaagtaaatatgggcattaataccattaaatggaaatactgggttagagaagccacacattgcttaattccttttttcttctttttagagtatatattttagtttcctaacctgtcttggccttaagaagtcttctgaactctgctgaaatgaaaagcatcatctctttgttctttgaacactttagttaactgggtgacttaatattttggggagtaactttaaattcaaagatttacttaattattcaggcaatgcactagtatagggtggtggttaaaggtgtagaccttgcctccagtctgcttgactcaaatcctgcctctgccatttactgtctgtatgaacataggctagtcacctaacccttttgtgcttcggttttcccagatggaaaatcgtggtaaggccaggcacagtggtttatgctcgtaaatgccagcactttggaaggttgaggtgagaggattgcttgagctcaggagttcaagactagcc

SEQ ID NO: 46414 - DNA, 1474 bp, Homo sapiens
ctcaggaggcactctcatgaggcggaggttgcagtgagctgaaattgcgccactgcactccagcctgggcgacagagtgaaactccatctcagaaaaaaaagaaaaaaaaatttaaaaaatgcttcctatttttttccagttagagacctgctgggatgtaacaatgttagtaggaagaatgtttgcagtaaccatggaggtttagctagttagcacaatcaaagaaatttgaagacatttaaagccctgatatttttattgaaagacaatgatggcattgctattcaatttagtcttcctaggtggatttatggactgatggacttcatttgaaagtaatgtcgtctttcattacagagcccaaccaactcttgatgctacaacagagtcttaacttgctgcattttccaaaatcccatccttgtaagcttcatgctttaggccctaattgctagttttttctctatacaggattgtttttcattaggttcacttgattcatccgtcgctggatttgggagcactggcaacataatcaacacacttcctacaatcttcaggcttcacatgtgctgatgatgatgtaaaccaactctgccccaatcatctccccttctcttagggtcttactacatattgcaacagaagataatattggaggtgaagagggtaacatgaagtttggcactaccctgaagaactgtaggcatctcttggaatgtgctaaggaacttgatgtccaaataattggggttaagtgagtatttgttttaaacttttaaagctgtgaacattttatggtggtaacctgtctttctggttattgatttaagactttatttgcatgaaatctaagatgcaattttttctagtcttttaacacacatgtatgtgttttcttcttagtttaggcaaaacaacttaaatatgccttgtcccttttcatactgttttgtgactgtacctccttccccacaataaaaagaatagcaaataatattttgattcagttagtgcagagtaacttaaatcgccgccttttaaattggatgggaggggatttgctagaattcttaatgaaaataaaagtgtcagacttttttgtccttttaacgattactctgggggacttcaataaattagactttgctttagccttttaattttatatgtgaggaaaccgagactccaagaggttcaaatacttgataatagcctcagaactaattacaggcatagtaacactaagccctagatgttatttgccagcccattgctacttttactaaagtaaaaaggtcttgctttttcaaacactcacaaagatgtattgtgtatctttctttaattttattatttattttttgagatagtatctcattctgtctcccatgctggagtgcagtggcacgatcacggctcactgcagcctcaaactcctggctcaagcaatcttcctgccttggcctccca

SEQ ID NO: 46415 - DNA, 1057 bp, Homo sapiens
tggtattttgatttcttggatgcagatacttatttcactagctttctttactcttaaaatgggtaaaattatgtgtgttataggaacgcaaaacaagataataatacagattgggtctgcaactctgtaagtaaggtgaccatataggcttgtaatacattgtgtatatatgtgagttaccccttcaaattatattgacctttttgggtaaatgtattttaattcatgtatttgcttttttaaatgggcgttaaaggaaattaataatctgatgtttctgaaattgtaaaattgcgtaaattcctcactaaattaggcacttagcacactttcattgactcgtacattatgtctattgaaataatacagacttttatataacttatattttgacagtttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctggtaagtgccatttctcaaatacagtgtttgtcattttccaagctctgaaacgagtgctttttaatttccaagatggtaatctgatcagaagtacttggttcatatgctatctgatttaacttgaccttcctcccccacacccactccccttgagtagtgatccatttttctttccaatccacattattttaaaatcctccctatggccctttaccttctatgccttttagcatctggcacccacatatgttctgtttattctgttgatgtgatgccagccaaccttctaatcagtacatggcttcttactcatttttctcaattttcttttttttttttttttttggagacgagtctcacgctgtcgcccaggctggagtgcagtggcgtgatcttggctcacgtgcaaccctcgcctcctgggctcaagcagttctctctcagcctcctgaattagctagaat

SEQ ID NO: 46416 - DNA, 1338 bp, Homo sapiens
tttaattcgtgtctcttgctttaaagaaaagttaccttgcattatagttaatatttctactggtgtttcctcttagaaacttgagagactattgtcagtgagctgaatgattctgcaaaatcagggaaaagtagtctttagattaataatgtaggattcagaaagtctatagtgtctccctctttgtgggtaggagggaatgggagcagatagaagctaaagataatttattctgcaggttctggcagtcagaataactggcttttaactttattatgcccgggtacaatgcatattatgtcaaacaaatataacttctttaaatattcacatgtaatcttctcattttgcatgtctagtatttgatgctttgctataaagctacaggtccacaatccctttttcatagaattctgaaatccaaaaagtctttaaaaaaatttttttatagcttccttgatgtgaccttaactgatttgggaaaaaaaaaaaaaaacaaaaaaaacttgacctggatctgtgctgatttgaggctatttttgtctttacttatcccatttagtgttaatattcctaaattttgcttcagaaatattgtggttgcagggtgctgactcattctcctgaagaatattacataacatatgtaaagtatgtgtactacattatggttcaaaatctggagaattctgaattcacaaagatacctagtcccaaaggtttcttgactagaatttgtaaaattggcaagagaaaattccgcattccagaaatgtgttatccttacaaatcaataagagtttgctctattggacaccgaaatcctggggttaattttctgtagatcaacaatattatttgaaaaccattaaaaggagttaaaacagcttcatggaaattatttggcccatagcattgcaaagcatgtagctatatgaactctgcttgaactggtccactaggattcccgtgcaggtagtctgagatccagaattggcttcagagttaggttttaaatcaaccacctgaattttgatggaataaactaagtatctggaaattttggaagttgcttacataatccttttctttcataatttagaatgtgtgtatgatgtagtacgcaaacactgtaaaaatgtcttaacaaaatattttaaggtcaatatcaaagattaatgggcccctaattgtgaaaaagtttttgtgagccttttgagaaatcccctaggccaggtgaggtggctcacacctgtaatcccagcactttgggaggccaaggcgggcggattacatgaggtcaggagttcaagaccagcttggccaacatggtgaaac

SEQ ID NO: 46417 - DNA, 1083 bp, Homo sapiens
tgcagtgtttacatacaccattctaagtgaaaataatttatttttttccatactgccttttctccgcatttccatttaacaagtccttcttcatgcttttttatcctaactgtccggataaacattctatctatcctgtatgtaagtgcttataagaagtgcttatctatcctgtatgtgtttataagaagtgcttatcctatgcaccttttgggtcttgctgtgttgcccaggctggactcaaattcctgggctcaagcagtcctcctgccttaacctcctcagtagttgagactataggtgcatactgtcacatctggctcattttttcttttcttttctttttttggagacaggttctccctctgttgcctgggctggagtacagtggcacaatctcggctcactgcaacctccgcctcttgagttcaagcaattcttgtgcctcaggctcctgagtagctgggattacaggtgtgcaccgccatgcccagctgatttttgtatttttagtagaagatgggatttcactgtgttgaccagactgatcttgaactcctggcctcaagtgatccactggctcagagccactgcgcctagccctattttttgtatttaaataatgcctttcaaattctagagccttcattccctactagtatctttttgttaaatggaaatgttgtagggttctcactgaggaacattctggaatgtctgacgtttaatgtccataatgtttcacatcattgctcttgggttgcattaagcagcaaaatagctgtggatatatgtattgagaaaaagatgaataatgtcttacctagggtatctgatcctattccttaggataattgagaatgatctgtccccagcatgactcaactttttatttatttagaaaattacgttggtgttgaaagaatcagaatgttatggagtagtacattatttggaatctaatgtaagattattatcatcattgcatgtttgtaggagttctttcctcatcatccataaatgtcattcattgagcatgtgatcagcttctcctagatagatgaaacattttgcctccaccag

SEQ ID NO: 46418 - DNA, 1060 bp, Homo sapiens
aaaattcagtgagtgatctcccaaattggcgttcaagggaacaatgttctggaagatatttatagaaaagtcatttaaaaaaatgcgttccgtactcaaataagtttgggaaccactgaattaatcaaagtcaagcaggtttcttaataataggttttttgtttttttttggaaactgacgttttgatatgctttgtggttctctacaaaaagggaatacaaaactctgtgttcttagaacttaacttaccaccaaaacatttctgctgaggcatatctatgaataatatctgagttctgtgacacatggtttgggaaggatgagacgtggtgaactgatgcagatacagtgatgggagggcgcttcagtgctcttgtgagtaagagcatgtgtgttggtgctgggcagatgtgggtacaaatcctgtttctagcatctactggccacaggactttggagaaattacccaaactcactgagctttagtttccttattcataaaatgaagtgtatcaatttgaaacgtgtttggctccaagaatgaaaaaatctatcagaattacttagggggttatttttctgatataataagtccagggtcaggccatccatggccaatgcagctattcatggatgttttctgggtccaggctctttctgtatttctgctttatatatatatatatatatatatatataaagagagagaaggttaagtgagataatgtaagtaaagtgcttatataatgcctagcactagttagtgctcaataaacatcagttgttaatatgtataggcagccttggattcaatgtgatacaagtctgtaatttagagtacctggaaaggtgaaaaactgtatattcttcagccaataacaagtatctatcttttttattggggaggcttttgatagaagcagaccagactgtttgatgctactctctcttgcaaggctctggaatactggtagatagagaccctgtttgacagcagatgtcctagaaaccagacagtgaagaggaaggctggcatcctattgcaccagggaggaaccc

SEQ ID NO: 46419 - DNA, 1030 bp, Homo sapiens
tctctacaaaaaataaaaagattagctggtcatggtattgtgtgccgatacgcccagctacttgggagactgaggcaggaggattgcttgaatctaggagttggaggctgcagtgagctatgatcacaccactgccctccagcctgggtgacagaatgagaccctgtctctaaaaaacaaaaacaagaaacaaaggcaaaaaagtgcctttgaactcagctgtcataaggacaaaaggggattaaagtgaaagggccccaagggaatggtaaaaccagagttagcagcaagctgcactctggagaatgtgggtggggattagccgaagaagctgttcccttaagaagctccatgtagttttgatccatatgccctggttttgctttctaaaactatggatagcaagtccattcacttgtgcccttaatagtctttcttctgtttgaaagcagcacaccatcaaggggggcagttgtgaaatttgaagtcagtagatccaagttttgaaccttgaatccatcactactgctggattcattcattcattcattgaacaaatgtttatcaaagtcccactatattctcagccctgttcaagactacagggatttatcaataaataataataataaacatcccagccctcaaagggcttacaagttagtttgtcatgacaggcagtaaacaatagatatagtaaatgcattatgtaagtatgttcggtgataaattctatggaatacaatagaagatggaagaggaactaaaagtttagtggcagtatagaggaagccaattgtaattttgcatagagtggtcaggcttagtctcataagtaggtggcattgagcaaaggcttgaaggtagagaagtaagtaagctgtgcaggtatctatgagaagaccattccaggcagtgggtattccaatgcaaagcccctgaggcaagagaatgcccaggtctttccatcattctgttctgtcatcttcaatgggtcagttttaccctctggctttctccactcctgata

SEQ ID NO: 46420 - DNA, 1050 bp, Homo sapiens
tgttttcagttgatggacatttggattgtgttgacattttggctatcgtgaagagcgctgctatgaccattcatgttcaagattatgtttgtaccactgttttcagttcttctgggtacaatggctgtaccattttgtattcccactagcaatgtatcagaacttcattttctccatatcgttgctagcacttattttccattttttgtttataactatcttggtcgatgtaaagtggtatctcaatatagttttaacttgcactatcctaataactaatgatgttaagcatcttttcatgtgtctgtgggctcttcatatatcttctttggggaaatgcctgttcatttcttttgcacattttttgactaactagtttgtctttttgttgtcttaacagcctcgtaagctggccttcctctactctttatacctctaacttttgttttttaactcagctgttagaatgagtttttgttatataatgttattctacaccaaactgtcaatagctctccatggctctacaaataactcaggcattcatggcctccacagtatcttctcaacctcctttaccagatttgacttttttttttttttgcactgatgtacatttatttttcatatatatatatataattacactttaagttctggggtacgtgtgcagaacatgcagatttgttacataggtgtacacatgccatggtggtttgctgcacccatcaacccatcacctacattaggtatttctcctaatgttattattcctaccctagccccccaccccctgacaggccctggtgtgtgatgtttccttccctatgttcgtgtgttttcattgttcaactcccacttatgaatgagaagatgcagtatttggttttctgtttttgtgatagtttgctgagaatgatgatttccagcttcatccatctccctgcaaaggacatgaactcatcctttttcatggctgcatagtattccatggtgtatatgtgccacattttctttatctagtctatcattaatggacatttgggttgg

SEQ ID NO: 46421 - DNA, 1033 bp, Homo sapiens
aggtgaatgtgatctttattctagagcagggacacctttctttgactgcccttggacatcagaactccgggttctccagctttcggacttggacttaacaccagcacaccccccgccccaggttcccaggccttcggcctcaaactgaaaattacaccatgggcctccctggttctccagtttgcaaatggcctattgtgagacttctcagcctccgtaattgggtgagccaattcccctaataaatttcctctcatttattaagagatttataggtatataggcatacctttgagatctctgagatatttttatagttcagttccagaccactgcaaccaaatgaatatcacaataaaatgagtcgtgaagtttttgatttcccagtgtatataaaaattatgttgacattatactgtagcctatcaagtgtacaatagcattatgtctagaaataccttgtacatagcttaatttaaaaatactttattgctaaaaaattctgacaatcatctcagccttcagtgagttgcaatctttttgctggtggaggatcttgcctcatgatggctgctgactgatcaggttggtggttgctgaaggttggggtggctgtggcaattttttaaaataagataacaatggagtttaccacatcgattgactcttgctttgagggaagatttctctgtagcttgtggtggtgtttgatagcattttactcacggtagaactttgtttgaaactggagtcgatcctttccatccctgctgctgctttatcaactaagtttatgtaatataccaaatcctttgttgtcatttcacaatattgacagcatcttcaccaggagtagattccatctcaaggaaccacttttttaaaatttttaatttttagtggtacctagtagatatatatttatggggtacatgagacattttgatacaggcataccacatgtaataatcacattagggtaaatggggcatccgtcacctcaagcatgtatttctttgtgtcacgaacattc

SEQ ID NO: 46422 - DNA, 1035 bp, Homo sapiens
tgtttccatatatgaaagagatgtttgttcttcagtatgagactagttaaattattataggcagacatcaccatatttccctttaattctaaaggaacagaggagaacatttaggatgtttaaatttaattcaattcaagaaatatttaatgagcacctaagtgacaaatttctaggccgtattccatattattggcattaaggaaataaagttttatatttgtatgtgctgtatttaatgttggctagcatttatccaagctatgaggttttttaatgcctacattaggtcaattaaaactcctgcttgtacatacatttaaaagcatttgaaagatagctaattgaaagcactttttagttcagttttgaggtgtccctaccctctcttactcagtccatccataaaaggaatgtaaatccctacagatggcttataaactacattactttaggacattgaaaacatgaacttaaatcagagtaaggtttgactgctgcttgctccatgccttgtgtcagttagaacttccgtgttttcaagctagctctatacaaaattaagcattatctatttttccctctaaaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttcttgctttttgccttccccatatatatggaacttggctacctctgcctgaaatggctgccatcaacacaatgttaaaactgacacgaaggatagagtttcacagatttctacgttttattggtggaagctgatttgcaacatttgctaa

SEQ ID NO: 46423 - DNA, 1098 bp, Homo sapiens
accacgcctggctgttatatggaatttcttagcagaaattattatgattactctgtgcagatttcaagaattttactcatgacaaagtggtaaagtttagaaaagttatgaatccctaatggtttaaaatgatttggtatagtgtttctttaaagtataattttaattttcaaattatacaatttagtagccttgtttaatcgcctcacttatgtatactatccagaaggaaaaaacagtaagagccgtaagtctttgtaactcctactttaataccttgatttcttaatgttgattagtcaaaacctaacttaatcatttttgaacacatagccactagcaaaaacctgagtcataacaggaccaaatatttgttgaataaaggactacttaggaaacctggcaaatgagaaacttaaccagatgaattttttaataaaattgtcactctataaaggatgtaaaatgtgacttactgtattacataattatttaatttttgaggggtagtagttactttggatttgaggaagattgtgataaagttggggtagatatatgtgtcacatgcacagattattggggtgccagattcctggttcttttcgcctatcttcaacccctctgggattataccatgtgctacacctaaggtctgtatctgcttaccatctgttctctgcaccaggccacgttgtttaggagtcaagacatttttgctatccttacacttcaaagagaaagcatttcacatttccatctcccttttaatttacctctagctaactgcatgaggaactttttatgactaccaaaaacaatgtctaccttttgaccctaagactgtgcctcagaaactacatttcacagtttcagatatggtcctgtgcattatctttttttttttttttttttttacataaatgtactgtttctaatttgggttgtcataagtgcgaaagtatctgtatgctgaataatcttattgaaatctcattttaggagccatgaccctctgcattacaaacccattatgggtaacaaaaactcgccttatgttacagtatgatgctgttgttaactccccacaccgacaat

SEQ ID NO: 46424 - DNA, 1051 bp, Homo sapiens
tttaggaggccaaggtgggaggatcacatgagtctgggagttcaggaccagcctgggcaacatagtgagacctccatctcttcaaaaaatttaaaaaagaattagtctggcatcatgatgctgcatgcctgtagtcttagctaattaggaggctgaggcaggaggattgcttgagcctagaaattcaaggttacagtgagctatgattgtgtcactgcactccagcctgggtgatagagtgagactctgtctctgaaataaaaaaaaaaagaaagaatgtgttcacttgacatcgtcatccaagagaaaagtagaaatcggcattaaaggaaataggctgatttgactcccttactctgaaacatttaatggatattttctaccaaataaaatgcaaatctcaatctaccactcaagtgtggccaattttccctgtcttcccacccacccttattacttttcaccatgctcatctttttccttgttgaaactgtgcctgtctcaatacccagctcaatactacctcctacacaaagccttctgtgatctcagtcataattcctgaatttcttctattgtctgtgttgtcttttattatgatttatttgtgtgccacttaatagtccttattaatttgttaagaaaaattcatcacttgtttatctttttatcatctattagaaagctaactatagtacctgaacgtaggtgctcagtatatatttgttaggtaccccttctttggtcccttttgtcttttatggccagtctgtgtaccactactgtactctcccctcctcccagtttccttgtcttttgaagttaattgatgagtgtctgattaaaatattttacatttgtattgctagccgtattcatttgagagggaggggtggtataatcttgcagcaaaccacttccagcaaattcattcttgaaaaaggtctcattttgtggttgcattatgcattgacttgtgcttttggggtactgctgttgacttacatacactttaaaacagacttaatgacacctattcaaattaaactgc

SEQ ID NO: 46425 - DNA, 1365 bp, Homo sapiens
ttacctctataagtacctgttatacaatggtttgaacattggaagaattttagacttgcctgcaggtgcaggcctgtatgacttgctgtctgtcttcagtagcattttatctaggagcagaagaggtgatagtcgaggtgatcattgaagaatagtgtggttggcctgatgagtttagacagtgctttgaagcatatcattcctgaggaaagggaattcttggtacctgagaagattaatagtcttgatgaattgggaagagtattaggagactagtggggctgaggtgacagataaaaggattgagtttggattggaggcctaaattaaagatccaggagtggaagcaggactttgtaataataaagctcacagtgtagctgtgaaatggtgataggaggaaaacttaagaagatgaataacgaaataaaaatttattgattatcaacatcagtgctgagtaacatactataatttttatgcttccatgtaattaaactcatttaataaagttaaaatctaatgatgacagggtgtgggggttaattctgaatgcatgtgctattaaaccaaacctggaatttttctgtgagttcaagtataaattggaactcagaggtgtccagagtggtagaaagattagaaattacttcatatgaaaaatgactggaggaactagtttagctcgggagagaaaaaaacctcaagatatttagagaacttacatgtgggaaagggggctgccttattgtgggttgatcctaaggtcagacacaggttgagtggaaattacaaggaagcagattttggtttggcaatgtggcagtgctcagaaatgaaattgatgatgatcagaagtggttcagatagtagttggatgacagaagttagaagatattcttgtattaggtggaaagattggattggatgattattcaggccccttctaactttactctgtaattttaaaccctcaagaatgatgagagagccccaacaaagaatgagatgtaaaaatagtaattttctcaaatacccaaaagcctaatctgcaagttaaagttgtgtgtgagcttttgtgaagaatgtagagactatgactacatccaaaatattaaggaaccaaaacgtaaaattcagtaacagtagtgccgagtaaagttgtgtaagtatgtggtatcgcaagacccagtagcataaataaactagtacttacagagtgcttgcaatatgtcaggcataattctaagagctttatatgtactaactgatttaatcctttataatttttagagttaggttctattattttttcctatcttacagaaaaactcaggcacagagcaatcaagtgacttactcagg

SEQ ID NO: 46426 - DNA, 1055 bp, Homo sapiens
catatactcatccctctctctccctttcttccacgtgttttccctagactgtcataccaatatacctactgtgcttatagatagcacttgtcacagtgtgttgtggccatttatttccttgtctgtctcgactggaccatgaattctttaagatcaagtaatgtgccttcaacttcagtttccccagggcttatcagagcgtctcatacattatagagactcaataaatgtatactgaaaaaatatatgagcagtcacaaaataatgagaaaattacagttgttagagtatgaagaaagggaggcaaagagttgtagcaaaagataaagctggagaaattggttgttataagattatgctacaatcctatatgctgtgctgaagaatttgaacttatatcattagacagtggaggttttttagtgagagaactgacatgatcagctttgattttcaggaggatatcctgccttcagttcttcacccatgtctaaaatgcctactagtagaatactcaatggacacagatgcataatggtttgggcctggagacacaaataacagaattttttgcttcctgctttcagaatttatttttgtagctattttgctcagtagattataacagcatgataatgaggccaaggtcatggtttaaatccctgagtgagtcagtcagtgcagtggccacagctgactgttaatctttgccagttgtcagatgacaacatgttatttcttgaccaggaattgggtgagagactatgactggttcatccaaagttaatcaccattattgtagaagcaactcaaagtacatggctattggttataggactataatttcattttaatgaaaataatagtattatattagtgatgaccaaagagcacaacctcagagagaaacatacattgtttgttcctggagaagaagctagagattagtaaaatttaattattggaattcaaggccaaaaaataatgaaaaacttaatggatgttagtgtaggtaagcattattaattactttttgtgtatttagcaatatagga

SEQ ID NO: 46427 - DNA, 1046 bp, Homo sapiens
tccagcttggcagacagagcaggactccatctcaaaaataaataaataaataaacaaacaaatagagttgcagaaaataccattcatcttcctttagtcaaaaacatagggctgagtatggtggctcacgcctgtaatcccagcactttgggaggccaaggcaggtagatcacctgaggtcaggagttccagaccagcctgaccaacatggagaaaccccgtctctactaaaaatacaaaattagccgggcgtggtggcgcatgcctgtaatcccagctactcgggagactgaggcaggagaatcacttgaacccatgaggcagaggttgcggtgagccgagatcgcgccactgcactccagcctgggcaacaagagcaaaactccatctcaaaaaaaaaaaaaaaaaaaaaaacccataacatagtgagtgtggtggttgtaggtaccattgacattaaaatttgatcaaagtaacttactttggcagttaacctctctgagacatagcttgtacatctgtaagattgaggtaatatttcctacctcatggagttcctgtagtgataaaatcatatatgcaagggctttatagtccagtgccaagcatattcaaattcaataactgactattccataaacaatgatgggggggaatcccacatgccaggcattgttctgatgagtactactcttgacttcaagctccagagccctgcttgagagcacctctccctggctctccgcaccacatgcttccctaagaggcaaggaatccacagggttatggagaaatgagtgctgctctttctcgctccacttctagaccacactcttggtacccagaatcctagattttcccatccaagtggcctaagtctacatgcaggacctccctcgtgtcttcctgggatctatcttcctggggctggatggaactgctagcatgaatatcccaggccccaggggagtgaggagcttggatggactgtggctaggcaggctgcggtgtccacaagcacgagcataaggcctctcatggtgcag

SEQ ID NO: 46428 - DNA, 1094 bp, Homo sapiens
ataggtaagagaatttaatttttccttcttagacccaaaagcaacaatgagtaacagaatttttaaccacaacacattcttaatagaagggtgtttttttttttttttatcttagtaccttgttgttaactatcttaagatcttttcttatttttgtaggcttctgttttggaaaatctgaggctagcggtacgatctcagcttggatttacttcagtcaggcttcctatggcaggcagatcaagcaacatttggaaccgtatttttaattttgcaagatcacgtcattctgggtcattggctttggtctcagcagatggagatgaggttgtccctagtcagagtaccagtagagaacctgagagaaatcatactcacagaagtttgttttccgtggagtctgatgatacagacacagaaaatgagagaagagatatggcaggagcatctggtggggttgcagctcctttgcctcaaaaagtccctcccacaacggcagtagaagcgacagtaggagcatgtgcaagttcctcaactcagagtacccgaggtggtcatgcagataatggaagggatgtgacaagtgtggaacccccaagtgtgagtccagcacgtcaccagcttacaagtgcactcagtcgtatgactcaggggctacgctgggtacgttttacattaggacgatcaagttccctaagtcagaaccagagtcctttgagacaacttgataatggggtaagtggaagagaagatgatgatgatgttgaaatgctaattccaatttctgatggatcttcagactttgatgtgaatgactgctccagacctcttcttgatcttgcctcagatcaaggacaagggcttagacaaccatataatgcaacaaatcctggagtaaggccaagtaatcgagatggcccctgtgagcgctgtggtattgtccacactgcccagataccagacacttgcttagaagtaacactgaaaaacgaaacgagtgatgatgaggctttgttactttgttaggtacgaatcacataagggagattgtatacaagttggagcaatatccatttattattttgtaactttac

SEQ ID NO: 46429 - DNA, 1035 bp, Homo sapiens
gaattgtactgctataaatatgcatgtgcaagtatctttttcatatgacttcttttcctctgggtagatacctagtagtgggattgctgtatcaaatggtagatctacttgtagttctttaagtaatctccacacagttttccatagtgcttgtactagtttacattcccactggcaatgtaaaagtgttccctgttcaccacattccatgccaatatctgttattttatgatttcttgattatggccactcttgcaggagtaaggtggtactgcattgtggttttgatttgcatttccctgatcattagtgatgttgagcatttttttcatgtttattggccatttgtatatcttctttaaagaattgtttattcatgtccttagcagacttttcaataggattatttgtttttttttttcttactgctctgagttccttgtagattctagatattagtcctttgttggatgcatagttagggaagattttgtcccactctgtgggttgtctgtttactctgctgattatttcttttgctttgcagaagctttttagtttaattaagtcccatctatttgtctttgtttttgtggcatttgcttttgggttctttgccatgaagtctttgcctaagccagtgtctggaagggtttttcaaatgttatcttctagaatttttatggtttcaggtcttagatttaagtccttgatccatgttgagttgatttttgcataaaatgaaagatgaggatccagtttcattcttctacatgtgacctcccaattatcccagcatcatttgttgaatagagtgtgctttccccacttcatacatgtttttgtttgctttgtcaaagatcaattgactgtaagtgttgggctttatttctgggttctctattgtgttccattggtctacgtgcctttttgtttgtttgtttctgtttttttttgtttgtttgtttttgatgaagtcttactctgtcacacaagctggagtgcagtggtgtgatctcaattcactgcagcctt

SEQ ID NO: 46430 - DNA, 1030 bp, Homo sapiens
cgtgttggcaaggctggcctcaaactcctgacctcaagtgatctgcccgcctcggcctcccaaagtgctggaattacaggtgtgagccactgcacccagcctaattttcttttttttttcataatgatagttttgtttttttagttagctatgcggtgctgatttgtgtctttcttatctcccctgattactccctccctgccctgtcccctactctcatccctacacctgagaatataagaattgtaggtcctttcctcagaaagtaatgcccctgcgcacattcacagaaaattttgtacataatgcgcgattctagaatgtctaaaagctcatttatgacctctagatccttgcttttcaaagtgctcttatagaaacagctacattggtcctgtctggtagctggttagaaatgctgaatctcagggcctgtgccagataccaaattggaatcttcattttaacagatcccttgtgatttatttgatattcaggtttgagaagcattgctgtaggaggttagaaacttctgtgatgtatgtgatatatattcttttcctgttgtgttaccttttacatatctggagtatcatctacagcacttttaaaaaaaaatcatgacttgatcaccaaaattgtaaagtagaaatattttgaagtagttacaatatagtatagtatctgaatagcaagctatgctatatgaagtagcaggaggcaagcagggactgatgtatacactcattcttgtaacaatagcaaacagttacatagtagttactatgagccaggcagcattctaatcattgtgtttttgtttatgtatatgtgtttgtatatatgtgtcttagtccatttggagcactgtaacaaaataccatagactgagtggcttataaagaatagaaatttctcacagttctggcggctgggaagtccagcatcgaggcactggcagatttgatgtctggtaagggctcactttctgattcatagacaatgtctttttgctgtgtcctcacatggc

SEQ ID NO: 46431 - DNA, 1040 bp, Homo sapiens
tcgcaggactccacagttattgaggaatccaaagaatggtttttgtataggagctatatatgtttttaagaatattaggaattaaaattgagtaattattaaaacattaattcgtttaaaatgacaataagaaacctattacatattaccgtaaataacatgttaaataaaaatatgtaagatgacaactatattttccaacagaaacaaaaattttttgagaatagtggcattgtcttagtttttgcaattaccatagggtcagatttatatgtaaaacatatttagtataatgccagacaatacttgttgaataaatgaattcatctatctataaatggagtaaattacatttatgtgattcctaatgttgaatcatttttgcattcattcatagggcataccaccttgctaatgatatattttaatctgctagaatacatttactgataatttttatactttgcatttatatttatgacatcagtccatagtcagtcttagctttcttctgccctctacctctttttttccttcctgtaacctaacctccctcttcttctgcttgattttcatatctgttaatccattcttttagatgcacttacgatcttttttttgttgagttcagtgtttagaagtagtataaaagattctagtgttccagttattattattttgccttttaagattagaaaaagagaagtaagtgattgtttatgaactatataggtactgtaacaggaaagcaaaaattaaaaattttgtactaataaatgccgaggggagaaatgttttcattcctagtatgtttagactttatttcactaaccaagataatacagatgagcctgtaagaagtagatcccttcttacgcatcagctataggattaagtaagccagtaagagacctcagtggagatagatcagttccattagaagtggaactcacatctgaaggcaggagctgtgtgggaggtaaaatggagatgctaaatgaggactgagctcaagtcagggggtaggactcctgtattct

SEQ ID NO: 46432 - DNA, 1052 bp, Homo sapiens
tgttcaaggacctgtaattatctttcaggggctactgtatcttaaccgcattcaatgtgcctaagagttaggagagagtaaaggttgacctctgccacctttgaaagtttgaagggataaaaatatcagtggtgacaaccacaagctttgctacgcattgtcctaggcttactgtaagaggaaaaagtgctttgtcatttttcacatagggatgtctcgcttttacaaatctatgggagtttccaaaacctctgtctcctagtcaatagaagctgttagtcttgctcacctcctaaaccacaatttggtaattctgacagttccgttgctttatcctttccacttctgtttgtctcccagattagtgtttcctaacttttactcaaacccacccttaaaatacacattgcttcgggtactatgtacatagagaaaaaagttaatgaaatcgtactcttaactacctgtgcactcagatgttttctatttattcctcctctttctcacccttcccttcttcatttgctggtctggactcattaaataaattttggatccactaataaattgcagtccttagcttgaaaaacactacccaagatgaagccttaaaatatagtttagaggccaggcgtggtgactcaagcctgtaatcccagcactttgggaggctgaggcgggtgagtctcctgaagtcaggagtttgagaccagcctggccaacatggcgaaaccccgtctctattaaaaatacaaaaattagccaggtgtgctggtacatgcctgtaatcccagctactcaggaggctgaggcaggagaatcacttgaaccaggaaggtggaggttacagtgagccaagattgcacgattgtattctagcctgggtgacgagtgaaactctgtctcaaaaaataaataaataaataaatgtaatttagaatgtttcttgtttgtatatcattttacaataaacttcaagagttgcagatggttaatttttggttacttgctgccagagcatttgatagtcgtagaactgttcacagcatata

SEQ ID NO: 46433 - DNA, 1058 bp, Homo sapiens
gagcagcctaactgggacgcaccccccagtaggggcagactgacacctcacacagccagatactcctctgagacaaaacttccagaggaacgatgagacagcagcattcacggttcatgaaaaaccactgttctgcagacaccgctgctgctacctaggcaaacagcatctggagtggacctctagcaaactccaacagacctgcagctgagggtcctgtctgtttgttagaaggaaaactaacaaacagaaaggacatccacaccaaaaacccatctgtacatcaccatcatcaaagaccaaaagtagataaaaccacaaagatggggaaaaaacaaagcagaaaaactggaaactctaaaaagcagagcacctctcctcctccaaaggatcacagttcctcaccagcaatggaacaaagctggacggagaaggacttcgacgagttgagagaagaaggcttcagacaatcaaactacgagctacaggaggaaattaaaaccaaaggcaaagaagttaaaatctttgaaaaaaatttagacgaatgtataactagaataaccaatacagagaagtgcttaaaggagctgttggagctgaaagccaaggctcgagaactacgtgaagaatgcagaagcctcaggagccgatgtgatcaactagaagaaagggtatcagcgatggaagatgaaatgaagcgagaagggaagtttagagaaaaaagaataaaaagaaacaaacaaagcctccaagaaatatgggactatgtgaaaagaccaaatctacgtctgattggtgtatctgaaagtgatggggagaatggaaccaagttggaaaacactctgcaggatattatccaggagaacttccccaatctagcaaggcaggccaacattcagattcaggaaatacagagaacaccacaaagattctccttgagaagagcaactccaagacacataattatcagattcaccaaagttgaaatgaaggaaaaaatgttaagggcagccagagagaaaggacgggttacccacaaagggaagcccatcagacta

SEQ ID NO: 46434 - DNA, 1028 bp, Homo sapiens
gaaagctggtcggctccttttgctttctttattgctccagggtaaaggcattgtggaagaaacaaatgtctgttttcttcttttgtagcaatgagctgagcagcttcactaaagaccttcaagccttgcagggttgctaggtgggatgaaaataagtttccattgggggaaggctgcttcaaattcccatttttctcacattttattatgcttctttcgtagctgacatcagggctgtttcgttcgctttctggattcggaaacactttgccgtccagttgacccaggtcattacgctgatgtgcagtaaccgggcagaaattctgcttgtgggccagatagttttctaccttattgaaactgatcttgcacacagtgcactcgtgatagtccagcagccttttgggagacgtggtcgtccgctcagactgagataaacactttttgctgagatctatgggcacgtccatctctaggcaggaaacactggaatgagtagtatcacatttggaaactggaacacacttgttgatcgtcagagaagtttccaagtgtttagagacaattcctggaaagatatcacatcttgggtggtagcactctcctagcccttctgtgggttcttgagtggaggtacaaggattattgaggttggctacgtcaagaaatctctgctgaaccagtggaggcctttgttcctgctcaggtaggcacatctcatacatctttctgcgcttgcgtgtgcgcatggttctctgcatggcaggcactttgttggaagcagacctcttcagtggagggtcgtggcgtgtagcacagtaatactgtttgtggaccatgtatgtttcgtgccggctgaaggtaatgttgcaagcttcacaggtagtcttatttgggtcactttccccatccactaaggggacactgggatttttcacatcaacaggttttccattaattttgtcatcattgttactggaggtggagagcttcttagtttgagtggaaaagtccttgtcatggccctt

SEQ ID NO: 46435 - DNA, 1036 bp, Homo sapiens
aacacctattagcataaacaccatccaggaaaacataacctcaccgagtgaactaaataaggcaccagggaccaattctggaaacagagatatgtgaactttcagacagagaattcaaaataactgtgttgaggaaactcaaagaaattcaagataacacagagaaagaattcagaattctatcagattaacttaatagagattgaaattaaaaaaaaattacaccaaaattccagagctgaaaatgcaattggcatactgaagaatgtgtcagagtcttttagtagcagaattgatcaaggaaatgaaaaaaaaaggacttaaaacaatgcagcactcctatacgacgtacaaaatagcctcaaaagaccagatctaagagttcttggccttaaagaggagttagagaaagagataagggtagaaatttattcaaagggataataacagagaacttcccaatcctagaggaagatatcaatatttaaatacaggaatgttatagaacaccaagaagatttgatccaaagaagactacctcacagcatttaataattaaactcctaaaggtcaacaataaagaaagaatcctaaaagcaacaataggaaagaaacaacatacaatggtactccaatacctctggcagcagactcttccatggaaaccttagatgccaggagagagtgacatgacatatttaaagtgctgaaggaaaaaatgtataccccagaatggtacatctggtgaaaatatccttcaaacatgaaggagaaataaagactttcccaaacaaacaaaattgactgattttattaacatcagacctgtcctacaagaaacactaaagggagtacttcagtcagaaggaaaaggacattaatgagcaaaaagtaatcacctgagtgtacaaaactcgctggtaatattaaatacacaggaaaactattattatataattatatattttatatattattaaactattataacactgtaactgttgtgtgtaaactactcttatcctaactagaatga

SEQ ID NO: 46436 - DNA, 1031 bp, Homo sapiens
cttctaacagatagtatcaatggattttgaactttcatacacagacctcttttcaaatcttgtaaaattatgtctctttcctccagaaacatgtatgggatcacaggctcaaaataaatattagagtattctttatataaggattaaggatgctgcctaattgtaacgattgtataatagtttggaacttgttttcaaattattgaaagtttcattttactccacacctgccattttagatcatacattctgacatgtaaccatttaatatgatatattgtttctgtctcccatgccttctctccttcttatcttaaccacgtccttgctattccaagaataagaaaattttcagattcaagtcatctggctggagcgctgtagaatttccccctcggatattcttaaaaagtctgtctcttaggggttgctgacatcaaaattgaaagatttgaaattgacctcttattcatttgcctttcttttctttgacctgaatgtaggtatgtgtcaatttagaatggaacctgatgggtaataagcagctttgcgtgcatgtaccagacatgttctataaatatggctcctataaatggtagttatttattctgagaaaccagccatccaataatgtagatgtgcattatttctgagctgacatgctgaatttccctggagtttgacaaaatgaaaacaggttacatttgctcctcaaatcctagcaatggttaaaaactgcattttcatgcaaacataaattacaaatggaattttgataactgattaccccccaaaatgcacacaaaccctttgtaatcctgccctggagtgcagtatagttggctcattgcatatgctgacagtgtttgtcaggctgttcaatcactgctacttcccatggcaaactgtacaggggcgtttagaaaaccagtatgtctctatttccctaaatctactattagggagtagaatcgtcagtgcagagcactgctgcttcacaataggtataatcctgagtgtgtatcttcttt

SEQ ID NO: 46437 - DNA, 1069 bp, Homo sapiens
tctttttcctataaattgccaagcttatacttttttaagaatggtcaattttttttagaaaggtgtttaattatctttttttatatttgtaagatctaaataaatagtatgacagtagatataagaataagtgacatagtcagtaactgttgtctcacatatataacctctaaatttctttttttttttttcactttgtataatccacctctcctctttggtggggattggcctgagtttcaggagtgaggtatcttttactcagtggtagatataactgaaacaaaaaaaggtaaaaagaagaggaagaaaaccgatgaaatagggaaaagtaatgaaagaaaaaaattgacttggaggaattctagaaacacattttgacttttaccttctaaaccagtggatggttgagcagatatgcaggcatctaaagaagccagaggagtggtaattattcctggattctctgcagacaattcagtccatgaatatcaataacttttttaaaaactttagctgatatggcttggctgtgtctccacccaaaatctcctcttgaattttaattcccataacccccacatgtcaagggcaggatgaggtggaagtaatcagatcatgggggtggtttcccccatgctgttctcatgatagtgagtaagtctcatgggatctgatggttttgtaagcatctggcatttcccctacttgcactcactccatcctgccaccctgtgaagaggtgcctgtttctcttttgccttctgtcatgattgtaagtttgtggaggcctccccagcaatgcagaaccgtgagtcaattaaacctctttcatttataaattacccaatcttgggtatttcttcatagcagtgtgagaacgaactaatacatgggcatttatatatttctgtactattcatctatattgaccactacttttggttcttttagacaatactgtttctatggaggcatgcatcctcaccacctgtatgtgaaactgcactttaagaattgtctgttttgctctttgaattatccttattacagtctaatatttgggagc

SEQ ID NO: 46438 - DNA, 1030 bp, Homo sapiens
ttttattttatactttcttctaaatgttttaatgtgttcagcatttcctttaggttcacaatatatttgggtttttttacatatcttatgacatatggtgaaaaattcatttttatgtgaatatccaattattttagcaacatttatagaaaagacaatcctgtctgcctatatgatctttgttacatttcttgaaatcatttgtccatatgtttgtggctctattttctggactcttgattgtatctgatttatcaatttgcttatatttatactaatattactttaattactgtaactttatactaaaacttaaatcagatagtcttagttctccaactttgtttttctttatcagagttgttttactttttgtatattctttgctcttccacatacgttttagaatcagtttactaagttgctacaaaaagaccttctgggacttttattgggattaaatttggtttatagatcaagttggaaataattacaatttaataatgttgcatcttttgactcacaaatactacatatttttttaactatttggttaggttttctttaattactctcaatgttttcttgttttcagcatacaggggtagcacaactttgtcagattttatcctcaggcgtttcatttttgatgctatttaaattagtattgtctatttaatttaattcctgattgttcattgctaggatataaaaatataattatttcatatactgatttcatatcctgcaagctgctaaaatacctatcagttctagtaggttttggtagattccattggattttctatttagatggttaggttgtctatgaataacaacagttttatttcttccttttgtttttttgagtcaggatcttgctctgttgcccaggttagagtacaagagcataatcatggctcactacagccttgacctccagggcacaggtgatcctctcaccttagtctcctgagtagctgagatcatagacatgcagcaccacatccggctaattttttgtattttt

SEQ ID NO: 46439 - DNA, 1030 bp, Homo sapiens
tttttaaataatacaattttcatggactctttacataaagtcttagctcacataaactgtttcatacaatcaagtgtgaaaaagccagcagtcctccctggaatacaattcccagattgaactgattaatctcaataagaagggagtaattaatgagtctgatagtatcctgcttgcttaataatgttaataacttgaatgtggcctaatcttaatgtgtgttgaatttttactttcatttgtgaattataataaaaaacagggcaaaatcacactgaattctaaaaattacattgaaaaaatgttctatacattcatcctctaagagaaaattaagaattaacaaacatttctttaacagagtataagaagaacatgtaaaaaaatttatacaataggacttcaagttaacttttaaaagagtcaataaatccaataaaatctttatttgcttgtttgtgctgttcaaatgttttttttcaaaattccatgtagctctggtcctctcttggaaggatttttgaattatgtatatgagataattgtctcaagacacccaatagattacattaattttaaaaccaaaataattgccatttatctctgcatcttcacaatcactgtgataccacagtaaaatacaatttgtgtgtgggtgtgtgtgtgtgtctgtgtgactgtgtgtgtgtgtgtgtgtgattagttggttagttagctactgttggttcaattggttttgtttagtaaatggatagaggacagaatgaataaagttatttcatggtgtctcatgttttagttaagagaatgaattatctgtgctcatatatatatatatatatatatatatatatatagcacctgtggaaaaagtctcatatctatatgagctctggttcatgcatcgttcactttcattgctacaaagcaccttgtgacattatattagcacttaccagtttcacatatcataacatatagtgggattagcagactgtaaaaagaagtgacaagttgctggtcaaacctg

SEQ ID NO: 46440 - DNA, 1047 bp, Homo sapiens
ttcactgtccattcatgcatgcaggtagacaggtgatgtttggaaagtatcacagctgcagtctggcagaaagaacatgattgattccctctgctttcctctgctgagggagtatgcagcttttcatttcattttagagacaaatggtctgcacgggaaggaagcacatgggtagctgtgtctttgttcatttcgctaacaaggccagagctgtgggtccatctctgcataagccagttagtgtttctctgctcctaaccacagatttgcacttgaacctttgccagctgtttcccaagtgcatgccattggatgtgagggagacctgaaatgagtgcagatagattagcttaaaatcatcacaactttttcaaacaaaacaaagcataaagcatgaagcccttaatggcagatcagaagttttatctttgtgtattcaaaggtcaaaacctttataccacatgtgctgctgtcagagtatatgctatatgataggaacaaaacttaagaagctgtgaccaacttgaatattgaaacttttgttatcatttttatctaaaaaaattaaatttttggtggcaagttagtgtaaccagtcctagaaaatagtggttggaatgaggatgatctcattgattcagaaatcatcaagaggtctacaaaaccagtatgcctcctgttttaatagaggacataactagagaaatgttcttagttgtctagctcccttgccctgggatttgtgcctagttctttgaggatttgtaggactcagatttctctaacaatcaataatcctttttattttctttatattttcacttttagataacatccatctatgatcatttatatgattttaagtgagtttgagaacaaccttgtaatgtaaataaggtattagtcttgaagtttacctggttggttatttggcaataaccatttttatctgaccattagtgacttaaacaactctgagaagaataattgacaataaagtggaaaaaaaaagcatagtcctatactaacaaaattaattctaagaca

SEQ ID NO: 46441 - DNA, 1028 bp, Homo sapiens
ctcggctgagaaggaaggaaacaagacttcatgtttccttcaccagtaaccaaagggccaaaagttcctacatggagacatcattaatcaccgtttaagactgtagctcaaccaagccacattaatagctaacgaagatttctggatgattacatagctcagcagctaaaaacaattattaaatatgccctagtggactagtaaaagccccagataggaaaaataggaagccaataataagtatttaccatgtgtcataggaagccagtagtaagtatttaccatgtgtcaggcatttttatgtcctctgtttctctaaataaactaacctaaggagaaagaagggaatcttaacatttgaatgccttgcttaagcctggaaatactaaaatttaggtggtattatttatatgttattgatgaggaagcatactcacatggttgcctaaggcaggagtccgcagcccctgggctgtggactggtaccagtctgtggcagcattcgattcttataggactgtgaaccctagtgtgaactaagcatgagagggatctaggttgcgcactccttaagagaatctaatgtggcctaccccccatccgtggaaaacttgtcttccacgaaaccggtgcctggtgccaaaacgattggggactgctggcttaaggtaatacctaatacaagttaaagtaaggaaaagactcttaagttatgtcacactaaccttccttacatcattcattgttgccttataattagaaattgcaaagagttaagggatacatatttagtaggttgtgcgaacaggtcttgatcaccaaactaggtttctcagcaccattatcttccaataagagcaaagggtactctatttttctacgggtataatcattggatacaagtggccccttacacacaaaacctgttggaacatagaaaactctgaagaacatctctttgatttttcttttttctatttatgctctgctccttcaagactatctgctatatgaataattaatgctca

SEQ ID NO: 46442 - DNA, 1050 bp, Homo sapiens
tagaagattaacaacaacaataataaatagaacaattataacaatatgccagcatcactactcttgtactttggggccattactaagtaaaaaatggttccttgaacataagctctgtgatatcaagacacttgatagctggaatagctactatgtaactgatgggcgggtagcgtatacagtgtcgatatgctggacaaagggatgattcaagtcctaggtgagacagtaggacaatacaagatgtcatcatgctagccagaacagtttacaatttaaagcttatcaattgtttatttctggagttttctatttaatattttcagactgggattgactgctgataacagaaaccacagaaagtggaactacggataagtgggaactactgtagttgggttgtagaactaacctggcagatgtgtaagatagattgtagagactcaagaggtaaagtagttagaaaactaagaaatagtaatggagcctggactagggtagtgactagaataagaatcaatcagacagtaaatatttatcgtctcctgtgtatgaggagtcatgctgctaattgctggacataacggcagtgaatgaggaagatacggtgcgtgcactttggttacatgtatacggtctaccttggaagcagatattcagtaaaacaactatagcaaaaataggtgctatgaaagcacctaactgatgtatcacagatgggagaggtgtcttagaaggcttatgagggtcttattttagctgagacctgatagcttccatgaagataaaagacagtatataaacacacatacatacatgcatgtatactacatactcttaaatattttacatgcatatgtaggtactcttccatcagcggaactgacttaacctatttactaagactggtgtgtttttaattctgataaattaagctctgcaatggccctcttcaacctgatcataaaattggaaaaatacaaaatgcagattggttgatatcaaagagtattttagatcaagatcttcatggtctggtctgctccctct

SEQ ID NO: 46443 - DNA, 1055 bp, Homo sapiens
gctgagattacaggcctattaatcatttggtttcttttactgagtgtattttcatgttactgaaaccagattatttctacattctttaattcagtcagagtgataatcagcagcttagataaactgagatgccatcaattatttactagtattccttgggccttatttcaggtttttctttgacctgattcacttcgaaaagtaaagatcaacaaataaaagatcaacaagcacagtgcaaacaaagatccacaaagtaagatatggctcagagcgtgcaggcatttatggatcttgatgcttgttgcaaaattacaccagctatgttggaatgagtcttagaatatggatgtaaagaaagagagagggatagagaattctagttagagttattacataagatggaatttttttttataaagacacaggatcttgttctgtcacccaagctggagtacagtggcgcaatcatagcttactgcagtctgaaactgctgggctcaaatgatactcacaccttagcctctcgagtatctgggactataggtgcaggccactgtacgtgcgtgcgtgtgtatgtgtgtgtgtgtctgtgcgaccatgccagtgtgtgtgtgtgtgtgtgtgtgtgcacatgtgcacagaatcttgctgtgttgctcagactggtctcagacttctggcctcagcctcccaaagtgttggaattataggtatgagccaccacatccagcctagaatggaattttcactctatggtcttaaaaatctaagattaaatatcatttccttaggtaagctgttcccaaatctccagattagaactggtagacctttttgcatttcacatacataggtccttccactttttcttttttctttctttttctttttttttgacatgggggtctcactttgttgcccatgctggaatgcagtgatgccatctcagctcactgtaacctctgcctcccaagatcaagcgatgtttaagtcaagacccccttgacttaaactctgtaaaggctggcaacagaggatgttttgccagtagc

SEQ ID NO: 46444 - DNA, 1025 bp, Homo sapiens
catgctgattgatatttagtgagcttgtcagcaaaacccgtagattagaaatataacttaaatatttatttaagagtgtattaaatacaaagaagttattgtcattcagtagggaatgaatacccttatgattggggaagtttattactgtttattgaccaagggagacttttggtagtagaggaatttgaaagctttcagaatgcttctaggatgagactttagagaacttggtttgaaagacataataagcttaaggtgtggtctggaatcaggataggaacaattgttttgggaagatgctaggtaatttggctagaaattaatggtaaagaaggagaaaacaagaagattgggatattctggggcaatctgctaaacaatgttgaatcagacttaccttgaccgttgacttatttttacaggagtcttacacatataaagacccaattacagaatttgttgaatgtttatatgttaactttgactttgatggggctcagaaaaagctgagggaatgtgaatcagtaagtgtgaatttttatttataaactaatactattcttaaatttttggatattgtaacgttaatcttgcagtgtcttccttaaagtaatgaagtaattataacggaaatatgcttattaatcttaaaaaggcctaaatggctcatgtttattaaccttaaaatggcttaaatggcttgtgtttattaatcttaaaatgggaatgtgctagagtgatgacttttttaatgttgttgccatgtgtttatcccttttgtgagggagtttgttaaaacattgggggtaatttaaatttacagacatatccataatttcatgtcttaaatctcgaatgaatatttttaatatttcatatgtacaggcaaggtcactttgaattgcaaataacaactgtgtttttaattttggttcatagatgggcttatctttagaatatttcccatggttgtatttaacatttgtgataaaccaggcaattcattgtaattacgaatttta

SEQ ID NO: 46445 - DNA, 1050 bp, Homo sapiens
tagccagtgtgtttttggtgtcttttcctagaaattatttattcttgagtggatattctttttatacttcacctcgtttagagggcattcagggtggctaagtgggactagatattattaagtgttcaattctagggtcctctaaagagtttaaacaacattttgtgggaatctataatataataaaatacagatttactcatcattgcctgggggaacttagaagataaggtattgaagctggaccttgaaggatggctaggatttaggctttcaggggtatgtatttgggagaccaatctgtgtggagtgaacttgaagaaaagagagaggaagctgtcaatggtagtgtgatgggagatgtagctggatggataatttggggcttgaatattcacctaaaagaaatggactttattgacagataattctgagatatgtatagtgtctggccctcagaggtgctaaattagtatttattgggtaaataaatagggagctatttgaggaaattaagcaggagaaataagggtaaacacctaattacagggcattgtcccatgttgatcatcacaacagcaagatttgctaaatattagccaagaccctgttaatgtttacctgacatctattccttcctaattcctactgctaccactttaaccaatgtcttgtaatattgtaatattccttccccgttgcttccagtctttcatcccctgaattatttaatttaagtggctgattttctcattagtatgagtgctttgcacataggttttcacacatttttttctaatgggtgaatgaaagtcatcgcttagtagccttttggaacagactgacagcatgtcaatgaaccttgcaaaatcctgttactcaaaaataataataggataattagcctcttgattgagtcttccatctcaccccatattaaagaaatagtggctagcattctcctcatttggattcctgaaactggattctgtttttaaatttccttggaggagattttcttataatactcattcttaagtgtttgcagtc

SEQ ID NO: 46446 - DNA, 1037 bp, Homo sapiens
ggaaagcaactgtcagaaaaattataacctttagaaatggaatattagatcccagcagaattttttcacaaaaattaatgaaagtgaggcatcaaaatttctagcccagagcattgcctcatgcccatagccctatcacttaggctaaggcaggaggatcagttgagcctgggagactgagtagtgatcatttcactgcacttcagcctgggtgacagaatgagaccctgctctaaaatttttttttcagttaagtgtctgaggggttcttttcttttctttctttccttttctttcttttcctttcccttttcttttcattcccagttctttttctttttcttttcatcctgtcctgtcctgtcctgtcctttcctgtctgtccatgtctcgctctgtcgcccagtctggagtgcagtggtggaatcttggcttactgcagcctcggttcactcactccctgggctcagatgatccttcctcccaattcagcctcctgagtagctgggactataggctcacaccactacgcccaggcatgtgtagtacttttatcagccaagtaaggaaagtcatttaccagtggtgatccagttaaaacatgtttgattttagcagccagagaaatctgtccagtgaagtaaacttgtttaaaactattaacctttcagcgagaacagttgctctgagttgaggatattgacagcatgttgatctggggagagattgaaagtgcccccaacccgttatcaaacactgaatggctctggaagttaacttttgcagcagacttgataatgtttcttagtttgtgccatctaaaattgcaaaacaaaagtgtttatatgtagaatttatattgcagtaaagtcatttcagtgacaacatggtatgaatcataagtaataaaaagccagctgctttacacattttgtgttctgtcagaagttaaaacacaaagggagaccttcattgctaaataggattgtagcagatgcatttccaagttcaaattatagttgcagaaagttttagac

SEQ ID NO: 46447 - DNA, 1028 bp, Homo sapiens
tttgtccttaaaatgaaagtttagataccagtgcaggttaaagtctcttacatcacatatattaccatttctgccataatttattctgaatctaaaatggagatgatttacacatttgaaaagtgttgaacttttaaatgtaacataatatataagataaggtggcaggtgtaagatagagcagtgttcgtaggctatcggagatgaggctttgccactaaatgtagatgctgttaggaaaaagaatccatttgtaatacaatgccctattactctccacttgtagaaagaaagatgcaaagttcagttagtaaaagagtattttgttttctcaataaaaataatctgaattttctaagaaatttcaagttttactattaaccaatccactatgtgatgtccagaatttgtacagacagacctttcctgctgttattttccttatattttctaattagttcctggtaaaaaaaactctttgtcgtgcagatagtttacctgctttagctcactcaggatgacctccaaggtcctcatctggaggtctacttagtgtcctacctgtgtttttgtttttctctttttaaagcctgtccttcatgaaatgcacttccctttttgttctttcttgtccaaaacctatctgtttttaaggtccagctcagatttacttccttcgtgaagtcatttcagtgtattttgtttagcttgtatttggtgtttagttacttaaagctgttaaaataaacaaaacttataatagcttcatctccccaacttgtaagcatagttacagacagagttgtcatttttcatgttcttgtagcacatagtagatacttaagtatttttaatttggtggcatattttatgttttgattattaaattttctgtgtttaattatgaaacactgtaggaaaactcccataaagctgtacagttggggaagattgtgctagaatgaaaaaataaactaaaacattttacttacctagcttgaaatttcacttcatagcacaaatactga

SEQ ID NO: 46448 - DNA, 1034 bp, Homo sapiens
tcaaggacatagttgaaactttttgtgtgttttttaaaactgcaaaagtgtggtggtgaaaaatatagggactgctagtatagtttgatgccactgctttgatttactctaaagtacaagaagaatttgtttgtttatagtttagtaatttttagtaacttaactgagtgatataaccatcacaagtcagttttagaacatttttattgccccagtaagaaccatcatgcctgtggaactattttctttgaacagaaacagcctgtggaaaagaaaactactcagtagtatgatgacttttagttgtttacaaaagtactgtgtttactgttttcacttgctatagggtcagattgctgtcttattttctgtcttgttaagtcttcttgcctgattttgatttttgcttgattctgacttttttcctaatggaaatatacccagttgacttgacagatcattgtttcacccatttcctggacttcatattcttgaagtgggagagctatttactgttgagattgtgtgtgatttgcatttgtatatctataatcagtatgtgtttttcagttgtctctgtttaagatttatgaaaaaagtagttctaatttcttatagcacagtaggtagttggttgattgcatgttcaatggatattatatgtagattgtaaattgcatatttttaaaaattattttatttttattttttttgagacggagtctcactctgtcgcccaggctgaagtgcagtggcgcaatctcggctcacttcaagctctgcctcccgagttcacgccattctcctgcctcagcctcccgagtagctgggactacaggcgcccaccaccacgcctggctactttttttttttgtatttttagtagagattgggtttcaccgtgttagccaggatggtctctatctcctgacctcgtgacccgcccaccttggaatcccaaagtgctgggattactggtgtgagccaccgtgcctggccatactttttatttttaatataaaagtacgttagag

SEQ ID NO: 46449 - DNA, 1049 bp, Homo sapiens
aagcaaaacaatgaataatgaaacaattttctttctcaacagcttcataatgaaagaatgttacttggttttaaagtcgtagtttccaagaaggtaccgattatgttaaggacttaactgtattaaaaatcaaaacaaattaaaaattttctcattaataaatggtaaattgattcaatttaacacataatagaattttaacgaaagtaactttgaaaacaaaattagtgagaagagtgacattgctttacatttttgcagaccttcagttgctgggttaattgacaactgggttttcatgcctgctttcttgcagtctgttgtgatgtgctttaactgtaggatgaaaaacctagcttcacacatgtagttggaaaagaaaggtgtgttttattaataatatccttttccgataattgtgaatattcttttttgaagatacagtaaaattcagtaagaagtacagataaaataaaactcaacaagaaatagtttttaaaaggttgtttgtaatgtagaatctgaaaccatgtggttaaactttttgggatcctaagctgtactggtattctagactgtattgagctatcttgcacttggaatggatcttttttacccatgcatgattttatagtatcattcattggttgtttgggaaatacttactggtccagtgagttatgcaggtattccagtgtgttgacattatacaacaccagaaaaaccacattcatgaacatcactaccagacccatagaaacgggtttaagcattggaaagctttcaagctcccagtggctgatacaaattttccaaaattctagtttttcttgaaagctctaattttatcatttgtttttcttgaaggacaggctcacttcattttctagaaaatgtctggcaaattcccaagtctgaatgtctgaatagctttagtttgtctgccattctttcaagtaaaaacagtgttctgtgagaaaagcagctggttcatcttgtttctcagttgcacaagtgcttttccttaaggacagccgtgacagtgaagt

SEQ ID NO: 46450 - DNA, 1030 bp, Homo sapiens
gagaaaaaacgtagccttcatttctgttttacagctactgtgccctttttttctatgccagtcaaaatgacactatgctgttagtgccacctattattgaaagtcctatgcagaagacagttttcatctacaattatctaattaaaccacttactatgaaatgttcagtttaattcttgcttttaaaatgttttctgaaatgattataatttataacttctgtaagagtttataaattagagcgtcttcagtagacattattgaatctgtctctaagaacagggtaataatttggaatgtcgagggatcatgtagagagaaggcatagggggtcggacattgatcataatgacctccgtgcatgccttagaaggggctcatttttaattacagttttgaagttagtgatgtttgtcctcctgcctctttcttatatattaatattttttatgtatatatttttaaatcctttagtctgtgagttctccacttcagtctcttcagcagagaacatggctcattcactggtctctgtttgttttcttcaatcaccccaaaggtcgcgataatattattgacctcttcctttatcagccacagtaagttatttcactgtgtaattttggctttgtttagataaaattacatggagttgtttaaacttaaaatatacttttttctatcatttgaatttgttgtcacctgtttttttttttcttcatgtagtagatttgcttgttactgaaaagtatgcatgtgactcttaagtaaactatttgacagagtgtaccctaagccttttaaagtgctatttaaagtgtggtccctgggccagcagcatagaaatcatatagaatctcaggactcaccctagaactaaattagaatctgcattttaataagatcccaggtaactcatgtaaacatcaaagctttagaaatgaggctctagggcatactacttgaaaggaatacgtgcatctttttatatcatctttgctctgtcaactagcttttgtttaatattttg

SEQ ID NO: 46451 - DNA, 1048 bp, Homo sapiens
taatgctgggagtgaattttgagaatgaagatttagtgtcatgttagagttccagcacagtaaatttattgttgctggtcagtgagtgaatgtgccattttgctaagacatggaaacttaaggtaactgctggaaatccagatattgaaactcttctagcatatccacccttgaaagcaggttagtatgaagagccaactgtaatgacatggagtttagccagagtagtacacatgaaccttttgaggattaaaaaacttgctacactgctacaaaaagcttttattctaacacatataacacattctagtgttaatagtattatatttatgtagtatggttttatattagtctgaaaatttctacaagtgacaggtttgtacttgtaggtttggtgaatttttatgtttatttttttaaaatatgacgatacaagttaattcccggtcttaaaaaaatttgagggttagttttaaacttttgcattgcccctaacaaatcttgtgctggaactcaaatgatattttgattaagtgattgaatactgtgatacaaacactaagttaatatgttttacatcaagaacagtcaacatagagttactggaaattctaaaaagttacattcaattcgttttaaaatttttgtcctgtctgagccacaaaacatttgtgttaggcgagagtttgttgcttcctgttggcatattggcaggctaacagtgccaagcttaaaagaatagatatctttttcttttgatttagatagccactaccacaagatctgtgtatttgtttgaagttttgttaatagcaaatctaaaaatcttgtttggatttgggatgagaaatgtcagtgttttactttttagttaattaattttattttttgcagtggcctttttttatttctaaatacttttctggtggttgattattcttttaaatctgtggttagggaaacataagctatgaaagagctattgtaactatgatctgagattagaatttgactctccaaatgacctattgtaggtcagtgttgtata

SEQ ID NO: 46452 - DNA, 1082 bp, Homo sapiens
tcctgatttaatactttatcatatatatatatactccttgaacttggctctaaacaactgtggaatcctaacggtatgtgaaatattttatgccttagtagtaacttttttccagttacctctgccttcagctattggaatataaatatcaatggtttcttcattacgtggggtatagatgagtttaaatggtactattaaccatgaagtatcctattaccgtatatttgacaggcttctagatttagtgcttttgttagagaaggagagttgtgtgaagccaaattaaaaatcaggccttggccaagtgcggtggctcacacctgtaatcacagcactttgggaggctgaggcgggctgatcacctgaggtctggagtttgaaaccagcctggtcaacatgttgaaaccctgtctctactaaaaatacaaaaattagctgggcatggtggcacgcacctgtaatcccagctacttgggaggctgaggcaggagaatcccttgaatctgggaggtggaggttgcagtgagccgagatggtgccactgcactgcagcctgggtgacagaacaagactccatcaataaataaataaatatatatcaggccttcaaattgatgtacttcgttctcactctgtcttctgtttaggaaagtgtattaagtgccttctacagttatcaaaacatccttgtattaactagcctctcatttgagaaattataatttgttaccttggactagtaagtaggtacttaaagtctaagatttcttttttttttttttttttttttttttgagacagggtcttgctctcacccaggtaagagtgcagtggtgccatcatagctcactgcagccttgaactcttgcgctcaagagattctcttgcctcctgaatagctaggactacaagtgtgcatcaccactcatggctaatttttaatttttttttttccaagatggagtcttgctatgttgcccaggctgatctcaaactcctggcctgaagtgatcctccctcctcagcctttcaatgctttgggatttacagccatgagcctctgcaccctgcctgtctaa

SEQ ID NO: 46453 - DNA, 1045 bp, Homo sapiens
tagtatcgtacttacactttcccggaaataatcagccagaggacagtgattatatacgtgagtggtatgagtagtgcaatacaaagttattcagtgtgatccactgcaaatgttcagtttttgttgaagttcttctatgttggaatttcatgtacatttcataatcagtattgtaatacacctatattaatttttatggggacatatctctgctccattaaatcttcaagcaaaattgtgttcccaaagacacattatagcatatttcttctcatgagaaggataagaaaatgtttttgttttggaaaatgcagtcaggtgcagtagctcatgcctgtaatcccagcactttgggaggccaaggtgggtggatcacttgaggtcaggagtatgagaccagcccggccagcgtggtgaaacctcatctctactaaaaatacaaaaattagctgggcatggtggtgcacgcttgtaatcccagctacttgggaggctgaggcaggaggattgcatgaacccgggaggcggaggtggcagtgagccgagattacaccagtgaactccatccggagtgacagagtgagactccgtctcaaaaaacagtaacaacaaaaatgctcataaggtgggcaactatacacatatatcccctgtcccttgatgtctttctttattattagtttgtcttttactagtctgtcaacatctcaagataatgcaaagctaatttaagaaaaattaaatatggcacttggttatacctaaggattgtgtagggtatgtagcatagctgtcatgtatatcggacatgatttttaaatttttatttattatttttttttgagacagagtctcactctgtcgcccaggctggagtgcagtggtgccatctctgttcactgcaacctccacctcccaggttcaagcgattctcctgcctcagcctcccaagtagctgggattacaggcacccgccaccatgcctggctaatttttgtatttttagtagagactgggtctcaccatgtttgccaggctggtcttg

SEQ ID NO: 46454 - DNA, 1021 bp, Homo sapiens
ctggatttgtggttaaaagagattatttaatggatttaaattccattcaacctagttgataacctgtaatagtaatatgtaaatccctctgagtttttcttcaaaaactctgggataatattcacctaagaaaattaaatgagaacaaatataaaaacacttggaaagaagtttctgcaatggagaattaaatgatagataattgggtcctaccctttttttctttcacatccctctgtcaccccaaggctgtatattctctagtttccctcaagagtaggaagaggattcccttttcctttttgtgcctttgtattagtagaaaaaagaaattagggatcggggacatttctgactgagtagcccatggcatatgaatatattgggggtaaataaatatatgtatagtttaaatacactgaaaaatttccagacattctcatgatgagtagcacaatttaacattccttaacattgtagtgctcttctgcatttttaattagctttgagagagaaaagaaccacagtggttgcacaactgaaacagcttcaggcagaaacagaaccaattgtgaagatgtttgaagatccagaaactacaaggcaaatgcagtcaaccaggtaaactcgtcttaattttgaattctaaaaattctcctttctggattaatacaaatgttaattcaaactttatccagtatcccatagtaaaagttcatggtttaaatgagtgctttattcatttttaatttttgtttatccttattttgtaggggccagtataattaataaatgttaatattaacactaagtttttttcctaaaaaaaacttctttagtacttatctatactgattatactacagaaattccatctcctgtttcccccttcctggggacatttggcaatgtctggaaatactttttggttgtcataactggaggggtgctatagggacctagtgagtagaggccagttatgctgttaaacatcctacagtgcataggacaagcactgctg

SEQ ID NO: 46455 - DNA, 1026 bp, Homo sapiens
acaccaacactggtattgtcaggattttttaggtttttattgtaatttttagtatgcatttccttatgattaatgacgttgagaaccttttcatgtgtctgttggccatttggttgtcttcttttgcgaagtgcctatcttttagccatttcaattgcaaggtctgtcttgtcttactcatttataggagttctgcatgtaatttggaaggttcgattttgctctcatggctaaataccctttgaccaccttcatctttattttttgtgggcagtgaaatattgtggcattttcttggatttttctttccttgcaaaattaagttcagtacagaaatcttttcttttgctgaagcatttctgtccgtgaatattttgtagaatctttacatattactcagtacacttcatgttgttgtgagtttgtgtatatgtatctatttgctccctgtactataggttaaattatgcttttttggatcctttgcaaagcaaaagcctgatctgacatggttgacttaaaaacttggtgcaggttgtttcagcaatgtggatggagaagcatataggagtttattactgattacctggatgtggagaagtgacagctatatgtgctttacaggaaagatggcgtgggttttatttatacacagccttgcctagaaagggtaagagatggtttgtagggacacataaaaaataaggtcatgtaaatcagaagtaggtgggaatgtctacagtaattctcttcattttaaaatttttaggtaagtaaaatacttttacgtctataggttggttgcttgccatattgcttgccattattacaagaggggaatgttaatggtttatcgtattttataaagtatttcttgaaatatatttccaggtaaattagttttagtattaatcagtttatttggggaacttaaatatattcattagaaagttatcttcttttgcagatatataatgaaaaggaattattacaaggtaaattggaccttcttagtgataccaacat

SEQ ID NO: 46456 - DNA, 1042 bp, Homo sapiens
gggaaattgatgcattttaataatgcaaagtaatttgcagtgatgaaggaattcgaattttttcagaaaaataagtgagttctgtttctggaagcagactacaatataagtctacttagggaactctagatttggggagtggattttgtgtagcaaaagacaaaaagcaataaaacaaaaacgtcccaaaaaccagcgtccaggtgttgtggctcgttagacaggtataatcctcatattcatatgcaccttttctaaacatagacaactctaaagttgttgacgttaggtaacggctaagatcattttcagtaaatgtccaagaatgtcttgtcatgtaaaactttctcttgatatatttttgctttgattcttctttttacacctgtattttagaccttgagtaaaacattcgcatctgcattgttttcttttctggaaaagtgaggacaaaagatctagtaaaaatgctatattttgaaagcctttaccagctgcttgtagaagtacttctgaactagctgaactttatatatttttgtgttctttataatttcattttttttatggcacacagaaggaaaggaggaatatgtaaatgtgaattagattttcatagggctagacgaaaactatgaactgcaggcagttgagaatcagtgggaaaaactgcccaatacccacctctttggagaaaatgttggtaagatagctgtaatacaccaagaggaagacagatgctggagtatttaattagcaatttctaagtacatttgactcttggacagtacaggggttaggaacgctgagctctcgcagtcaaaaatccgttataagttttgactcccccaaaacttaatatatcctaatgctgacaggaaggcttactgagaacatggacagtcctgtgttgtatgtgttctatactgtattattacaataaagtaagctagagaaaataaaatggtcttaaattataaggaagagaaaatacatttactttttagtaagtggaagtacatcatcatgaaggtcttcattg

SEQ ID NO: 46457 - DNA, 1050 bp, Homo sapiens
tgttggcagaaataaaagtctttcttgaggagttatcactcagagttttatttggtcttttcacaagtggaaaattggattgcattctagatagctacatcctggcttactgattttagttttccttgttgtctagacgtcttctcttctttttccttttccttgaataagatttaaataaaactaaaaacttccaaacaaaaatttgttcaacacaaacatctaaatgtaaatttgccaaaagtattccttctcaaattatatgaagatgatgtaatggagtagataagcagataaagcaatgatatagtttattaaaggtatgtaagacacttgcattagagtttattctgcattatgattatatatatacataaaatatataaatatatataatttattgtaatatatattttatatataaacatattatagtttattgtaatatatattttatatatattacacattataattaccatatcagaatcaccccttgaaattttgtgaactccttatcagggagtgtgatataatgttgggatgcatggaatttaagagaatccataatgccctaaaattgaacataaaagtttttgtatatgtgcttttttctggagacaagatccatagagttcttgaaatttttaaagcagcctgtagcctcctaattcccatatgagaatcaatgttatagaagaaaactaaagatgttatcaaaattttaaaattttcttatgaaaaagaaaaaatttatattttgaattaaaatgctgtatacattttaatatcttgatctagttgctataggctatttaaaatacatgcggttttgtgaattggcatttttattaaatgataactttcattcattaaatgtttattgctttaaacactcatttctaatcctcatagatctcttgaaagtaagtattattcttattttacagttaggaatctaagcctccaaaaacctaaggtacttattgactagataagtggtagaatctctatgtggtgacaaagcctgtacacatttattttttctgt

SEQ ID NO: 46458 - DNA, 1052 bp, Homo sapiens
ctactgcagcacggagtgggatgtgtgcaggtccattgcctgtgaaggctgcagagtagatctgctggtcacgggggaccaacacatagcaaggggctggattttgtatatcttttgtctcctcggctttaagtaaatgctgtattacttgagcctattgtgcttgttgttcaactgttctctttcctggatgacacttatctgtctttaaccgtggctgcaccaactggtcactcagtgaatggtgaaacaatgttctgctccttgccttaaagtgggattctaaaattcagttgttcacatattttaggaatggaaagataattttcttgcttaagggaatgacacatgggtaaattatggcatacagtggcatcagcattactcaattatcaccagtgatggcaaatgcaggcagataaggtgcaagtagaagacaagacattgggagatcaggaggtggagtcataacaacttagttgttatgttgaaaatattgatgataaatcttgtggattcatctggcttcttgtgattgtcctagaaaacatacatttgaaacaagagaaactggaagctgtgatataaaatttaaagcatgtgaagaaccagagtgcctccatgattgccttgaaatagtccttcatatgctgcggacattgttagagtgactgcaatgagggagacagaaatactcagattttccagaagatattatctagtgactgaactactgctggtctctggaaggatgaaatgccttgttgatttgaccttatatttcagtcaatgattgctttgatatatgcatatgtgtatatataaatacatatatgtatacatgtgtatataaaaaaatacatatatatacaagtgcatatcctatacatttccttgatttatactcctacatgatgtgacttaattgtttcatgactgaggtgaaggaaagatagcatgtttacaggagaaaaaagccattggcttaggaagaggaaagactgtcaattttctgatttgtgtgggatattaatggtttgacttttggcatg

SEQ ID NO: 46459 - DNA, 1103 bp, Homo sapiens
actacaccacaaaaagtgaattttattatatgtatacttaaaatcaacaaaaaatctctatgtaggaggaacttaaaaggaaacacagactaaaaaataaacctatttttttcattataaaagattttttggggtaaaaaagagcaaagaaacctagctgagttataaatgaatgtaaccatcctgagagagatggaatagtaaagaactaacctactttgcaaaacagattttcagcaggattaaaacagaaaaaattgtccacaaatgcatgggttggcaattcacaaactatgtatatagtaaggtttaattaataagtaaatatagcttagattcaagagccagatttgtcactgtcagagaaagaagttacaaataaggaaagggagaaggatagaattctttgaaatctgaggtattggtacaaactcattgtttttaaaatgtatgtattgagatagatacccaaagaaagaaatttgctatgtatgcgcctgtgtgtgtgtgtgtgtgtgtatgtgtgtgtgtgtgtgtgtattctctgttcactaagtgagcctagaacaaatgacagcccagtaagaatgagtacacccagataatggttctattggagcatgatataccattctccaataagaaccagggcttcttaaagaagtgcttgattccaggtctgggacatgaaaaatacaagataagcctggagcatcttacagtacctgaaagtttttaaaaattcaaaaaggatcaggatgggtcatattgggaaagctctggagccagtcagaaagagctcccaatggccaaggctgaaacagtttgagcaacaacaacaacaacaaaatagttattagattataatgtaaagaataaaagaaaaatacatgagtatatactgatataaataccttgtatgaacaaattaaaaaggaagaaggcacagctcttccttacagaagaattccaattaataaatgtaggcagaatgaggaaaatagaaagtcaccatgaaaataccacaataataattgttgcaggcaagaaccatcaatcaatgccaaaatttgtgatctaatgtttgaggagaaatagaatat

SEQ ID NO: 46460 - DNA, 1035 bp, Homo sapiens
tgcacaggatagttctcgttgacacacaattatacagcccaaaatgtcaggagtgctgcggttgagaaaccttgctttcacagaaactaaaagacagatgacaatgcagtcctggaagggcagtttgctagccccgcagtatcagagtggagcacaaaagaacagatttggagctcagatacaatatataaatgactggcacaagcatctatcagggaaaagctcatttctgaatacagagagggtgtgaatgtccgtggacctcttgatccaatctctatcttttatagacaagagaacaggttcggggaaatgaaatgaccatggtaagaaaaatcctttcttagagaacatacagttaaagatagtgaaggatcatttgtatttgtctcagctgctagtttttttttttttaatttactatcagtgaaacaaatgaatacctgaagagcgtgaacataatcctccctctgaatgagttaaatgtatagaaatatatattaaatgtttttgccttggtctttttagaactatttgaggtatagaaaagagatctgttaaaaatatagagtcaagttatttggtgagagttgctattcctaagttttttaagtgttcataaaacatgtaaaagtgtctataaaaaaagcacagaacaaatttaatgaaactttcttactgaaaagtgtaataagccaaacttaaggtgcttacattggcagtgacttaaatcgcattaaccctttcttttgaaattacttgattacttttcactacaaaccaaatgcaatgtatatgcattttaaaaggacagaaaatagaaaaggaaatatgtacctttaggtgatgcattacttaatctttacattggaaaaagaattttcatagccttggcatattagcaaaatactaaggtagtatgaagcaatagaacattagtaggaaatcaaacataaaataggaattattctaaagcctgttaattataggaaaaccactatgcattttatattgatattaaataatgatatgggg

SEQ ID NO: 46461 - DNA, 1033 bp, Homo sapiens
gcgttctagagaacaaagagagggttcagggtttttttttttttttttttttttttgagacagagtctcactctgtcccccgagctggactgcattggcacgatctcggctcactgcaacctttgcctcccaggttcaagcgattctcctgcctcagcctcctgagtagctgggattacaggtgcccgccattagacccagctaattttttatatttttagtagggacaaggtttcaccatgttggccaggctggtcccaaactcatgacctcgttattcacccaccttggtctcccaaagtgctaggattacgggcgtgagctaccacacccggccacattcaggttttatagcaacagttcctgcccaggttcccaagcagatccgtttatgcaaatgaatgaattacagcttagttctgatcgatcagcacagctgagccccttggtcaatatagttgagccatgattgattgatttactttggaagaatgtttgccaaatacccaattctgaataaccatagtttgagctgaataaccacagctgagccctgattgaccagggcaggtgagctctgactggttggttttcaagcataaaaccagaagtctctgtcaagtgtttctttcaaatggtgagtgatgggtgaggggattctggctgctgtttattttggcaccaacaataggaactggtttgacttggctgtagaaaaggaagtcctgtcatacttttacaacagctttctgagaacacaataggtgaccacttcctcacccagccttggctgcctgcttctgttttaactttgagcacttcagccatgggagtccattttgtctgtccactgggggcattaacatttggaaaggtattagagagtaaagagcagtcagtatctccgctttcaaaacatacagaagttaaagagaaatgtagaattaacttaaaacaatacgaagtaaaaccacatatacaagtatttaaattttctttttcttggtagattcctttagcccatagagagtgg

SEQ ID NO: 46462 - DNA, 1021 bp, Homo sapiens
taataacctattaacataaataatattttctaatgaaaattgggatcttttccagagtaaaaaaaaaaaaagtaggaggaatgtcattgttttacatttttgcagatctctctaatgtctgcattaatatagttgaatccttatatctgcttctgcattcaatctcttgcaatatgatactgtagttgaaatatattcagattcctatagatatataactggaaagaaagggatacttaattatcatttgcagttaatggtgagttttttcctttgatattacaccaaaatttgacatgcccatttcttaaatattagttgcaatgtaaacttttcatgctctgttactttaaaatcagttggtttttgagacactttgaatggatgtttttacccatgacgataacttggaaatattgcttctcagagttatgcagactttccaaatgctaatctatttcattattcaatataaaccgatacacacataagcatttgttaatataccactaatctcaccagaaaagtgtttaaggattggcaggctattatcctcatggtgataaatatgagttcttcaaaattctaagttttgttcaaaagctgaaattttatctttggcaacaaatacttttgggtgttctccttgaagtgacagactttggtcatttactttggaaaaatgtttgccaaatctcaattcagaataaccatagtttgtcgactgttgtttcaggtaaaaatgatgttccatgaaaaaacagccatttcagtgtttgcaactcaaacgattcccaagtgcttcccaagtacaaccatggtactttagtatgcagcagaagtgctttatgtgtacttcctatttagtcatgcagaatactaaaaagacatatactcaagagtcaagatttaataaaattaatcattttgacttctttctcaaggacattttaaagtgaaactggccttttctttacagtgagtacgtggcagtgaagaatgtagcaacttcaagtaatta

SEQ ID NO: 46463 - DNA, 1059 bp, Homo sapiens
atagaagatagaaacaaacaatgtttgctactgattgtataatttgtataattgcttaatgtaacattacttttcccatttaaacttctagcttggagatttccttgattaagaagaatgaaggactgacctggccagagctagtaattggagataaacaaggggaacttataagagattcagcccagtgtgctgcaatagctgaacgtttgatgcatttgacctctgaagaactggtaagtagttggaatagtagtgtgactttccaagggtccaaaaatatgttatgtgaagattatgccatgcttttcaaacaatattttgcttttcctaatataaaagatacatatcagatactactgatctgagtgatgtttgaatatggcctaagttctaatatttatttcttacactatgtaaatacatacatatatgtgtggtcatactgtatagagggtttgcctgtatctgtttatgtgtgcgtatgtattgtgcgctctctctctctacatgtattctttaggagaatcaactgaccaatgctggtaggacaaaaattatgttacaatttatttgctaagaatctacttatccctaaaatttttgaggtgagtttacaattttgcaaggatatatgtatcatatatagtatagttattttttctttataatgtaattcattgtgataattacagtgacaacacaatacttaatcatgaggttgaatacattcccactctcatgacgtgtaagatcatgttaagaatgtgaacaaatacagcagtacatcagaacttgaaattatgtgttcgttttctaacaatgatatcagcatatgaaagatgtctggtttattgccatcttgaattatagagatgaggaagactgtgcaaaaattatttatactgtaatgttacttgcatcctaagatagaaaagaaggactggaatattgaaagtgaatgtcactatcaaaaggaaacatggctaaatagagaaactaagtttcatgtttgccagtagtaattgaaaatttcagaaatcactggaattcttatgt

SEQ ID NO: 46464 - DNA, 1033 bp, Homo sapiens
cagagaataaataacaaacaaaaaacaggaaaaaggcatacacacatgcacactcatatacaatatctagaaactgagaggaagcaaggtagccaagactaatgatcagtttttttcttatacaaataaatattttcttaaaagttctgtcctcagggaacattatctaaacttgcagtctttatgtaaaggcctttttattttcaaatttcttgtaataaatagtatccaaaataactgttgaatcaccagaatcctatatattccctctatgctatctgtgttcatgtaattatgtacacttttttgtgtgtgtaattttgttttgtagattatgtttaatgaagaacttggggatccttttattataattcacagtatctcactgctaaatgctgaagaacattctatagctaccctacttcttcgaatagagaaagaggaattggatatgaaaggaagtggtttctatgtttctctggagtgggtcactatcagtaagaaaaatcaaggtaaaacaaaagtctgaatctgtctctactggttggcattatttagtagattttgaaacacaaagctgtccctgtaaatactgtttgctctttcttgggcattgtgttacaattctggcacctgccaccactggtggaatgaatatgtatagatagtttttcctcaggtatattttatagaaaaaaattgcagtgtgcatccacagccaattatgccttttatataaaagaagacattgttatataagttttgaataatttaacgggtatatttttaatatatacaaaaatatatgcatatatatgtgtgatacacagaaacatatacctaaaactaaatgtaaattaatacattatagtataatttaaatgtaaataaatataaatacttacttggaaatgaatgtctttatttcattaaagtacaggtatgatttcttttaaatctaattgaacttcattatttgtttctacatttaggaaaactgttactttttcttacctgatgtgctcccatgttt

SEQ ID NO: 46465 - DNA, 1524 bp, Homo sapiens
tttaatttgtacttaaaggtctaaggggcagttactggatttcatttgtaagaatatatgtgtgaggttgcatcttggagtgacatgttacaactatttgttagaggagctcagttttatgtcagtatgttcatctctaggcctgaatgtcagcttgttttcacagttgagttaattattaggggaccacttacttacctgtgtagagacgaaggcaaagtgtcccctttattcttagaaggtttgctgaaaatctgttgacaaacggcagattaacatgagaaaaaggcatataaatatattttaacatgtgtacatggcagaatccaggaaaatgactacccagtaacccagtggggtacagatgcttatatacccttattcatacccttcttatgcttgatcagtaggggacatgggggacatgcgggatagcaaatgatctttagggggaaatgaatgaatgggcctgatgctcagacaatgattagttaatacttttctttggaaattgaatgggatggagagcagacaatggtttgtgactaagttcatctgggctgtaggtggggtgtttaattttcagcctcttcctctgtgatagaagttttaatcttctctggttaatgaaatttcagggaaagcaattgtgtttctctttggcaggtccagtttataggtagatgaaggaacttcagagaatagcttcatcctgtgcttgggagaaacaggaagggaggggaggccagaaagaccttgaggctgcttcatgttgaagtggcattatttcggagtaacattttttgagctgcaatgcctgatgaaagaaaaaaataaagagtggggtaaatacgtagaactgtgcgtttaatacaaaaaaaagggaaaaggaaaaaggaactttttatgttctttcttccaaataaagttaatggttattaatgatgaaaatactttgtccagaaaaagatcactgccttttaaaacggcaaagttttaaatatcattgtctcataatactagtaaatagtatctaataatactagtaaatggtatccccacttgcttatttttttaaacttgagtagccctttctataaatctatatttattagaaaactacttcgttagttcaaagattctctacttatagctgcaactaagagggtcccaaaatgtgtttaaagatgttttttataaatatatatagtttatgtattacttgtttactgtttatttacagtgtcatttatatataatatatgggcattataatttttatattacatctatattgacccaggcatctgcattaaaaatactgtgtagaggcctgaagaaaaactgaatatagtagttacattcaaggttgatttggggggttggggatgggtatactagaaattgtattgagatctgaagtattaatttatttagaaaatcttcagaagtggtttcttctcaagcaaatgtggagtaggggaaagaaaaccaacttttggagtagggttttatcaggatttg

SEQ ID NO: 46466 - DNA, 1074 bp, Homo sapiens
tgaaggaagtaaagctcaaggctaaactgagacctgaagaacaggtagtagttagccaagcccagagggatgggaaaataatccagctagagggaacagcatgtgtgaaagctgggagtctagaggctatcgtgcctccttcaggaaactgtgaatggttccattggcagtggttatggtatgacagtctgaagagattatggagggtttgtaaatcgtgctaaagagtttggacttcatggacacagggtgccattgaggagtttcaacaagggaattgcctaatgaggtttcttctctggagtagtgtggaagacaaactgctcagggccacaaggagcagctgggcacagtgtgatgctgtttcagtaattctgggtgagaaatgatgatggcctcaggtggagaattcaggatgggaaagagcagacagatgacacagttactaaacagacagatttgaaaacaagaagcatttgttgtagtgatttctcaacattactgtgcgtagaagatcacctgggcaatttgtgaaaatggattatgaggctgacttaaagaaatttcaatcagcagatctggagtatgagtcaagaatctgtatttttaacaaagaggccaggtgatactgatgcaggtggtcctcagactgtaccataaaaaaccctatctatttgatgtttcaaatggcaacacttctttaaaatgtatttctgttatgttaactttttgcttaagaatgaagattcaatcctattatctttgtcgaaagtagatgaatgacacagccccagggtttactgtgcaagggcagtctccttgctagtatagtctgtgttcactaattgtttgctctctggtgggggatacagaatagagtagtgatgatttcgttaagactttttattgcagattgtttgtaaatgtgttttcaaaggtttcagtgcaagcaaacactttgggtgggatggggggtgagggtggcaaaattgccccaagtcttgaagttccacgcaggtatactttcctggtgtttaaggcacattttgaatcttattgtgatgtttcagatcc

SEQ ID NO: 46467 - DNA, 1034 bp, Homo sapiens
agagaaattcatctttaatcatataaaaaagtgaacacagcattatgctagattgttaactttgtttacttttttatgctcatgactacttaggcaaagggcacactgtttttatgtcatcttttccaacggttagtcatggctcaattttaattgcccagaacagtgaaaagataccaccctttgagaatgtgaatgtaccaaggactactctgtccctggctttgtcactggggtcaaactttaggtgattaacttaatatttcataagtataatttctaacagtagatggaatagcagacaaacatgggtgtgtgagaaattctatagagatcatgattttggagccctggaaaccatgtggatgacactttctccaaatttttactgcactaacagtataaagccccatatccctttctcagtggatctgcaatgaagtcccctgcccacctctaaaaaccagcatagtatgggatttatttttaacctcaaaatatctgactcttttctctaaaacttttctttcctctatgtagtggagatagtaagagtacccctcacataaggctgctttgaaaattcagtgaaataatcaatggcatatggcatacaaaaaaattaacttctattgtattgtgattactataaacgttatcatcatttttacaatgcctggtagtcaagggaggcattagctaatagcttgaacaattctttgtttcaatttgattcagcctatcaaatttcttatcaagtacttactaagaatctactatgtgcttaacattttgatgggaattgtgggattttatgtacatgagaatgtacctaacaaaaagtgaaatatacagtagtggtttttgtttccttttcaaatgtgtgactttgttgttttgctaaatagctatatatatgtgtatgtatgtatatatatgaaattgttttgctattaacaaaatgggtaagataccacagtctgagccatagcataagtctagttaatatttacaacttgaatttaaaatgtgat

SEQ ID NO: 46468 - DNA, 1079 bp, Homo sapiens
gtgggcttttgtacatggcttctttcccttagaataatgtttacaatgttcacccatgtggtgtacatcagtacttcatacgtttttattttattgtatttttttttttgagacagattctcactgtcgcccagactggagtgcagtggtgcgatcttggctcactgcaacctccacctccaaggttcaatggattctccagcctcaccctcccaagtagctgggactacaggcaagcgccaccatgcccggctacttttttttttagtagaaatggggtttcaccatgttggtcaggctggtctcaaactcctgacctcaaatgatctgcctgcctcagcctcccaaagtgctgggattacaggcatgagccactgtgctggccctaccatcctctttttgcattcccagaacacaggctctagtgcacattagagactcagtcaacatttgttgacctcaacagcaaaggtaggctatgggattcagaagataaaatgatgtaggaaagaatgtcagcttcatagattgaaaaaaaaaaaaaaagtatgtttcatcatgaagctattgtagggttttaacataacctgtaatgattttatttttgttatcctcagcccacccccaccacctcattcccaaaacattttatggtgatggcaatacaaggaaacagtgaaacagtagacaagtatggcacagtaagaacaaactaagtttatatgagcgttaatattatcatggcccttccttgtttcaataatcataataattatatgttaacaaaatacttaaaactctgtgtatatatacagaattcacactgagcaattccctaatcctgtagaaaatactcatttgctaaagagcagccactcatcttgatgagaagtattatggctctccatcttcatgaggaaatcacagggaataggccgggcgtggtggctcatgcctgtaatcccagtactttgggaggctgaggcgggtggatcacgaggtcaggagttcaagaccagcttggccaacatggtgaaaccccgtctctactaaaaatacaaaaattagccaggcgtggt

SEQ ID NO: 46469 - DNA, 1028 bp, Homo sapiens
tagttcccgtaatattcacaagatgtctgaaaagttattagtactgaatgtctttatttgttctttgtctaatgagttactaaagtaactctggcatcaaaacatcttcatataataaagattatttagtaaagtaaatttaccactaactgatcagtttgagtagatgtacttttaagtaatactgatttggctttgaggtccaatacagttctgctcatcaaaatataaataaattaaccaactatcctaagtactttaataaatgtggaacgcatttataggagtcagcagtatgactttcctgtttccataataagcatctatgtaggtcacttcatatcgtgcatattaacttaatataatcaccctggtaataatctgttatttgaaagttaaaggaacatttctagtctaaaaatcattttcatcttaccagtttactccagatagcaatatatctgatttatgtatttttggttgtgtgtgtatgataaaacaggatcacttcacactgcttctttgaaccctaaagtcggatgacttatctttcaaactctgttaaccaattgatgggtcaagtgatccaaaactggatgtggtcaataatattcaagtaattttattttccagatgtaaactctgaagagttcaccctaaagatcctgaattgttctggtgaacttcttattactaaacacatccaaaaatctatggacacatatgacccaaaaatacactatataaagtgttgaaacagacatgtctttatgttttgacaaaatgagtgttacagaaatatttgtgtcaaaaagcttacaaggggccgggcatggtagctcatgattgtaatcccagcactttgggaggctgaggcagatggatcgcttgaggccaggagtttgagaccagcctggccaacatggtgaaaccctgtctgtactaaaatacacacaaaaaatacccgggcctggtggcatacgtctgtaatcccagctacttgggaggctgaggcacgagaattgctt

SEQ ID NO: 46470 - DNA, 1029 bp, Homo sapiens
ttccctggtcttgttcaattgttggccagcctgtgctcctggtaagagtctggctattaatctaaaggtgtttattgcaaaccaccatctatttttaagttgttttagctcctgaattcagtatattccatagggtctactggtgtgtagtcaacagctggttaattctattttggaggggaagaggggagggacatggccttcgatgtctcctagtggcgcatgatagagataagaataaaataatattcaacacttattgaattatggaatatcaacaattattgaatatcaactacatatctgacagtcatgaacacattaagtcatgtcaactctattggtaattaatagaacaatgtgattgataggacattattactaatgtgaaaataagcaagtattaatttgtttctgaagtgacttaaactgttacacgtttttacaaaggagcacaggaagtaacccctctgattattaggtaacttttagcctctaaatgagatttatgaatgggcaatactttggtatcttcaggaaagtttccacgtaattcacatgatttcagctgtcaatgttcatgaacaatttctgtttgtgttgctttagctccataattagtatgtttttagaagattccactggaaaatctgcaagattacagaccatgtttgtctcacgctgtgaccctggcttgtagcacagtgccaggcacatggtggacacgcaataattactcccagaacttaattgacttaatttaccactgaaattgtattactgtgaaatcgtaccagaagctttgctcataaccatctatgcatttcgcttacatgaatgttgcaaagactttttgatataatcagataaacacagaaaatatttaaagagttgaaaatatttgaggtatattcatactaacattatataaatcagatttcagattgattcgatttaaaatggctaagatataaaaccataaaaaatgtgagtaaatattctgcctatcagggcttgttatgtaattac

SEQ ID NO: 46471 - DNA, 1048 bp, Homo sapiens
gctagaaataagtaataaaacatgcatgagggaatgtgatctacaatgtgttcctttatgttctagaaaggaccctgatttccttcctcaaatttcaacttagtttgtgtgtgagaaatatgtatctttaaaatggaggaagtcaccaccagagttatgtaatgtaatccttaaagatcttttagaatgcagtcaaaaggagagaataggaaagaaagagaggagagatgtattcatatatttttaaatgtgtcattgatgtaataaactctttaaaagacagtttcttatataagggagttttagggtcaccattaatacattttctcatgttgtaaaaataaatatgaggcgctttgtataagttttgtgcatatgcacattaacatagatattgagttatacacttgtatataagtgccaaaagtgtattcagttttcaatatctttaaaatctaatgtctattgaattattcaatctcttctgaaattaagagagaaagaaaaaatttaatgatctctgaatgcctcatatatgtcaaacatgacattccatagtctcacatacatcattatgtttatgttaactgagtatgtatgtgaattgagagaactccaacatagtaataaaaataagttggcaataaaaattaatcataagttatcagtgtcttattttcctcctactaaagtaaataattataaggctgacatttacagcattctcctaggtactctattgcttcatttttttttcagttttttaatataaaattaacatataaccaattatatttattctccactatgtaagaaactcatggaatttcttgacaacattgttggtgttttaatcccacttataaaatatgatattgctttaatgaaaataaagacaactagtgatgtctcactacatggtagtgctgaaaatgattccattcatttacgtgagtgtatgtatgtatatatgtttgtatgtacatgtatatacataaccaacgtatgccatttctacacattttgcaaattgctcattagctcagac

SEQ ID NO: 46472 - DNA, 1033 bp, Homo sapiens
gttatgctggtgcttcaaagggaataacatcaaaaacttgtggagaaaagccagaggctaccatcccacctccaacctgcacacacacacacacacacacacacactctctctctctctctctctctctctctctctcactctcaattgggagacctatcatggtagaataaagtctggttcaccaaaaaagagggataatgaggccatttttcattattttcccagtggattctaaaatagttacctcataaaataaatagtttaagtttccacattactttttgcctttaatctgtgcctgcgatgcaaataaatgagtggagatttttatactcccaaaggtttatgtagaggcaaatatattacaaaatgaacacctaaactaagcatgatttcttactaaaacagcatcttacagaatgctgtggttgacggaagggagacactttaggaaaaggaatctacaaaaagatttaattttatactcattgttcaagtatatgctactcttcccgatcttgtcttctctagattaaatttaaatggaaaactttcagaactgaactgagcctagccaagtacagaaatatgtatttcgtatgtgagctcctatggaaaggatgcaccaaaactgtttttgatgtgagtagagtaaggtgttaagagcgccgtaagttttataaaattaaaaacccatgtgctaaaactagaaatagtttattgtccttgtttaagaggcaactgaattaacctagttatctggctaataaacataaatagtccaccttagtgaagctctaattacagcctctgaacctttcggtgtatttacaacttaaaacatctgagtgattctgccttttgaaagctatgtgaagttagaaaggcggcctaattaaaacaaatcttgaataaaccacttcatggagatagaagtttgatggttggatatatcaaaaattgttaccagatgttgttcagaggccttaacagtttaaagatcatgaggtttttttttagcaaagcaaaaa

SEQ ID NO: 46473 - DNA, 1026 bp, Homo sapiens
tttcaaagtcgtttacatttggctttggcaagggttttaattgttcattggagagtatctgtaacctgaaaattcttgagacacggtaaccacagagttaatatgtgactcacaaaaggctggaaactgcctactttttccatcctgtccctctcatcagttttgcttccactttattctgggagttaatttttatcaaccttcacacagaagtactatttgtttgttcatatatgcaagggaaattatttttattcctaaagcatttctccctcttaaaatcctggattagattaagcaaatatcccgtttatgtaaataaatcatttaattaagcagaataggtaaggatgtcagaaataataaaacagatgatttgtcagaaataaactgtagggcatatgatcctttgaagataattgaaaattcactatttaaaaatatgaattaaaaaatatatagaacttgatgagttacagttacatacattactatgctattcgtatttcggaaattgaaactcagaaacaaaagcagtgctctagtttgtcattccttatcagtgaagtgtggaatagtggaatcttcatggggaatttctgtaggcacgaaaaatctagaaaacaaaggctgtggaggaggctgcctcagtcattctaattgatgtcgtacagcaggactactcttgggtaacatctctgttgtgcccaaggttatggagattttcttgcagtcataggaagaagctcaggttatgatcaacctggggagaaatgattatactccttccttagatagcagagaagtttgaggtgtactagaagtgtggggttatttacacagtgagctaagagtagtgataagaaattttatgttcaggactgctttcttatcctattgaacgtcagtctcatcccccttagtgactttatagcttgctagctatcacattccatgttattccccttatgtctgttaatgtcatttccagtgctatccttctagcctatccctttttaaaaaatg

SEQ ID NO: 46474 - DNA, 1029 bp, Homo sapiens
gttaccctcatgctgctgttctcatgatagtgagtgaattctcatgagatctgatagttttataaggggcatttccctctttgcttggcacttctccttcccgccatcatgggaagaagaacatgttttcttccccttccaccaggattataagtttcccaaggccttcccagccatgtggaactatgagtcaattaatcccctttcctttataaattgcccagtcttgggcagttctttataacaatatgagaatggactaatacagtaaattggtaccagtagagtggggcactgctgtaaagacactgaaaaatgtggaagaaactttggaactgggtaacaggcagaggttggaacagtttggaaggctcagaagacaggaagatgtgggaaactttggaacttcctagagacttgttgaatggctttgagtaacatgctgatagtgatatggacaatgaagtccaggcttagctgatctcagatggagatgaggaacttgttgggaattggaataagggtgactcttgctgtgttttagcaaagagactggtggcatttgccccagccctagagatctgtggaactttgaccttgagagagatgatttagggtatctggtggaagaaatttctaagcagcaaagcattcaagaggtgacttgggtgttgttaaaagcattcagttttatgtagtcacaaagacatggtttggaattggcacttatgtttaaaagggaagagagcataaaagttcagaaaatttgcagcctgacaatgcaatacaaaaggaaaaccaattttctgaggggaaattcaagcctcctgcagaaatttgcataagtaacaaggaggcaaattttaattgctgagacaatggggaaaatgtctccagggtatgtcagaggccttcacagcagcccctccatcacaggcccagaggcctaggaagaaaaaatggtttcctgggctggacccagggccttgctgctttgtgcagtctcaagacttgctgacctgtgtttca

SEQ ID NO: 46475 - DNA, 1029 bp, Homo sapiens
ctgtgaattttttttctctagaaagttttccatttacccttttattttatccatccatccatccatccatcccagagaattttctcatggtctcagtgaattttttttatagtcctaaacaaagttaaataacaaaacttctgaggttctaacactatgatcttgacaatccaagtgaacaattatcagtaaatataacagaaaactctgccatttacagcacttcacattatcagattattaaaatgatctaaaattattcatttaaatgctagcagggaaataaatgactctaaattccctgcattactcacaaatactacaaaaaggaatgttccctggtttctgtggttagaaaatgtatagagcagagtatttcatctaaacctagagtcttctttttttatttggatttgccacttataacatgaatgattttgaaattcccatagcagaaagcttttcatcattgtctcactaagaaagacttgattctagtgccgaaaactgaagaactccttagggcataaagtcagagaacagcagcttattccagaccactcctctaaatgttaatgaaacttacataaatcatacataacatatactatccctttgtgctggaaaatgccatgtttttatggttgtggttgtacagctaggataataggaaccaaagacataaaacagtaattaatatatttcagaagtgaagtgttttattggatagatgctaattaagactgatagatggcagtgattgaaataagcataagccatttggtcaacacaagtgaaagatcagctatcatcttgaatgctttaattaaggatgctttgctttttgtttcttcttccctactcttctgaatatatgaaaaaacatggagaaaaaataataataactgctttttgacagggaaactgatgtgtagtgcatgcctgatatggtttggctgtgtcctcactcaaatctcatcttaaattgcagttcccataatccccaagtctcatgggagggacctggtg

SEQ ID NO: 46476 - DNA, 1847 bp, Homo sapiens
caattgctttatagttacttatgagtcaggttcaacattttatgctgattttacttgcacttaaacaaatagaaagtatattttctgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaagaaagtatattttctgaacacctctttttggtaaagcatgttgtatatttgataatttacaatttagtttgctgttttcttttgttctttgttgcttactttctgtgcttcaagtttattgaacttcaagtttattgagctagaacttatcacagatggtaaatgtggaaaatgtgatggatgtagaactcctcccacataggagtgaaatgggagactacttttgttttgtaattgatagtatgaagccttacatggactatcttcaatatgcattcattacatgatacattcctggtattaaattgtaatcgtcgagatagcactgctaaacgagatagcactgctaaagtttatgtctgtggtttactatttagtataattattcttagcttaataagctttctgtactattaaatgaaataatggaatctcagattaacatttctttaaaaaaattgtattcagcatattaccatacatttactgagactgaactgctttcttttcaattttcgtgaaacttaaatggcttccgtttttctgtgcagtaaattaaaggtgcttacacagttatgatagtttccaagaagaatttcaaattggcatcaactaattgcagtagcaagtgatccaggttttacaaggaaggaaaatgtgaaagaagcatgtctgagtataattttgttcctgataacaaatatatatatatatatatatatatatatatatatatataactgtgattcaaaaatatatagtaaaattaccttccatcatccctagaagttattcaccttcattataactttataaccagtacataactagatgtgtgttttatggcaagaaaagtttataaaataatgacttttgctatggcattcttttaaaataacactaatgcattttatgaacctggtttttcacttaatcctctgttttatgcacttagagcttaaaagtcctgcagtaaatattatcatccttagctttccatatttttgttcaggaagaaagaaagttcattctacacttaattttaatgtcttcttgattctgggaacccataatttttttctcttttcttactgatgggagaagcctgcaccatcatggtttgctacttttataacttgtgagcaaacagaatatttatctctagtctcttaagtagagttttaaatccacttgcacagcttttaaaatattcccacctgccctctccaatttgtttttacttctttacattttgtacatttgaaaccgaaatttgccttatattccatgtgtaaataacagaaataatttttttctgaatattttaataagtgtaattcaattctggttagtttgcaacaccattgaacataatattactcacttctgcccacttttaaatacagacactttcactactcttacagaacagtaatctgttctctca

SEQ ID NO: 46477 - DNA, 1087 bp, Homo sapiens
tctgtcgacttattttaatggctgacatgcacgtaaatttagtgttcatattgaatcaaatcattagcatgaaaaattacacaacagcaagtcctgttaactaattatgctagattggcacttcagaagaggttcatcaattcaagtattatcatttgtagaaagaaaccttttaaaagaagctttctattttaaaacttgttaatgaaagggcttaaaaatagagatatatgtatgccgaaaaatggccctgaatataatatatgcattctttgcatgcatgcatttttcgagaggttacacattaagagatttgatatagccttccagatatatttctgacctatggtagcttaaaatgaggacaataaaaatcaatctttacccagataaaaattccacatacctaagaaggcatcaggtttctcatgccttattaacatttattcttctgtgcataaattagtccatttcatagcataaattacaactgacattatctcctgtaaactctataataaaagagtacagaaactctgccagccagccattttaatgttgatttctttacttatatttaaacttctaaataataataactaccattactgggtgcttcatttatgttggacactctgctaggtgttttgtatggtatttcatttcatctccctgttgaaagctatagattaggcagagaagctcagagaggtaaagtgaatttctgagaacacaaacttctaaatggaattgggatttgtgcttaattttaatctgtctgactttcacagtcatcttcagtatgaacagaagaaaatccctgaacacctttgaaatttaaagcaaattaaagcaaatactatgccattagagtatatacatatgaatatgattcactccctgtgaactctgctgtattctcccacctctaatgtgcctcgcctctgcttcattgggaagtaaaaaaccattttactacctgggaattgtgaagctatctggtcctttttaaaaatataacactcttctgaggactttctgatgctgtgatcaaatgatgtggagagaatcttctaagaaatatatt

SEQ ID NO: 46478 - DNA, 1047 bp, Homo sapiens
gaatacttttataataacattgctaaacagataacaaaccctaaatatcaaagcaagaaactaaagaagtgaaaggaagcaggacaaaggacaactgactttgtgtccttatttgcctcttgaaggatgtgttagagaagtcttcagcatctaagtactatagctattacttctatcatggggacatgatatttgacttgcctctctcagataaaatttggaaatatgaaatattaaagatttaaacttttttgaatctttaatattagattctgaaattgaatatatattagtcatattatgatattgtgtttacctgtattttgtctaacagatttttttttaagctttagctaatgaagacacatggcattgttaacagtggtaaagatgggaggaatgtttagattttctagtttggatgtagtatgccttgttttgagatacattgatgttggtttattttaatggcaaaagtgctttcattattctaaactatttgatttatcatgacctcatcccattctgtaacaagaagaagattgttatatttttctccagaattaacattacaatgattaataagagaaatcatatattttacaaagccactatgagtcaaatacacatttttctgtgaaagcatttttggagctgggaaatatcctctcctgttctctgtagtatcctgtctggagaaaatccagtttgtatcttttatatgcttttcaaaaattactcatctttagaggctactgggagctgattgtggtgtaatttctttgctgtgttcaattctgcggatcaaatttgcaatctgatatgcatacatacctctagctggcttagaatagatggagatagcaccttttcatacatgcctgcagtgtcagtgtctatccacaaatgtttgggaattagaccagaatgttaatattgaccttgccacttccttgctgtgagcttgggcaagttacttaaccacttggagcttaaatctcatctgtaaaatggagatgattatttatcataggatgatacttacaa

SEQ ID NO: 46479 - DNA, 1049 bp, Homo sapiens
atatcttttaaaattatatgtagattacataaaaactaacataaaattgcaaatctttaagtcaaattattataatatccatgccagtatggtttctaacaatataaattgatgatagtaatgcatgttggatgtaccttttaaaaaatgctttataggcggggcgtggtggctcacgtctgtaatcctagcactttgggaggctgaggcgggtggatcacttgaggtcaggagttcgggaccagcctgaccaacatggagaaacaccatctctactaaaaatacaaaattagctgggcgtcatggcgcacatgtgtaatcctagccacttgggaggctgaggcaggagaaacacttgaatccgggaggcagaagtcgcagtgagccaagatcattgcacctcagcctgggcaacaggagccaaactgtgtctcaaataaataaatgcttcatagaatagaaacaggatagaatagtatattaatgctagcaatatgttttaaaggctatatgccatgtgacatacagtagattctagtctttaaaactggaaataattcatggaagttaaaagctagtggcttattatggtgataggctaaaaacctgtaagttcaaagatggatcacaaaatgttttcactagcagactcttgctaatagtccagggggtggatattcaggtgcaggctagaagccaggcctaatgcgcttcaagaagaacttacagacttgaccagtcttttaaaaaagtatcttacccctcctattaatcaaaaatccctttgtctgggccaggcaaggtggctcacacctgtaatcccagcactttgggagaccaaggtgaacagatcacttgaggtcaagtgttcaaaaccagcctggccaagatggtgaaaccccatctctacaataaaatacaaaaattagctgggtgtggtggcacactactgtagtctcagctactcgggaggctgaggcatgaaaattgcttggacctgggaggtggtggttgcagtgagccgagatcttgccactgcactccagcct

SEQ ID NO: 46480 - DNA, 1109 bp, Homo sapiens
gtaggctcttcttttctgtatttaacaattgattgttacagttaaagagtacattgcttatttccataacacaatggtctttattttgaaagacaacccattggttgaaaagagcttagactttggagaccaaagagatgggttcaaattgtgtttctgccaattagtaccgggttctattgatagtttcttaggctttgtaaattataattttgttttcaacctgggataaataacacctattattgcataattattttaaggattggatgtaatggatttttagaaacagcacaggatttgacatgttgtagttagttgctcaactaagtgtagctacacgtttattttttgagccatgagaagcagagggggaattgagggggttctagtggtagaacgaggactcaaatcattcgctttaatataaagtgacaattggaaatgatcatccaggaagaagactaagggactccagatacaccctttttgaagatgtctaataattcaagcatcaccctgctcaattgaactaaaaatttggattgtgtagaatttcatttgaacagtagaattttgtttgaacagtatgataagctcattaaaatctatcacttgtgtgtaacctgatcctctggttaattccatgtgttttcctatggccttttagttctgcaaaagactgggcttgtaaagactttgatttcatttttttttttaacagatgatagcaaaagatatttagtacctagaaaggtaaactaatcctattttcatgtgcagtcaccctctagtgtaaataagtagttttcagtcttcaaatggaaaacattccaatgtcaaattctttaggaataggaataggaaaaaggattctgatgcagtgagtggctaatttatatatgatataaatttatatataatttaaatatatatatatatatttttttcctcctttctgccataatttggcttctccttttctgacataagatctatcagactatagtacaggtttcagcacagaagtaaataacagcatgtttccttgggagcaattgaacaacagaatgaaacagtgcttactgttttttgaaagttgtgtcaga

SEQ ID NO: 46481 - DNA, 1791 bp, Homo sapiens
gtttagagaccatttagactcacttccaaaaggatctggcctcagagttttgcagtagtgagcaaaaattctagaaaggtctaggttcagaaaccatagcaaagttacaagagaaaggttttctagcttctgtttcttatgccattcaacaagatttagaaggaaatgcagccaaatttaatggtcgttacctgatgaaaaacagacatcctttggattatcctcaagcagaactgaacagaactaaatgcaattagaagactccacggaggccaagatgatcagatgatcgaggaaagcaaactgatataaaatataagctcaccatgttaggtaactcatgtgtttccaacatggtgctattagaggagcattagagaaatttactgtatcatgaagtgcacattcgtttcctcggctgaggacagtactacgacaatatttgacaggaaatgtagagaatttttatttcagtcaactctaaaaagaatggcgaaattcttgaagctgtgtatgatgattctctattaatattctttgttcaatctttaaaatggcgtttatttctcaaaggaaagttcgtgccatcaatattgattccattatatttgtgatatacatcaagttttatcttcagagtgaaaagttctttgtatatctttgtagtaaacacagattttgttctcattttgaacatgcactaatttctacatgaactaaatttctacatgaactgggcacattggcttaatttaaataaacatgttaaggtggtcattactattcaagagtcaccaatgttctgattttttattttatgttctgcttttttattttagacaggcaagttgttagcatttttttcaaggaacaaagaacaaaaattatcttgataagaacttgtttctgaaaagctagattagctcttctctgcacaccaatcatgcaatgacagtacaatttagtgacttaagcagtacattaggattctcagcctaggcagaagcttcaccctcgggccagacctatataatagttgtaagaaaatgatttatgtgttgtaataaatgttacttctcaatctgtttgcttgttcaatggttgaggtcccaaaagaaaaggtctatctcaaattaggactggcatgtattatctgtcaactttatatagtactgtaaaagtcattcagctgacagtaatattagcggaatgttttatagatttttgtactgtgtgaagctttgtatgggtgacgagagactttgggtctgtggtgctctgtggtccgggataaagttgcgtgtagatgagtcgtttctgtgcttctctgtaaatgaacatctggctcacatattgattccatgtgtgaaaatgagatcagcccatataatgaccagaatcaatcaggcttcagccgaggagtaacatacactggtcttgatttgttagacaaccagaattggcagcaccttgcataatttggcaccaattgacaaagattaggctgtttggggaccctgaatggttattaatttgaaaaccccttatatattttgcagagtaaaatcagctgtaacttatttgttccagcccccttcttctcgtacgagccctaattgttttagacaaacgaacgagcttgcagcctgttcactttacacaggaagacatgaattctttgatccatacagtattctttagctcaaccttggagctatttactgaggagatttatttgcagacagacagtagaacagttctttgtgaatagaaatgagtacagcttctatg

SEQ ID NO: 46482 - DNA, 1005 bp, Homo sapiens
agatttattgtagttgaataaactgttgtcctctcacttttatcatataaaccaaagggtcagttgccctttggggaaacccagaatatgtcagatctttgtcaggtcgctgtgggtctttgtcaggtcccaactctgtcacagggattttaggcaactagaaccacaggtgtcacttccaaaattgatagcttgttatactgcaaccagagtcaattttagattggagaagagaaagaaaaagatcggaaatgattgaagctgtgggcaccaagaaagggcagtgctggaaagagaatgaatgacatacacacccaataacagggagcgttggtcatttttgcatggaccaaaacaaaattgaagaagtactgctgatcaaaggccaatacaatgcacacatatcattctggttaggttgtctcctgagaaaaatatttctcagcagcagtatgatttattttgaacaatatctgattgaacagcattctagtaatgtagaaaatttatagacatctactaaattttattctagcagataatccacattaaaagagacaaaagtccatgttttacctagaacctctctgtggctccttttctccaccagaaagacaataatttcatatctggcagaagttaatgctttttaagttcttgacgtgtatactctgtggaagaagtgacctaaaaggaaaaccaaatagtttgataaaggataactgtaaagaacaaaaaaagtaaaacaaactactataagactaatagtccttgagacaagcgcatgaattagtgatgaagtattgctttactacatcctgaaaattctttacatttatttcttcagttgaatgaagctttctaatatctgtgtctggaactaattctgataaccttggcattcaaaatggagataaaggatagatagccttccacaaaacgcttcagtatggcaagaagaatcatctaatattgacaaataaagcaacgtgacatctgtgttga

SEQ ID NO: 46483 - DNA, 1031 bp, Homo sapiens
tattaaaagaacatgccacctacatttttattttttgcctaatttccaagttttgcataatttttcatagcagtgctaacagataaaaataatagatgtcatctttaaaatattcatgttaaaattagttttccaaagcctacataaacaataagtttgactactgagtagattatacttgtcatctagttcatctcccaacaggttaaatggctttaccaagaatctacagcaagttatagggagaagagctgaaagataaatgaggtgagatgagcctggaaaatacccagttttatgttatttcttttttctgtactttaattgctctttagcctgtttctcctgatctcctagggcacaaaatgtatgggtatgtatgcatacagagcattcctggaacttaaacctaaggataactgtgttgaaactgctgacaggataaaaacctcatgtaattaaaactgccaatcacaatcaggacatatattaatgctgttttttttaaagtggttccatgtcatctgttgatgaatttgcaaaacaattatgattacattgacagtgaagaggtatgtatatgaatcagtgtttagaatctagatgcttatttccgtctttgctgaattgaatattttagatggaattaaaagggagctataaattttgcaaagttactgccaaaatatagttacaaattttacaaaaagcatttcttgaaaagcatattctagattattttgtttagcaatttatattttagagttttggaaaaacattatattcaatataattaattcttcttttcttttgaactgtcatagaacttcactctgtaatcttatgtttttagtaaatacagacttaagactttttaatttatttttcttagtttttatttctttccatattgttattaatgttgtttacacaatatgggacaaaaccttttgaatttaaagttataatacagaaaatatttttatgtatcctgtattttctgaccaaataatttagtagtttttttgttg

SEQ ID NO: 46484 - DNA, 1092 bp, Homo sapiens
ctttgtaaaagttcaagaaattatacattttggaataaccactattatagtgttacatatatctataagcaactttgatcactggtattggctatgtaaaattatgttgatcgatactaagatgtttattgaagacagttaatttaattgcattcatacatcattagattttttttcaaagaagctccattttaatgccattttatattattttagaactttctattgtttgtttaccacagatttatatttgagagtaagagttgatattaatacaaatggcatgtgccttttctgatattactcttagaaataagaagaaaatgctgggtgtggtggctcacacctgtaatcccagcactttgggaggctgaggtgggcagatcatgaggtcaggagttcgagaccagcctgaccaacatggtgaaaccctgtctctactaaaaatacaaaaattagctgggcgtggtggcgcatgcctgtaatcccagctactcaggaggctgaggcaagagaattgcttgaacctgggatgtggaggttgcggtgagctgagatcacaccattgcactccagcctgagcaacagagcaagatgccaaaaaaaaaaaaaaaaaaaaaaaaggaagaagaagaaaatgcaaagaaaacaaaaatcagaattgtgagtgttttatgttatgaaacaatacagtggtctatcagcacatgccaattattgctgaagagcagacaataaagcgaccagttaaagccaaatctgtcccttaatgtacatatttagcatctagatggggaagtaaaacacattctcacccacttatcttattattttaataacactatcatagaaatgattgaataaattcagttatggataatttttaagaagcttgaccaaaaaacaattttctggactctggagtttttgtttgtaaaattgttgtgaaatagtgtcctgatagattgtattcttttatttttcgtgaaggctaaactagtcttaaaactattttggaaagagaatggaagattcttttctatatcttgattttggcagtaaccttgtcagccttccagttggccaggaatt

SEQ ID NO: 46485 - DNA, 1078 bp, Homo sapiens
aagggttgattttgaaattttggctgcttgtgtttaagatttgattctcattctcaaacatttacatgtataattttgagaacacattttatttaacacaatatagtaaacagaatgaatcataactatgaacgttttccagaagcatttcttagataaattattttataaaaagaaaaacaacacaacatctaagatttagagtggaagaatatacttgtagttaacttccttgttgatttaaaaaatatatttggatttattttggcagggtgggggaatcatctaataaaaaatttaaagcaaacttcattttttctaaccagagtgaagagacagggagagaatcaaatatgtgtgagctccctctgttgctctgtaacagcattttattcatgatttgtgatgtgataaggaaatttttgctaatgtgtcaaaacaaattcaattttcctttaaggcaatttataactttatttaaatggaatataaaggaagaaccccctatatgtaaaattctgaccttcaaatttatgttaatatttttaaattattaaaacattaaaaatgcatctatttctcaccactaagagggaaaaaaaaaacaaaaaaaaaacttcagctatatttagtaagtactcactgaagtcctaaacattaggataaaatgcagggcctaattgagtaaagtatcaactgggatgatgatagtgaacaggttggcaaatttgccaactggatttatggtaccttttatattaattacataagagtaaaatgtgaactcacaaaatagtaatggcaaaaatgaggagttgttttaaaagtatgtaaatggcattttacaatgctgtgaaatacatttttttttttttttttttgagacggagtctccctctgtcgcccaggctgcagtgcagtggcgcaatctccgctcactgcaagctccgcctcccgggttcacgccattctcctgcctcaggctcctgagtagctgggactacaggcgcccgccaccacgcctggctaatttttttttgtatttttagtagcgatggggtttcaccatgttagccag

SEQ ID NO: 46486 - DNA, 1054 bp, Homo sapiens
aaatcgtttatgtcaaggttaaggagagtatagattctctgctttttgcaagtataaaagagaaaatgtgagtcttctccctgtatttgttcaataaattgaaaggagaaagcttaagcttgtgcttttccctcatggaactatgattatttcagagtaggtcatattgtgggacttaaaactgtaattatagcattgggcagttctctcataataataatagttagcatttatataacccgtttcatcttcaaagcatttcacaggcactaattaatcctcacaacatgtctgtgaggtgagtatcatcatccccattttacagatgtggaaattgattcaagtaagttaagagtcttgccatgggccataggaggaagtcagagtctaaaagcagggtgcaaacttgggagtggccggcgcctaaatccttttccacagccctaaattagaccttctccctttttctccccatctccccgtctttatttctttttttttctaagttctggaaaggactctggcgtttttcctttcagtcttccttttagagagtagtttttttaacactgcccccagaaataaataaatcatcttagtataatagctttaaagatctaatgtgtctaatcaggatataaatatttcggaaagtcaggaaatgaattaggtttgggtgcaagaaaggattccaaattacattttgcctaataaatatcgcatccgtaaacagtaaaagtaatgatagtgattagttaacagtaccaaataaaacgtgcatttaaaatgaacctgaccgggcatttttgtgtcatgctgactgatgtgtacacagtccattctttgaaaaatcaaggcgctcatttgaattgtaaattgccaacactgcaaatagtaaattgcagtagtcttattgtgctgtgatgtgacaaattacaaatggaatattggctaggcttccatatcttgcatttctcttccacttgctgctactatcaccattaatctcttttgcagaagttctatggcaaattgttctggacatggaaaggac

SEQ ID NO: 46487 - DNA, 1017 bp, Homo sapiens
ttaaacatttgaactggactttgtgggaacagttaacgtaggattgggacgtttttctttgaattatttaataattgcctcttgtccgtacttgtgacatctgtgcttctgttttaccaacctggatctcgaaggaacctctgctctgtgttaaaaagtaagcaaattttaactaaagttgcttattcagctcacagtaatgaagagttatgtaaactgttttgcccaagtttacagatgtctgcttatattaggtacttataatagtagatattttgaaaagatttttaaaaagtaatttatggaaataatttatggaaatgttacattagttaaacactaaaacctccgtggctctgtgtgtgtgtgtgtgtgtgtgtgtgtgtgtcacattttacatgccagagagttacatttatattttttcctactttatccattggatgtatattatttcttgaaacactaaggataagaacatgccaaattcagagttacttacaaaagcaaatattattatgctatcactgttatatctttgaaattaaaaacaaatagtatcccaggtatcacttaagtgtattagaatatagatttgattgttagagaaagtcacctattagtacgatgtttttatattttttgtttatttagcattttttagctagcattgggaatcttgttaaaactattgcaaatgctttttaaatatatatgtatatagtgtatacatatgtgtgtatttaattaaatgcaagaatttaatttttacatattatataaatatatatattcatttcaatttgttgcatgttatttattttgaaagttgcttgctgcccaccattgacattttctaaatatgttcttacatataaataatgctagcttaagttcacaatgtggacaatttgaaaagatattctttttctttaggtgagggatgataataattaaagacactgtaattccattgttatatacttttttgagatcataaactgttttaggttatct

SEQ ID NO: 46488 - DNA, 1065 bp, Homo sapiens
ccctcagacctctcttggagcagtacaacctgagtaattgaacatgtcgctggggagtatgcttggttaagctgattcctattatgttgacttgtcagggaccaataattaaagctgaagagcgatgctcattagtgtctgcaagatgattcgaagaatgagaagaagtccttgaggcacacctgcaaaaggcaggcattgcatggaggtgagagcagacggactggcctgcttttctgctatgttagcaagccagcgataaaggggatacactaaattaagtgttgcaaatgtattctccccaatttagattataaaatgcattttacttccgcctttgaacataattttattccaattttattccatgtaatcatattttgctcaattatgcttttaatgctatataagatgttttagaaactagatataagtctattcaaaagcactttgaaaaactttatactatgaatcatttcattcattttcctggaagcatcataataatcaaaatctgctttgcttctttgaactctcaatactctgcacgtaaaacatgtgagttatccagctttgatgataaagactttagtggcatacatttgtcacatttacttcacaaaaatggaatttttaaatgtgtatttaacacgtactaaaccacatacagtatacaagcattggctcccgagaaggccagaggaaaacactacatcataagtatagaatttatatttatcacaacttgagcaaagctgttgacttttggaaacaattcaaactttttagcactggaatgatacagaaactcaatcctaaagctctgagaagcatttttcttcttttgaaatttgccttaggtaggctcactttttacaaatctatcataaaatcatgggatatacaaatatcctaatattttggaatattaagaaaaataatttattggatcttttttctgtaatctggttttgaaaaaagtgctttatagtggtgaagtggcctttttacttccagtgttgtgcctgttaaatttatcctgtgcactttggctggagggatgca

SEQ ID NO: 46489 - DNA, 1050 bp, Homo sapiens
aacctctttcttttgtaaattgctcagtcttggatatgtctttatcagcagcatgaaagcatactaatacaaccagtaaactccagcactgaatctgttctttgcatgggctgacgtttaaattgctagggctaaaaatgctagggatgaggtaataggaagcttggaaatgtggcatacatgcatacttagcatcataaaaaataggaaatgccactagacatgatgaatttctggagatcttagacagaagtgttcccaacttcattaagttgccagatttgctgaatagatatttgtgtgtaaaggactcaaaaatactaggaatatatagcagtaggatacactacttggcctaagaaacatgcagtctgttttgtaaagcagaacacaggcacatgaattggcacaggaatggcatttgccatccttttagacagatatggtagcagtataccatatgaatatcaaaagagcacagaataaataaaggaccatggttttgaataaaaggacgttgattttcaagacctgtacagttgactccgagagatttaaagctagggtcagtctttggatggaggatatgcaggcattgcaggtgtgttaataggcaatttaaatatgctgcttatcagtcagtaaaaaaaagttcagaatttagaatatcacagtatttcaaagcagccattcaggcatattatctttgccatcagtttctctgttaaaaaaaatagttttgtcattctgtagtttttaaaagacaatttcaaaactttcagggggaagcaataattgccaacaggaaccttgacacctagaggttgccaatgtgatcagccttttgaatggtaatcttttaccatccctgtttgagatccacatgtagagtagttgggatatattgaaatcacacttagtgtcttagtcttgaaagttctttttactttattttattttattttttttcagacaaagtctctgtcgtccaggctggaatacagtggtgcaatcatggttcactgcagcctccctcctcccaggctcagg

SEQ ID NO: 46490 - DNA, 1227 bp, Homo sapiens
ccttatcctttaaaaaaataccacattagcattccaaagattctttatcatttctagttatagcagttgttttatcattaacacggtgctttcttatatctagcaggtttgattctagataatttgataactccaaaagcgtatgcaatttgtcataaaactatgttacagaaatataattgtaattatggatttgaaaaatcttaattgtacagaaccccactgagtagatgatgaaaaaaagcagtgattaagtacaggccaataatgggaagatataaatccacaaagtgaattttatgcttccaggagtaagtgtttttcatacttaattgctaaaatgctttgcagcactgagaagaaatattgagaagcaagattagttgtgccaaactataaccttgaattctatggaaaaccagtgcctggatgccttagtggctcagcctctttatctaggggaggtagaacagctaggcttaagcctcgactggccattccttccccactggcttgttttctgattttcatttataatcatctggaaattgaagagctttgattgaacgccagtgggagattttagctttatttcatcaacctttcccaatattaacagtaaattacaactatctttattactgctagattaagttaaattatagtaagatggtttatcatcatgtgtcctttatccctggtcttagactagagtttacagaatatctcacaaatttgaagaataatatacaatgttttatctgtgttagcaagaaatgcaaagccttttttttttttttcctgtctgttttgtgaattgagcttagaactgtcctcgtaattagaaatctggttacttggattctaagcttagagtttcttagttttaagaacacatcacctcataattgtaccataattatgaacgttacaagtagtagtgtttttgtgtctcttactgtcagtgacaagcaaaaaattcgctagaatatattactcttccctaactctgagatggaagacagataatagccatggtgcttgaaacatgtggtgctattgggatgggaaattgtaacagcatttgacatgcaagggtcatgtttgcacctcttcttggatccagtgaaaatgtattagttcattctcactttgcaatgaagaaatatccaagactgggtaatttgcaaaggaaagaggtgtcattgactcacagttctttatggc

SEQ ID NO: 46491 - DNA, 1047 bp, Homo sapiens
aaaatgagtatatcaagatttctgtactcaagttatatacagttagctgtaggtgataagacaggtatggtgacagctaaaatacaatcagacttccataaaagaggtgaagggagacgagaatgattatgattgtttaaagaggaacagatcacattgtgttgagaaaaccgacttagttgtcccaaaaggttttctgagcttgtttcggaaaggaagactggacttttagcaggtgaatatgacagcatgaagggtaagccaatatagaagaaacaatgtaagattacaaggggcattttcaggatataggaaagagaaaagcttgatgaaaagttaggtatagtatagtatggggagctaagacttgacataaaggttaggataattttctaaaatgtttatttgaaaaactttatctcagaaggaaatagggaaccattccaggatttgggcaaaggataatttgatgaaacctttaatagggttaatatgaccatcttacataggttgacatggaaaggaggtggacggggttgaggtgacgaagactcattagtaggctgatctcttactctatgagtaataacagggagcctacactaggataatgatgttgggaagtgatttctgtagctatgctgagcagacagtcttcaagagttagcaaagtttatatgtgcgggtgacaaaaaagaggctttgagttttgatgactgaaaggagacaaataatagctaatctttgataaagactaactatgggcaaggctttactctttgtttgtagtaacttacttaatcctcattataacccctttatatagatgctgtattttctccattttacagagaggaagtagagcctcagagatgttatgtcacttgtcaaaagtcacccagctagtgaatggctggatcaaactggatcatgtccaagtagcctggcttcaaagttcacacgctttactatatttattcttttttttttttcttttgagatggagtttcgctcttgttgcccaggctggagcacaatggcatgatc

SEQ ID NO: 46492 - DNA, 1173 bp, Homo sapiens
attctttttttatgactgaatatattccattgtgtgtatttacctcattttgtttattcatttatctgtcgttggacacctaggctgattccgtatcttgattattgtcaatagtgctgcagtgaacatgggggtacaggtgtctctttaatatactaatttcctttcctttggaaaaatactcaggagagggattgctagatcatgtatgtagctctgtttgcggtttttttgaggagcctccatactgttctccatagtggctgccctagtttacactcccacccacattaatagcacttgaaaaacgacaacaacaatgtttttgtaacctaggctgtttgtgaggtctggcatagttctgctggcccaggtttctaaagcaggtgaagcagatgtatcttagtgaattggactgtaggtttgcagctactgtgaaatgttatcctttagtgcagtatctgttcattatttcctatataactatcttttgcttggcttctcttttccatggactgcatgagtcaggacataacagggcccccaaaagaacccattgttgagcattcttagatgttggaagtgaagagtatacagaaggtggcccaagtttcaggagcacagggccagaatgattcaaaaatgaggtatgtagtgttgatgtgaatctggtaattttccggcagagcccagtctgatgggtccattttacaggcacattaatacctaaaatgccacaacgaggttttattttggatttttggggattttgttattttcaccaaaaaggtaaatattatctccattgtctctcatatatatatatatatatattttttttttttcttctctcccttccattagatactgttcaaaactttccttaagtgtttgtaagcaaaggcattgattagtagactgctctgcttgttaactcaaggaagcttggcaagctaggtactgctgtatctagttgtgttatcagtttaaggaaaggcaaattgtttcattgatgtttgaagaccctttttccttttggagaagcaatactacttatagacttttattatgaactataatttacaaatacaaggaagtctggaacacagctttatatcagtggttaggagtgaagcaaaggaatcttagttttgtttttttctgatgacagca

SEQ ID NO: 46493 - DNA, 1029 bp, Homo sapiens
agaagcctggtctaaattttagtataggttattgaaaagttcatattgctccaggcttttgacagtaatgttgtctttttaatatgttttctgtccttcagttagaactgataatataaggagaaaggagttgttcaagtctcaagagcactttatagcaaattgccttttctgcttcacctagtggtgttcaatagcctgaaagattgagcagtttaacagtttactgcttaaatgtcaagctttactcttttttcattaatagtagtaagacccagagtcttaagattctgaataacaataatagtaagatcattacctgtattttattaaagccttgggagttaggagatgtcttgtgagtttattcattaagttgcttagagccatgatgtagctagtaatacagtttatgggtactggtccctgcgttggtgtcatttgaggactttgttaaagttaaacatttagattctcagattatgcccaggatattctggttcagtgggataagaaagacttggaatctctatcgctgagaaagaaactctttgggttgcaatgctgcccagcctgttttgcaaaccattgctgtagtcagtttcttttttctctgttagaagaccttttccatcccctgtgttttcatttggcatatcgtcagtagttaacatttatataaaattagaaaggtaggaagtggaaagtagaaaaatataacattgttctgggagtttgaagccctgtgttcttgacttgatatagataaaatgggcaaggcactctttctccattttactatctgtgaaatgggccgtatacttcagtggaacatgagaacctgtagacatgagtgctttgaactttcaaaagaagtgtgaattgagcttgtttttacaaccttgttgtaatatccttccgttaaaatgtgttttccttttcgacataaaacctgggtctcacggaaaacttacccctgcactttctgtttcctttgtactttattcctatccccactcttctctgtgt

SEQ ID NO: 46494 - DNA, 1060 bp, Homo sapiens
caggacatcaattcttcaaggcctgttttactaaatgggacctatgatgtgcaggtttgtactttgtattgtctctttgtacagaaaaagttattagaaatgaaatgtgaattcttatattcatgttaaaaccaaggtcccagtaccagacaggtagcctgctagatctagcagaagagatggacacactccatagctacttcatacaagtatattcagagttgtctaaagacaacttttagcctcttattgtggaaaacaatcctagcatttttttaaatttgggaaagtcttttcatggaattagctaagcttcacaattctgggcatatgtcatggtaatttgatgttttcacagtcttccaaaaatgttactaatctttatggttgcacatgataataattcatgccttgttccagttttagattataaggcttttgctataatctttctttcagtgaggatatttcctgtatcttggattaggatttgattttatattcatcctgacggttcatattgatggttgcagagatagtcctgaaaaggcaaaataattgcaaatgaaaactgggatataacattttatgttgattagaaagaagtaaatgttattttaagtattagggacagcagaatgaccttggtaggggccaataaagcattcctttctgcatttaaggaaaatggcaataatttatgaaagcatttagtaataatttagatttttacttttattaaaaacagcctacctttttgttctatctttctgtctttagtttatggcatatgtgaaatggaaaaaagaaactgttaccattttgaatagaacgaaacatggaactgagtctaaataaatgtatacatttaattttagtaattttagcatagtcaaaattcatggtcagcttgagaaagtgtattagtttttgttacagtttgtagatttttattgtattataaggccagggggatttcaaaacatattagctttactagtaactttttttaggaatgattagaagtacccagagaactaatgaaataaatcccttaaaa

SEQ ID NO: 46495 - DNA, 1029 bp, Homo sapiens
ctcctgactgctaaacactttagatagttctacttgtttttgaactttacacgtgtccatatacattgaaagcatgcattcgtttgtgtctgccatgacacactcagcatcatgtttgtaaaattcattcatgttgtatgtagtttgttcatttgtattgtaccatagtattctgttgtatgaacaggtattgtattttataatcatatgccacaactttaaaaaatctattctactgctgatacagatttagcttgtttccagtttgagaaattcaggaagtaatactgtgagaattggtgtgtgtgtgtgtgcacgtgtgtttgtgtgtgtacgcgcattttaaaattaaacttctggttttgtgtccttctgaatgttttaagtttcttggcgtctaatccagatgtttgaggcttttctgtattctttttatgttccaggctattctcttaaaagataaactatttattttttatgtattatgctacttgtatagtatattttgagttttggaatgttggagaatacagaatgaaaaatttgtaaataaaacatatgtatatataagtgcatatatttatggtaaacattatatatttaataaacctattacataccatatgatgttcatgtataaaacatacataatcatccaaatatacaaacatgcaaattcattttactgattatggtactcttattatagaattatcactatatagagaatgtgccactttttaatgaactttcctctgtgtaatcagtctacagatatttttgatgtgtaaagttacacagacatttatggaatctaaatcaaaccaacatggctgtgatttaccattttaaaaaataaattcagtagttcttatgtctcacgacttgtacatttcttgatctgtgcccatggacctagagctatgatatctgattcttttttcagccgaaataaggagaaaattaatgccttgattccttggatgtcgtgatttggtttgttattatgttgttgagacaactttagca

SEQ ID NO: 46496 - DNA, 1025 bp, Homo sapiens
tagtactatgatttgcttattcctgtgaacacgaacaacactgacagataacagttttgaacagtagacctgtgtcttttaaaagcttaaaactccatgcacatcattttgtcgttgcaaagacttctaaaggcaggcatggggaggcattgtggagtagggagaggatattatgtccttcagtgatttaaggaaatgcatgttttccatcatgaaagaaaagataatcattatcaaattcagaggagattgttttatcattcccataatgaacctgtgtctcttttaccaattaacatatagatggatattaggagaaaccaggttcaggtagaaagaggtacataaaattaataatccatcacgaggaatttctgcaaagtgccttttatagagaattttttttcttggaaatttttgaaattatcaagtataaagttgatgcttaaattatgttttaatctttcttaagactttctctggatgcagattatggaattaaggtgttttgatactgtgaaagtatgtgttgctaatactgtaacatactgtacatttactatactgtcaataatatatgtaactactactgagtattgactactttaagaagttaaggtctctcagtttgtcacaagagacattagtcttatatcaagggtttacctcatgaagtgacataggcaggcgactgacattccactaccagtattagactttttatttatttatttaatttttgagatagggtctcactctgttccccaagctggagtgcagtggcacgatctcagctcactgcgacctctgcctcccaagctcaagcaatcctcctgcctcagcctctggagtacctggaactacaggcatgtgccaccacgcctggttaattttttttttttttgtagagattgggtttcaccatgtcacccaggctggtttccaactcctggactcaagtggtccaccgacttggccttccaaagtgctgggattacaggcgtgaaccaccacgcctggccatt

SEQ ID NO: 46497 - DNA, 1086 bp, Homo sapiens
cagaacctttcttgaggggtagtattttagagataatgttttgtggttctcactggatattttagaagttttattttgattatgtggaatatatcctacatgatcataagcacttcgttaataaaaatggtttgttattactgagatcacccagtttttcggcaggagaataataaatagaagttgtgtgattccatagccactgtagggtgtactctagagcagagtgattctgggttataaccacatatcctaaatttcaagctaatagtgtgtatgtgtgtgcgtgtgtatatatatgtaattacctcgttttattgcactttccatttattacactccacagatgttaccttttttataaataaagatttgtggcaaccctgtgtcaagcaaatctatcagcaccatttttttcaaaaatatgtgtttaccttatgtctctttgtcacatttggaaaattcctgctatatttcagaccttttcattgttattatattatatctgagttggtggtctgtgatctttgatgtcactattgttattgttttggggagccatgaatggtacccacgtaagatggcaaacttaattgataaatgtgtttgttttgagtgctccactgtctggctgttcccttgtctctctggtgctcgttggtcctccctattccctgagacataatgattttgaaattcaacctattaataaccctacaatgacctctaagtgttaaagtgaaaagaagggtttcatgtctctcactttaaattgaaagctagaaatgattatgcttagtgaggaaggcatgctgaaaaagagagaagccaaaaactaggcctcttgtgccacatggccaggttgtgaatgcaaaggaaaagtgcttgaaggaaattaaaagtgccactctgttgaacacacacatgataagaaagcaaaaacagccttattgctgatatggagaaagttttagtggttgggtagaagatcaagccagccacgacattccctcagggcacagcctaatccagagcaaggccctctgtttgattcggtgaaagctgagagagagataaagaagttgc

SEQ ID NO: 46498 - DNA, 1915 bp, Homo sapiens
tatgcttttaggtttttatccaaatgaaataacttctgagccttcacctctagacctaacttggttctgagttcccatatcagtggccttcagcctccgtaagtacttgcttttaaacttgtctatcatccttaatttggcattcaggacccttcagtttgcccccaatttaccagttccaaatgtactacatcatgtgtctatccttactatagtgctttctagtcctagaacattctcacaccgacttttgttcatattcttccctccttatgaaatgccttctacgcaaccttaactacagggattctatctgttcctcggcatgttcacttctgtattcttcttcctgaaacgctctacctccgctcatttaggttaaaacatccccgccttgtgctcctgtttatgtgtggctttagcatagctcataccagaagctaccgggcatcatgaacctgaggagagtgagagcatacgtaattcatttttgttccctttacaaatgacttggatgcagtagttctcaaaagtgttgcattaaataggaacataggggaagaacactttggctggcaacatagactttcaggtactgagaaaattgtgaaattggtttgtcaggtttcagaggaaaataaagattatctggtattgcataagttctagatgtttcttgatgtttgccctaatatatcgttcctaaggtaggataccactggttgcaacggagtatgttgtattttgcagtgtgcttgcaaatcctgccttttatcgattaatgtcatttagcgaagtgggacagtgtcagtgaaactaaggcaaaggggaagcctgaattcatttgaaaagtataaaaaaaggagaacacaggcagccttgtactttactgatattatatgtgagacactatgaactaatcagagatgcaagatgatacatggtgtgtccttaattgaggataacagtgttaggctctaaggtcatgagtcagaaatgtgcctttttaacgtccatgttttgaatgttctcaggcccaaaggttgtgttgtgatgtttgaggacaatggcttatgtcttggcttcaggatgaaagttacttgtaagtgggcccaatgcttgcatgctgagggggcaagggtgatttagagtcaggagatctaacatgaatattgatgagtagggttaggagctgagcacaaccataggtaatgttgctttgagatgcccaggtttatggcagcaagaggatattggattcctctttgctcaaatatttttaatattcacgtttccctcagtgatagccaatcaagtgataactgaataatagctgctgagacgtttttcatgttggaacaacaatgcctctgagatttctttgaatgtttgatttttactaatcacttttaatttcatcttaaaagcctgggaacaattttgaagtttaagaacttttttttttaacttaaaagaattattttatctgacaattgggaagtccctttgatttaacatttaactctgttaagcacctaaatattactttaaacagctctggaaaattaagccctgctattattgtacattcccaatctctatggacatgggaccatgaaggagaaatcaaggagatctatttaatgaatttctttgcttctaggacagttcattacttgtaggacttgcacttatctatgccttctttaaaaacaaaacattccaaagcttcctagaaaccttagctaattgcattataccaacatgcttttctgatgtcaccttatgtctgtaagcaactttacaaatcctttgaaagagatagttggatttttaaaagtaatatctgcttggattttgcaaattaagccacagtagaaacagtttcactgtagagtacatgctagttaataag

SEQ ID NO: 46499 - DNA, 1027 bp, Homo sapiens
ttgcctgtaaaatgcaaatgaattttgcacttattttgttttattttctcttgtgttttcagaaatgttttgatgcatcagaaattgagagatcagtgatttcagttctcctgtcacacctttttatgataaaatattttggtcatttctaaggagtagttagagggaaatcctttcataaatcattttcacttcaaaaaaacagtgatgttggaaaatcatatagtattctttgtgattagttgaaaattatgaatggtgtaaaataatatgacatttaattgtttctcatttagacatgatgcattttatatctcaaaatttgatgggaggaaaaagaaaaaaaagaactcacaacttttaccaggtttgaaactagcttaagatagttctgtggaattctccaaaagtgataagaaaatttaaaatactgcccagacacagggttaaaaattaaatctgtatgtagagtggagactttaatctgacatattttaatgtaaagacattttagaataaagaaagctttctctggttttgtcggctgtttttgtttttcgactgctttgcatgagacgatcggcattcttaaattataattatgtgtaaaaacaaataagctgctactgtaaaaagtaacagctctgcacatatatcttgaatactactagaaaacattttcattagaggaataaatgcattaggccctaaataaatttaagataccaaattgcaaacttagtatctctaatacattacccatgctagtccctgcaaagtggaattgattctgagagagctcattatttccgttgctagtagagtgtatttaacaatattttggtgtctccaccggtagaaatgtggacatttcaaccagctatccccttgtttggttcctgtgatgtcaggcaaacattttgccaaaatgtttggtccgatgtaatcacatcggtgttgtgtaattaagataatgtgctgattttgaatcttgttaacgtgttattttgaaagtgtaattttaaaa

SEQ ID NO: 46500 - DNA, 1009 bp, Homo sapiens
caaatttttcttaaacatttactattttgagagtttcaaaaaggggagttagacgccacatttaataattctttggttagaacaaggtattaatattgtgtgtaatacattttctacaaaatattttttcattaaagaataaaaggaaacccctgatgatttaaaagcctaattttgttttgctttatatgtgaactgaatgaattttaaatctggaatcctgttccctattgctaataaattgttatgtagacatttgtttccaaaacggcttgtttttgatgttggtaacatcattaaaaagttttttcttttaatttcctcttccccatcatccagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatggttagtaggaggtttattattcttttttcccttaatattattactactatttttgctttctgtcctttttgcctctaagagcagtctggcaggccttctcaagtaaataccaaccctgtttctgcagcagcctcagcagcagctcagtctagacagggtttccttctttctgtttatttttcttgctatcagagccctgatgtgtacattttggaatgctggagtagctgcttcatttctattcctccatctcccctccctcattgaaggggctggtggaactagaccagatgtctaacaaaccccgattgctagagtgtctggctctgtacgtgactgaccaatcataatacggtgtgccaagttttttttatacctctgacaacagcgtacaaaacctggactgtttcttagcacaaagatttttttcttttcggcctatttaatggtgtttcctcaagctctccagaccagatgttctgtgctgtatcagaactgtagg

SEQ ID NO: 46501 - DNA, 1492 bp, Homo sapiens
gaagtttgtattagtgtttgcacaagctatcagaaaacttctgttccaggaggaataacataaaaggtaattgtgtctaacccagaaaaccttaacattcaaaatagaaactttaaatgttgtacctcctcttttttttttttttttgagacagtctttctctgtcacccaggctgcagtgcagtggcgtgatctctgcttgctgcatcctccgcctcctgggttcaagcaattctgcttcagcctcccaggtagctggaattacaagcgtgcacaactacacccagctaatttttgtatttttagtagagacgggctttcgccatgttgtccaggctggtctcgaactcctggcctaaagtgatcctcctgccttgtccttctaaagtgctgggattacaggtgtgaaccattgtgcctggcctaaaagggcatttcttttataggcttttttttttttcctattaaaatagagcttcctgttggtggtattttgaggcaaaatttagatgactgaagaacatggtatgtcaggcagaaaatgcatggggattatgtagtacatattaactgaccaaaggaaacaacacttgagagtccatatatttgggatgtcttggggctttttagacagagtaatacccagcacctccccccactcctcttcccccaggtttgtaggagcttggggagtgagtcaaaaccaaaaggtggcatttggtcttgaactgcagtcagctgttagtactgctggcaacatttctttcaaagtgtggtatatgtgtgtttcttgtggatgcagtctgcaaatggattgttatttatgaatggtaaattaaagttgtttttacatttcctaactaagtagtttaaccaatgtttgctctcattgggagttgccatcaaacttagtaacgtagtaaactgtgtttgagctagggttataaaatgcccctttgatctaagaatactgaggggcaacagagttgactgaacagtaagcattagggttgaatgtattcccagagacagagcagtatcactgattttggtgaaaattagtatggacttagccatgatacattttcattttgcttatcagagcctttaatgtgttgagaataatgggtttctgattcatttgcttaatttaacagaggaaaagtattttctacctgtttttactttttatttaaaatgagtgcagagagcagagataatctttgaatatttgctgtgtgtgattatagtaagcattttttcttctacatactgagaattataagaaaaatacattataattagatcctaatgtcaatcacacctggaagtggcagttaggatcaaagtaatgttatagcagtctacaaggattagtacattctgtgccccttttcctaggcttaaatgtctgctattacagccttttcagtaagtgccttagctcagttagaacttcttttcaaattgttttgttttgtttatttagaga

SEQ ID NO: 46502 - DNA, 1055 bp, Homo sapiens
ggagtaagagatactagtgtcgactgttaacatattttgtttaagttttgaaaagaaaagcagagttgtagaatcaatcctttcagaggctaaaatatgaattgacaaaactgtaattaaaatattgatgtatttagagtagtttttcccagcatagggttatttttgtgtgactgaggttggagagaataagtttgtatggtgatgttatttgcagtgctctctgtgcaagttagtcatgttttacattggagaaaatctctgcttagttacttgcttcctcaaatctcaccttccttctcagctttcctgcagcccacacctagggtaaaactgctggaaacctagtctgtggttactattttgcctttgtattgctttagagctcagagaagagttgaatttggacagagaaagcttttaatattttttagacagatggggacattttgtgaatagacatgtgtttacttattattttgtcttaccccctatctgtatgactagtcagtgatcgttgtggtctgtttgacagattttttcaaaactctctttcttttgttgcatttttaaaaatgatatatttttggtagaactgttagaaataatatgtagacagtttgggggcatgttttgaaatttactgcagaaaaatagcatgtttacctagtgacctcatatcgttgtggtcaagtgtggaggtataataaaatgtttcaaatatccagaaaaaaaaattagtccactgtaattcacttcagcatttagccagcaaattacttgagtgggaagtaaaaaagatacaaagacaccaaatcctgcttactgcctcagaagattttaagtgggagagacaagtgtgtacataaaaaaattgtaaaacagaattgatataagtccagactacggaaggaaaaaatgatgcgaacactcagctatcagccactaattcctttcggggatgacttcacaggagaggtgaagtttgattctatagatagatgtcagttgcaattttaagaaactgttaaacaagaaagttgtgtcttttgaat

SEQ ID NO: 46503 - DNA, 1022 bp, Homo sapiens
gattgttaatgcagtttctttggtttacaagtgaggagcttgagaggtttaagttttttgtttggttactgggttggtggcacagttggaagtagaatctattccagaacagttaacactgtcacacagttttctcaggtaattaattttttaaatcatattcttggtttagaatatgaagaaataatattcattgcaattatggtaggcgaacgaaacaaaatatattactaattctagatcattggaagctaacttcttttacgagcttgaagtacttgaattgaccaatgttttatttcacgaacatgtactttattttttaaatttctacaagctctttattttcaaagttttaaaagaatgtttatttcaaaagtttcacatggaataagaagcacagattattatcctaattttacagattggaaaactgagaacagaagaataactgtgtgtttggatttacataggtagacttcgcgagagtagattttttaaaaaaaatgatcatttaggacctttaactgataagaaaaacaaaacctcaattctttggttttcctgccagttttctctgcttcttcacttgggttagagaaaaagcaagctgcagaataagcactacatgctgctatttgtgtgaaatttaaaaaaatataatactacatactgataaaagatacatacatatgtagtaagagtataaacatgcatgagaataataaacaccaaattcagggtaatagttacgtctggaaggggaggtatagaggggacacagaagacttcagctttattggtaaaattaagttagctagcaaggacacaagtgtatgttatttgtgttagtccattttcatgctgctgataaagacataccccacactggctaacttacaaagaaaaaggtttaatggattcacagttccacatggctgggaaggcctcacaatcatggtggaaggtgaaaggcacgtcttacttggtggcaggcaagaaagaaaatgagaaccaagtga

SEQ ID NO: 46504 - DNA, 1034 bp, Homo sapiens
ttcaggtgtcccgataattgagacctttatctctgtgtcttattgatagttttgtcatttatgtgtctattaacaggatcactttctcaataatagcctcaggttgagggggtattctttgatttggctgaaggaactcctggatgccagaccatggggaagctttgatttaagagcataactgctgtagatggacgtttttgacatgtaatcaaactcctggagtttcagatctgcgtttagattatgtgagctttattatttatgtaagggtaaaggaaaggatttgtaagacatttatttattcctcttatttaatttgtggttttgcaaacctagtacagtttcttttgttttttcttagaaataaaggaaataataaactaggatggttgttaagctcccttctgtgtgtgtatgttttaggtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaaggtaagggtgttcatcacaagtgtgtctttgcagtgcatacaaatggatattgacacaggtctcaccataacttttgataatgtgtgaattgggaatctgtcaggctagcctacttcacttgatgtctgatactttgggaaaattatataaattctgggaaatgagggtttatactatagacatcattagtttggcctttacttatttggaatttgtgattctgatttgtcatagattggataggaactgtgctgatgttgactttgtcaacatgaaatcagcttgctaaataaagttttgagggacaaagatcatccttatgtgtctgttatccattcccttctatcctcttttgaataagtcagtgtttagaaagagatggagttcaattttctgcttcagaaagaagatactcctcaagcatttcagaaattttatttttgtactatag

SEQ ID NO: 46505 - DNA, 1047 bp, Homo sapiens
atcctactgtaaggcatttccatgacattacttcttgaactaaagaactgaggttttagtgtgtatgtaggaaataggacgatcataaaatgtcacaatgaagaatgagctagcttagttttgataatagtgattttttcctgagtactttatcagattatattaaaatgacaagatcataaatattaaagttggaaattattttagtgattgagtctttcctgaatgctttcttttttggacagccttcagtactagagagaatttatccttagagttgaaatcttctttccagaaactgtcacctgtggttcttaggttttgccttcaaagtaagactaatcctctaagcagccaaagaactcttcagtatttggaaagtgctttttttgagtgtcccttgcctagagagagatttgcattaattttactggttctcatcacaggattttaagctttctctcttgtaattacccttttctgtggattcttactcatactgattgttttttgtgcttttctcatttcttagtttggtactgttactggtaaattttctcttgggtcattgtaaagaactgaggataacagttcagtgatgtcgaaagagcgagataattatttcttttacttggagcgctgtattctattgatactacataaaattgcattggctgtttggcaagcatgtcaagcctggtgtgctgtttggttacattatccttactgatccctttagaattcacttttgttagagttaagacagttttcaatatagtttgaactgtaataacttgttttaaaatatattaatttttttattgctattttcttcataactggaaatgaggttattttcatctggcttctttatgaaactgtgctggtcctagtcaccagtattcccttttgcatatgtaggaatcagctgtttaggaatcacttctagaatttgtctgaagaactatgttaagctcatatatcttctaatatctcttgtttactttgatttcagtagtggtttagcaatctcattagtaggggtaa

SEQ ID NO: 46506 - DNA, 1069 bp, Homo sapiens
ggatctcagctcactgcatcctccgcctcccaggttcaagtgattctcctgcattcagcctcccgagtagctggggttacaggtgccagccaccatatctggccaatattttgtgtttttagtagagatgggtttcaccatgttggccagagtggtctcgaactcctgacctcaggtaatcggtctgcctcagcctcccagagtgctgggattacaggcacaagccactgcgcccagccctattaatttttaaaactttatttttgggttatgggcttttttgggaatttgaagaatgacaaagtcttttttttttcttccccagggaaatgccttcaagtacgtagatagaaaatattgctgatgattttaagaggttcgtagatcttttcaaatgcctacctgtccttcaggtttgaatgtttgtttttagggcttgcacactttgagaagtatgctttttgatatagaatattgggtagtgtgaatttttaaaaaaatcatgtctttttgggcagggagatggtaaatattttaacattttccaatttctttgaatttgttttacgtaaacaggcttttctaggaacaaattatctgttgtctaaataatctcattaaattccaaaatactgtaaacagcaaaattctaagcagtatactttgtcttcaacaataatacaatttaatttatttttggtgacctaggtttattaaaaacatgagtcaatagatatttattttatattatacataataggtagggttatagttgtggttcttagctctttgggtattatagcatctcaggggacctttgaactctgaaattgagagtaaaattgggagtcagcgcatgtatgaattgtttcttcatcagacttttaaagtgtgtacagttttgttcagttaaggtatttatacaaaataaattccaccttttttttttgtgagacggagtcttgctctgtcgcccaggctggagtgcaaaggcgcgatctcggctccctgcaaactctgcctccccggttgaaacggttcccctgcctcagcctcccaagtagctgga

SEQ ID NO: 46507 - DNA, 1035 bp, Homo sapiens
atgacaaactgtacttgtttcatcaaaactgaaagggctgaagtggatgcttaaatatgctggagtaatatgccatattcttgttaatgttggtaccatgctcaagcatataagagaaaaattggattcaggaaaaacagtgataactcagtattaacttagtcaaaatatatatatttttaatcctttgagtctttgaccctttaaacatcagctgcattttggcataaaattttaagattttctttgcctccaaaatagtacctaaagtggtacttaagtgccacagatgtttattgtatcttgaggcttactgtttgttttttttttttttaatactttctatgtttccacctctccctgtcgccatctgattttatttcctgtccattagtgataaccactgtctacccaagtcatgaaggcttctggtatcgtctttgactatttcttgaggtttttcctaagatcacttacttagttctttgaatttataactacattgtctgtactgttcagttcttgcactctttctcaactatcaccaaagcctgtataactggtcttacagactttattttgtacttggacagtgctgctgactaagttatcttctcaatggacagctgtagtcctaaaactcaaccctttggaaaatcactattacacacaaaataaaatcaaactttatttcccaacttatttatatatgtgtgtgtgtgtgtgtgtgtgtgtgtgtgtgtgtgtgtttatatatatatatatatatatatatatatgtatgtatttttgagacagggtatcgctctgtcgcccaggctggagtgcagtggtgcgatctcggctcgctgcagcctccacctctggggctcaagtgatcctcccaccttagcctccctagtagctgggaccataatgggtgcatgttaccacacctagctaatttttgtttttgttttgtatttttagtagagatggggtttcgccatgttgaccaggctagtcttgaactcctggcctcaagtgatccgcctg

SEQ ID NO: 46508 - DNA, 1034 bp, Homo sapiens
tgtgatctccacctcctaggttcaagcgattctcgtgcccctcagcctcccgagtagctgtgtgccaccatgccctgctaatttttgtatttttagtagagacggggtgttgccatgttggccagactggtcttgaactcccggcctcaagcaatccacccgccccagcctcccaaagtgctgagattatagggatgagacaccacactgggccagacttttccgtttttatgttcctcccaagatttggataaacctgcaaacatcctgggccattggtcctttctgttaaggtcagacaccttattgaaattcattgccatttgctttttgacagtgcttactgtgttcgtgacatatatgctagtgatgacaatctatcatttgtttcttgtagctgtcttcttgggtattatttaaggcagcatatgcagtacttctcatggaggagatgacttaataaatcagttatgatctctaggccttagtttgatatgaagatagtgaatggccttcctactgtaataaagagaacctgaatgggtaatttcttacattgttgatatgatttttagtagtagatattgattttaatagttggtaatagttactgttggattccaaactggatggtttcccaagtaaatggaatatgatcaaaatattttaactttagttgttacagcaaatctggcctggatttatatggttaatgcctcacatatctatttaacattaaaaggtgtgggtgtacaataagcattttttatcttttgccttcttgtcaccttttgcttcaactggtttctgtatatgataaatttggatcttttgttcaatatcttggacttcattggtttggctgagcaactccaggtattttaagtcttggcagcaatgctctggacttgcagctcagtcctagcccataccttggagaaaaaagcctctacaaagcatgaagtttgaaaagaatctttgcaagttcttatttttgtgtttagattttcttttacttcatcaagtctaccata

SEQ ID NO: 46509 - DNA, 1050 bp, Homo sapiens
ggctccatctctaacactgggaaattacgtttcagcatgagatttggaggggacaaatattcaaactgtatcagcatcctcactgaattactactttattatacagattaagttacccttttttggttttatttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagc

SEQ ID NO: 46510 - DNA, 1037 bp, Homo sapiens
agcagcatcagcagcgtgatgttatcggtttgttctgttggaatagttccttgatgaagttcacatgagtatttggcttaaaatttacctttatactgtcagagtgaaagaaatgaggaatcaaagatatactcaaatgtttgggcagggaaatgcattggatctgattgccttatttaagtatgaagcctcctgtctttccagagttttaaggttcagaactggcagggtagatagtctgctaaagaattgtcctacattgtactgagggtaggacttgtccttttaagatcccctttcccctttacgtatattgctaaaaattgagtaaatctttatggagctaaaattttatctggccttcttcattaaagaaagcattatgtatgtcttagtgtactagtttaaaaaataaatggttctataatactgttcaaaactgtatgacctatgttttctcttcatatgaccaattgcagatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctgtaagtaagcaaatctatccattaagtcatttgaaggtattcatacagtcagtagcaagtggtatttagggaggccttttaaagtatcttggttttgacagaaaatggtaaggaatgagtccagaggaagaagagcaacaggatatagacagtccactcggagtgagagaatatgttctgggagtcggtgcagtctttcctgactctttttgaatagtattgctttagagtgctccagagtgagcatccttgactctgaagttggttctgatttattatttggcaaacattcctgcacaccttcagtactaggcagttttaggtcatcttattaagtaatcagaataaacttcaaatacctgagaaaatgtaaagcagtatctgtctgcttcattcaaactttgactac

SEQ ID NO: 46511 - DNA, 1046 bp, Homo sapiens
attccagcataaacagaatttctttattaagttgtaaagttttggaaacagttgctaattctgagtcttgaacagcttttagatatatatgagtgaattgtgatcagttggttcaataggacatttcggtaaaactagcctcttaaaatgttgtaacaaaacctaaatatgcttatctcagaatgctaaattttattagtacttaaaactgttctgtttgtgtttgatagctgtgttaagtaaaatattttttaaaatagataaataaactagaaaatacaaatgaagaatgagaatttttttttatataccaagtgttttatacttttataaactacctggaggagaaacagataaaagttgagtatacgtttaaattttatcccttttaacataattttgtttttccattgattggctgttgtggtttggcatttctttttcaaattataactaacttacattccctatttcagatgacaaacttattagtaataatgatggcggtatctttgatgatccccctgccctctctgaggcaggggtgatgttgccagagcagcctgcacatgacgatatggatgaggatgataatgtatcaagtaagcatttcatgttcagtgattctggggatgattgtatggcatccagaaagatacttaccatagaagatgacaaactaaaagttgtagtttttagtgaattataaatatctttaagtacagtgcttatgattactggttctgattctatgtttaatcttgcacccctccccatttttttggccaattgggttcaagtctggcggggctttcccattaactagaaaaatattttttcttagtaataacaggatttctttccatttcatgaagagatttttctcctccccatttgtgggatatatgttatataccaaagctttttgtgactttttttttttttttttttttttacagtgggtgggcctgatagtcctgattcagtggatcccgttgaaccaatgccaaccatgactgatcaaacaacacttgttccaaatgagg

SEQ ID NO: 46512 - DNA, 1028 bp, Homo sapiens
ccatacctcattttacctactcctaggctaaactctgaaccagactaatccagaaagaaagcttttgcccaaacaccactttttgaaagttgctagttctagataagataatagcagaggttttttttccctcctttgttcttaggtgaaggttcaatcaatattaattttaaattttataacaccacataaaaatagattctgtttttccattaggagcaacattttactttgaatttttttaaaattagggattcattgtctgataaattctgaatttgatcacaaatttggtataattttggatgtctaaaaatgtatggccatatacatcatcatttatgctgtaagtcacataaaatgctcataaatacagaacctgagagtcataagtagggtcctagagtgctgtagaaaatacacataaaatttaaaatacaacattttcttttacaaataacaatatactaatcataatttaaacattaagcaaatgtttaaaagctttttttgttaccttagaacttgttgtgctttatggcgtggtttgggaaagtatctggggatgtttgagttcatattgccttgttctttcagtaaattttccttatggctagaggaattttgaatacttgtgtttagatggagtcttatctcattgttttatcaactactgcttttccacatactgtatcccatgttaatgttgatcaagatctgcctcgaaaaaaggttgggagtatattttctggtgaaaaaaagctatggatactattgttctttatcaattagtatgctttccaaacttttttttttaaatcggtatgctttccaattaatggaaacttagttaaaaagtagcttaaacaataagggaaataacaggcttaattaactaaaattttggaaacagggagatctgagattggtccagcagcttgattatgtcatccaagaactctccatccttagtgtgttagcttcctgtcctcatactttagcattgtggtttacagggtgactgcatg

SEQ ID NO: 46513 - DNA, 1024 bp, Homo sapiens
acaaaattagaaatgtagaacaggtggtgtttgtcaagacttagaaatggcagagagagagggatgaatgtgatgagttttgtagtgatggaatagctgtgtatctttttgcagtggtgattatacacatctgcatatgtgacaaaatggtataaaagtctgtagacacattgaatcaatgtcagtgccctggttttgatactatattgtagttatttaagatgtcaccattgggagaaactaggtttaaaaaagtacatgggacctgctatctatgactccctgtgactctatttcaaattaaaattttatgtattgtacatgcacttgattttatttctgtaaagcaaggcatatatcattttctagtcgtggacattttagaaaaaaatcagaacaatagatttgttttaaatctggaaattcattctctgaagtagatttcttttaaatccgtgaaagaggggaattaaatgatataaaggaaatatcctgcagttaatgtactcttctgaactggggttttcaagcggcctttcttaatacattagagtgctgaaggaaagtagaatgtcagtaacatatttgtgattccaagactttcagtcataagataaatctgctgtaccattgtccctgatttaatatttaaattataagtagataaatgctttgtaagttcttaagttaagaaaactatatatataattctttaccttttttgaacttcgatttttctaaactacccacctgtaaaatggggccagcccatctgcttagctttgcttggtggaatatgaaatgcttagtacagtacttttcgtgtagtagcaattttacagataatttatcccagaatcgcgatttttaatggcattctaaaaatggaaatttccacagatttttatctgtgcctgagtatctttcttcatagattttcttttcttgccatgaaaaatatattctctagctcttggccagtaaacagactatttctactgtcaatcaagatagaaatgaaaca

SEQ ID NO: 46514 - DNA, 1049 bp, Homo sapiens
ttgtattcttgtttaaagttgtactgtacaattgtcccttgatattaaaggggaattggttccagaaccaaaaccacgaatgctcaagtcgcttatatgaaatagtgtagtatttgcatataacctactaacatcccatatacttcaaatcatctccatttatgatattacaatgtaaatgctatgttaatagttaatatagttgttatagttttttattagtagtattttttattattgtgtttttttgtccccccctccaacaatttttgatcctgggttggtttagtccatggatgcaagaagccatggataaggaggaccgactatattccgttgtttgggtttattaatttttcatatcacttattgatggccaagtaggttatttcgaatgttctgttctgctctggcaaggcagcatagtgttgtagttagaagtgtggattctgaagttcaagttccacttccattaaatactagtgacatttacttatcttcatctgttttctccatctctaaaatgggccagtaatttacttctgtaggacagtcatgaagaggttggatacataaaacacgtagtgcttagtaagttttcttaggattttttcgtgtttggttttttggttttgtctttagtaatatgcatctccaagtatatcttttgtattgattactgaaagtgcaagttctggctagaaagtgtaagtgaaatttttataaaatgttgtcatattgtccttcagagaggacagtaccaatttacacaaccgcagtcctgccatgctttctaatgagtgaaatattggtaatgactgatactatcctagaagcatgagcctcagtttgattctttgaaacagtcttaaattgccattttttgtattcttgaatatgttctaaaatagcaatctttctgctgtttcacatcagactttaattttttagggtcaattgaaaaaaactgcttgccgctttagaaaaaaatgattctcaaatcatgaaatgctaagttgtgctctggtatcaaatgcagattttctgca

SEQ ID NO: 46515 - DNA, 1024 bp, Homo sapiens
tacgttgggaatgctgaatatttcacagacgcgtggaaaaagagacggagggaagttgcttctttttccaaggatatttgcataattggttttcccctgaacttttctgatcattctttaaagtgattaaggatatcgggtgttgtagagacgctctgggggaggtgtgtgtttctgataaatgcttgatgcccttttcgtcgctgaaaaaggctttttgcgaatgatccgctttgatagtgtggggtgacactgtcgggttgtgctgccagacttagcggccttcttcaaatttgtaagagggaaaccctgggggatttacttggtcactctgatttgttagtgtcttcagcgtgaaaaaaaaaacagcgtttgtgcgaagagtttctgggaaaggcttgtgtttatcggcttctttttgcaagggaaagttaatctttgttgtcattatactggttagaagagtaattggttttcaggcaaaaatttctattttcttaaattgggtgtaaatgccagcgggcagtgcgagtctatagaattttggagacaggcaggagaaggtttctcaaatcgtgaagtcattaaatacctttgttaatgtcggaggcaactaattatttttggaaaggcattgatgaggacatacgccatatctgatcttcaaataagttaacagtttgtatagttgaggtgacagcagtgcataactaatagacatagtgcttttttttatacacaagtcagaattacaaaagaatttctggtgaattattttgtgaaacatacaaattctaagaaacgcttttacagtttggtacagaatggaaattttctaattcttgagaaataaggttgtgtttttagtttaaatgtcaaaccagagttgttaggcatgattatactggctggttaatgttttgctgcaagattgtcttcagagttacttttcgcatcagcagtggcactatgttaggtgtgcccttgtatttaattttcataatcttttttgatgaatattatc

SEQ ID NO: 46516 - DNA, 1080 bp, Homo sapiens
agacagttaaacaggttttttgttttgttttgttttcattttaaaaatgttttatttccataggtttttgggggaacacgtggtgtttttttatatgaatacgttcttcagtggtgacttatgagattttagtgcacccatcacccaagcagtatacactgtaccaaattcgtagtcttttatccttcaccccacttccgcccttacccgtgagttcccaaagtccattatattattcttacacctttgcatcctcatagcttagcttccacttatgagtgacagcatccagtgtttggttttccattcctcagttacttcacttggaataatagtctccaattccatccaggttcctacaaatgttattatttcatttcttttttatggctgaataatattccatggtatatctaccacaatttctttctttcttttattttttagtaattagggatatgtaaatttatttttttaattttaattttaattttaagttctggggtacatgtgtaggatgtgcaactttgttgcatagagaactcagaaataagaaccgcacatctacaatcatctgatcttaaacaaacctgacaaaaacaagcaatgaggaaaggattgcctatttaataaatgatgctgggagaactggttagccatatgcagaaaattgaaactagaccctttccttacacttcatacaaaaattaactcaagatggattaaaaacctaaatgtaaaactccaaactataaaaaccctggaagaaaatgttttgttttctacataacttctcagagtcttttgcatgcagtgtcatgcattgtgaatctcagactggagaatgtgacatctgatgatctgatgtttcccaaacttattttaccatggagtatcctctttttttggatgggggggacctgtaagactagttttctatggatcacattttggaaaacattaaagagaggtatacattaatatggattgcaactgtgtgagaaacatgctcattaaacatgacttttgtatgggagtaaatttatgaataaaagcttaaatttacccaagatctttagg

SEQ ID NO: 46517 - DNA, 1049 bp, Homo sapiens
agtgtggtggtttatgtctgtaatcccaacattttgggaggcggaggcgggtggatcacctgaggtcaggagttcgagaccagcctggccaacatggtcaaatcccgtctcttctaaaaatacaaaaattagccggtgtgatgtacatgcctgtagtcccaggtactgcagtggctgagggaggagaatcgcttgaacctgaaaggcggaggttgcagtgagccaagatggcaccactgcactccagcctggcgacagggcaagattccatctcaaaaaaaaaagtgatttattttatttcttaatttttaaacatataatatgccttctaggtagttttgtgatttggaaaaccacaaaagaaaactgaaatgtttgatgccttccacaattttttagaaaaagaattctgcttcaaatagtgaaatacatttgtaagtgaatcagactctgggtagttttcattaatataaagtcagtttcctcccagctccactcacagatggtaggctcatatgaatctttctacaggcatcagatagtatgctagatgatggtgaaatggagatggaaaggctcatcccagctctcaagaactgactgtctattgaacaaagaggtaaacagatgattacagtatgtgaagataaatgcaccacggtgggtatgtgtattgggcaatgggaactcatagaagtgttaaatcaagtttagcctaaagctgcctccatatatatttaagttcagtctaatggttttactgtacttcgtgacctataacaagtggaggtgtaaacagaccgtagcctacacttgtgccagtcacgcagttttggccaatcaaatgtagccaactgtttgaaccgtgttcaaataaggcaagtgctgagctgttaccaatccagctgtttctgtacctcatttctgttttctgtatgtcaccttcctttttctgtccatatatcttcttccaccacgtggctgtgctgaagtctctgagcctattctggctcagaaggctgcccaatttgcaaatcgtttattgctca

SEQ ID NO: 46518 - DNA, 2013 bp, Homo sapiens
aaaaacaggttataattcagcaaaaactagttcaagattatttatacgtttatttcactgatatttattaatcatctactacgcgccagctactgtgtcaattgccattgtttcagtacttaacaaaaaagacaaacacagagaacagagactcaacatatacataaacagtagaaagagacctggcattcatagttgaccataagtttaatacattgtggggaaaaaagaagtgtgttttatgagggctgggaagtggttatttttgctatgaattagtcagatctcataatgtcatatttggctcataaaaactgcagaagaatcagaaaaaagattattgtagagattttaaaaaatgactcccatactcctataaagacaaaaataaaatgcaatgaggtatttagatttggacttagaaacataagagatgacttgaaactaacttcaatatgtggaaatgctaactgcttgtgttctttcttcctaaagaaatttgcaaaagaaaatgagcttaagatacaataagagagattgtagttggacataagaaagaaacatttcttagcactcaaggtgatatacctaggcttttggatctgtagagtgggggcaaaactccttctcttgtaggtgagccctcttcaaagttcttggtcagaactgttaggatgatctttgcattcttttccccagggtttttgcaaattcatgaaatcttccaggagttgcagcccttgagttcccactctgcccctctggtactgagccctaccacttctgatggcaagaaccacctttccagggcttagtgccctggagttctgtctgcagccacccaaccatgtccactaacacagggattagggccttgtactcagagtggggttctgggcccagcaatatcagcaccatccaagaatcagaatctatagtttaatacaatccccagtgattactattatttgaagtttgaaaagattttttataacacactggcccctgggtcagaaagacttgatttcagagcttgccagtgccattatctggctctatgactttggctaagtcacctaacctatctgagattcagtttctttatctgtaaaatgggtacaagaattgttacctcttaggctctcagaaatgcccttccttgtcactttattttaaatgaaccctttctaatatatttaccttggtcttttattattgttttttccttgagaacagttattacaattttgatttatttttgattatactgtttgaatgtaagttccatgaaggtagagaccacgcctgtcttgtttattctagcatccctggggcttagcacagtgcttggtacctaatgagtggctcaatatttgttgaataactgaatattgtaagtattaaattagatgatgcaagagaagctcaaggtctaacttagagaaaaatcttcactaagtgacagctgtcaacaaaattgactgtgtgatgtgtactgcaaaaatgaaaatgagagacttttgctaaaaaatgatcaagcatttcatttggcaatagcagataattaaactaagcacggggccctttcatcactgtgcttttcatgactgcacaggtagtgtgcccaggaagccagttttggctattggtagtgttactataatagtgatgattctgccagagatgctgccactaccgagaatgcgccatctcccccttcttcttgaggtgtgaagtcgtgggcacatgccccagaagtcacactgccttcctgggctcagctcccccttattcccaggctcaggtgtggagggctagagataacctgaaacttgagaaagtaccaactggatgctgtcagttcagccggccctaaagtattccccacagcaaaacgctgatttacacatgattggtaagtgaggcattcattgaatcagcaaaagttctgcaaatatgcactaaacagaattttaaatgagtttctgtaatgtatggcttttaatttacttg

SEQ ID NO: 46519 - DNA, 1035 bp, Homo sapiens
gatatgcccagttcacagcattccttcgcatgaatgctgggacaaagtggcagggccgagccccagagcatctggatcctgacagctgtggccattacccctttggtttcaactactgcatcgagttcatgaattgctggcttgcgaggcgtatgtcacactggcatttctcaaaagaatttataagtgctccaggtgtgttgcagctccatgattcagggccactgtagtaaggttttatgttctcgcaatactccttcctcctttcctattttcctccctcgctccttccattccagtggtagctctcccccaactctgttactcttcttctattctctttctttgggcatttttacagtaagaacattaagtcaccaatttcacatatttacaggagagcgaatggcaaattgcatttgggagcattgatttgctttatgacatcaatcacattttgtgttctgtatttcactttgtccatctgtaaaatggtgactttaaaatagttacttacaaagactttctaaacaacaactgcctactgagcactgaacaaggcagatgtcaaggtgagcttggacaaggccagtccaaggcaaatcatcagagtaggctcagaaaggaatgtggtgaactcaggtcctaagctggcacactgttatgatagtgccacttgtaaaatctggccccagggtgtgtctaatgatagaatcattcccaagttggagaacaaatgagaaggctagttggagaagtaactgttaaatttggttctaacctacctcacagatatttcaatgaatgctatagcatgcaaagataccttgagcaaacctcaattacagatggtgttgatttatggtctgagcatttccactgagtccactcatgagatgagaaaatgacaagttatgtgtagatgcctgcgtcatcctacgttagcctcccctgactttgtgcagcctctgtggtatgcaggaactcaaaatattgggggagaaattagactaggttgggtactcctctaggctg

SEQ ID NO: 46520 - DNA, 1044 bp, Homo sapiens
tttttttctttgagacagagtcttgccctgtcacccaggctggaatgcattggtgtgatctcagctcagtcactgcaacctccgcctccccggttcaagcaattctcctgcctcaccctgcttagtagttgggattacaggcatgtgctaccacactgggctaatttttgtatatttattagagacagggttttgctatgttggccaggctggtctcaaactcctgacctcaggtgatccacctgcctctgcctcccaaagtgctgagattacaggtgtaagccactgcgcctggccccccttttttttttctttaaaaaaaaaaaaaagcttgggggattaagtaccctaagatagtggtctctcccatcagttcaataatgctgtacagaacctctggataaaaaagctgttatttacaccataattgtgatgatggatttgactcctcaaaaccatctctcccctttttgccctttccaaaaatcaaaggcttttgtctccatgagttttacctagtagggattgtagttgtcactggtctagagttccaatacattttatatcaggaacctcagtgagctacccagaattggaacttaacatggcccagcaactaggagaagaaggcaaaccttgagaaagctgagccctcaggatagcacagtctcacccttgtttaaaatcaagtcaggctagcctttcagtcactctggttttgtaatgatttgccttttaggcctcaggccatttgatttctgcaatagttttctgttcttctcctacaggaatacatccctgtcctttcggttgtaactattactaaaactagggctatgcaaatgacctggttaccatgtaatgaaccttgtgtacttattttgagagaacaatatgtataggatatgttgaggggcagaaagaaagacatcaaaaactggaactattttaggtggcaaattgtaacgcaaaaaacaaaagtataccttattttgtatacgatgtacacttgggacagagttttctaatatgttgccaatgttt

SEQ ID NO: 46521 - DNA, 1036 bp, Homo sapiens
agtacgtagcacatttgaaaccagactgcctgagtttgaatcttggctctgccacttattagctcagcaaattacttgaacttatatcttagtttccctttctgtaaactgaagaatgtaaaagcccctgccttacaggggtattgtgaggatggaatgagttaaaatggataagcacctatagctgcacctgttgtattataacatttcacaattatgagcattatatgattgtttgctgtcactatttttgttatttttattttctgtttattattttgatttaccattcatcaaatgatcatagaaatcagaagtgagtttatgcatttgaaaacagatcacttgctaactataagtgctggtttatagcaggttcagaagcacctgctttgggctactataagcaccggagagacatttagctgcatttcctttaaaataattctgtggcttcagttgttcttgtccccacttattcttagtgattttcactgttgatgctttcttctagtgtctcttaaactgtgcatcttcaaacctaagaagcctgaattatgttttctttatgatacctgctctgtattcctgttagaacttgtggtgttttttttttaaagttatttctcttactcttaagagggtgcttttattttaggcactttggctttgatatatgctgggtatgatatatgttgtatattcattctttggatatacatgggaaatttctcatttataaaacagatgtgtttgtgtctcacgtgaatcaaggcacgtgcacctttgaggaagggggaaaagaagctttttcaacttatgttttagcttgaacagactggatttttaaagggcatatcagcaaatttttttcttcctttcatttccatactactctgaagtttctttaacagaaaacattaaaatgtgcataattatggggcaaaatgtcaagcagtcagtttaatttgctgatgaatacatagaattaatgtttcgccacagtccccggattttgcattatgaattagtgggg

SEQ ID NO: 46522 - DNA, 1035 bp, Homo sapiens
gtggcatgatcttggctcgctgcaatctctgtctccccagttcaagcgattctcctgcctcagcctcccgagtagctgggattacaggcccccaccatcatgcctggctaatttttgtatttttagtagagacagggtttcaccatgttggccagtatggtatcggactcttgtcctcaagtgatccacctgcctcagcctcccaaagtgctgggattacaggcatgagccactgtgcctggccgccatatcatatttttatacccagaataccaaaaaaaagtgataggcaccaaggactgatttagtgttcctgctttggagaaaatgagttgacttagggtacccctacagcttcatagtaatgatttgtgtccttgttctaccctggggaattttactgagatgaattaggaattagtatggggatggggaggaaaggagccttaatcatagtggcattaacaggcaagaggaaattaaagtaggactgctagacacctctcaaccaaccaatcaaccatcctgccacttgccattcaaagttaactaaacgagctggacgtgatggctcacgactgtaatcccagcactttgggaggccaaggcgggcggatcacttgaggtcaggagttcgagaccagcctggccaacatggtaaaacccattctctaccaaaaaagacaaaaaagtagctgggtatggtggtgcatgcctgtagtcccaactactcaggaggctgaggtgggagaattgcttgaacccaggaagcggagctgcagtgagctgagatcatgccactgcactccagtctgggcgacagagtgagaacctgtctaaataaataaattaaattaaacaacaataaaattctagctcacttggttttgtctggttacaggttccttaacaggtgttaaatggcagaaaattcccaatagattgatcagcacttgactttttcgtagtatttcccaccagaataacgtctgtagaagctactctatccaggatagtcctgggggatctctggca

SEQ ID NO: 46523 - DNA, 1049 bp, Homo sapiens
taaggtaaaaaacttacagtaagctaagttattattgaaaaaagaaaaaaatttaaaataaatgtagtgtagcctgagtgtacagtgtttataaagtctataacagtgtacagtcatgccctaggcctttgcgtttactcagcactcactcacccagagcagtgcccagtcttgcaagctctattcattttaagtggcccacagaggtgtaccattttttatgttttatatcctatttttactgtacctattgtatgtttagatatgtgttgatacacaaatacttaccatggtgttacaactgcccatagtaatgtgatatacagatttgtagtctaggagatacaggctacaccatatattctaggtgtgtagaaggttataccatccaggtctgcgtgagtacactctatgatattcactcaacagcaaaatctcctaataccgcacttcttagaacgtaaccccattgttaagtgactcatgactgtattctaaagagtgctctggtccctggaaaacgatggatttgatactctagatctcatttcttgcagaccagaaagctggctttactggaactttttactgagtcctctctgcttcatgtaagactgagactttgtacagggtttacccaagtatctgccttggtaggaattggagaatgctcttagtgcttgaaccctagatgtgccaagattacttgaggaaaagaatgtaaaacacttagcatcaagaagtaccaataaatggtagctactagtttgctaaaattaattttcccttttcttcagcctttttttacccttagtcccaggagccatcaaatttcctattgctgaatgtgtggcacccaggcttgtgagagcagagggcttaggaacagcagcctgtgctatggaagctgggtctctggctggccccatgcctctgctgactccaagcccaaggattgaatttacttactttggtagctgcaacttggcaaatatagcagcttagcccgtttgtcagtgaggggagtgattgcagggtagaatggagac

SEQ ID NO: 46524 - DNA, 1024 bp, Homo sapiens
taagtttttatcattgtctgaccctattgtaaaatgagtttttaagagactgatttgtaagagatacagaatagttttaagtttcatttattctttgtaaatgcagttttgggaaataattcttttgagggaacatatatcatcccccttaatcctgtattactgatagcatttgtttgcttaaagagtttttttccagcacacagtatttatgctcatttttggataccaaatgaatgttacctaaattagtgaaactttaatgtttggctaaaatgagccagaaagctgtttctttaaactttagatcctatttaagaaatagaaatgtatccgatgtttacgattgccctttaattttacaagtgatgaagaggtaggtatttggctttttcaaaaatattgcagagccaatgccatcttactgttcaagtgtaaaaacccacatgtggcaggtgtattttataggcttataaatacctgaacttgctcacaggctgattactagactttatagatcgcttcaaaaagtgagagtttcctaatagtggataaatacttacccattaattttttttttaaatgtgaatttaatcaggaagacctagaatagattcttaccaagttcaatgtggtatgagagtaaatctcacagcataatttatgaattcatatataatatggcagaactgatagctataataaacagcaaagtgagagcatattcctaattcagagtatctcattttccattattaacaattaatggaactttccatttttaagtgtcactactgaaagtgttagcgtgctcaacagtaagcaggtgaattcagaatgttattttaaggcaatagggttcccactgacagcaaaagtcaaaggatggacaggaagcacacttcctattagtaaggggaaccatcatgatgaaacagatagaggctttgtcgattgttctctccaaccctttgtgcaaggctctgatgctaggtacctagagcaaatgtttcacagtgtttga

SEQ ID NO: 46525 - DNA, 1028 bp, Homo sapiens
ccaacgctttgggaggccggcacgggtggaccacttgaagtcaggagttcaaggccagtttggccaacacggtgaaaccccgtctctactaaaaatacaaaaattagctgggcatggcagtgcacaacagtaatcccagctacttgggaggctgaggcaggagaatcgcttgaacctgggaggcggaggttgcagtgagctgagattgcaccattgtactcccatctgggtgacagagcgagactccatctaaaaaataaaaataaaaaaaaattaatttacaaccttttctgcagcaggatttccaggaaatgaactgggaaatggtggcaatgaatgatgacaataaatgatggcaaatgcatgtaccatccaactatgattttgtttcttttcaaactattaatagcaccagctttcagatccatgtcgggccctccttctcaaggaacccttgctcagcttaaatctgcttgtattgtaaacttgaaataaatataaaaaacatgggaacaaaaaaatacatattttttgaatttattcattattcacacagttcactaaatcaaactagcataatctctgctggtccacaaacaggatcacatacatttacagtttttaaaagatgttggttctccttttattacatactatttgatctctttaaactccagtgttctcatctacaatatggcctaatatgatgataaagataacatgctagaagtgaattttctttcttgtaaatgaaaaacatagttttaaatttccaattgcaactgaagggcctgatttggcatttctcaatgtcttactcttagtttagaataggttgcaattattgttcttttttagccatgacaccaagttattcatctatagcagcttttctcttttttttttgagacagagtctcgctctgtcgaccaggctggagtccaacggcccgatctcggttcacttcaacctctgcctcctgggttcaagcaattctcctgcctcagccttccgagtagctgggatta

SEQ ID NO: 46526 - DNA, 1061 bp, Homo sapiens
cttggcattctctggaaaagaggctgtactggttaaagagagtctctgcttttgattttatacttaactaatgacaataggaaagaagattctccacatggtttaaaaaagggagattttgcccaggtctttggaacagttgaagtgtctgaaaaacagaaggagataccctgaactgccactatatactggggcccctagactggagatgagctgaagaagtagttactgaggcattttctgtggtttgatgttaatttctagcgaaggggacagggaagctaggggaaccagaaccctggcatgcattgtgttctcttggactgtctgacaccttttaaaaaaaatggagtctctttctgtcacccaggcttgggggtagtggtgcagtctttgctcactgcaacctccacctcccgggttcaagcgattctcctgcctcagccttccaagtagctgaaattacaggtacacgcgaccacccagctaatttttgtatttttattagagacagggttttaacatgttgtccaggctggtctcgaactcctgaccttcagtgatccacctgtctcagcctcccaaagtgctgggattataggcatgagccactgtgcgcggccacattttaagaaatgctcagttgtcccattgttagctctatcacataaatttatccttgtcttatttagttcttatgcaccaattacctggaacctagctcatggtttccagcatagcctccctactgttatgagaaataattcataaattgtgggaagaaatttttcttcagattgctcttgactttgggacattatatgtatatgctttctggtggtcatgttgtaaaattgtagatgattcactattaggggatcaggatccactctagccagaataaactcatcacactttgtcgctcctccttggcctctgccacccagtgctctgagactgttgatgtgatccaggaagctgaatgaacactggcccccaagttaggaagcctgcatcccagactcagcttgatctcttgtaagcccatggttttctctcca

SEQ ID NO: 46527 - DNA, 1025 bp, Homo sapiens
agcacctctgctttatagttttaagtttttacattcagccaaaacagaatatttcagactttatcacaaagagtgacttttgttttgttttgttttgttttgttttgttttgttttgtttgagacagagtctcgctctgtcacccacgctggaatgcagtggcatgatcttggctcactgtaacctccgcctcttgggtttaagagagtctcgtgcctcagcctcctgagtagctgggaccacaggcatgcgccaccatgcccggctaactttctgtatttttagcagagacagggttttgccatgttggttaggctggtctcgaactcctcacctcaggtgatctgtctgccttggtctcccaaagtgctgggattacaggcataagccaccgtgcctgacctcaaatagtgatttgatatattgtttgttatttggttgttgaaataaatattttgatttttttataagaatgaaaaatttgaaataacttaaatttctatcagtaggagattgattaaaagcattgtggtacatccatttggtagaatattaggcaggattttagaagaatgagggagatctaaatgaatgcctattcaggtatatatatatatatatatggttatatctattaagcaaaaaacaaaaatttgaacattctatgcagaattattccactcaaacaatatcagcagaagaagactgatcaacttgtaataattagtcagcataataaaaccatattgaaatagtttcttagtggaatatcaggggaacccgcccccaatatttcaatgtagattctttctatcttccaaaagtgttggccggctgagaaataaagagaaagagtacaaagagaggaattttacagctgggctgctgggggtgacatcacatattggtaggaccgtgatgcccacctgagcctcaaaccagcaagtttttcattaagggtttcaaaaggggagagggtgtaagaacagggagtaggtacaaagatcacatgcttcaaagggcaa

SEQ ID NO: 46528 - DNA, 1043 bp, Homo sapiens
ctttcatgttcacggaaacttctttataaagtttctaaatgaaacgaaaacttggctaccaacctactctagtaacgcaacaacttgcccctctgttcttttgagttctggcttctgattgtttctcaccacattgtcaactccttgggaaagtactctgtatgttttaaagcaaattgccagggtttttgtttgtttgtttgtttgtttacttagacctcgggagataaaattaatcgacctctttaaatacatggaggtaccccctttctcgtttttgaagggagacacttgggaatttagaaattgggagtgtgagttctaagggctggtgtggtttagatagcccatgacagtttcaggaaggtcctggtttcctttcaagcaaaaggggccacctctgaaccaaagtggattatctcctgcagcagcaaatccagttggcagttgaattcctgcagttttatgggaatttcagtgaaacttttaaagctgtaatttttgtaactggagttaaaaaaaaaaaaagaaaacaaatctgaataaagcgacataatccattgcagagtctgtacagttctatttcttctatcatgaatgttttccaggcagatgaaaaaatgttttgaatgttgaatatatgcaaacattacaatcaaggataattgtgtctatgtgctttgactctcattttgcttttctcttccttcatcttctcctataccctataggaatgtgatcatagacatagaaatagaatttgcatttgtataaataatgcccaagctgtttggaaaaaagactccctgtattaggcacaagatttagagatggcattttctgcctcaaatctcagtttgatttagatcatggaaataatgccttttatctgtatggacatcagagtttactcagcccctttccctctgcccccttcatttgatctgcactctctaacctcatgaagttgtctgaactagtgttattattctcattttgccaatgagtgaatgagactcagaagaaagcatctaggttagaga

SEQ ID NO: 46529 - DNA, 1050 bp, Homo sapiens
atagaagcagtaatggggaatctgtcatgatgacttactagaaaaatctattgagcctgcttatgattctttggttttggaggaggagggcactaattttcattggttcattcattcaaaaatattaagttcctactccatgtctaataactgcctttctggctagtctgtgagcatggcaacggacggatgatgtcttttgttttctgttgtgtctctgatgtctttcacattgaagagcagggaggaagtgctcgtatcatatttgtgccagagtgaggaggaagagggaagcactcagagctgacacttcctgtgatttagccttctgcctgtggatcatcttttcatcttttttgagctcatgttagtttctctactacctgtgcgtttctttaccttccttggagtatttcttccttgagctcagtgttgcaggcactgcttggtcaggcttagcccatagacagaaaatacttattgagtacttactgtatatatagcactcttccatgcactgtacatgtatgaactcacttgctctttccagcaacttaggagatgtgtgtcttcattatcaccccaattgaagaaactaaggatgagaaaggattcagacttaatgcaaatgatccactatctgggaagctatttaatcaacctgggctcaattatttctgttttctatttggccgtgggcttttgggttgtttgttttagtgggcacagaactcaaggtccttggctttttcatgccctttttcatcggtgtcgtaagtacttgctccgtaaggaaatgattttaattttacttttctctaaaagtaaaaaaatcctactctgtagtgtagtggtttcatcttttttttttttaatattgactgacatgtcaagagaacccacaggctttgcacatacacttttccagtcattgcttcagatatcacatccagtggaaattattagatgtgatatctgaaccagttgcaagcaagatctctcagcctccttcaattgctatgttccaggtaaatgttattgctgtgatta

SEQ ID NO: 46530 - DNA, 1028 bp, Homo sapiens
aaaactgagttagacacagtcaaatatgcctcattagcaaatgcagattaaaatgaagaccctctagaccccagtcatacttttgatattagattacagtttcctcatccataatacagtaatctaggccaggcgcggtagctcacacctgtaatcccagcactttggaatgccgaggcgggcagattacctgaggtcagaagttcgagaccagcctggccaacatggcaaaatcccgtctctactaaaaatataaaattagccgggcatggtggcacgcgcctataatcccagctcaggagactgaggcaggagaatcacttgaatccaggaggtgaaggttgcagtgagctgagattgcgccattgcactccagcctgggcaaaaggagcaaaactcgcatctcaaacaaaacaaaacaaaaacaaaacataatacagtaatcttgtacattgatatttttcaaatattctgtagatgtagaatttcatgggcaagtctaacatctgaaataaataaccacagaccaggcgtggtggctcacacctaatcctagcactttgggaggctgagacggacagatcatttgaggtcaggagtttgagaccagcctcaccaacatggtgaaaccccatctctactaaaaaatacaaaaattagctgggtatggtggtgggcgcctataatctcagctactccggaggctgaggatggagaattgcttgaacctgggaggcggaggttacagtgagccgagatcacaccactgccctccagcctgggcaacagaatgagactccatctcaaaaataaaataaaataaaaaccacagagcacttcaactggaagaggaaagtggagtcccctgatccttaaacttgcccccctttgcccaaatggcatcaagagctccgtggagtccagcttgaaaagaactagactaaaaaatcaccagggtctctaagtgctaaaatggaacctcagagaggggtcctgatgatttgattgaggaagggtgatgtacaggg

SEQ ID NO: 46531 - DNA, 1030 bp, Homo sapiens
ctgggtaattactgtcagaattgaattcaatcattagatatcaagtaggtttccaggaagttggagaacttgttgttggtgtgaggggaagaaacccataagtttggtgtcagagcattgccagtagagaaacaggtcccccccacatatgagttggatggtgttatgctcttggtagggcatttgttttgaataattcacagatgcagagtgtttgcagaaccgtaatggggttttgaattatatccttgtataggtgggattacaaataagactccaaatataggctggtttgaacctcagttgtattcattgtttgtatcatttagcaaggacatatataatctaaataacaacgaatagagtgggaggggagcttcagagttggctcagtccatggctcagtcatatccctagagttttagacactttacctttcttcactttgccatctcagcatgccagtttgggtcacaaatggacatcttatgggggcaagacagctgtagacatcacatcagagtatgacaacttctagtctcctccttgggtctcctcttaggagcaagagactttcctggaacccgttagtggacttcctctctgcttctctgtttaaatcattcactggcagaatagcagtaccctggatagctagggcagtcaggagccatcccctgaggggcagtcagagctgggcttccattagtcgcgggtcaagcaaacagcccctgggaagagaggagatacacaggagagattcttctagaaaggaagaacaagaccagaaatggattactgcagcctgtttccttagttgtaaggtggagataataatagcacttaataagattattgtgagaaccggatgagttaatacatataaagcatgcaagacagtgccaggcacataataatctttcggtaaataacagtttttttatttttatttttattttttctgttgttgttgaggtggagtcttgctctgtcccccaggctggagtgcagtggtgcgatcttggctcac

SEQ ID NO: 46532 - DNA, 1070 bp, Homo sapiens
tatcagatggttccagttaagaaggaaattatgactctgttgttacagcctgggaaaagtgaaacaacatgtttcaaacttgccacttcatggtcacgggattgaattgggcagaacattttccaggccccagctggtagtgcctccttcacggaggcgggtatcttgtgcccactctggtgtatttgcactcccagaacctccttctttctctctcctcttcccccatcaggaatatatgctcatggttaaggaaacctagcttggatttccttggaatatatgtccatttaatttataattttaaggctggatgcagtggctcatgcctgtaatctcagcagtttgggaagtcaaggcagccggatcacctgaggtcaggagtttgagaggagcctggctcatgtggtgaaaccttgtctctactaaaaatacaaaaaaaaattagccaggtatggtgatgcgtgcctgtagtcccagctatttgggaggctgaggcaggagaattgcttgaacaccagaggtggaggttccaatgagtcgagatcataccactccagcctgggcgacagagtgagactgtctcaaaaatttttttttttagagtttaagatgagaaagcaaagggaaccttttcctctatgttgaaatacttccttggaatcatttggtagattctcatagaatggtagtcagagtcttccaccagtagtcaggaaattcaagtttcacatcctttttataaacccctctgatcttctaggtgaggaaactgaggtccagtgagtggaagtgattacttctgggcagagccaggcccgtgccaagggcctcctgtttcagcgtctgggatccccgacttgtttttttttttttgctgttaaaaaaaaatccgtagttatcactttcactccttttcctgtgtgtgttgttgtcattcattaataatgcttaaaatagatggcagaggctcagattatctgtaaacagcaaatactctaaaatcattttgatttttaaatctgctgctgcttttctcattatgttaatgttccatctttttgagtatt

SEQ ID NO: 46533 - DNA, 1049 bp, Homo sapiens
agataatgcgaagtgcttatccagcatctgcctcaagcaggtgatcatgatgacagtggtaaggactgtgccgagaactgcctcagttacattgtcctcttccttagtggtatgcttcccatggttataatttgaagacgcttctggccttcaaatatagtgctagctagcaagggcacagaagaatgaaacagagttgtttgtgggaaacatgaagcagaagcgagtgatggacagaggtgaggccaggggaacaggctagagcttgatcagggccggccttgtgtgctaggctagagcttgatcagggccggccttgggtgctaggcaggagagttctgtctcctgcgggaaaagctgcctgtcccttggccagctttccctaaggcatgcagctttcacaggcactagccattcttaagccattttctctttccttcactttgtgcacaacctgttggaatttctcaggtccaatgtgatgctaattggaggaagtgtggagttggacctcctaggagttcaaacaagggccccttagtgattgcagttagaacctggactgtttggtcaagggaagtaactaggatcagtgcagaaaaacccaacctattgcttgttctcagtagcctcagaaaggagattttgcatgtggagtaaaatgggaatgtttagtaggggagccagagatggtaagtgcaagaattgtgagagaaatggcatatttaggaaagaaaaaaaggccttgaatctgttttcaatggaataatttaactttagtaaattacatacttttgcttaggctagttgaaaagaatgctctagttctatgtgcaggtagtaaaattagtgcctttcggtacatagtaaatgctcaataaatatttaatagacttgattattgtgtttctctgatattaaatttttagactctagttcactattatcattgctttaatttggaaagcaattaagcaaccaaattatagtagaatgatttaaatagaaagattatttttagtttagatgtgattcagataaatattttg

SEQ ID NO: 46534 - DNA, 1026 bp, Homo sapiens
tatttggctaacaaaacaggtgatttctgtgagtatatatatgtatatgtgcgtgtgtatatatgtgtgtgtgtgtgtgtgtatatgcatgtatgtgtttatttatttattttaccatggacatgcccttgatgaaaaagaaatactttgcttggttattcctccaagtggaaatttggacattaccctttgttcatggtggggaagatttttagttattccacatatcagaattatctacgtgaatagttagcacataattaggattaaaaagtaactagttgcagaaaactcattattttttctaattctaagaaagtagcttcattttgggtattagagaaaagctcaagagattcactgattaatatgtattgagcctgttacatagctgacaatgtgctagtgttttcacagtttctatctaacttacaaaataactgaaagaggaagaaaaatattctattccatatgtattagaaaactatcctttaagttctaaagttggcttatgatctcctgaattgcacaatatttatctgcaaaccttgaaactatttaatcagagacttctgaccccaaaatgccaacattactcttggtggtctttcaaggtaattcccccttgtttttagtgtatccattgaaacactaaatggaaatatttagtgccctgatgctaagggaatattccaactagcggcactgattccactccaggttattaattaaacagtagcaatcagcccatctgatctttaatattctattgctgctgactgatgcccagacatcagacattttgtaatctaatacaaaattgctctgtgcttaggactaaagaaaaacaacacataatttatactatgttttatctttattttcaagttccagaggatacgctggttgtgtctttcaatgattaacttaaaaaaacaaacaaaaaaacaagacactacgtatctcaagcccaacatgaagggtattgagagtaaattatagttaaatcatttatttctgactttt

SEQ ID NO: 46535 - DNA, 1104 bp, Homo sapiens
agtgctgaacttttaagcatggaagtctgaagatacctcctcttgtgaagggaaatttaaaaaatatttaatgactgctttttaagtttttggtctgaggaaagagcagcattaccttggtcattgactaaaataaagacataataaaggtactggaaactgaacagaagtatggagtttgtgagtgaagagttggtcacacagacagctctccttcctcagacattcaggtgcattctgggtaagttgactgatttcaaaatgctcaccttcaagtgccaggcacaaaattataatgagcttcctttctcataattcttcttttcatgattttctcagctggattcttcaaaggattatttgtaaagacctttatggtgtgttatgatttaatcagatgtagcccgaatttcccaagatgtgttaattatcattgccacacaagtgcaacagaggaagcaaaatgtttttcatttgggcaggttgagggtttgtttaaaacgtacttagggccattaggatcacatcaaaatatagtgcatggtaattatgcatgaaatagaaggttacctgctgtttaagtagctagtttcttgataatgttgcaataaagtattgagagaaaattggtttctcaatagcagtggaacaccttgtttaagggacaaagtgaactgcattaggctgaaaaacgaaaagggggaaaataaaaatagattttatcatcaaagttgtcagtggatattgttctcagtcttaaagaattatttttagtctttcccttcatcaaaatggagaattatttgtttgcatgtagattgtggtagagttggtatgtttcagatttaatgaaatgcagaacagaataaatccctcgggaaagaaaggaaagaggggatacgccagacttagtatatgagagtagtcaaaagcctggctttaaaagtcaaagaaaccccaaagttgacacctggtccctatgctaactagctgtgtgacctcctccatgttacttaacctttccgacctcccagtttctttagtagcaaaatggagatgttattattaatataacagaccttgttgaaaagatgaaatgagaca

SEQ ID NO: 46536 - DNA, 1036 bp, Homo sapiens
taagaaagcagacaacggcttcctccgccaccactgccctgccgtgctcacgctgcatgggggtgccctcgcagcgggagtgtgtgtttgtcctggtggccggggactgcggcttggcctttttgtttacaagagagaggacagcagcctctgccctccagctgctgtgaaaacagtgttggaaaaccagagcgaagtttccactgaagaactcacactggaaaaaaaaaaaaaaaaaaaaaaaaaaaaaaaaaccaccaacacccgaacaaacaaaccttccctcataaaagaccatctgggttaaagtacagaccactgggtcagaacccagatggtaatgagaatagttgttcttctgcaaactttccgagtgggatttccatatattaagttggaagagagcccaacgttgaaaaacaggaaactaactgaagggctgttagtgtagtttgtaaggaagattttagcagtgggattaattgtgtatgttggataaaggatccccatcactggaggtctccttccaagtgaaatgggtgctcctgctgatttgaattgggaggtgacagtggcgatggcagatgggtatggattagagcaatattttggaggaagtctcagctggggttggggatagattgcatcctgaggggtgcaaaaggggaaaagagagggggaaggacgaggatgactctcaggtcatttctttcctctcttatcctttgttcttttctcatattatcactcaggcaaaatgggaatgggcatgtgagatgctttgattagtcagtgccagcatccagcaatgtggaattctctgtggggcatcttgaagcctctgggtgttgatgtggagtgctgaccctctctgaattagtaacacacttctagctatcttagacaggaaaccacagtcattacaccatggagatctcttcattatagctttgctaccttgtccatggtcacattaatgactcctgtcccagttcatcattgataacacctacagtaacccatggtgctctgggag

SEQ ID NO: 46537 - DNA, 1050 bp, Homo sapiens
ccatcaaaacaggaccagcccgagcaggtttgaagataaaaatcaatcattccgttcatagtactttcttatttcatgttcctttgcttccaactcccataaggaatttgctaaagatacaacctcagagatagcttaaggtggagagaaattttcgaccataagttccttggagaatacgaattcaagtagggtgagtgggaagaggtttctaccaacattttctccttgcatctcaggtcctgaatcttccaaaaagtgctgcttgtgccctacactggctcaaatttgcatttctgaaactagtttggtttgcattaatttcactggagttgtgatcacattgaaaatgcaaagcctaattgttaattaagaaaagtcattttgagatgtgatggtgttttatactcaacatgagcaggttctatttggttgtggcaaccttaagatttatgactgactgtcctatcaacacttggcaaatgtttccatgctatggggatgcattttacaggctgttaaataagaacccacgaagtggtccggtatgtttttaaaaaatgagcctagcaccaatgtatagctttctctagaatttaaatctcattgttaatttgaagttcctctctttattgaaagctgggtattgaatacacctactgggagatgtggccacatagagatagtctggattaatgggctttggtcttattttttagacctaaatttattcttcattaaaagaagagtaaaattccaggtgcggtggctcacgcctgtaatcccagcactttgggagcctgaggcgggtggatcactcaagattaggagtttgagaacaactcctcagttggtcaacatgtcaaaacccctctctgctaaaagtacaaaaacttagccaggcgtggtggtgcatgcctgtaatcccagctactcgggaggctgaggcaggagaatcgcttgaacccaggaggcagaggttgcagtgagctgaaatcacaccactgcactccagcctgggcgacagagcgagacttcgtctcaaaaaaa

SEQ ID NO: 46538 - DNA, 1045 bp, Homo sapiens
aatgagagccatctccactgcctccctttgagtggttatctggcttgtgttgcttgtcttgtcgggagaccaagggccttgcaaagtaggtgcctgtgaagagtgtcagctgaggccctgcagggagctggaagcttggaaggcctgggagaaaatgcctggctaatgtatgaggcctggaagactcttctttgttaagaagattcatgggtctctgaggagtggagtaatcaggactaggagaagatgttgggccaagccttcgtatcctatatccatctgcttgaacatttttttttttttttttttttttttagctagttgaaaggaggaggtcccgttgaggcttatttgaacaaatatttgctctccctaattatatacccagagctgctctcctgaatgtttaatgcaaaccttaatatttacaatagcataaggaagagtttataatgtgtttgggaggcttccgaagttggggcagtaattcttctttgcacttatgtaatacttttcttcctaagagacctgagccatgtttaccttagccactgttcacattgagatgaagtgaagtgagggagggagatgaaaactccagagaaaggaggagcccctgtgggcagctgccaacatgttttataggtgagacacttgtctttgccaaaagttgtgtgccagccacaaacttttctttctggtcaggaataacatgtaagcctgtgcttacaattgccttctgatatggacgtggagagtgtcacagaggtgccatgctgggtttttgaccctgatggtagtagacttcttgctcagtgccctgctgtatgacaagcctgacccattcccttattagactcaagatttagtgagtcttaaaaagatatttggaggctaggtgtggtggctcatgccagtaatcccagcactttgggaggccgaggagggtggatcacttgaggtcaggagttcaagaccagcctggccaacatggtgaaacgctgtgtccactaaaaatacaaaaattagttgggtgtggtggtat

SEQ ID NO: 46539 - DNA, 1533 bp, Homo sapiens
tcaaactgtttcttaaagggctctagttattgaataagttttgattcacaatttcatgaaaaaatttgtaaacatattagaatgtggtaatatggtttttctgtttattgtgctaaaagcaaaagtgtagaaaagtacaaaaaccatgaaaatataccttgtttgaagtaaataaatatgaacatgaaatatattatttaaccatgctggaggtcaattttaaatgaattctgcttttctctgggcttaaaaagaaaacttagtaactagtgggttgctatgttttatgttaagcaacatttaaattgaaatcaaagtagagtaagtacatattttaactaaaacaggtatgtctagttatggggcaagtaaaattgtatagcaatgaaattaaataaaaaacctatgaatattttttgagtttgaaatacaattggcagaatctgagcttgctatacatctagttggcttttaagggaaactgattttttaaatttcccttctttgattttggatcttgacttaaagaatccagattcccataaacattatacagaaagttctaatggtgccaggaattagaaaaatctaatttctttttttttaatttttttttatttcaataggtttttggggaacaggtggtgtttggttacatgagtaagttctttggtggtgatttctgagatttcagtgcacccgtcatccgagcagtgtaactatacccaatgtgtagtcttttattcctcatccctctcccactctttcctctgagtccccaaagtccattttctcattcttatgccgttgcaacctcatagcttagcttccacttatgagtgagaacatatgatgtttggttttccattcctgagtttcttcacttagaataatgtcctccaatttcatccaggttccttgaatgccattatttcatttcttgttatggctgactagtattccatggtgtgtatatgtgtgtgtatatatatatatacacatataaaacattttatccactcgttgactgatgggcgtttgtgctggttccatatttttgcaattgggaattgtgcatctataaatgtgtgtgcaaatatctttttcatacgacttcttttcctctgggtagatactaggagtgggattgctggatcaaatagtagtcctacttttagaaatctccaggccgggtgcagtggctcacgcctgtaatcccagcactttgggaggctgaggcgggtggatcacgagttcaggaaatcgagaccatcctggctcacacggtgaaaccccgtctctactaaaaatacaaaaaaattaggggggcgtggtggtgggtgcctgtagtcccatctactcaggaggctcaggcaggagaatggggtgaatctgggaggtggagcttgcagtgagctgagatcgcaccactgcgctccaacctgggtgacagagcaagactctgtctcaaaaaaaaaaaaaaaaaaaaagaaaaatattcacactgttttccatagtgattgtaatagttta

SEQ ID NO: 46540 - DNA, 1053 bp, Homo sapiens
aaaccccagctgtcaaaagttaggtagagagctttggacctcaagtcctgactgccactctccagctctgtgatctcatgcaaatcactttgtctcaggactttgtctccctcacccccatgtaaaagtgggatgataacatcattttccaggatcagggtggagaataaatagaccatgtttactaaatgtcctacggagtgtggtggccaagtaggtgcttagaaagtggctgcagctctcagtattattgtgaatgaaaaattctggcctcatatccggtaaatcaaaatacttcaccctaactcctaaggcaatattgttgcctagaatcatcagcatatttggagaccaataacgcagtttgcatattacatggagaatgtgggtggactaattgcatccaggcatggggtgactggcttgagattaaatcaaaaggaatttcctgagtttgtgatgtaagggaagctcaagagactggaatactcaggaagtgaaatcccagatacaaggactgaaaataatcattcaagtggtggaaaaggtgatagaaagattgatcaatggcaccgagtttagtgggacatctgcgctgtgctccctctttggtttcctccctttcgtggctgagaggtttggtgtatcagtgcttcttcctcctcagccagaaagtttcagtttttctatattctgcccaccctcttttcttgcctgtatttgtccattcattcaataaagactcatttagctccaaaatattcattgaggagctaaatgtgccaggtcctggagatgcaacagtaaaacacacatatgcatatacccacatgcacgtgcatacacaatttgcacacatacgtgcacatgcacacctccatgcatatgaacatggatgcacacatggccacgtgaatccctctcttcttggaattgacattctagttgaggaggacagaaaatttaaacaatagtagtaaggaaaatatgtagtttgtttcacttgacgattattgtaggtttccccacaattttttttttcctgcctctgct

SEQ ID NO: 46541 - DNA, 1929 bp, Homo sapiens
tggcaccaggaaccggtttcgtggaagacaattttttcacggaccaggagggtggtgtggggatggtttcaggatgaaactgttccacctgagatcatcaggcagtagttagactctcataaggagcgtgcaacccagatccctcacgtgcacagttcacaatagggttcactctcctatgagattctaatgccaccagtgatctgacaggaggcagagctcaggtggtaatcctcgcttgcctgtcactcgcttcctgctttgcagcccggttcctaacaggccacggactagggtcggtctgctgcccaagggttggggccccctgctgcagacccagtgttggtatatgcaaatattgcttgcccttttggagtctggaaatgttggccactgtctggtcattcacttgctttgactcaccctttctccacgtccttttctcaactttccctctgtggattagagccacaaatctatgccctcattttccagtcctgaaaatggagacatgtgacctggcatagtttttgttgtttcttccaggactgaagtaatctgggaaatgtagtttggctgccaagaatttggcctttcctagacacattgctggttgattagaacaacagaggagaatgttagtctgggaggcgtgctcacattcccagtgtagctcaggggaccctttcaccagataggactcacagacttctcaagtccctattgcgatgtggcttctgggacaccttcaacctctgtccctggtaagccaatggctgcttcatttcccatgttggtttcccccaattttctgggacctccacattaatacctactttcccgtttccttttaaatctcctggcagttctactgcttggaatgcattctacagatatacttgcgtagataagagatgacccatttcataatagcaatcacatctaacacttgctgaggatttacctggtttctggaactaagaattttacatatttttcatgtatttcattctttaaaaaactctgtgaggtgggactgatagtatcttcattttcagataaggcaatttaagcaggaagaaagtaaaatgtaaccaaaggtgtatttttttttaattgcagctgtggttttaataagaaaagattagaaacaatgtaatcaatgtgtgtctaattaaatacataatgctttattgccaataccataggatactgtgcagccacagaaaaatggtattgaatatcttcatataatagcgtggaaatccctccataatacatgaagtgaaaacaagtaagtctgtatataaaatgcaggctgggcatggtagctcaggcctgtaatcccagcacttttggaggctgaggcgggtggatcacctagttcgagaccagcctggccaacctgctgaaaccctgtctttactaaaaatacaaaaagttagccaggcatggtggtgggcgtctataatcccagctacttggaaggctgaggcaggagaatcgcttgaaccagggaggtggaggttgcagggagctaagatcacctcactgcactccagcctgggcaacaagagcaaaactctgtctcaaataaaaaaacaaaaaaaagtataatatgcataaattagctcaaccattgtggaagacagtgtggccatcatcttcagcaaactaacacagtaagagcaaaccaaacactgcatgttctcactcacaagtgggagctgagcaatgagaacacatggacacagggaggggaacgtcacacatccctgggcctgtcgggggttgggaggtgaagggagggagagcatcagatttttattattagttaatttgttttggtcgtcatgactagacagtaattcacatggtttaaaacaagtatcaaaatatagtgaaaacagtctcccttccacctgcgtg

SEQ ID NO: 46542 - DNA, 1035 bp, Homo sapiens
taggccttagccccgtggaagaaactctgtcctgtgtggtcttctgtgtgcagtggaaactttcagcaaggcttctaaattcttgatgatcacaggatcgctttgcaccgaaaactggcatctggcctgcgcttcattgagggttccctacttttggcgagagcttttgaaggcctgggtctgtgagttttcctttattagtaaatgataacaaagcactttaaagaaaggagacacgtccgtggtggtagttcttgctgtgtgaagaaagggagcactggatctgagaacaaacctctcccaagttggtccctggggctcctcctgctgctgctgctgggagccccttccttgcaccagtggtcggctgcttcccatgttctctcgcgctctctgtaggactctgcctgcgatgactgtcctcccttcctgagccatttataaaaacagactgtttccatttctaagtgactaaagggattccttgaagtagtgagatcaaagatgcgtttggaatttgtctctgagtgaatactaacggcttgtcatggagacatgtcacaggggagcccgatcttgggaaaaccaaatgaaagccttaggagccagagagcgatcagggtggggagtgacagatgcagggaattttggatcagacaaaccagaaatgatcactttccacatatgcgactttgggtgagttgtgtttgtatctgtgaacctcagttttcctaatctgaaatagcattagtcatgccgacctcagagagtcctagaaattaagtgactattatgtataaaatgccaggcatggtgactcagatccagtatttactcgatactttttcccctcttcataccctaatatggtaatggaaaatggattttgatggattttgtaggcacattttaaaattaaaagctattgcagaattccagctagtcattcactggtgttcataaggttagtgggtgcctactacgttccaggctcactttaagtggctggggaatggagtattatgagacagacac

SEQ ID NO: 46543 - DNA, 1031 bp, Homo sapiens
cctgcattaatttttttcttgctttcccagttatatatgcatatatataaacttcacagataccaaataggttattgctcataggtaatataatttgtacctgatgtaaaggctgcaactgaggtttcactgatggttggtttacctggaattttgtgagttggaaggcttactgaaatgaaggaaaatgcttatgtatgacccagctctctctctacgcattgaccaaaataggttgatcagggcaacagaaatgattaataggatagtgcagatttggataaagagcaaaaagattaggatttgaaagttggaggatgaagggagtcatgtaggatatagtcaggtggaattcggacttgctcacaaaatcccagaatactgtaacaaaagggcacttctttatgctagaaggagataatttcactttaaataaagggaaatggaatgtctttgcccagaggataacaagcaaatagaactcattttcccgaagaacctgtgtagtctggggtgtcagggatgtgtgttcaagaaaaatttaggcaaaacccaatgatagcttctcaagggtaagtttcaaacattcagacaatatccctaacccttgagtgaaccatcacacagggaaacgattctgttgtacagaatatgttttgatgccactgtcagacataaagtctggtgggaactggacttctactctgacccagggtgacaatttttatgtttttaaaatcggccgtcttccagaagtgttcattttacagtgcttatatctcagtacctgaacttctgcagaagagttttatttgagtcataaatttctaatgtcaaaacctccctgacaattattagccaaatgtttagcccaaaagagagattaaaaacatatatcttgtaacctagctacccaatgagttaacccagagagaattttcatgttggaagtagtttcataagactttggggagagatacctgcagatctgacatattagtggtcagaacaaaaacctttgtaatacatga

SEQ ID NO: 46544 - DNA, 1018 bp, Homo sapiens
atttatttgtcacttcagtgtttcttttcccattgctcttctctcagcctcttgtgtcagccctgcccaggctggcttttatatccttagcctttttttttttttctaagtatgggaaaacatagtttagaagtaatcccttctcacaaaatcacctctctcaaccactctgtggttattttatttgagggtggtggaaagagggagatgtttgtagagcctcagagagaaaagcacggttttaaatctaatcattatcagagtgagagctaaatacttttgcaaccttcatgagagatatccctgggaattttctggataaatatcattctcaagttttggcagtgtgcagaatttaggccacccacattgtatggggcataaaactgtttagtgaagttcaaataatgtgttgcaagagtttggttgaacttgtaatttaaccttgaggaaagcaaatacttgtgggaaaatatttgtgctcaaaatcaataaggaatgtgcaagtaggatgccctcactctgagagctgtagtttgcagctgaagctagtacaaagtggcatttgtcagtagtaagtaaaacgagcaaagtggatgggtggcaagactttgacattattggcctatcacattcagatcaagttcatctgcagatgaatagtcactaagatttgttaagtgtttactttgtgccacatagtacaacacagaactttagcactataagaccctgacctgtgagatggggaaattgactcttggagaagttagttactttgtggtggtctcatagctcaaagggggctataatttagtctcagatctacctgacctcacatttcagataacttattatctgtgcatgccatggcccttaaaagaggattacttgtaactttttatttattaatttatttaataaagagatgaggtctcactgtcacccaggctggagtgcggtagcatggtgcctcattgcagccttgaactcctgggctcaagtgattctcccacct

SEQ ID NO: 46545 - DNA, 1068 bp, Homo sapiens
accaaaaaattagccaggtgtggtggtgcacacctgtagttccagctaattgagaggctgggttgggtggattgcttgagcccaggaggtcaaggctacagtgaactatgatcatgccactgcactccagcttgggcaacagagtaagaccctgtctcgaatgaatgaatgcatgaatgaataagaaactgaatctttaggaatagttacttagagtcctagaagtctgacttaagtctgacttaaatcttaagtaagttaagagtctggcttaaatctgaacacagtatgtacattttagtaatgttctggacacagagacctgagccttggtacagattgtgtggtattattaccaacaccgttttaacatttatgttacaaaagacttctgcatgttggacaacaggaaagaaatacagtacttaactcacaaacaacaaaaggattaggacagtccttctgaaagcaggggtctcaacatcaaatgtgacaacagccatacaggctttacaaatatgtagactggcctagtataagagaacagggagtgggcacatatttagcgcattgcaatgggcataaatacctgaagttacttgacccgtggaagagcccttgacagccagataggcagcaacccctttcctagtctttgttgtcatacactgtaaactgaaattgtgctgcatttttttaagtggtacatttcataagaggttgaagtgaaaagaatgtacctagaattttcacctgggagaaaattttattcctgattcttggttatctataaaattatatacctggggataaaaatttcagtttagcttaaaacttaaattgttggccaggcgcagtggctcacgtctgtaatcccagcattttgggaggctgaggcgggcagatcacctgaggtcgggagttcgagaccagcctgaccaacgtggagaaacctcgtccctactaaaaatacaaaattagctgggcgtggtggcacatgtctgtaatcccagctactcaggaggctgaggcagatgaattgcctgaacctgggaggcggaggatgca

SEQ ID NO: 46546 - DNA, 1092 bp, Homo sapiens
tcacctgtggtcaggagttcgagactaccctggccaagatggtaataatacaaaaaaattagctgggcatggtggcgcatgcctgtaatctcagctacttgggaggctgaggcaggatagtcacttgaactcgggaggcggaggttgcagtgagccgagatcatgccattgcactgcagtctgggcgacaagagtgaaactccatctcaaaaaaaaaaaaaaaaaaaaacaaaaaacactcttgttgatacaaagaaagatctagaattaaaaactttacaggaggaaagtgaaaaggctggaactaactcacccaaaatatttagcaagttaatcataaataagataatagattttgagtctttcggttttcagtggagaactttatatttgattttgcctaatgtgtgaaactgtataaagcatactctatagtatatgttcctgctgcctggaagcagacacatcatcaaagtgtgtgtgtgtgcaagagaaaacacattaatttctctttctcagtttgtcataagaggggagtgctataaagaatcttctggctgggtgtggtggctcaaacctgtaatcccagaactttgggagaccaaggctgcagtgagctgtgattgcaccactgcactccagcctgaatgacagagcaggaccgtgtctcaaaaaaaaaaaaaaaaggaatctttttacctgcaaattgtaaggtactcgagggcagacattggcattttcagatacatgtgaccctgtgtgtttgtgtgaatttctgtgcacacgtacatccccctcccacgccttgacataatgcatacagataaatgttgaggttcagtggcagctgttttgtttcccacagacattttacttagattattctggaaaacattctgaagagaatcacaagcattgatcataaagttagaagatgtgatgtttaagacaacatggacataggaattgaaattttctttcccattgtctctcgagtgtttttgaggccagtgtttcttactcttgcttgagtatacctggataacaaaatccagtttctaagatttctgccctagagattctgatggattt

SEQ ID NO: 46547 - DNA, 1339 bp, Homo sapiens
ccacgtggccaatattgttattattctgtagatggtatttcttggaaattttgtttcattccctttctggaagtgagttggacttttacctgttttttggcatagatttggtctctcctcctcccagtagtggaggtgtaaggagtaaaaacttttcctagaaataaaacataacaagcacttactgagtgcctggtgtgtgttcacattgtgtgaggtgttatgactgcagaatgagttttccataatcactgtgtctgcattggagttggaggagaatatcttacacagagctcccaaatcccttgcaatttcctgggtgatcaactatcttttgttctaatgaggttacccttagtggacatgatgctaaggcagcatataaataagtgagggctcatgtgatgtgggctgtgtaaatgtgccaagatacttcagtgtgagaaaaaaagtcacatgtgatggcattagtctgtggaagcttcgtggagaaaactctggatagggactttggaagtgtagtttttcttggctgagtaggtctctttcctaggaaataattctgtcccattccctgcaggtatcaagtttggattttgatgaataaagtgtctcttcgttttaaaaatagggcactgaatcgccaaggcagtggcatacagggtagaacttcgtggccatggcccacgtggactgtaatggcttcaggcatttggttttgcttcacacttcaaagaactgaaaagtgaaggggatttatttattcatgaaaacctgccccacacaactgctctgtgtgcctggaattcttgttgtgggtgggcaggctgatctggtgagaacagtagtggaaagaggagaggaacatttcctccctaggatggaagtcccatagagcacgcatttgagactgctgagttcattgccatatgctagcacattaaacagagtgcgccatagagttggggctcaaaagtttctttgtaagggagtgagataataattgagctatgccttctgctcttaatttggtgttaggcatacaagcagggtaatctaatgacagaatgaacataaaacaagtgagactgattcaacagatgaggctgtgttgaatgtataggtgggcagaggtgagaaggagcaactgtccatcttggagttcaggaaggttttggacatggtgttgtacgaacttggtctttaagtatgaatggagatataagttgaatggaaatataccaggtatttcaggacaaagagaacacaggagaacatgcctaattgtaggaatggcagggcaaaggagtactggaattaaaaaacaaggtgggggcca

SEQ ID NO: 46548 - DNA, 1463 bp, Homo sapiens
tttggagtaaaatgaattaccctccttaggaaatctggtcgctctatgtggccattcctttagttcctgcccctcctccacagaaacacaccattccaaatctggcagctaatttttcatggtctttgtttcttcaaaattattttcaggaagtcttggtgaatatatgttggggtataaacagaccacaaagaaagaccccataggggtattctgttgatggattttctgcacgatcttttctttttcattcttccattatacttcctggaggagggactacccctttgttcgtcatttagttccagctgggtaccaggttgggtatttggggaggtttacagattaataaaactagaccactaccctccaggagttttcaattttagaagggaagtatataaatgtaattctaggtttaattttctaaaagtcacttcagaggaatacaaagtattagggaattcagaggcagcagaggcagagtgaggtggtgtgaagtgtgagctctgcagtcactgccttggtttgagttcctgccccaccgcttcctacccacagaactctggccagtgcttgagccctcctggtctccaggactttgttggcacagtggacatgccaaattttttgatgagagacatgacgagttagtgctggtggagtgcacaccaccgggcccagtgtgagggtcagtcctggtgagctgctgtgctctgtgcgttgcctgaagctttccagcaggccttagctgatgctcatggatccaaaacatcaatagtaagttactaagccttatctgctgctccttaaattgacagagtcaagaattaggtaaccagggaggagccacagaggtgtgtgaatgggaaactagacccagtcctggaagatgagcaggaaatggagtgggagacattgataccccaagaccctagttaggcaaaaagaaaaaaaaaaaaagacatctaggctgggcacggtggctcatgcctgcaatcccagcactttaagaggctgaggctggcggatcacttgaggccaggagtttgagaccagcctggccaacatggtgaaaccctgtctctactaaaaatacaaaaattagctgtgtgtggtgatatgtgcctctaatttcagctactcaggaggctgaggcatgagaatcgcttcaacctgggagttgaaggttgcagtgagctgagatcatgccactgcactccagcctgggtgatggagtgagactctgtctcaaaaaagaaaagaaaaaaaaaagacatccagtccatccagagagcccgggacccttatctagtaagaaggcagctgcaatagaaagaggaaggcatttggtgtgaggactcagatacgtattatgtatatgtggtggcaggtgggaggagggtggtgatggaagcttctagtcttggtggtaacattcacgatggatgacatagaagagg

SEQ ID NO: 46549 - DNA, 1047 bp, Homo sapiens
cttcagattataatgtaaaagtgaagtctttttgaacagagcagaagaaaaggatatcaagggcatgaagtggatgttactgaagggagtcgtggtgtgctgtaaaggaactcctgagagggacattggccgaagggtcatctccctcttcttggcactgaacgaccaccacagaccacaaaagggcttagaaccgacctccatttcaatgggacttttcagtgacacttgagacctcgtgtcatagccagtttgtgaccattctccaacccaagcattctgctgcttttacaacagattattttagaagctgcttaggagatgctactagggatgtgtcaggcttcaacaaattaggatttcctccccaccactctgatgatggtgagaccagcatggagactggcagagtgatgaatgcattggcttatcaaggtcatgagtggcagccggctgcattgtgtccccaattcaaacaaggatcccccaacactgcaacagtctaggattgtctcctaaattcttcacattccaagcacacaaaggaggtgtcctggagccatgtaccttggggaaggcagattatttgtaagctcttgtgttgccttcactgcagacagatgggcctcctctatcctaaacagaggctatttaataacgtttgcttcttgttaactttccttactcacctgatctaatgaacctatgctgctttggaacatcactggaaatgtttcagaacaaagcaagaatcatttggactagtacttcttttggagaggtggctattaaatggggtttaaagtttttcatttgtttgtttttttacctcttagatttggagcttcttctatggccttgcacatatcattctgtgactatgatgcccacattagcccagttgtcttacaagtatgtaaaatccttccagcagttcaggttcatttggcattcttgttaaatgtactgctgttaggactggaatgagaaaaatgatagaaatacaagtaaccataaaacaaaactagaatagaataacagacactg

SEQ ID NO: 46550 - DNA, 1029 bp, Homo sapiens
tctcagagcggcctcggaaccccagagaggttattattgtttgatcagtcagtcaacaggtatttattgaaattcttccaggtactttgagagaatgagagatgtatgtgagcttaactgtgcctggtagtgggacccatttggaaagagctgggctctggagttagtctgatgtgggtttcaatcctggttttcccactccttgggttaaagcttttgaactcctttaccttctcttagcttctctttagtcctagggaaaaatggagatggcagtatctttattttagggtcgtttgaaggattagcaataatatgtatcaaatgcttggccaaagtgtggggcacatggtaggaatgcagtggcagcgattattatcatcactttaattgcaaaactggaagttcagattccaggaggaggatgtagttgctgtggactggccttctcaggcaaaacttcacttggaataggcttggaagactgtataggagttacatgaagtggaatggtttgactcaaagtgcagaaatgggactacataaatctgttaggtttcttgaggaagtaggggagatcaggtaggggaagggcaagaaatcctacttactaggaaagatggcttcctagctagtttggggcacaaatactcaacagaccattgctatggtgaaaatggtagaaatgagaagagcaatggagggaggaagacctgtgtcatgaaaatacttatctgactgttcagcattattgatattgtggtctggatgactctgtgtcatggagacttgccctgtacattataggatgtttaacagcatccctggcctccacccactggatgccagtaggtagcattcttcacccccatacacatgacagtcaaaaatatctcctgactgccagatgtgccttggtggggtcactgaagaccactgctttagtaattagactaagcatcagtgaagatgagattttcatttcagtgttggaagggagaaaggagtggagttcatttaaaataatag

SEQ ID NO: 46551 - DNA, 1034 bp, Homo sapiens
accaaatcctctcactttgtggagtcttggaatagtgtccacgtaaggctggcctggttagtttctcctctgcttcctgagtccttgagtggtctttgtatatagcgtgaagtgcacagcattgggaagtctgtgtctgcaagcccatcaccttcactaggatacaacattttcatctttggacctctaggctaaccggagattgaaacttacttggcctctacctaaacatttcttgagcaactcagtgagctgtccatgtagtttagcagacgttccgatgattgtttcatggagtttgtgtcaacggggaaggactgctgagaggcagaaaccataatgaccagaaagctggaagtcatggaacacgtgtccacgtttcttcagttaatttttagaaatgagtgaatgtcacctgacagttggtgtctcttgtttttttttaatgaagctgtaccattgcaagccattttctctctctaagtttcctgtggaatttctttccttatcaagatagtaatactttggagttttgaatttttaagagattcagtcaaagcatcttgtcattttatccagttgctccacttcttaatctgtaaaacggagatagtgtctttgctattaatttttcttaagggacacagaatccaaatactctttgatctacaaatcttttgcaaagatgcataactgtttactgaacattttactagaagtcagcctgttgcttttaaaatctaggaatgttatttggcttaccaactaaacatattcatattttgcttagcatgccccctttcagatgacttgctgcagaataatgaggtgcaagttgaacaaagtacttttcaaattaccacaggacctcaccagttttaccacttacctccagatgtgtggaggccatcatgggagaatttacctttttatgtttggacatttttgtaaaaagcttgtggtgttgaatcaatgggttatgaaatggttttaggaatgtaacgagccatcccgtgattctacagagagagaca

SEQ ID NO: 46552 - DNA, 1862 bp, Homo sapiens
caagctatgcctgcataagtaagaaccgcagtataatgaacacttgctatgagccagacacagtgttggaggtggtataggtactccaggaggaagacgtctccagccagttagctcaggtgtgtttgtatggcaccagtgccccaagatgacaatattcaaaaatgccagacttcttgaagtttagacttgagagtctcccagtgtcatttctactacattcttttggttaaagcaagttacctggctaaacctagagtcagtgagagaggggattgttcaacagtgtgcatttagggagagaattgtggctatgttacaaacaatctaccagagacttacagacggcagctgtctattccccatttgacttcatcatttatgagcagacgtttgttaagcacatattgggtagcaaaacatctataatattagcttttaattttttaaaaaacttttatttccagaaagcttagctttatctacaagtacagttggtccttgaacaatgtagattagggggtgctgaccctctgtgaagctgaaaaaccatgtataatttttgactccctgaaaacgtaacaatgaatagcctgttgttcactggaagcattgctgatgacataaatggtcaactaacacatatttgtttgttctatatattatatgctgtattcttacaataaagcaagctgggcctggcgctgtggttcacatgtgtaatcccagcaatttacgaggctgaggcgggcagatcacttgaggccagttgttcaagaccagcctggtcaacatggtgaaaccccatctctactaagaatacaaaaactattttgggtgtgggtggtgcgcacctgtaattccagttactcaggaggctgaggcaggagaatcgcttgaaccgggaggcggaggctacttgagccgagatcatgccactgcactccagctctgggcaacagagtgagactctgtctaataaataaataaataaataaataaataaataaataaataaataaagctagagaaaagaaaatgttattaagaaaataataaggaagagaaaatatatttactattcattaagtgcaagtggatcatcatgaagggcttcttcctcattgtcttcatgttgagtagggctgaggaggaggaagatgaggggttagtcttgctgtcttgcgggtgacagatgtggaagtaaatcctcatgtaggtgggaatgagcagttcaaacctatgttgttcaagggccaactatagttgattaactcatatctctacagttaattttcaaacagatgtgatagctgaatgagaacttttaagatagtactggacagtaaccttattggaactggaatggcctttagactttttgtgtccagtttcttctcacctcctctttctcttcaaatgtgcaactgaaactgagagacctcagtcccatgtccaaggtcaggcagatacttagcggcagagtgaggactccagcccatttctgcagctctgctgtgcagtggaagatttgggacaagtacattatttaaaaatgcccacccactaaatattacattcctaacttttcccaatacacaaatatgcttgaacttttaaaagcttgtttttggtcgtgcttggtttggaatgtgaatgactaaaactacctttagcaatttcccaaagtgtaagttcaaatgtacagagaatttttttcctgaatgcccaacacaatatgcagttttacaacacataccagattcttagattcatttggtgaaggaagcctctgaattaaaacttttaaatatttctgatttgcaaccagacgaaaaagaagaaaattgacaacttttttg

SEQ ID NO: 46553 - DNA, 1070 bp, Homo sapiens
taattttaatttacattaactttaaaatatttgtatgccaaacactagttattttgaggggatcgaaacaaatcatagcagagataaggaactttcatactttgggaggattttttttaaataactgtatgtttactctaagtagatatgtgtatgcatgcattcacttatgatatgcacacacacacacacacacacacacacacacacacacacacacacacacagaaatttatgatgtcctttaagaatcttgggactatcagaaaaaagttaagtgaaataacaattttcaaaaatacatttttgtagtaaaaacgcaccatcggtgttacattactgtataaatcaaatttgctgaagtttataaatatttttatgtttactttaaacttggacataatcagatctatctgctgttgacgacatggctctcaatataaaaataatcaccttttctgcttaaagcctcattctcagaagtaaaatgtgtatgtgaggatattaactagttcataggattgttgtagaaaaccttttacatatgtggatactgaaattcttatggcctggatcagtggcctggatcatagctaatctttatgaaaagatcactgtattattacattgttactacaggtagattttcaccctggtccttgcatgaatcatttggttgtactgtccatgatgtccagtagtagattaaaaaaaaaagaaataaaaacaaaaacccaagccaatgcctacgacgttgctacaagtatcctttaacctgtggtgtgaagttatttccaaagatgaagtttgccattcaaataccatttcctggtgttcatttgatttctgtaacacctctttttctatctccgctaactctagatctgtagtccttccaaacatgctacctaccacttacactttgccaaagtgtaatttttgctctcttatctgcttcataagagaatgtttgtagtttcatgatttgtaagtgggagggggtgcttagcaggagttgagatcaccagcccagggaggaggaaatggaatcagaataagcaagaggaata

SEQ ID NO: 46554 - DNA, 1033 bp, Homo sapiens
agcgtatgtcactaatgtatagcatatgtcactaatgtataacatagttctaatcaactaaaaatttgtacagactcctagatgggctactaagtgaatatattttcctctgtcctctggtggacttcactacaacttttacatatttcgatactgaaattcttaatagatttggcttcaaattccagcctgatgagataatattggcatctgcccctgaagtccagtatcaggtcattcttgctccacttcaggcttctttcaaatttggtaatcgtgctcctcgtgtcttggatggctatattggcaagtcagaacccttcaattcatctctgtagacctacctgccttgggttcccgtaacccattagtaagtccctttgggtaagagttcccactaataatgtttttctctcgatttctttatcatgccttgaaactgacttgaaacattttgttaaatgcctagctaaaatcccaacacacttgtgaacagatgttagtatgatggaagaacagaaaaaagacacggccaagctaagatgttggtatgattaagttggatgaacagaaaaaatgtgcagccagatctatctccagaatcaaccaatttccacattgctttcgatctcatcctattatgttttctgtaagtaaaacttccactgcaaatattaattgatgttaagtcaaaagtactgacggtctggtcacaggggcttagggagaaacgagagaagcaaaaagggtctccccccttagggtaagctagagtcttgctgggtcagacaattaggcaacaatgtaaggcagtatataattaaatgctaaattatgtagagcagattatgtgctatggaatggagaaaatggctctcacaacatttctaatgtcctaaatcagtttcctaaatcagaatggtttcatacatccatatgtacttaaagcatgctcagtatcattggtcctttcctgcttttttgaagccatggtaatagtaaacattttctaagtatctactgtaggtcaggg

SEQ ID NO: 46555 - DNA, 1338 bp, Homo sapiens
taaaaaaggagttggaaaaggaatatgtagattcaaagtgacttaaagaatagaaaaaaaatttgttttaaaaaatggccaagactaaatcatagtgtctagggaggtacacctgaataataaaactataaagaaatacaaaatatgattactactaagaatagtctgttgccagtagtacacagaatgagcactcaaattataacagaagcattttggtattcataaatgttctttttttaaaaaagaacacaatcgaaattataatataggctgtaagtactgattttaattgtagtgaatgtgaaagtgttgttaatgaaaatataaagaatatttgttaaagtgtggacctagccaggaatactaggtagaaaaggtaactctttaaaaacatttttttaattgtgaagttaatttattgtcactttgtttgatatttattattagagtccctaggttaattctgtttttattgcttttcagaataattaagacctaaatcttctgccgaattctgtttggtttccttatttcttttgccatgttctttcattccacaaatgttattgagcacttccagtgtaccaagccttgtgtttactgctttgatgataaatgcaataaggtaatgctgcttttaaggatccttcaggataggctcttgtagcagtaaggacttagtatttttgctatagaagtgtatggagagctatctatggtgcaataactgtggaaatacagtttttattctatttggttcccatatacattgagtcctcctttggtgggaatttgatcaggttggtctcagttgaatcctggctgcatatgcctcagtaaggaagaaggcctaggggactgtggaaagcctggtggtggtcctggaaggcttgagaatacctggagctggaagctccttgctcattggtgacctttttcatatgcagcagagctcttggcattcctagcatactaccttgaaaggactgtgtcttgcctcctagaaattctggacttggtagaatcatttgtttatgttattttaaaaagaaaaaaaactctgaaatgtactttttggaagaaaaatgaacttgtttttggacttttctgtgtgttgtttctttaattgaaaattctgtctggagattgattttcaacccccttcctttccctctagttttaaattgtaacattgctttccaagcatttcaaaaaaacaacaaaaaagaaatattttattattactctatttttatttgctcattaataattcttgattttctatctatatgaaatcaaagaaaaattactgtataattttcatccagttgcagt

SEQ ID NO: 46556 - DNA, 1044 bp, Homo sapiens
gacatcaaaaggaactctaagctttaccaaaaaggttttattcgagtaattaatactcttcatgcacagagggaaattagcctccaacttgtggacatggtgaaaaattagtatcttcccatttgctcggcttgtttgaactatagttgattatttttaaagataaggagatcaaatttccttaatatttcagtatgttgctttttgtacccttaaaattattttttcctatgcagaattgactttgattaaaaaatgtttttgatgactattttcctgattcgtcagtatatctaattgtgttcattttactcatgaaaaatcttgtctatgagggacgtatttttagtaacatttttatagcatataagaacttttacagcaaaaacaggaatcattaagtgtgtgtgcttttatcataacttctcttttaatggaacttaaaatcttaactcgtgtttttgcagcactttttttgcacatggtaggttcttaatatttgaatggaattcagtgtgactgttctttgtgttctcaaaagtctgatctttgtaacaatttgtctttcacttgagactttttttttctttgcatatgtgcacgtctcactcttggttttccttaatcttttttaactaaacacatctatgactcatatttccctatttatgaataggagcaatttaaaatttcccaacatggtggtatgtgatgtaacataaccaaaggctacatgtttacccttgtttaattacccttcatttgtggaaagatgacgtatgtatttatgatgtaaatgtctttcagaatgacctttgggactaagcttttttttttttttcccaccaaaaaatggtcatgacctaggaagccttgttagtaaaatttaaaaaggaaaagttggctgggcatggtggctcatgcctgtaatctcaacactctgggaggctgaggtgggtgtatcaattgaggtcagagttcgagaccagcctgggtaacatggtgaaaccccgtttctactaaaaatacaaaaattagctgggc

SEQ ID NO: 46557 - DNA, 1081 bp, Homo sapiens
tgtctgcctaatgatactgggtttagttcttgaattctttatattcagaatatggattagggccaggctggccttgacaacctgaatcattaaacacttatggtgactggtgggtgattagccacataagaagaagatatattcataacagatataataggagcaatggggactcgatggagagtattaaatagtacagtgtcttccataaatgttctttaattgtggagattactgttctgtagattattcactcaggcattgagtatgcgtttattaagtgctttttgtgtcctaggctcattcacaagtctaaacttcaaatttggttcttaaattcctcaagaccagagtttagctaaaagtatcattatatcctgagatggaattttatcaaattgtatgcttaaaatgaggagatatgtctgtttctccatctcgcaagccccaccagtttaactgtcaattggtcttgtcaatcaactataagaggtgtaaaaatgtcttgggctataagtacatactccagggcgtatcctggtgacagagattgagaaactgattggaagagagtgtaatcagtagtgctggccttactgttctgaaatttctggtttctttccctcgctccaaacttaattctttcttctctattttcaatttcagaagaaatttagaatgagtgagggaaattaaaatgaagtccagaagaccagcagagatttcaccgggcatgtgggtaggaaagacgtgtgagaaaaccatttgaaatggaattaaaagaaaacgtgttcagctcactatataattatagttagcttggcctggtgttttgggttgcattacctgtaagtttggaactcatttgttgtatagaaattgataccccacatttacttaaattttgcccatctgtttcttgttaaaagaaactggacatctgctaaaatatccttgttttggattactcaatcttattgtcaccttataatggttttattttgggggaggtttattcgtattagtatgatggggaaagaacagaaagatcttattggaaaataaatttagaattttccaa

SEQ ID NO: 46558 - DNA, 1050 bp, Homo sapiens
aatatggattgtgtaaggcactgggctttaggcccccagcccgaatatctgtcatctattaagtacttactgtggataaagaaggcagtatacttaacatgcactatttcatctaatttttgcaaaagctctttgagtacattaggccagtctccattttattaatacggatgaggaaagtgagaccaagacttgagttcaatgacttgcccagagtcgtgcaaagcataaggggcggagtaggatttgaacaccgcatgaactgggctctggaatcaaacgcttccctaatgccatgccctaggtctcagcctggactgtgctcccagagtcacttaagcacttttcaaaacactgacatatgtggacccagcatttcgaggagctgggctctgggcatttgggttttgaaggttttacaagtgaccctgatgctctgtcaggcaggcttaataacgactgaattatataacatgcccagcttggtttcttgcttggttgttgaattgctgcatgaaaatctgatccctgcagtctttgagcctgcagcccagtgaaagagatggatgtgcacacaaccaagcatgaacaagatgcattatgacaagtactatggtagtacagactttgtgctctgtgataattcctatgacacgacttgcagttgatcccaggaggtagcatctgggacatagtcactttagcaagtcctatttattctagcttgggagagttccttgcatcttaactctgtatactctgtgatcaccagacagtcttggtctaggttattataaaagtcctagttgaggatcttgaatctctcccattcagtttgactgagagagcttggtgattagatcagtggtttgtatattacctcatttgtcttccaaactaatagataagttcctcaggatccactccagtgggattactaggtcaaagataaatcattaccagactggttgatggtatcacccaggctggtgtgcagtggcatgatcttggctcactacagcctctgcctcccgggttcaagcaattctc

SEQ ID NO: 46559 - DNA, 1031 bp, Homo sapiens
ttccttactaaaaaaatgaggcctcgctgagtagggccagatgagctgtatattctgagattatttatagtgtttatgatagagagaccaaaaacagtaagcacttaatagctttccttatttacaagtcagattcatctaagggatatttttcttttatttttctggtgcttgaaatgttcctttaaaatagattatcagaggatacacagtgacacaaaatttgttgcttgtgaaaatgcagagtggattaagcttttctttttcaaggctctgcaacaaaacaggtacatttttatttcagtaaaaacactgctttttttttttgcctccgtcacacacacgagtaacataggatagatatgtgtatgtgaacatgtggctcttgttcccagttgtgtaatggatgcattcccttaaagtttgcagtaaagtgaatgtttattaagcaaattgtttttccccagtgacttctactgtaaaaatggcattgtctttcagtaggctctgaatatagtatgttcccatattctttggtaagatgaccaatcaaccaaaaaaaaaaaaaaaacaaaaacagccccaataacaaacaaacaaaacaaccctttaggtaccataaatctataggaaatactaaccttctgatgaagctggcccgatgccacttattgttgtcccccacgcctaagctatggtatatggctttaataacaaaatggcaacacacaatagtaccacaacctggagggtgttactctttcttctgctcacccttcctcccattgttcccatgggagagaggacagacaccaaggctgtagcaaataggttattttaataacctcagcatccttgtttctatatgatatacatttgatagccaagttgaatttacccacctctctctaaacactttttcctaaccctttgtcaatttgtcacaccatctttggatgaagagtggtacctgatggtgtatgatgcttaacaatcgaaacatctgtaccttgttagccataaaggctcat

SEQ ID NO: 46560 - DNA, 1109 bp, Homo sapiens
tcaagcagcagcacgataaaaataccatattgcatttccaatgaactcctttaattagatgagatgaattaattggatttttgggacatgtctgtgaaagtataagatactcacttttggaactcccaggcatggtgtggcctgggagctttctcagtttgctcctattcaggacatggtgtaagaactgtcatttgaagcctgtcattttagtcccccttgggggttttacaaatggcctagtgatttttcagatagcagagaataaatcagcagtgatttggcctgcccttcagcctagggcattccctggttatcaccagcctcatcatcaggtgcttgtattacacgtttttctgtccacaccggcaggtgagatggtaatctaagagttgatttccaacacgtgcggagggactttcgaaagtccccctagtcccggtattctcttgccctgtataattttaggggtccaggcattcaggcttggatcgtcctccttatgtctttcagggccttggaaaattctggaatttagacaggggcagtaagtcagtggctgtagcccttgaatcccatttgggaccttaactcattctaccttgcattataattatttggtttttaactgtctaggtttctgtactttcaggggtaaagctgattcattctcctctgtatcccagagtccacctccaaggtggtaggttgcttgataggtgcttagtaaatatcatatttgattaactttttgtagcctcctctttagtctagaaattctagatcccaaatagaaggtaagatatggtatattctggacttttagttttctatatctccttttcaaatacagacctagggtgacagacaaaaaaatattgtgatcaaagtatatagcatttcctttcatggtggaaaaatgtgcctgataaatgttttctctgcattattttcctccaaatatattttaatgacagttatttggatatttcacactttatactcgacttgggctcagattaagtcttgtgttagttataaccttgaataacaattaggttcatgagaacagggatggtgtatatttgtttttaatctgtttcccagca

SEQ ID NO: 46561 - DNA, 1037 bp, Homo sapiens
cttatgtattggagctggggctacttcagcaaacaaaacaaactcctacccattcaccttaccattctagtctgtcagttttgtaaagttgaagtcagactttaaatgtatttttggatgttattttttttcctaacattatccaagggcatttttctgttctagtaaattgtttggaaaataggatttttaaggtgtgattttttttttttttctaacccatggttggaccagagtttgtttaaccatttacattttcttacatatattttatttgtttattattattttgagacagagtcttgctctgtcacccaggctggagtgcagtggcgcgatctcggctcactgcaaccttcgcttcctgggttcaagggattctgctgcttcagcctcccgagtagatgggattacaggcacccaccaccacacccggctaatttttgtatttttagtagagatggggttttgctgtattggccaggcgggtcttgaattcctgatctgaggtgatctacccaccttagcctcccaaagtactgggattacaggcgtgagctacagcacccagccttcttacatatttaacttgttttttttttttttcctcattagaaatagtctgtaatgggtttcaccttgttgagtgttttcttcttgactagggtctctctctcaaaacacaatatagaacttcctgtcctgtcctccctaactccccactccaatcccattctgggctatagctgtttttaaggtgaacacccatttagtgaagtagccatcattaaatgactgcctagataaacatttgtaggtgttaattggtcctgccagggggcctttgaagctccactgctctgttctctttgaagttttgtttttctccagccaaaatcctccctggtctcttactgagcagacatccctagacttcactccaagcactgtgcatataaccttgcctgggatttcagaatctgcaggccttacctaggtagatgttactcttctagctaattgtatgcagtttatca

SEQ ID NO: 46562 - DNA, 1028 bp, Homo sapiens
atcattcagcttccaacatcctgatttttacagatgtagaaactgagggacagaacgtttcaggggtttgcttaaggcaagaaaattgtttagtgacaagggtagcaccagaatgcaggcccccttaattttgccttgatctgcagtctttcatttctattctcaggcacccttgaaaattcaccagccacaaggagatccttattaatggtgtttgttatgggatttctcttagaattcttcagtaatctgatgaaaacttggaggacaacctttgcaaaaataaatgataagtaaataaataaaagcatgtacacaatttgttatatggtttcaggggctgacacacacctcccgctgagggcatcctcagacttacaaactcttgctctgggagtttacattttgcctgtttgtttagttgggtaggtctgtggagctgtttagtctaagtaggagttttttgaacctttcaatttggccctaaggggtttagggaatagactgtgcattgactgaacaataagttgaattacatgcacttacagcaaaaagaaaatatgtgcaaggcaagtaaaaatgctaaatacttttttctttttttcctcattatcccaaactgtattaacagacaccttgagcaagttcatgatccagcagtgaaccttagatgaatgttttccttctccaaaatgaaaggtgggaattgagattctcgggttttaaatgtaaaatattagcacctttctccccacagttgtacaatagcacaaaagcatttctaacataaacccaattagcacagttaaaaaataaggtagggccagccctatggaaaattatgaagttggcaagtttgtcttctgacaccgagattctgattctctccttcctttctcgcctctttctaaacctgctttctggagagcacctgagaacctcaatcacaaggaatccctgagtaaatgttggggtgttatttgctactttcagggacatttgtattattactgaattcagcctagcaa

SEQ ID NO: 46563 - DNA, 1127 bp, Homo sapiens
ctaatttttgacctctttgtgatcgggccaagaaatatgacacccacactttggtttatgtttaaagaccacaaggggtcaggacctcaggattgggtctgatcagaaaagtggcatttcgtagaaaagcaagtttgctctttctcccaagcagggatctctttagcagggacacttctggattttcattatgttcccctttggcataccttccagccctaaacttgcatgtagcccgggatggtgctgcgaaaggtttacattcactcgcctggtacacctggagttttgactcattcctctgagtgggttagcagaattatttgtctttgagaaatggtgcttacaaactttattgccatttattattggttttttggaacacatgaagatgaagcaagaactctcaaatttggagatacgctagcagagcaagcaacgtgtgtcgtgctctggcgtaagagcaactactgtgctacttatattgatgctttctggaagatggccttagatatgtgagatgcagaactcctcaagtcaagatatgccagtctctctagcgttttgggtggaggcgatattgaagttaggtctgtagacgtgatctgtgtaagtttgacttctcatactgactcatggtgtgacttttgattagtcaccttgagcattagtttgggttttgcagagtgggtttcagactgcttcaggggtgctctaagcactcatttggtaatagcttgtaaaaacacaatcagtttccatctagcttattagcaagtgtccatgggaaaaaaaaagcttcagtttaatttgctccctcaagcaatcacctgtaagtttcctttggagcaaactttatgcagcctgatgactagattgaaaatttatggtattatggtcaagttagagtatatacaaatatagagtatatacaaatgtttcaactaaaaaaaggttgcttttggtgaaatagaatattatgtgtcgataaagaatttagtgctaaaagagcaatgacttctgtctcacctgtgcctttgtgaaaattagacgttgattacaaaggtatagaaaagctgcaaggaatgaaagaaaatacttttctcttgtaatagagagaaaataaa

SEQ ID NO: 46564 - DNA, 1012 bp, Homo sapiens
aatccgagaggcaaggcaatcacttcgtcttgccattgattgggtatcgggagctttttttttctcccctctctctttcttttcctccgtcttgttgcatgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggcttgcagtttagggcatcgaggagccacagccggagagaagaacacagcggtaggaatggcttgcaccaccccagtccggatcatttctggccccgcttcccggacgctctgcgccccttcgttccttgggatcaattggaaaacgaggattccagcgtgcacatttccccccggcagaagcgagatgccaactccagcatctacaaaggcaagaagtgccgcatggagtcctgcttcgatttcaccctttgcaagaaaaacggcttcaaagtctacgtatacccacagcaaaaaggggagaaaatcgccgaaagttaccaaaacattctagcggccatcgagggctccaggttctacacctcggaccccagccaggcgtgcctctttgtcctgagtctggatactttagacagagaccagttgtcacctcagtatgtgcacaatttgagatccaaagtgcagagtctccacttgtggaacaatggtaggaatcatttaatttttaatttatattccggcacttggcctgactacaccgaggac

SEQ ID NO: 46565 - DNA, 1045 bp, Homo sapiens
catatttgcacctttcagatacagccaactcttccagggcctagactgagctggttggagctccccaaagcagcattcagttgcttttccttgatatccaccctggctacctatattccctttctttatataggcacaaccattcaccactacgctggattatctaacactccaattctataactcatccaggggacacacagttgagtctgatgaagcctaagaactgccaggtgctgagatattgtaactgggaattaagatttagccaaggacattgtgagactactgctgactctcttggaaaactggacatgctttgtagtgcaaatgttcactaaatgatggtggttcattgttacttactttggcctttgcaaaatattctgaacaattcaataagtagagtttcctagtttgtttgtttttttaagtcaaaggaacgctgtgaaattattgaaagatgatgggtgaagagggacctaggagaaggcaaaatgaagaccattaaagagccccattgaagactgtatctctaaaaatgccttaatgcctggcacatattccatatttgcatatgaactactattcttttccaaactgtcaacttctgtttgaaatcattgtgggggatagtttggaaatatggtggcataaaatccaagcagtcaagagctaaaccagcaaaaaagaggaatgacttcattcacaggctttggcttctttattatgtggtggtcctctgtgatctcccatggttaacttcaactgtgctgtactttcttcccaagatgcatgtacggaatgttacctcctagaaatccagaaatagttgtggtgagttttgtttgataggaagcaagaggtggggaagtaaaggatacatatttttatgtctaaggactgtaaactgttgatgcttgacttttccttttacctacacctgtgctacacctttattaaaaggctgacacccagacttgtgcaggaaaggcactcttgggaatgaacagaaatgaataattatgagactttccatggtgcc

SEQ ID NO: 46566 - DNA, 1042 bp, Homo sapiens
agattaactggattaactgaaaaaagcacccattcagtcaatattatgggttttggaaaaatcttgctttgctgtggatttaaaatgaggtgcataatataatgccaactcattccaagtggtcattggcagaccattagctggaaaattgcttccagttttcatcactgtgcataactcaagttccctttggggagctgtctgtgcccttcactagaagtcctgttttagcatggcaactactggattattttattatgtgtgcagatggcatgatgttttagaaaaaaaaaattacagcaattctgcaatctcagtggaagtgttcacaatattatgccctggtaggaatgtaaacacgtctcgattatgttagttatgatgtctaaaggtatactgtccaactcttaagcactttatatgagaacactacaccaagatgaatcagcacattcagcacatgtgagaaatcaagtattttctttttatttttataaatcttagtggtttttttttttccggctcagactgtccaagacaaactccactactcgcatatccccagttgtttgtggtaggttgatgtaaatatggccacaatactgttagacttcacctccagatactttattgaacaactggtttacttctagcaccaaagggaagaagaagggggtccagtgatggtgatatcttagcttgcttctttgttcacaggcactattgaccacatgaacatacaggtactcaaatacaggaggcttctatttggctcctccaagggaggagttcctccaagggaaaaaaggggatggtattcttttaatcaaagaccatggtggatggatggtaagggcaacagaatgcaattcttttgtgtggtctgacgttaacacttcggaaaaaattctaagtcaagttgaaatcgccattctctcaagagagaaacatcaagagagaaacatcaagtgaccccactatgtgcctagagaaggaaaagggtcaagtcctatactaggttccttacttagggtagaaccta

SEQ ID NO: 46567 - DNA, 1091 bp, Homo sapiens
aagtataaattatcaagttgccatcaggttatataattttcctccctgctgctctcacaactgcatgccatcagagttttgaactaatatgtcaatataggggcataacgtggcttatattccacatggatttctagtttggatgtgtgagtgtttagaagagaaaattccttccttaaatcccacagcagatatgtgacagagagggcatctcttaaatacttccattaatggttttgtaccagtggctcttgatggagggaaaactccaattttgagacctatgtaatataatctcctctttgtggatgcaaattctcagtttttctatggttgtctccctaccaatgtggtttagtcatcttaagaaaggacaagattccttagtagtaactatgggaatactgttatttcatttaataccaagtcaaggtaactaagcttcccttgctcagtctctgtgtcatctatgagtttagtctgggaagatcagggattttgaagttagccctttgaacttagctctgattcttactagatgattcttacttggactcactattaacctttctaaacctcaatttcctcaattgcacactttagataaaatcattatccaaaaggttgttgtattagatataacacattaaaaatacagagagcctgtcctgcatggatattcactctacaagtggtttaataaaagctgtagttggagatggccatggtggggatggtagaaccatatttaaatgaggaggagaaaagactaccccatatcaaatgatattctaagacaatatataaataaatgttgtaaagactataagagtttagacaacagaacaaaagagaagaggaagtggccctgtaaatattcatgagatgggacatgatctgggtctggagggatgtgaagatcagaggcatggaggggatgaggatggcctttcaagtaaaaatcagcaacagaggctggaactgacagattttgtctatgaacttctgaagcattcagagacaggcatagtgtagagcagcagtcagagggtgtttatatttgatgcaagaacagataaacagccaaaagc

SEQ ID NO: 46568 - DNA, 1058 bp, Homo sapiens
gtacaagagaaagacgaaagtctatgaaaaatccaggatgcagggcctccacagcgggaagcatagagtttctatgatatgaaatgtaggctacaaatgaggcatttttagggggaagaacaggagctcaattttggacatgttgagtttgatatatttattatatgtaaaaattaaactgaagtcatcagttgcatatgtatatatgattctgtagttcaggaagaaaactgagctggaggtatagttttggattcctcagcctacatcatggtaaaagaaaaccaaaaaacaagccatgagactcaatggagagccctgatacgacatgtgaaaaggagattagtacagtgggcagtgagatttgtcttgcatttacccaaaggcaaaactcaagaatcagtaaaaagatgatgaagatctgactttgacttccatatgaaagtacgttttgaagcattaatgtttattaacaatggtgtggcctatttcataggatacgttttcggatgctgtggattttctgggaaagtgctgaatctagatcagtgtttttccaaattttatgtagctcaaaaaaagagaagaaaagaaaaaataatcattttaaattaggagattgacattttgtctttacccaagtaaagttgtttacacacacaagccttgatatattcatcataatttaggtttactaacccccatcttagatgtcttaaagtggattggactcttgcattaggtttaaacttgaacccactaactactgagagtccttgacaacttttggagtctgtggtcacagcatttagaaattttaaagtccattaataatattcagtgtgggcaaattaagagaaaaaaatcctctagtcttatctcctttaaaaaaaaaaaaaaagacactacaacagtgatgtctttaaacagtggttctcaaatttatggtcccaggactttgtcgcactcttaaaagtttttaagaacctcaaagagcttttgtttatgtaaattatgcaaatacgggaaaataacgaatacattggttaataaggatt

SEQ ID NO: 46569 - DNA, 1098 bp, Homo sapiens
acttattcctcttcttttttctaagccagtttaatagaacatcactaacgataaggatagtcactggaaagcaccaaataccaaggactggtaattgtgcctcaaaattcactttactaagtgcaaattgacacactcctcaaggatccaattgtaactattacccaattttacattgcagttggaaagaggcttcattggttgtggttgagttgtctacagtataataaatactttctgatggtttgtttctctattcaggaagtgtaatgataaacatacaacagagccaggagctggtctgcaattcattggcactacagattatttaatagaaacatggagatttataatgtgctgatttgcagagtggaacagacctcttatttaaattttatgatatgaatattttttaaatattgatttggttgtcactatgggctatagaattcattggcttctttgattcattaacaaaaggctttgtatgtagtgtccctgggatagtgtggaggaagataagcctgttgttgcatatcaataacacaaagtgatgcactaggagaaatcctgctggcttcatttgtaggggaaatggagaggaggagtactgttgttttagggagatgaattcagtatctgtttttctggcacccactcaaaaagagagaaaaataccatgagaaaactgtgaaacttggctaggagtgttttagttgttttattagcgatttaaagaaaacaaagaacgggaatcaagtgtaaacataaacaacatcaggaaaggaattcttcagtatgttccctgaaaagatttttgtaaaaactaatttataattaatggatgtgaggaggtacgctgtgtgtggcttactttgttttattctcacatttgctctgctaaccaataacagatggatattaccccttttgtggttgttgaattattattttcctttattttctttccaaacccctaactggtcatcttgaggtgtaaatgcctttctcccaaatgcacaaacatggaaaaatatggcatattactcagggttctccagagaaacagaggagttagaaatccaaatctaaatctgt

SEQ ID NO: 46570 - DNA, 1048 bp, Homo sapiens
atgaagggttgactgtacttaaccttgatcaaattacattgcttagctgcctttgagaaggtctgttgcaatttagggatagaatgatctaattcttggctatctgtatttgttggctcaaggagcaaaaatgtctccaaacaaagctgccaacccaatataatgtcacccatgataggaaaggacacaatgcatatgaaacataatgaggatgtacttcttaagaattctcataagggtcagaacaagagacaagcaaatatgacttcatgctatgtgagttccaggaccccagtacatgtatattgagttcttggacagggctcaaacgaaactacagtaaacttatatccgaagaggtaagcttttattactaacatgttaagctctgaaaagtatgacaattaatatgatatatttaagccataggttcattgtataatcaagaaaaaagaaaacctagagagcatttgaccatctaatttattttacaagttagggagatgagactcagatgagactgaatgacttcacaaagatcttgaggctagcagtgacacagtctacctaaaacacagtttatctaacacatgaacagtgcttttcactcttttatgctgacagatctataggaaataacaagtgcttggagccacttagttaatagtatttgtctagtggacgaagagtacaggatatgccatttgacaatgtaaaaggagggcggtgttcaggcgagtgtatcagagcccactaaattcatttgagtttatccacccaaactactaaattactaaagtgattctctttggagattattggtacttgccatcccttctgcctataatgttctccccttgatcattgttcagctagttccttgtcatttaggtcctagctcaaatgtgcttctccaagaggtctttcctgaccaccctaactaaatgaatccctagtcacattctctgacatcacttggtttgatgttctgcatataactttttctggtctgaaatcatcttgtttgttttctgtctctccacagaat

SEQ ID NO: 46571 - DNA, 1052 bp, Homo sapiens
aggctgaggcaggagaatggtgtgaacccaggaggcggagcttgcagtgagccgagaccatgccactgcactctagcctgggagacagagcaagactccatctcaaaaaataaaaaataaaataaaataaaacaacataaaatgcttattagggtatttggtacacagagaacaactaataaatggtatttgttttcttattcacattctctctttcaacattgactagacaagggctatatatgacttaagataatttgctctcctttactagtaaatacttaacttagtcttttttttttttttttgaccatttctaatatacttggtctcatgacaaattctgcatcaatcagtggtggtgaagacagcaacatgtaccccatttctttttttgctctttcttggtcagatttatttgtgctgtctgcgcattgtatttgaatatttgaaatgctaatggctaagggccatgtccttttggtctctgaggttatttcataaagataatctagaactcctaggaaacagagacaaccttgcccaactcctcatttaagagattagaggctgggtgtggtggctcatgcctgtaatcccagcactttgggaggctgaagcgggtggatcacttgaggtcaggagttcaaaaccagcctggccaacatggtgaaaccccgtctctactaaaaatacaaaaattagccaggcgtggtggcaggcacctttaatcccagctacttgggaggctgaggcaggagaatagcttgaaccggggaggtggaggttgcagtgagccgagattgtgtcactgcactccagcctaggcgacagagcaagactccatctcaacaacaacaaccaaaaaaaaaaaaaaaaaaaagagagagattgagaggttagaacactaaggcctagagaggttaaatgttgcacctaaggtcagaggtaggatggctactcagacctccagcgtcctcatcttattctcaacacaaacacaatcagcccctgcccagaaaagaattatcacttgcttatctttcccccaa

SEQ ID NO: 46572 - DNA, 1039 bp, Homo sapiens
taaagaacaaatgatcttaattttgccatcataataattttaacataccctgtcattttcactctgtgtgctccttccttttgacactgtaaagacctcttccagtgatcttttttccctaaggattactgagttaaattaactctcagaacttcctgttgccctaatgatgccaacatcagcatgtattctaccgtatactttttgaaagtgcaggtcattatttgagaaatttgtattaaaagtgtgttttcctttaggaaactccatattaatcttaaatttcatagatgccaagtattgcctagtacaatcttcttggaaatagcaaggcagtacatctaggaagttgtttggatattggaatgtgctaagattgtgtataagcaattaaaataagtatgaaaatagatcccttaatataaggaactggcctctttgggaactggcatggttttatagtgtgtccagcacttcatttgagctcatcttcttgctggtggaggtgctggaacaagaatgaatgaaagtccaggacacattctgaaccctagttgggctggggttcctggaggatgccagaatttgtctttaaaatagaaagagctttggactaaatggagtgaaggactctcagaacaatctgagattcttatgtctccaaacatcccagggaaccaaaagtctggccaagaaggtctggtccctcagagccatgtgaacaggatgaggcccctacctctcccaggctgatgaaattcaccagcagctcagaacccacagactgaagagtgctctgtacgttctcctgccccatccctcatttgccagctacagtagctgttagtttggggctgaggatttctagaggctccaagggggctggaacccttttcgagctttcccagggcaggtatcccaggtgattttgaaacaatggttaagcttctggatgttctccacctcccagttacccatttcctcaaaaaataagttgtcactctttaaggatactctcaaaggctggtgacaatgaaac

SEQ ID NO: 46573 - DNA, 1027 bp, Homo sapiens
aaaatatgggaatatcttttgcatttattcatgtcctttttaaatttgattttcaacataaaagttatttgttttttttttgagatggagtctcactctgtggcccaggctggagtgcagtggcacgatctcggctcactgcaacctccgcctcctgggttcaagcgattctcttgcttcagcctctctggtggctgggattacaggcatgcgccaccacacctggctaatttttgcatttttagtagagacggagttttgccatgttggccaggctggtctcgaactcctggcctcaagttatccacccccttgggcccttgggcctcccaaagtgctaggattataggtgtgagccaccgcactcagctaaaaaaaaaaaaaaaaaaattattagcagaccttacttggcatttagagtaatttaggtgacttggaaagcagccagacagaaacttcacttttcttcatcaaacaaattaaaagtataacaacttaaaatgcactaaagaacaaactcacattttaaaatatgttatttacctataatactgatcggctcttagaaatagagtatgaggcctgaaggagaggaattgtgtttatatataaagatgaaaatatggatatgaaatatccataaagatttatatccccatttatattacatatctgtaaattgcattctataattacatttcacttttattcttataatccttccgtagtcttattttacacagtcttaaatttcaaagcacaagaggatgttagaatctacatcttttaggtttatagacattaaattgcagccaaaaggggttaaattacttacactacaacctagcagtttcacttttctcccatctctttctcaattacaaatccaatttaatgtcttactactgtcagttaaatgtaaaaatttccccagttcaccttctttaaagttttgctgacctccataagaattacaacccaatttctttcttcctcacttatatccaagcattgcagttactcttag

SEQ ID NO: 46574 - DNA, 1032 bp, Homo sapiens
ttgctgtcaatctcttcttaggtgtaggtgttgttttatgaatctgggtgctccagtgttgggtgtgtataaaattaattcttggttttgttttaaacttcgtcagtatataatgcctttcattttgcttctttctttctttactattgtcagtttaaagtctattttatctgatgtaagaatggctactcgtggccgggcacagtggcttattcctgtaatcccagcactttcggaggtcgaggagggcagattgcttgaagtcaggagtacaagatcagcctggccaacatggtgaaacctcgtctctactgaaaatacaaaaattagccaggtgtggtcgcacatgcttgtaatcccagctactcaggaggctgaggcaggagagtcacttgaacctaggacggggaggttgcagtgagccgaggttgcaccacagcactccatcctgggcaacagagcgagaacctgtctcaaaaaagtaaaaaagaatggctactcctgcttgcttttatttttcatttgcgtagtatatctttttccatccctttactttgagtctgtaggtgtcttttgtcattgagggggtctcttctaggcaatagatggtagtgtcttgttttttatccaacatgccattctatatctttttttttaagagacggagtctcgctctgtcgcccaggctggagtgcagtggcgtgatctcagctcactgcaacctccacctcccaggttcaagcagttcttctgcctcagcctcctgtgtagctgggactacaggtgcatgccaccaggcccagctaattttttgtattttagtagagacaggttttcaccatgttgcccaggctagtctcgaactcctgagttcaggcagtccgccctcagtctcccaaagtggtaggattacaggcgtgagccactgcacctggccactctatatattttaagtggagcatttatgccatttctgttcaaggttaatattgaaatgtgaggttttcttcctgtcatagtgttgtgggtagt

SEQ ID NO: 46575 - DNA, 1030 bp, Homo sapiens
tgcagctgacagctcagaattattcgtatcccatttcaaggctgatcctttttctgtttaagagttttctttattgatatatccccttttctatacaaaattgcagctatcagttcttggaatatatgttttaggttgacattttattatatattcatgcttcttgttaacatttgatcaggaaaataatttgatgtttacttcattcccaccagctttaaaataaagagactttgttctatttaaattttattacatttgatagccatttttcctaaggatagctttcaatgttgtgtgaaatactttatttgaattttagctgctgttaatgtccattcagaattagaaatctcacaattttccaacctactttttcttaaatgtaggaataaaaagaaaaaaatcccactgatgaatggagaagaagttgatatggatctttctgcaatggagtaagttagttaacttaaatataaggttataatactttctgcattctcatctgtctactttgttatgcgtacgtaaaagtgtataactgtcctccaaatgagtgctttaacattattttaatttaatagaaaccctatgttaaaacagtttatgtaaaatcataactaatcagagataaaaagtaagtctgccagggcctaggtgaaattaagaggaaatgcattatggttgaggggtgagcacaactttgactaggcagcttccttattctctctttgtggcctctagagcagtgctcagactataatgtgcatgtgaatcagttggggaccttcccaaaatgcagtttctgatccagtactacactagtgaggcctgatagtttgcatttctcatgagctcccaggtgatattgattctttgtccttagaacaaaggtcttgggtgccttaagtctccctatgcttgcaaaacaatttaaaaaccactgttctaaactttatgtggtaatatttattgattgacagtgttttatttttaaatatgatacagctcaaactttctaattttgccc

SEQ ID NO: 46576 - DNA, 2001 bp, Homo sapiens
gggaatttcaggctatatctatggactttggatgaaaaaaacttttggtgttaatgagtaccgccattggattaaagaggtaataacagctagatcccttatccacttacaagtcttatgtcctccatttttaatgactgtaaaatacttttaaaatactgcttgaaaatccctaatttttcccagcaaaatgggaattgatttactgagaaagactaatggtctattttatctaatctccattgtcaacattggcccctaaaaacctttttttcccctaaggaagagaatatttaagtttcttaaacatcagattggtcgttaggtatgtcccagctccttatagtagtcgtttgtaactgtgcttcctaaatttgttagctttgtaaccttaatctttccaagtctctgtttaaggagggcaattgtagtgtctgcccataggcagagattattagacattatacaagtaatgtgcatgatgctttgcacatattaactgcttattatattctggctaggctttgaatgcatttatgttgtcattgtcacatcttttttttttttttaacgatttaaagatttggccaaaaagaaaacatcagttgtattttacttagcacattgtggtcatatacataaacattttaatcatatcatgcttagtgtcttccttctcaggtggaagaattgcagcctttcatatcttcattaaacaaaccttatcatcttccccgtattctcattttacatattattatcatccaagagtaaactcaagtaagccaaaaagttaattttcgaagacttcaaacacctagagctattaaggtatttgtacatctagaactggagtctcttctttatttcagaaactattaaagaagaagaacaaagtaacacaacacttaaaatatttcacgcactgttacaaatgttttataaatattaaaatgatcttaattctcctaactaccttgctatcattcccattttatagatgaagaaactgaggaacagaaagaaaggttaaattatttggtcaaagtatacagctagtaagtagtaggcccaggattccagcttggcttttagtttcttctctatgctgtttgccacttttctgtactacatctgtattatttaaagcagttaggagtttccagcacaattgtggtagtgtctttattttaacttatgcttttttttttttttgagacggagtctcactctgttgctcaggctgtagtgcagtggcgcaatctcggctcactgcaacctctgcctcccgggcttaagcgattcttccaccttagcctcctgagagctgggattacaggcacccgccatcacgcccggctaattttttgtatttttagtagagacgggatttcaccatgttggccaggatggtctcgaacttctgacctcgtgatccacttgcctcagcctcccaaagtgctgggattacagatgtgagccactgcgcccgtcttcacttatgctttttttcttttaattaaccaggcacggtggcatgtgcctgtagttccagcttcttgggctgaggtgggaggatcacctaagcccaggaagtcaaggctgcagtaagccataatcagctactgaactccagcctgggtgacagagtaaaaccctgtctcaaaacaaaacaaaacaactgcccccaaccccccctttttttttctgtttaaaaaaaaaaatccccctttttaaaagttcaatttatgtcatgttagagaagactggagaagttttaaaatgatagattcctgacataatttattcccattcctttttactcgcctaaattttttgaagcaaaatacagagaaggaaaaataaacttggagacagctcagagagattgagaacagccataagaaaaagttgccaggctgctgtccagccctgaagtcataaagtagagaagtctttggcttttgtcattctgccagctgtgtaggctgctttatttat

SEQ ID NO: 46577 - DNA, 1026 bp, Homo sapiens
tccaccgtgaatttaatttttaagtagttaatattttataaatgtgatcagtaaaagtgatcactattttcacaacattttctttcagcatcttgaaattattaaagaatagatttatgagaacatttatttatagttgaggtgtttaggaaatttccaatattaaatttaactctttcatttagatgatcttccttgcttcttcttttcaggttactcatttttgtttgccccaacttcttccattgctgaaacataccacatcataccttcatgaagtctttgaattttatgaagaaattcttacatgtcgttacccatactcctgttttaagactgtcttcattgatgaggcttatgttgaagtggctgcttatgcttccatgagcatttttaggttggtatctcttcagatttgaaatgcctaaattaagatcatgatatgaagaaaatttactgattttgcggtcaattttaagacgagctttgaacttttttccgcaatttggatgtgattggctttgtacaaaatttggttttaaaattttttaaatgtagaaaaacatgaagacaaagtttttgagataactcaaaaggctcatcttcatccagaattaactaatattagtattttccctgttttagtcttgtgttcataaattctttaaaaattgtacaaattattgtatgactagtatgaatttttttctagcactatttaaaaatgtactgatattgtcagaaatttactgatatcatcagtggaaaatgtgttctttgctttaagcaagttactaagatgatgaattttagctaaattttgaaaagattagaaaggtgggagaattttttctctatttagcttccattgttttaaaagtggaattattttattttcactgaataagtatttatttcttggttataatgagctttcttctcttttaaattccagcacaaatcttttacacagtgccatgattatagatgagacacctttgactagaaggtgtttagcccaatcct

SEQ ID NO: 46578 - DNA, 1158 bp, Homo sapiens
tatcctggctaacacagtgaaaccccatctctactaaaaaaaaaaaatacaaaaaattagccgggtgtagtagtgggtgcctgtagtcccagctacttgggaggctgaggcaggagaatggcgtgaacctgggaggcggagcttgcagtgagccgagatcgcgccactgcactccagcctgggcgacaaagtaagactccgtctcaaaaaaaaaaaaaaaaaagaaagagtgtgcttacagtggttgagattcctttgaactgtagaggaatataaggaaaagaaacacttggataagaggctgaaaggcatttctatctattttatccaactgttagctgacatgttacattacatatactaacaatttaaaaacatattggttatgtaacgtgtataagcagctgtctttttgctttactatttgtcaataaaataattcagcacttgaagtttttcgacatatattttgtgtgtgaatcttatggattgtagatagattgtagattgtctccacaggagctacactttggtgtttttgtttttgctgtacttctcttttcttagaaaaagttaaatgtagactttgtcagagaaactgtctctgtggatgggtaacctagctttttttcctctttgttttgttcctagataggctttgcctctttttcttttcttttttttttaagaccaagtctcggccgggtgcagtggctcacgcctttaaatcccagcactttgggaggccaaggtgggtggatcacgaggtcaggggatcgagaccatcctggctaacacggtgaaatcccgtctctactaaaaatacaaaaaattagccaggtgtggtggcaggcgcctgtagtcccagctactctggaggctgaggcaggagaatggcgtgaatccaggaggtggagcttgcagtgagcagagatccagccactgccctccagcctgggcgacagagtgagactccctctcaaaaaaaaaaaaagaccaagtcccgctctgtcatccaggctggagtgcaatggtgcaatctctgatcactgcaacctccgcctcccaggttcaagtgatcctcctgcctcaccctcccgagtagctgggattacaggcatgcgccaccacacctggctaatttttgtatttttagta

SEQ ID NO: 46579 - DNA, 1168 bp, Homo sapiens
gattgctacagtgcactccagcctgggtgacagagcaataccctgtctctgaaaaaaaagaaaaaaaaaaggcaagagtatgagccttcatcaaatgttggggaatttcatagatattaatgaagaagcataaaggatgatgtacctgtatagcatgaacacaaaggataagcagaaaagaataacaaaagcatttattaagcaaatactagatgccagctataattttaagtgttttccatgtaagtttttcagttgtctttgttttttgagatgtgatcttgctctgtcacccgtgtcacaatcatgactcgctgcagcctcaacctcccaggctcaagcaatcattccacctcagcctccccagtaactggaactacagccaccatgcctggctaattttttaatagtttatgtacagatagggtcttgctatgttgaccaggctggttctgaactccgggactcaagcagtcctcctgcctcagcctcccaaagtgctaggattacaggcgtgagcccatgcctggctgttcggttgtcataataacactaataggccaataatgtcattttttatgaggaaactgaggcacagtgggctggagttactagctcaatatcatacagttactaagtggtagagctaggatttgaatacagggagtctacctccagaacacctgcttttcacggtgacactacactgtccttaaccttgtagtgtacagtaaataaaatcctataagtgacccagaagtagtcgtggaaactaggagaatgcctattttccactaccctcgtttatagtgaatgggagagtaagtagcttcttgtctaggaggattcaggaaccatttcatttaaggcaagagggtagagagggagttttagaaaaggttgaaaagcacaggggaaatgtttaaaatggagtgtgggctccaggagaatggttatctgtgaagtggtggggagagagcaagaagcaaggagtgagaagctagatgacccgagaggcttgcagttatgccagtggctaagggcagcagagattgaagacttgtagaggttaatgggtccgaatgtttcaggcagctgtaggttagagccctaggtggtggcagaggcctgatggtacaaggagactgggcttttcctatcttcctga

SEQ ID NO: 46580 - DNA, 1035 bp, Homo sapiens
gctgtgtcatataatagaaatagcatagactttgaagttgtacaaacctggtggcaggatttgactctcatttattacttgtctgagccatagttctcatatctaatatagggttaaataatacattatttctagtttttgttttttgcttttttttttgtttgtttttttgagacagagtctcacactgtcactcaggctggagtgcagtggcgcgatctccgctcactgcaacctctgcctcccgggttcaagcaattctcctgccccagcctcccaagtagctgggataacaggtgcccaccaccacacccggctaatttttttctatttttaatagagacagggtttcactacgttggccaggctgatcttcaactcctgaccttgtgatctgcccacctcggcctcccaaagtgctgggattacaggcgtgagccacccgcctggcctactcctacttttattgtgtgggttaaatgagacaatacatataatgtacttaatttaattaaaacttagaaccactccccaccctatctctcccacaaacacctacacttacgcttgttgagaagacagattcagggggagagagagaaaataagtacatagtactgtatcataatatgttccctaaaatattcatgttatatattttttattgttcctacagagatttgtgtggagagaagcaaaccataggtgcattactcactaaatattctcattcttcgatgcaaaatggtgttaaagtttataattcgagaagacccatttcttaaaagaacaacggtcttttcttcaggactcaagttgctttataaagttgctggatagaagaaaaataacttgtacttttatttctgacttttagaaacctagtcttctaaggcatttttctcctcatcttaagcattttgaaactactgttatttcttaaatgttataggatgtagctttaaaattatatttgtactatgtacacagtgtaaacaaggacaaaagaattctttcctatattatgtctgaggt

SEQ ID NO: 46581 - DNA, 1052 bp, Homo sapiens
agagtggctgcactattttccattgatgttgaacatcttttcatgggcttattgacgatttgtatatctttggagaaatgcccattcggtttctttgcctgatttttaattatttatctttttattactgagttgtaagcgaattctttagatagtccagatacaagtcctttatcagatatattatttgcaaatattttctcccattttgtgggttgtctttcgactttcttgcttttttcaattggagtaaaatatacataacataaaatttaacatttttggggttgggggcaatggttcacacctgtaatcccagcaatttaggagggcagggtaggaggattgcttcagtccaggagtttgagaccagtctgggcaacatagcaagaatctgtctctacaaaatatttaaaaattagctggggctggctgcacacctgtagtcccaggatgaggtgagaaaatcgcttgagtccaggaggtcagggctgtaagtgagccgtgatcacaccactgcagtccagcctgatggcagagtgagactctgtatttaaaaaaaacaaaaacaaaaacaaaaagaggccaggcggggtggctcacgcctgtaatccaagcactttgggggaccaaggcgggcagatcacctgaggtcgggagttcgagaccagcctgacctacacggagaaaccgtgcctcaactgaaaattcaaaatttgccaggtgtggtggcgcatgcctgtaatcccagctattcaggaggttgaggcaggagaatcgtttgaacctgggaggcagaggttgtggtgagccaagatcgcaccattgcactctagcctgggcaacaagagcgaaactccgtctcaaaaaaaaaaaaaaagaaaaagaagaaaaaataaaatttaccattttaaagtatacagttcagtagcatcaagtacattcatagtggtgtgcagtcattagcactatccatctctagaacttctccatcttctcaaactgaaactctgtacttgttcaacaatcactcccatttcccctgtcccctc

SEQ ID NO: 46582 - DNA, 1031 bp, Homo sapiens
gtattttttgttttgttttgttttgttttgttttgttttgttttgttttgttttagatggagttttgctctttttgcccaggctggggtggtgaaatggcgcgatctcggctcactgcaacctctgcctcccgggttcaagcaattctcctgcctcatcctcccaagtagctgggattacaggagcccgccaccacgcccagctaattttttgtattttttgtagagactgggtttcaccatgttggccaggatggtctcgatctcttgacctcatgatctgcccacctcggcctcccaaagtgctgggaagtaggaccaataatgttaagtgtcacttatcttaatgtagcataaaccatgtgcttcataacttgatgttttgtttcattcacaaccaagtaaatttttcctaccattttataatacaaactaaaatctccgaaaagttttttcctaatgttaagaggtgagaaattactccattttcaagataatataaatgttttgacttctgtcatttctgaattctgaatttgaatctgcttttttgatatgtgcttatttcatcctaatgagtagcagtattttgcttgtttcatctaatgagtagcaggcagtgttttgcatagggatgcgtatggtaaagaatttgctataggaaacagaatgatgtggcatgtggtgtgattttaactgtttttgagcagtcacaagcaccagagaatattttctacaactcagatgaggctttttaaagttctgttttctcactcaaaatgtaatactattttcgaaagttactttgtataaaggcagtttttgctagtgacaagtatctgcaaaatagatagttgttacagaacatttgatagctatggaaagtttagcacaatttagagaatgaattaaggaaagttttatgttagctatttcttagatgattcattaatctcccaagtatattttaagcacataaatgaaaatttaaaactttcgtctttcacttcaaagatcaaagcttgtgtgtgt

SEQ ID NO: 46583 - DNA, 1065 bp, Homo sapiens
atcatcatccaaggatcacttcatgatgaaattgcaagaatttaagaactcctatttctgattgtattgtcactttctttagaaaccataatttctaaaagacacaaaaataatatttatttcatttacaagatacgtttgagtgtagatattttaagtattcacgatagttccgttaaataggaaattatttcatttcagactataaaataaatgagcctagttcccaaaagtgaattggtaagtattcagaagcttgacagtacattttatcaagccgatgggggaaacaggcacacttatacattgttggtggtagcacaacatggtgcatctcatctggaatcctgggaattaattaggtaacatataatgaaaatacatacatcaggagattgatccttgatccagcaatctcatttataaaaatacaccttcaagatacacatgcacatgattattttcactgtattcaataatggtacaataagaaaaacaaataatgcttattcataggaaataaattatcgagtattgtgcaattttttaaaaaaagaatgacagatatttttgtgacttggtaagttgtactttccaggatatattgttaagtgaaaacaaacaaggtaaaaaagaatgtagatggcatactacatttgtatgcatatatacctatgtatgtttacatacacacaagcatatatttatgtgcgctactttttgcgtaaagcacgggaagagaaagttgcaactactagactatgggtacaaaggaatagggaaagaatgagatttttttcagagactatctttaaatttattttttatgttaatcatgctaaaattttatatattagaaaaataaaatgacagcaacagtagaagtgagcacaactagttcccaaatcttgttttccacatgctattccctaccaaaaggaacttagttcttggagaactgattgattcacgatctggagcagagagagaactaaattattatagggtatacacatgcaaaagactattatttctgcatgatttataatagtgaaataatagaaa

SEQ ID NO: 46584 - DNA, 1024 bp, Homo sapiens
tcaccactttgatcattaccacaaccatctcaattttacatgggatgaagaaatttgaggctcagaaaaatgaaaagacctatttgaggtcagtgtatgagtcaggacttttggttgtattttgaaagtagcccaatttgaactggcttaagaaaaaaaaaaaaggaatgtagcagaccaagtccttccctctcgatggcaaggtggtcatcacagatccgtgattccatccaaccccccagtatttacaatgagggggaaaaagtctccttaacaattattcctggaatagaatttctttactctctatcactttctattctggaatgtgcattacactgcattcagtagaaactctgggcctggatctctttggtccaaattgtttcacacctacaaccctcaagccatcaaatcccccagaccacttagaatgagattgaggataaagcctgttaccagaaaagcagggtatggaaatggcagacaaacaacagatatccataagaagcatagttcacaaatgacagcttgggcttgagacaagatggttttaaccaatagttctatcctatggcccgtccttctcctcttctgtttaaatgcattgaatacatgataaatgcgcctggaacaaaatttaaaagatacaaagttatacagtaaaaatctcccttccaattttgtcctcctgtcactcagtttccctcctaattgaactcatctctatacccctccagggatagttatagtttccacatttacaagcatcatatgagttgtttttacatcagtgatatattattctcactgttctgtccggctcttttttcgctccactctgttaggtatttttggctctctgactttaatgacttcaaccacccaggcacaatgacattttcacacaccacttagttttcactcttgagttttttccgttttcctttttctctccttctccctaccctcttcttactgcatttcctcattttacctccttccatatgttcattatgtaatt

SEQ ID NO: 46585 - DNA, 1050 bp, Homo sapiens
atgaaccccaatgtgtaagctccatggcaaatacatagctttacatttttctattaaaacataaaatataccaaagtagatttaacaatgatatgcagtgatttgcattcattacctaatgactaaaaatattctagccaattatagcgctatacagtattttgtaggttaacatcttctctaattacttggaagatacactatgtcttattcaatttggtattgccaatatataattggcatatgattggtgctcagatttatgttaaatgacttaatgaatttttagaaagtgagtggataacaatataaggaaaatagtatttaaagaaaaaatattatatataggagagtgggtgattataaatgtataatcaatagtgaagacataatgaaatggaaactttatgtgccaaagagcattgctataaaccacttggggcaaaaactattggaaatacaaagataaattggtggtaagagtgtgggctttataatcggtcatacctggatttgaatcatggctctgatatttagtagtttggccaattatttatcctttctgaatcttattttcatcatctacaaaaatgagactaacctcattgtgaggattaagtgaggaaatgtaggtaaaagtgaaggagggagagatgtatcctgttctcagtggttatgcagcatttggtcaataaatatccccagagtgagaaccctcttcttgtcattttcacagttctttagtgccagtataatgccttgttctattaaacattcaaatggctgctgagtactgaataattttaaaaagaagagtgccgtaaactgtttccttgcttaaaaacagaaatctaactgtagtggctttacaaattaggggtttgttttcttacataaagctgagacataggtgatcaggtgtggctccatgaatttatgaaggacacaacccccttctctccttcagttcaaccaaccttagcactttctttccatgctccaggtcacagaatggcttctgaaactctagctatcatggccactgctgtg

SEQ ID NO: 46586 - DNA, 1032 bp, Homo sapiens
cattttcccttctaattgagtttatctgaatttcttctcttcttggttaatctagcaagtggcttttcaatttcattaatctcttcaaagaaccagctttttgtttcattgattttttttcttttggtttcaatttcattagattctgctctaatcctttttatttctttttacttgctagctttgggtttggtgtgttctttttttttctacttccttgaggcatgacattagattatcaatttttgatctttcaaactctctggatggcattttgtgctataaactttcttcttagcacgccttttgctatatcccagaggttttgatcatttgtttcactgtgatcattcatttcagaaaattcttaaattttcatctttatttcgttgttaaaacaaaaatcattctggagcagatttgtttaatcactatgtatttgtatggtttgaaggttacttttggaattgatttctaattttattctgctgtgctctgagaagatacttgatactgtttcaataatttaaaatttattgaggcttgttttgtggcctatcatatagtctctcttggagaatgttttgtgtgctgatgagaagaatgtgtattctgaagttcttgggtagtatgttttgtaagggtcttttagatccatttgagctagagtacagtttaagtccagtgtttctttgttgattttctgcctcaatgttctgtctagtgctgtcaatggagtgttgaagtcctccactattattgtgctgctgactatttcttttcatatatctaatagtaactgctttatgaatcttggagcgtcagagttagttgcatatgtatttagaattgctagatcttcttgttgaattgatcattttatcattatgtaatgaccttctttgtcttttccttgtgctgtttttgctttaacatctgttttatctgatataagaattgttactactgcttgattttggtttccatttgcatgaaatatctttttccacccccttaccttgggtccataag

SEQ ID NO: 46587 - DNA, 1026 bp, Homo sapiens
gttgttaagacccagggacaattctacgggctgggtatgaaagggaagtcggctcaggaggaccgagtgagggcaccgaggcgggacgcacgcacccggcgaaggtgcagtgtgggcgcccacggagtgggggagctgggaagaaagggggctgcggtgggctggagagaagcgggacggggaaggcgctcgggaagctgtccccgcggcgtcgtgcgctctggggacagaggaggggaggtctgggcgggcgggtggcgtgtgaccgccgaggctgcggcggctggaacaggtgagcggccgctgggttgtgggtccccgcccttcaccgccagcgtgcctcctcccacggactctctccagcgctgagctgctccgcggctccccttgctttggggttttgcaactggctgctggcttttttcccctcccctgtctcggtctctccttcttcttttaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacttttccccccttttccaatcacatggcattttaagaatgccggaaagatggcggtagcggcggcggcggcggcggctgggccggctggcgcgggaggcggccgggcgcagcggagcgggctgctggaagttttggtgcgggatcgctggcacaaagttctggtgaacttgagcgaggacgccctggttctgagcagcgaggagggcgctgcggcgtacaacggcatcgggaccgccaccaatggctcgttctgcaggggcgccggggctgggcacccgggcgcgggcggcgcgcagcccccggactcgcccgccggggtccgcaccgctttcaccgacctgcccgagcaggtgcccgagtccatctcgaaccagaagcgtggcgtga

SEQ ID NO: 46588 - DNA, 1056 bp, Homo sapiens
taaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaaggttgtctgtgttaagtttccatgtccctgctctgctgtctcttagatatcacataatttgtgtaaccaattatctcttgaagagcatttaggaagtacccagtattttttgctggattaattcctggatgcagaattcctgggttttcattttaatgaaggaggatgcttgctaactttgagtgaggagtcatatctgattgtagcatgctttatggcatttttatagcttctacccatggatctgagccctggaactttataaaattagtttaatcctgtttcctcataaggcacacacagactagatagcaggtgccatgacattcctgagcccttttttttttttttcctcgagggtgaacatcccagtctgtatcttgggccttcgacaggccaacttcactcatcacaaggtgaggtgaca

SEQ ID NO: 46589 - DNA, 1034 bp, Homo sapiens
cttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttg

SEQ ID NO: 46590 - DNA, 1051 bp, Homo sapiens
agctaaatctttgaagatcttacatgagctatctaaatcattgctttccttgctcatttctggcctctttttggtgtttgaacattgacaataatggttgtctagtattttctaggcatgtgacaacagtggttgtctagtattttctaggcatgtatatggatgttttttaaaaattgagattatatggtaatgctttgttgcttactttttgtaaataacagagcttgactcttacatttctgaatccatctaaaataatatagttttgttgtattttattataggattttgtaatatttattgtatgataaataataggatcaatttataattctgatcagttgagtttccctttacccaggtgaggattgttgtgaagaggaggggtaaaaagcatagtagatgtacaccttttttaagtgcctctggagcctggtttttacatgtcgacttcttttgcagttgctgatgattcctctgatcatgtcagtactttatgtctgggcccagctgaacagagacatgattgtatcattttggtttggaacacgatttaaggtactttgccttggttggaaaagtgtccttttcatttgtctgcagaaatccctcttcagtccagagatgtactttctgactcatccagaaggggtcactgcagagcagtgtaccataggcaagcccctttctgccctcctcaatcccagctctatttaattagccagcctggagtccgttgctggcctttgtttcttcactccctctgtacctcgggcccctcaaggttatgtccctgagtgatcttatgtgtctgtgttagagagaaggagagataactcatgtgaaaccctgctttaaaaatctgttcttatccctccctcgttccctgttatttgctttatactgtagctgaaacagattgtttttgcccccaaacacttctctttgtacattctttcacaattttccacctgtaacatcttgattctcttctttgtataaatcctacccattcttaatttgagttggaactgaacatatttcctga

SEQ ID NO: 46591 - DNA, 1748 bp, Homo sapiens
agaggccgaagggggtggatcacttgaggtcaggagttcgagaccagcctggccaacatggcaaaaccctgtctttactttatgcaaaaattagctgggtgtggtggcaggcacccgtcatcccagctactccggaggctgaggcaggaggattgcttgaaccagggaggcagaggttgcggtgagctgagatcgcaccattgcactccagcctgggcgacgagagcgaaactctgtctcaaaaaaaaaaaaagtttttgaacaatataaagccctatagactggttacagaagaagggtagcatttgttacagatgtagtctatacatgttgttttccttataaatgacatgatttgactttagaaaagtcattactcaaacgtgatttaacatctgtgatggccgaggagctgtgctctgtactaggaatttacattgaacaaaagctcttatggagctaaatggtctgttgggaaggacagatgctgaacaatagtaacaataaaacgagatgtgttctgtctttgggaaggtacagtgtcagcaaatcagtcgtatggggctttatctcctatcttttcactcaatgtgggaatatttagagctgcccgcaggccttcacttgctggtgtacagtttcctggggccgtacaccaggtagttttgctcatgtttcatgctcagtgtggttctgtgagggagcctgatctggacgcttgcaggccaggctttccttagacctcacatcaacttgaaggtaatttgagtctgccatctgctctccgcaaacttcaacttacaaaaagcaggcctgtttttactaacccagaggacatttgccatatggcaagttaggcaagagatgttggcgctggttaaggagatttgaaaaggattttctgatcaaaaggaaactaagcaaccccttttggccaaaaattataattgaccttggtaatggttaccagggaaggcatttggattcaattagaatgcgtcatgaagcatggagagcttcagggctatcctgtttaaaatgtctaagccaaataaaatttggaagtggagtttgttcaaatcctcaaggaaattaccatttggatttttagaaagccttgaatattacaatggaatcattaggccaggatctaagaaaagtggctgggtctttcagatacctggctgaagacagtaaagattataataaaaattggaaataaatggatatttatgtttttgatgctgaacatttggcaggccaccatctaggaattgttaagttattatgacattaggatgtttgggaatggctggtgactctttctctaggtagcatatatctctctgggtttacggtttcaaacatgagatatattgaaatatatttaggtcactcgtatagctactgaaagatacttctaatttataacatatacaacttggttttttaggcattctcattttatatggaaaatgctttgaagtttaaacttcttaaccttttttttttctccttaggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacc

SEQ ID NO: 46592 - DNA, 1071 bp, Homo sapiens
gtttcggtggctcagagaaggatctgttgccaatcagccgatgccaggtctccggtgctggggatggttactaggcaggagaaacaccagtcagaaaaccctggactttcagaactgtgcatcaggcgtcctggcaacctgttgggcaggactgtcaggtggaaagcgggctcgtggggttcgcccctttctgtcggcttcacacatgatctcagcggaccttgcgtgtctgcacggcattctcatttcctggtaagctgtgttttgttttgttttttaaaatttcttctctacctgaggaccctcgccttttgttactagctctggcccatatctgtttttttgtgacggtggttactgtcttttcacattctgtagggggacctgtcgcagtatgtaacattgaacaaaatagacagcaagtcccggggtggccatcaagattcgaacattttctgttcacaatttctgctgaaattcattcacctcttttcatgatttttggataaaatttatagtaggacttatttcttaaataattacaacattttcttatagtggttggtattcctgtgtggtaactgtggtaagaaaatggctttctggtagtaagtgactccttttcatttatccactcagcactcaacaaacatttcagtcctactattttcctggttctgggttcgatgctaaggagacaaacaatatatcgtgtacatgcagtgctcatctagtgtctggtcggtttagccagcgcacatatacatcagctctttttttctttttgagatggagtcttgctctgttgcccaggctggagtgcagtggtgcgatcttggctcactgcagcctcctcctcccaggttcaagcaattcacctgtctcagccacccaagtagctgggattataggcatgtgtcaccacacctggctacatttttttttgtttttttgtttttgtttttgtttttttgttttttagatggagtctcgcactgtcgcccaggctggagtgcagtggcgcgatcttggctcactgcaacctccgcctcctgggttcaagcgattcac

SEQ ID NO: 46593 - DNA, 1071 bp, Homo sapiens; identical to SEQ ID NO: 46592

SEQ ID NO: 46594 - DNA, 1071 bp, Homo sapiens; identical to SEQ ID NO: 46592

SEQ ID NO: 46595 - DNA, 1071 bp, Homo sapiens; identical to SEQ ID NO: 46592

SEQ ID NO: 46596 - DNA, 1033 bp, Homo sapiens
aatgttagtcttagaattttgagatttggtgttctccaggtcgaatgaatgctccctgatctagcctcccacggtatatttctgtgtcttttctttcataaatgcgtgaatgactccggtctttgttattggtggtagtgtctcttgtccggaagcacggagagtacgcattcatttctgtatttcccaagtttcagccacataatgaccgaaacttaacaagttacttaacctctccaaactccaatatcttcaaaataggatttgcaaaatgggaatcactttggctttcataaggtggttgttagccgaaaagaaaaaatgtgcttaacacagtgacgggaatgcacagtggttgacaattggtacttgcaccgggcttagtggctcacgcctataatcccagcactttgggagaacgaggtgggcggatcgcttgagatcaggttcgagaccagcctgggcaacgtagggaaacccagtctccacaaaaaatacacaagttagacggtcatggtggcgcgcgcctgtagccccagctacttgggggactgaggcgggatgataggttgagtctgggagttcgaggctgcagtgagccatgatctcaccactgcactccaacctgggcgacagagcgagaccctgtctcgaaattattttatttattttattttattttattttttattttgagacgaagtttcactcttgttgcctaggctggagtgcaatgatgcgatcttggctcaccgcaacctccgcctcccgggttcaagcgattctcctgcctcagcctaccgagtagctgggattacaggcgcgcgccactacggccggctaatttttgtattttcagtacagacctggttactcaatgttggtcaggctggtctcgaactcccgacctcaagtgatccgcccaccttggcctcccaaagtgctgggattacaggcttgagccaccgcgcccggcctcttattttaatttttaaaaaggtacctgcgagttttaaacagctactctggggcc

SEQ ID NO: 46597 - DNA, 1040 bp, Homo sapiens
tattacataaagatgataaatgtttataagcaaatctagcatatgaagaacatatacatagatgagttgcacacaaagcctagtgtattatggaagacatatgtggcaggtaatctcaagagaatacaaaagatgtattttcacttttatttctaaaagtagtaaaaattaaaatatggttttctttaaattttcagttttttatgatgtttttcttttttagctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcac

SEQ ID NO: 46598 - DNA, 1030 bp, Homo sapiens
gggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatgtaagttaagaaaatttttaatctgcgtatatgttcatcaaccacatacattttgaacagtcaccttgttgtatcagtcatcttcatttttgatattttctgaagtagtttttcttttccctaataagactaggtaccactagtatagctaagagataaatgattatcatgtgtagttttattattattatgtagagtttaatgtcttaattattatttttcatatgaattgggttttttttactttgttttgaaggaaagttacccaatctctatgaagggagactggcaggcaggttgaggggattcacaaacaaatactaaagataactaaaatgtattttattgcaatgcccccttcactaaagcttcattttttgcctatttaaggaaataattcaaaaatgaaaactaaaaagaaggggaaaagtacaccaaaggaaagacttaccacagggttgaggattgtgcagttttaggaaactaggtgaaaatg

SEQ ID NO: 46599 - DNA, 1022 bp, Homo sapiens
tgctaaaaaaaagtgagagaatttataatattaaaaaatgttatttttttctggaaagaatttttcagggactgaaaatagcatcaattaggcacctgttttgtatcaaagtaagtgaaggaagcatttttacttcctctgatgtggatactactatttctttttcccccagggaagccttctctgcttcttttctagaagcctcctgcagtgtactgatatctttcttactgcactgatcatagttattctaagtaattgtttactgcttgctttccttgcttcactgctggtacctgaaaaaccagagactgcctgtcttggtcaccattgcatcattattgcctttcatgtggttgacattcaacaaatttgttgaattgaagaatcttgagaaaattgaggttgaattgaatagctcttccaggcacctaactactaattgacagaggtgactgcaaaacctgtggctttaccctattcacaatgactttatgaattaattactctgggcctgggattcttcttccataaaaatggggcagttgtactaagattaagatccttgtttcctccaaacttatgactttataataataattccgaggatacctttgtttgccctttggtctatttttagactatacacattatgcagaattgagcttttggaccaaatcttgaaactcttttgggacttctcagtctctttttagaaatatgttaaataatacactgaccttacttttgttagcaaaatcatggggacctgacagtggattatagcaagcaaatagtcttttttttgagacagagtctctctctgtcacccaggctggaatgcagtggtgcgatcttggctcactgcatcctccacctcccggattcaagtgattctcctgcctcagcctcctgagtagctgggattacaggcgcccaccaccatgcccagctaatttttgtatttttagtagagatggggtttcaccatgttggccaggctggtctcgaactcctgacct

SEQ ID NO: 46600 - DNA, 1045 bp, Homo sapiens
ttaccatcgaaagtaatctatagtaaatcaagcacaattgtttttatagctcttctataaatgagtgtttaatgaagtaaaatgtatgtaataatacatagtatagttatatttaaagattttttttttttgagacggagtcttcttctgtcgcccaggctggagtgcagtggcgcgatctcggctcactgcaacctctgcctcctgggttcaagtgattctcctgcctcagtctcccaagcagctgggattacaggcacccatcaccacactcagctaatttttgtatttttttagtagaggcagggttttaccacgttgaccaggttggtctcgaacttctgacctcaattgatctgcccactttggcctcccaaagtgctggaattacagatgtgagccaccatgcctggcctaaagatactttttagcaaacattattggggtcctaataagtattttgttgggccctgggaatatagtggatagctaagtagatactctttctgatcataaaagaagaacttgaataagaactctcaaactttttagattgtgataaaacacattttgctttcattaaatgcttttctgtagagaactattacctgtaaaattgtaaaaattgtaattgttttgatgagttcagaatcataagttgattgatgggtatcctaccctcaggagaagatccagtatacagatagatctacggaaactggctagtctagatctacaccctggagattgtgtttgagtggtcttgagagctcttagagccaatctgacttctcagagctccaaaaactatacctgaatgctacatactgagggattcttgcttccctggaaaatcctttttttttttttttttttactttgatatttccttccttccttcttccaagcctcccttcccctccactcctctcccctccccttcccgcttctcttccttctctttcttccttccttcctactttcctctcttcctccctccctccctttcttttctttctttttttttttttaaacaaatttgcat

SEQ ID NO: 46601 - DNA, 1045 bp, Homo sapiens; identical to SEQ ID NO: 46600

SEQ ID NO: 46602 - DNA, 1045 bp, Homo sapiens; identical to SEQ ID NO: 46600

SEQ ID NO: 46603 - DNA, 1045 bp, Homo sapiens; identical to SEQ ID NO: 46600

SEQ ID NO: 46604 - DNA, 1031 bp, Homo sapiens
aaaggtatcctctgacatttgattatctttgaccacaatttcttagatgctttcacttttattatttttattcctgtttgtatattcactttaatacttgattttctattgtcttgagactattttttacagttttcttgagacttatctctcaggtcatgattgtaggttaccagcaatctttaaaaacatttgctgtggatgtaaatttgtgttgtcaaattcctaatttaattttttaagaacttgatgtttctaaatgttttaacattttatttttatttttacattttaactttgaaaataccttaattgtataaaatcacctttattttttttaacacggtggataccttttgttttaatatgacctaattctttgtttgtactgtttaggcattccgtgatttttgtggatttgtaacttctagttgaatacaaacgtgttaaagtattttcagctggctaaacagaactcttgactcagagagaagtgaaactaaatagaatacagagtcccaaacattctcggtatatatacaaatgcagattccaagggattctcagtgtgtatatttttgctacctaagaacagttttatttttgatgctacatcaaaattaacatgatccctaaaaactatagtatcttctaaatgctcttttttttttttttttgagacagagttgtgctcttatcatccaggctggagtgcaatggcgcaatctcggcttactgcaaccttcttctcccaggttcaagcgattctcctgcctcaacctcccgagtagctggaattataagtgcacgccacgacgccgggctaatttttgtatttttagtagagacagggtttcaccatgttggccaggctggtctcaaactcctgacctcaggtgatccacccgcctcggcctcccaaagtgctgggattacatgcgtgagccacctcactcagccctaaatgctcttatttgacccagaattgttgtaaaaaacaaagtttgtggccaggcacagtgggtcatgcc

SEQ ID NO: 46605 - DNA, 1031 bp, Homo sapiens; identical to SEQ ID NO: 46604

SEQ ID NO: 46606 - DNA, 1031 bp, Homo sapiens; identical to SEQ ID NO: 46604

SEQ ID NO: 46607 - DNA, 1031 bp, Homo sapiens; identical to SEQ ID NO: 46604

SEQ ID NO: 46608 - DNA, 1050 bp, Homo sapiens
attacaggcatgcgccaccacgcccagctaattttgtatttttagtagagacggggtttctccttgttggtcagactggtctcaaactcccaacctcaggtgatccgccggccttggcctcccgaagtgctgggattacaggtgtgagccaccgcgcccggccggtatactcattttaaagaactcccaatttctgcatctcaattttcacactagagacggcatatattcacgttttgaaattttattcaaaatggtctaatagttatttagttgttctatatgatataaatagagtttttttaatgtgtagtttttgtgtttactaccaatattaggattggtatttaaatggttcttttaaagttttgatgagggaataaactttttttttcaaaattacatttatttattaaaagctaaggcattaaattgtaaaaatttcctgactaaggctaaattatatctagaataataaaatatgacttttttgtaggagaagacagactgctgctttggacctgttggtaatgatggcctgagctaaacatctaactagaagggatacccttccatttcaaagaacagaatgctaaggaagctgtggcaagtatgtgtttcattgttttggtatggtaaaactcagatactgaatgtactcactttagatcccatgatactatatttgtctaaagtttttaaaagctttccttaaaaagcagcagacatatgcttaacacttttttttaatatactttcaaattttaagagctataagtataggactgctttaatttaaaaggagacggcatcatacttcataataaatcttgtatatttataattgattttaaaattagtatttgataaaatctgctgtgtcaggcactataccaagtgctgtgataacagaggtaaacaagacaaaatgtacctttggtatggggaaattgatctagaaattttgctatgcttttgcctatatccagaaaaatgcttcaggatgtacaagaacaaattctgaaactgtattttcaaaacgtaggctac

SEQ ID NO: 46609 - DNA, 1048 bp, Homo sapiens
gtaccttgattaatactatttgaatttaacataagatgaatgcaccccagactcatttcaaagttatttaaataatgaagtcctacaggtaaaatctatgtggcagtcttaaatactgaactgaatgtttattttcactatcaaatatatacctgaatattaatattcttaaggttgtttactgaaaaagtaatgaaatgtttctttagcttattccatattgaaacttactatttgctcttcctcccctttatctagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattccctcgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatttcttggtttacttttgtaattatatacacaacaaatgtattaataactaccttgttaaacaccttttaatagcacaaggtttttatatttgcaagctgttgatatctttctaaaac

SEQ ID NO: 46610 - DNA, 1089 bp, Homo sapiens
agtatgtaaattgaaatcataatgcttttactctgcagattactaatccccaaacactggcttgtgactagtagcattctggctacatgggatttacatgaaaaagtaaaactttttttcctccaagcttccctttactgttcttctccttcccctgttccaaattaagactaggtcaggcacagtggctcacgcctgtaatcccagcactttgggaggctgaggtgggcggatcacctgaggtcaggagttcgagaccagcctggccaacagtgtgaaaccctgtctttactaaaaataaaaaattaggctgggcgcagtgactcatgcctgtaatcctagcactttgggaggctgaggtgggcggatcacgaggtcaggagattgagaccatcctggctaacacggtgaaaccccatctctactaaaaatacaaaaacaaaattagctgggcgtggtggctggtgcctgtagtcccagctactcgggaggctgagacaggagaatggcgtgaacccaggaggtggagcttgcagtgagccgaggttgtgccactgcactccagcctgggcgatagagactctgtctcaaaaaaaaaataaataaataaataatagataaaacaaaaaattagttaggtgtggtggtgggcacctgtattcccagcctactggggaggctgagacaggagaatcacttgaacccagaggtggaggttgcagtaagccgagatcgtgccttccagcctggatgacaagagcaaaactctgtctccaaaaaaaaaaaaaaaaaaagaattattactattattttttaatataaaatagatttttaattcttaaaaaaaaaatagacaaagtctcactgtgttgcccagtctggtctcgaactcctgagctcaagtaatcctcccacctcagcctcccaaaatgctaggattataggcatgagccaccatgcctggcccaaaattaagaattatatccaaggatctgtggtaggaatcagagagaaaatagctaagtgattctgacagctgtcaggttatctgttgctcattctgttcccctgcctgttcccctaaattca

SEQ ID NO: 46611 - DNA, 1049 bp, Homo sapiens
ctccagcctgggcaacagagtgagactccgtctcaaaaaaaaaaaaaaaaaaaatttcaagataaaatcaaaattttttaccattttatggtctgggccttacccacttctccaccttctcacagtatgctctattcttgtttctgtattttaatcatacaaaatactgtggtttctcactatttatcctttcatatatcagggtttttcactctttgaatttcagaaaatggttgaatgttctttcatcatttttctttaaatttcttgaagctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaaggtacgtctttttcaattaaaataatttactgattttaaaagatatttcaaagtttctaaacacctaattgcatcttagtttattgctttttgcttgcctttcagagagcagatgttagttaattagaaaacaatagcattatctttactattgagctagtaaggatagttacaagctgtggcatcaaacagacctagatttgagcctccagttcactacttagtagcttgtgacctttggcaagatacttaacttgtcagcctgtttgcttatctgcaaaattggggtagataagatagttgcttggtaatgaggcatttttaagattaaatgtaacaaactaaagtatatgataccctttcatttttaagcaagataagagtctg

SEQ ID NO: 46612 - DNA, 1029 bp, Homo sapiens
aggaattgtaagagctactatcttagcctaatatgctgagtttatttttggtatattattaaaagggggaaattaaaaattacattttttactcacttcatagatcgtcttattaggcatagagcctgtgctttaagagatactgcctatgccataattaaagaagaacttgatgaagactttgagcagctctgtgaagaaattcaggaatctagaaagaaaagaggtaggaaagtgatttggttgatttgtaccaacctaatattatcaatgaatttcagaatatatgaatttcagaagcatctgaaaaggatgcttcagatgtattttgtacttttagttaatccttcatgtaattttgaaatctggaaatccttttgacatcccacatatctatttataaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctggtaagtactcaagtagttttcatttatgaaattataactttattcttttctaatgccattaactttctcccttattttcctttatttgtgttaatgcagtgaattacattgattttgttactattaagacaactttgcattcttgaaataaatccaagtttataatgtaccacttgcaacccagaagtcaccatctaattgtggactgtcttgatttgaaactgatgtctgtaaattctggtctatttcttactcccccttattcttagaaggtaactccacgttacctattcaaagcctgtagggttttctaaggcctgccttccttggcagacttctaattccaatttttgttctttaagcccctttgtcagactgcttagcttctcagcctctgttattcacttgttttcccagattttagcactgtaattcctcactaccctttttttttttttttttttttttgagacggagtctc

SEQ ID NO: 46613 - DNA, 1162 bp, Homo sapiens
actctgttgcccaggctggagtgcagtgacacaaattatctttcactgcaaccttgtggagatagggtcttgctgtgttgcccagcctagtctcaaactcttggcctcaagcaatcttcctgtctcagcctcccaaagtgctggggattacaggcatgatattattatgacctacacaattggaagagacctggagagccacgtcttaagttgctctgaaggatgggtggcaattggatgaggaaagaatataggctgttactggagaatacagctgcccaagaataagaaacaattactggaggatacagctgcccaaggaatagaaacaaatacaaaacaaaaacagccttaaatcaagtgaaaggttttatgttaaatatattatcataatctcttacgtatttattctctatctcctatattgcctggcatcgaaacttgactcacatgttatgtttagagttaattttgtgatttgatcatttgcttgaattttaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggaggtgagcattagtgaattttttttcagggggttgagttggggggcagctaacacttagggttgatttttgtgtcaggtgctatattataaacataatcaaaatactatttaatcctcacaacaaccattttacaaatggtaaaaatgaagtttagaaaggttaaaaacattgctgaaggtcacacttccaggaagggacagagtgagaatttgaatgcaggtttctttcattcccaaatccctgtttattaacaattacatgatagatcctctaatgagacacaaaatggcttgtatactttgtatatcagtgctcttcctcaaagtggaaaagtaggcactctgtaatgaaatagtttttaaaatattctattagttaagaccattataatttttattacaaaagcaatataatatagggcttactagtagtaatatttttaaaaatctagtcccccatttcctttctccaaaggcagacactgttaagtttgaggatatc

SEQ ID NO: 46614 - DNA, 1054 bp, Homo sapiens
ctgctccgagtgtcagtgtgttgtaaagcatggtttaaaaatcttggttacagaagatttaactcatgatagaaacaaatgtctgcgggtcagtgatgttaagccactagtaagaggagggctatggtggggaatgtggctgaatgtcctatcacaagagcatattcagttgcttttatctctgacctgttactgatgtgcagaagcttacccagacttgaaaaatcgattttttccctcagattttatgttcaaattgtcaagtatcttaaattttaccagctaatttggatgcttttaagacattgcctgcgctaaacaaaatctaacttagggcattactactagtttaggattctaatactagaccaatctccccattttaaagatgggtaaattgaaccctcaacccccatgattagttgcttatccaagggagcacttttacaagtgctattgtcccaacctgaatctaaattgcttttagtcccaattcatttcagttttttagaacttctttttaaatggtttcatgaatgatgtgtaattgattgattaatttggaatatcctaaaggaaatatttgcatactttcatatatgctagtagtattgttttatattgtagataatgtagatgaataagatatagtgtgtgattgataggtgggttttggcttttctaacatctaacaagatttgctatattctaatggccttttaaacttgatgataaacaattttgcttattgctgtgagtaaattaaaatatatgttaagtaccatggtaaaagtagttttgtctctgcatgtcctattagtaatcagataaactttttatatgtgacgcatttcattatcagtcacactatattcattgtgctaacaggaaggaacatatttaacaatacttccatcacttcataatcaagtaagttgagtacttactgtgttttgggatacttctaaaggtattggaggaattttggcaaaaaaattacagagtaattgtagcaaaactgtgccatctcaaatatatatatatatatatatat

SEQ ID NO: 46615 - DNA, 1076 bp, Homo sapiens
attctgtttatgtggtgtatcacatttattgacttgagtatgttaaaccatccctgcatccctggtatgaaacctccttgatcatagtagattatcttttttgatacgttgttggattcgattagctagtattttgttaaggattttagcatctatgttcgcagggatgttggtctatagttttcttttttggttatgtcctttcctagttttggtattagggtgatactgacttcatagaatgatttggggaggattccctctttctctaccttgtggaatagtgtttacaatgtttttaaactgaagtaatgacctttctacagtatagagtaattgctaagaacctgggcccatgactaggactgtctaggcttggagctcagctctactagttattagcggcctttggcaagttacttaactctgtttcagttttttttttatctgtaaagtgaggatagtaggacctatctcatagtattgtgagaattagatgagttaatacatgtaaagcatttaaaatagtgtctgccatacattaagtgcggtatgtatttgctattataactgtacttcgatgtttaaaaataatctccattttgcaaatcaaatgtcagaaatttcatgttggtccacaggttgtgttattgtttgcttttaactttattggtttatgaaattaaaaaactggaaatcatcagtatagtaatgtatagaatgcagattttttgaataaacatataggtttgaattctgacactatcaatgacagattctgatattttgagtaaattatttaacctggaagccacactggccctaactgtaaattgagcctactaataatccacttttccaaaattttaattaagattaaatactatatcaagtacatggtacagaaagcagtcagttaatgttagtcttttttattaattgggaggttagtctgaattctgtgactacatagtgagttcacataaaattatgtgaatacattaaagtctaatattcatggtaataatgaataagttagtttttcatataaagttgcagacttgtactggatataa

SEQ ID NO: 46616 - DNA, 1054 bp, Homo sapiens
aaccagcccaaacatttaatgcattctactacgtaaagcgtacaggagaatgattatcagaggtctttgtgacaattctgtatatgtctctattcttggaaagaaattttaaaatatttttatacaagtaaatcaatgcttcttataaaaatatttaaaaccttagtgccaaaagtttgcaatggaagaaaaataaagtttttaaaattctgctactcttttacaattttcacttacatttatatcttttttttaaagcactgctgaagctgtacttcaaaaaatggatgacatgaagaagatgcgtagacagcgaatgagagaacttgaagacttgggagtgtttaatgaaacagaagaagtaaatatattcttccattaagggaatgatttaatatccagtttaatttttttatagtacctaatccatttttcattaaatatctactttttccagcatttatttgatcagtcattagttactgctggaaatgtaagagtttatggctgtaaatatcttaattttaaacaagattggaggatccaacttaatttttttaataaatagattccaaatgttaatggcttttatttaaacatttttagagcaatcttaatatgtacacaagaggaaaacagaaagatattcaaagaactgatgaagaaacaactgataatcaagaaggcagtgtgggttagtctcttctcttgttctgtcttctgggattgaatttaagaactttttatttagtagaaaatagcctttttagctagaaggtgtgacatttatggtagtttgtgagagatcagaggattggtaacttaaaagtggggaaaggggagagcttaagaggatagtatgttttgtttgggaaagtaactgaaatcaacaatctaaagccaataatattggtctgcttatgtaatacatccactatggacaacacactgtatatctcttttttagtttaaaggtgattaaagttatgttttgctattccatttaggacttaattaccataatctattagaacttatcttaagtgaaaatcag

SEQ ID NO: 46617 - DNA, 1128 bp, Homo sapiens
agtaactgtgtcatgagggtacgatctacatacttacttacttgatcctggggttcttaactagggtccagtgattaggtatagtcttcgcagagtgtacacaaaacctctgaagtaatgtttaaacttgcgtataccgtagctttcatcagatttgcagcggttgacaaactccagctgcatatttttgtaaatagtttccttggaacactgccatgcccattcattttgtatgtggctcctttcaccctataatgttaggtagctgtgacagaggagactgtatggcttccaagcttaaaatatttagtgcatagcaattgaaggaaaagtttaccaacccttggaaggttgctttcctcctgcaggcaaaaagaagacagtaggggtgggtggttcagaaaaatagtgctttagtcattctgttcctagcatctgaaaggggcctggtttataaaatgtatagacctacatggtatgaagggaggagctcctttatgagaaaagtctgtgagcctttgaagaaactaagcctttacctgtagatgaactactcaaaagtttgtttgtttgtttgtttttgagatggaccctgtgctctgtcacccgggctggaatgtagtggtgcaatcttggctcagtgcagccactgcctcccaggttcaagtgattctcctgcctcaggctcttgagtaggtgggactacaggcacctgactggttttggttttgtttgcttgtttgtttgtttgtttttaactagagatggagtttcaccatgttggccaggctggtcttgaactcttggcctcccaaagtgctgggattacaggcatgagccactgtgcccagccaaaagtttttattttcttcttaattcttacctgtcttccaagagagatgaggaattaatgaagacttactttgttaatgagaatatataagttaactcatcagggaaagatggttttattttactttaagttgtaatatttgaaattccacatataaaccagcccacttgcaaatagcttgatacataggttgattaacagatgcagcctaaggatggaaaattgagtcactaaaaacaaattaatggcacatactgttttgcttagtagatttt

SEQ ID NO: 46618 - DNA, 1014 bp, Homo sapiens
cgggcgcaatggctcacacctgtaatcccagcactttgggagaccgaggcaggcagatcacgaggtcaggagtttgagaccagccgggccaatatggtgaaaccccatctctactaaaaataaaatttaaaaaatatagctgggcatagtggcatgcacctgaggtcccagctactcgggaggctgaggcagaagaatcacttgaacctgggaggcagagattgcagtgaggcaagatcgtgccactgtactctagcctgggcaacaaagcaagactccatctccaaaaaaaaaaaaaaaaattagtatgtacacattcatgcttttattattcaaagatgatacctgtgatacatatgagtacagctaacaaggttagctgacgtaggatcagttctcaggtatttgagtatctaaagagaccttttgtgactataacttagcttgtggtttatggctccacttcatagtctatacaaagccttcattcataatcgtagttctgtttctgattgcttgctataaagttttttatcaattctgagtcatttatgaatttctatgtgttggtgttggtgtatttctaaagcagtctgtacatacggttttttggtttttagaagaggaggcatgaaacccattttaaactcaagaaatcaattttaatggattaggtagtttggctaaattcatggaactggaatatctttggttcagggcgaaaaaccccaattagggtaaaatttgtttgatgaaataattgttttggctgggcactgtggctcacacctgtaatcctaccactttgggaggccaaggcagaaggatcacttcggtcggggagtttgataccagcctgggcaacataacgagaccctctctctacaaaaaataaaaataaaaaaattatctgggcatggtgtcgcacacctgtagtcccagctactgtggaggctgaggcaggaggatcacttgagctggggaggtcaaggctgcagtgagctataatcatgc

SEQ ID NO: 46619 - DNA, 1657 bp, Homo sapiens
aataaatgagaatattacatctctaggttaaaatttcagactaagtttgttttctctttgttttttagtttttaggaatttttttctggtaatacatgtgaaaatgtgaaaaatagaaagtgaaagtccccatctctgtcatccaatgttaattactgttaacagtgttgaacttacctcttgggaattagatgacttcggtttaatacctgtgctagtcttccttaggaaagaagatatacacaagataattcatctagagatatttataacatcagaaaaaattgcaggcaacctaaatataatacattcagcaatttgttaaatagattcatgtaatggctgaaatactattcattcattaaatttttagagtaatatttaatgacatgaaaaaatattgatattactagaaaaaacttataaaacatatagtattatctcagttttaaaatcatgtaaatatgtttgcataggaaaaaaatggtttttgcaccaagagattaaaagaggttgtctgtgagtggctgaaattaagggtgacattttcatttttccagtaataatgggcatgtattgcctttatttttatattgcttttgttagaactgtttttgaaagatgcatttaaaaattttttagtgtatactctatatagaggactcccacataatttttttttttttttgcccacattgttgagtctttcttgctgcctagtacttatttggagagaatgacaagccgttcactatgcacatcaaagattctcttataccacttataagattgtcttccaagtttcttaggaaatgttttttcctagtattgtccccatccaccccttttcttgttttgtaaggaaacaaaatctttttttatcctcaggaatatggtagcatttattttcttttttaatgtaccaaaatatacataacataaaattgaccgttttaaccgtttttaagcttacagttcattaagtacattcacattgttctgcaaccatcatcaccattcatctccagaactttttcatcttccagaattgaaactctgtacccattaaacacttactcccagttcctctctcctcctagtccctggcaaccactgttctactttctgtctctgaatgtgactgttctctgaatctcatattcctagactaatcatatttgtcttttatgacttgcttatttcacttagcatatcttcagagttcatccatattgtagcatgtgttaaaatttccttttttaaacaagaaggaataatattccattgtatgtaccatgttttgtttgtccgttcatctgtcagtggacacttgggttgcttccccttttgggaattgaataatgctgctgtgaacatgagtacaaatatttgtgcaagtccctgcattcgcttctttgagtgtatacccaaaagtggaattgctggatcatatagaaattttgtgtttaactttttgaggaattgccttactattttatgttaccaccagcaacacacaaggattccagtttctctacatcctcaccaacaattgctattttctcctttttttttttttttgtgagtagccatcctaatgtgtgtgaagtgttatctctgtggttttgatttgcgtttctctaatgactagtgatgt

SEQ ID NO: 46620 - DNA, 1028 bp, Homo sapiens
ctgtttataaactattattatcctcattactagattcttagtatctagtatccatatactaagtattctagattcctagatccttagagtttaagttaaggtggtattagtaggaatggagaaaaatgtccaataatacagcacaggatctgagagttgtttgaacacagggagggaagacgttgtttccagctaaagaagtgagcagtagaccattgggagttttgttttgttttgtttttgagacggagccttgctctgtcgcccaggctgaagtgcagtggcgcgatctgggctcactgcaagctcctccttctgggttcacgccattctcctgcctcagcctcctgagtagctgggactacaggcgcccgccaccacgcccggctaagtttttgtatttttagtagagactgggttttcaccgtgatagccaggatggtctcaatctcccgacttcgtgatccgcccgccttggcctcccaaagtgctgggattacagatgtgagccaccacgcccggccgaccattgggagttttatgccagaattgctaagaggttgggactgcttgtccttgaggatgaatagaaaacagcaaagcacaggccgggcacggtggctcacacctgtaatcccagcactttgggaggccaaggcgggcggatcaggaggtcaggagatcgagaccatcctggctaacacggtgaaaccacatttctactaaaaatacaaaaaaaaaaaaaaaattagccgggcgtggtagcaggctcctgtaatcccagctactttagaggccgtggcaggagaatggcgtgaacccaggaggcggagcttgcagtgagccaagatcgcgccactgcacttcagcgtgggcgacagggcgagactctgtgtcaaaaaaaaaaaagagagagaagaaaacagcaaagcacaaaaagaattaaggaggtctgaagcaatgcctgtattttaaaggtgagaagttgaatcatggaactaagagtattaagtaaaccaagggaccga

SEQ ID NO: 46621 - DNA, 1029 bp, Homo sapiens
taaataactgttttactagatgaagttttcaaaatgcatgttcctgactttactggtaattacgtctctgtacctgcactttttaagctgtgaaacagaatcattcgaaggctcagaggtatgtgacttccttagagccacttaggctacaacacctacacgctgcacccacagacacacacacagagcagagcacggatgcaagtcatctttcagaaatgatctcaagtatttgatttttttaagagaatgtacatatttattatgaacatttacctgatttattctaataatttaccccattcccacatctcaagtgtaggcagatagtctgaccatgtgaatgtgagacccaagttcccaacttatctctcacagaaaacccacatacacattctacctggtttctggcattctctatggcctggactgactgactgggatttttctaaggccaggagagaactgtccagccagtgatataaacaagcgggtcccatgtgtcccaagggcacttcccttcagcaacttcagaacacccatttagacgatcacagttggccaggtgcagtggctcatgtctgtaatcccagcactttgggaggccgaggcaggcagatcacttgaggtcaggagttcgagaccagcctgaccaacattgtgaaactccatctctactaaacatacaaaaattagccaggcatggtggtacacacctgtagtcccagctactcgggaggctgaggcaggagaatcacttgaacctgggagttgaaggttgcagtaagccaagatcactgctcaccagcctgggtgacagactgagactccatctcaaggaaaaaaaaaaaaaacaaaaaacctctagatggtcacatttgcctggagcttgcctctgttccctctgtccacttccaaggacccctcctggccacatctgtccacataccctgcactgccataggctcacatgctcagaaccctccttagctcatccacaaacactcttcggagctagctattgtagct

SEQ ID NO: 46622 - DNA, 1048 bp, Homo sapiens
atctctagaaacagcaacttacctacttgtggaaggacatttaaaacatagtttaccctatacctcaagaccaacacattttggaaattcccttgaggaactggaaggattccagaggccaagccagtcagactggaagtttgtaaccatgagtaggtgagtgctgactaaccaggccacagagaggtcagaggatcgagtgagtcttgggcatcaagtcaaccaggagaaggtttcggagaccatcacccatgtaatggctctgcagtgagcctgctgtgaccccagtggttctcagtcctggctgcacattcaaatcaccttcgaagcttgttagactacagaagcccacctctggagcttccgatttaattagttgaaggtggtacccaggcattgctacttttaaaatatctgcctggtgatcccaatcagttttcaagtttacagaccagctcagaaactgctttggagcccagatattatgttttgcatattaatgagaatttttaaacaaagtgcactgagacattaaactctagatacgacttctggggcgtgtactgtggtccatcaggaatttagtgatggaaagaggacagcccctcctatattccagctcaaagttcgaagcttctttttttgtagtactttctgcaaatcaatcattttacttctctaaactgtaaatctaggataaccatacctgtattgaagcatttttatgagaatgaaaaaataaaatgtaaaaataaaggcagtgggtgtgaaagtgttatataaatttcaaaatgcaatgtaacttacttttcagaaagttaagtaggattttagcatatccaaccatctttccagggtgattaaaacttgaagactgaattcatgggccagatacagttggggacagagattagcctatttgcaatggaacttttgaggtccttagaatggtcgtacatttttaaaatctttatattctccccagtgaggctcagtgacagaaaacaccaacatttacccaaacaactgccccgttcccctggtcctt

SEQ ID NO: 46623 - DNA, 1031 bp, Homo sapiens
catggaaactcacggaagaagccaagcaaggtaaaggagagtgggcaagtctcagtgagaccatttaagacataaacagctaaggagagtctttgagggccattatgtaactgttttcccgaacccagatcataggagcaatttgtagctggaaagagaagcatcggaagctttggtgcttacctttgttcattcatttattcaggcactattcacagcctcgtgtgccccagactctgctagcataggagaaaggaccataacaaaggcattgtctctgtttccaagattccagaaatgtaaccagggaggaaggcatataaatagcttgcagaagcaactgtaattatcacagtgccatggcatccactgttgtgttaaatcgggtttctcttggtggatgttcattgtggtgtctgcctggaacttgtccgcttctcggtggaaatgcagccaccttcttttaggagtattgttcctcatcccgtccccctctgagtaagcgctgtctgtctgcactcctctgaccctagtgatagttaggagaatggctaatgaccacagtcagggcaatcagagttctttcctgggattcctgtaaatggaccttgggaaagaagagcttttatttttttctgtttttcttggaaagtgaagctataagggaaggccaagtgctgtagagaccagtctcctgcctcagaaagatcagcagttgaggctgggtgcggtggctcatgcctgtaatcctaacactttgggaggccaaggcgggtgagtcacctgaggtcaggagttcaaggccagcctgctcaagatggtgaaaccccgtctctactaaaaatacaaaaattagccaggcatggtggtgcacacctgcaatcccagctactccggaggctgaggcaggagaattgcttgaacctgggaggcagaatttgcagtgagccaagactgtgccactgcactccagcctgggtgacagagactctgtctttaaaaaaaaaaaaagtggacagttaagaaaataa

SEQ ID NO: 46624 - DNA, 1031 bp, Homo sapiens
ggattgaacaaaagctattataaattaccaaccatgtaagttttgcacttttgcccttttaaacaagaccacagagatggtttgccagtacttattttagttttttcctttcttacaattttttgtccaaatttcaataattttcttctttccacgtttgcaattgtgctaaatttcagctgcagcatcaaaatgcagcaagaagcttctcgttgaaaaatactggcaaattctcagcttgtaaacagtagacattttgattgccatgtttatctcgataaatactgtacaaaagttgcttgcaaatattagaatattttttcatcgcctggagactagctctaaatattattggtaaagacctgcaaacttcctgcaaagctcctaccgtaccactagaactttttaaaagttttttgtagcttgctttcttccaaatctgcacaagatccattcctccaccctccccacccccctgtttttctctgtacaaaaatagtcccccaaaaggaagttcaggatctctctcatagaagttttcttgtcggcatcgcggtttttgcgtgagtgtgaatgggattggtgttctctttggcagctgccatttgctgtgggtgatgggatatatatatataaatatataaaagaatatatatttatatataaatatataaaagaatatatatttatatataaatatataaaagaatatatatttatatataaatatataaaagaatatatatttatatataaatatataaaagaatatatatttatatataaataaaagaatatatatttatatataaatatataaaagaatatatatttatatataaatatataaaagaatatatatttatataaatatataaaagaatatatatttatatataagtatataaaagaatatataaatatataaaagaatatatataaaagaatatatatttatatatataaaagaatatatatttatatataaatatatataaaagaatatatatatatatataaaagaatatata

SEQ ID NO: 46625 - DNA, 1029 bp, Homo sapiens
tttggaaccatgtaatagtttccagttgttctgaaaccatccagcagaaaccacctaatacctccattcaaaaaacattttatttggtaactatgatgtatcatttgattttctcctctttattttaacttcaatttttttttaaaaaaaatgtatctgaaggggaattacattttatgaggggaaaaaaagcaatttgaaaaggatattagtattttagctaattgcagttttatttcaatttcaaatactaatgaataaccagtgttttgacaatgttttatatatgcacatacaattgattcttggttcttccatatttttctattgagaatttattaactgaatgagaagtagaatgggaaaatgagaatctgagttctggacctagctgtgtgtctttgagtaagtcacttaacatctgtgggcctaagtggctacatcttcaaagtggagaatgaagtcagtatttcacagtgagtgtgcttctggtatttgggctggataattctttgttatgaagtactctgttgtgcattgtaggaagtttagattccttaatgctggtggtagcatttcccagtcattatcatatcccagacgaccctgcatatccaaacctcttctagtggggagggaccacttcatattgagaactactggcaaatggtctctaagaattctttcagcttcaacattctgtgaaagaattcttatttggggcatgattgaaaaagaaggtaatatatcatacaccgaaaaacctctgctgcttcctggatacgaaacaattttattttaaaatgaataacttttacgaatctgtgtagccctactcacagatctaccatttatgatgttccaagataaattattttattctagcttgccttaggctttttctctacagtattatccatagctatatgattttttaaactaaaaattatatagtaccatctctatatctaataagtaaaagcaacaagatttttttttaagttgtactattgttttaatatcttagcc

SEQ ID NO: 46626 - DNA, 1058 bp, Homo sapiens
tactgaaatcctgcaatactttaaggctaaatcctacctcttctaggagtctgtctcccacttcttagggaaataatttctcctttctggaatcttacctgtatttttattttattttattttattttattttattttattttattttattttattttattttattttatgatagtaaattcaaggaatttaagtggaaaacatttgacttctaagaaagagaatcttgttcctttgattttacactaatttgtataggcagaaaaaaatgtatattaaattttaatgccctatttctctggatttatgcaaattcattaataattcatttttcattattataggcaatccctgctttatataatttctatatgcatgaatctcagtaaccatgttttagttaaataacaccagttcccaacaactcagttcaaatttcatttagaacagtataactttcagtaattgtataaagtacaaactttgctgctagctcctcagtccataaatcactctgtagaaacatatgtacatcgtaatcatgaccaatcacattgcttttctttaatagtctgttggtgattggttactatatgtctgtcattcagttcacacagagacagcaaagcatgtaggtgtgtttcctccttgtctcccagtgataacgtgatgttttacaaaaatggataatcaaaaggaaatggaccaaaagagataaaagcgcagccaagaaacaaaaagtgaaaatgctgaagtgaaattctgggaagtgtaaatggagtatagaagaaatagctgactgtgggaatattgacactgctattgaactgctgtcatttaagagactccagatatacatccagaggaggttagggaaggtgaacttatggatataaatgaagaaagtgaggaggttgtggtgaaaagatgaagccgtttcaggggaagtgaccctggcaaaaagttcacattaaaggaactcttggagatatttcatgacgttgaaaatgtaaaggataaaatgttataaactcatccagatttagaaaagtgtgtga

SEQ ID NO: 46627 - DNA, 1087 bp, Homo sapiens
aaatctctaacctttagttttcctttagattttggaagattttttatatttgttttcaaaatgaattcctaactcgaatgactttttaaaacgaaatctaacatttaacctataggaaagctctccagactttgagttcattttcagctttactgggtattgtgagataactatataaagatatttagtaattaattgtatatatcaactctggagctccagagtaagagtcaagtttgggacttctacccatataggtagtaactagggctaggcagtataaatagagtgataggagaagatcccaggagaaaatgctgaaaaacaccagtgtttattggaagagaacaggaagaagaacaagaactagaaagagagagaggagtaatgtccagagagacaggaaaaaaaaaaaaaagatatcctagaagctaagggtggaagaggcatttcaagaaagagggaataagaccaggaacggtggctcacacctgtaatcccatcactttgggaggacgagttgggaggattgtttgagttcaggagtttgagaccagcctggacaacatggtaaaaccccgtctctactaaaaatacaaaaattagctgggtgtgatggtgcaagcctatggtcccagctacttgggaggctgaggtgggaagaacactatagcctgggaagcagaggttgcagtgagctgagatcacgccattacactccagcctgtgtgacagaatgagacactgtctcaaaaaaataaaaataaaaaaagagtgatctgatgctttagataggtcaagtaagaggaatattggggctgaggtgtgtgtggggtccattagatttaataacgtgaaagagattgatgtctttgtcagagcagttttaatgatagctatgtgaggagaagccagattttagttggctgagaagggagtatcaataaggaaggattcaactttctgaaggaaactttggatgtggaagggagatgttgggcaatagcttgattttatctgaggtcatctctttactcataagtcagaaatgtgaatttactttaagtatatgttactggtgtagaga

SEQ ID NO: 46628 - DNA, 1063 bp, Homo sapiens
aagtgccgggattacagctgtgagcaccgtgcctagcctaaatataaattattttaagctatgagcctctggaatggattgggaatagtttgcttttgtccaataagaaaaagggcaagaaaaacattttatactgcaaataaagatacgtgaataaagatatttcagtgcctttgttgagatagtaaaaaggaataagggaagtatagccccacctaggcccggcaagaggggaagaacaaggacgtggataagaagtatgaattgaggcaagaggagtgagagatctctgatgagccatgggcttctataagttgagttacactcagttaaatgaagctttgctacaatcagttattttaccaatatggaaagaacctaattacagtagtatatttcagcaagcttaattctgagttctttagagttacggggtatgttggaatggtcttattactagggattactgccagtagaagacagataatcaagtaatcaagtaaagtttttttttttccattatgaaaggcatatatgctgtttaacagtgtttaatcatcacttacatataacatgtccagagttacgtgtgacttcaaataacaacccttctatcatagctcatgattttgtggatcaagaatataggcagttgcaggtacagagttcataggaaataaaaaaataaaattgaaaaaaaaaggatataggcagggctcagctggatgctgtttcttatggtatctatggaggtcattacataaactttggctggctgatggtctggtcagaaggtccaacatcggtttgtttatgtgtctggtactttggtggatggctggagggctggcctcaactggaactgttgacccaaggagatggatgtggcctcaccagcatgacaatgttagcatggttgtaatacttaggtcagggatcccagagaaaatgttccaagggggctgggtagaagctgtaagactttgtattagttttctttctcttttttgagacggagtctcgtgctgtcactcagtctggagtgcagtggtgtgatcttggc

SEQ ID NO: 46629 - DNA, 1042 bp, Homo sapiens
ggcttaaaacaagcatgtattaactcataatttctgaggctcaggaatgctatagcatcttagttgagtatttctggcccaggatcttaagaagttgaaatcaagctctcagctggggtggcatcatctgaagtcttaactggggctggaggatccatttccaagaagtctcactcacatggctgttggctggatgtctcaattccctcccatgtggtcctccacagggctgcctgagtattctcatgacatggcagtgggtttcctctagagcaagtgatgagagagcgagagagcaagagagagcgagtgtgtttgcaagacagcacctgtgggcacctaagctggaagccacagacttttataacacagtcttagtagtgacagtccatctcttttgtcctgacacattgtgggagagtactacagaaggtgtgaatacaagggagtgggaatcatcgggggtacatctttgaggctggcttccacacttatttaaggtggtgtaattaatgctcatcagagagttacacagagagacaagaactggctattggagaggtaaaatgagagatatgttttgaaaaaaggagcctcttagggaatatttttgttataatatgtatactataagccacagacttttaaaacgcagtcttcgaagtgacagtccatctcttttgtcctgacacattgtgggagagtactacacaaggtgtgaatacaagggagtgggaatcatcgggggtacatctttgaggttggcttccacattatttaaggtggtgtaattaatgctcatcagagagtttacacagagagacaagaactggctattggagaggtacaatgagagatatgttttgaaaaagggagcctcttagggaatatttttgttataatatgtatacttaagatatttaaaaaatgagattgtttttacatatagcaaataaaagatgtattgaggtgaacagagcagtttttctatcaatgttaggtctcaattagcttgcattttttgattactctatgtgagtgg

SEQ ID NO: 46630 - DNA, 1098 bp, Homo sapiens
tagggtttcaccatattgcccacactggtctcgaactcttgagttcaatctgcctgcctcagcctcccaaagtgctgtgattacaggcatgagccactgggcccagcccaatagatttcttataagcgatttcaataaaatgaatttgctatgcaatataatcttagcaaagctgctgtgaccttcaaaactgtgtcatcagcagcattaatcaagagttccaattctgagaagtgcatacagagggacattcagtagtttcctaagaaaaatggattttcactgtcttaatttaaatgttaatagatttgcttttagtgtatcttgactgtcagataaaattttagtgtagtgtttgcttagtataaacatcaagcaaggcttttgtgtcacattacaaaacaattttttaaattcccattaatcttagatctccatccttaattcctttaggtgttaacatttaagatactaagggaacaaaaagcttaggcaaagaatatttaaatgttcaatttggactttggaactttctaattcatgtattaaaaatcttccacttatatataataagtatggagacactacggatcatcattactgtaagcacagaaactgaaagatgcggccaggcgcggtggctcacacctgtaatcccagcactttgggaggcccaggtggggtggatcacaaggtcaggagttcaagaccacggccagccaacatagtgaaaccccgtctctactaaaaatacaaaaattagctgggtgtgatggcaggtgcctgtaatcccagctactcaggaggctgaggcaggagaatcacttgaacccaggcggcagaggttgcagtgagccgagatcgtgccactgcactccagcctgagcaacagagtaagacgccgtctcaaaaaagaaagaaaaaagaaaaaaaaaagaaaggaaagaaaaagaaaggaaaggaagggagggaagggaaggaagagagagacagagaaagaaagaaactgaaggatggacacctgggcttatttctctcgcaagggtagaggtacagaaagccctcgccctcaataaccacacatttttccaagtaaat

SEQ ID NO: 46631 - DNA, 1381 bp, Homo sapiens
ttttggaagacttcagattttggtctgcacttttctaccatctggaacaaccagtgtatgattgtgtttgtttgtttgtttgtttgttttttgagatggagtctcactctgtcccccaggctggagtgcagtggtgcaatctcagatcactgcaacctccacctcccaggttcaagcaattctcctgcctcagcctcccaagtagctgggattacaggtgcccatcagcatgcctggctaatttttttgtatttttagtagagacagagtttcaccatgttggccaggctggtttcgaactccagacctcaagtgatccgcccaccacggcctcccaaagtgctagggttacaggcatgagccactgcacccggccatgatttgtttttaagtaaatatgtagtcaggaaaaaggagatgtatgagaaaagaaaaatagaaaattagggggcaagacagaaaaattaatatacaatagatgtagtgtctgaaaaataatggtaagtgaaggcggtgtatgaccatgttaaaaggatgagctttggaatcagcagatctttgggtgagatttacaactgcctttggtgtcacttcatccctttgtgcatcccctttaaaatggggagattgctgcctacctttcttaacataaggcacataaagcccatagtgacatgagtcatgcagagtatgtgcacaatcatggctgttgttacattcctcatactagaaataattaccaccctaaaggaagatgctagctattgtttttgtttggaacttttaaaagtttttttttttaatacttttttcttgttttagtacctagaccttttctggaaaaagtattttttaaagactaagaaagagaagcaaagagtgaaaacaaggaaaggcctgatctacttatggaaagtttatcctttaagccataccctgtattttcaatttcctggccttatgctacactcctttccttgttgcaatttagagctctgttctcttgggtaggaggaatttgctttgggcatttttcttggggctttaaaatgttaacactgtgcaggtcttaaaaactacaacaagaagattttaaaacaatcctttggggatttaggggaccctagagatgagcaattgaggccatgttgccatcaagcagcttacagaggagggattactacttgtgttgaggtatacccatgaaactcactgggctttttggatttgccttgatcctaattaataacaactgctcctgaagctgaacttttccagctcttgtcgttagatagttaaacctcaactgtaagaagcagtaataaaatcagaagcttcactaagatgagcaaataactcaagtggaaaattattttcattt

SEQ ID NO: 46632 - DNA, 1051 bp, Homo sapiens
actttccttctggccatgtttcccattttccctaatgagctccctgctgggctgtggtaacagaaccataacccaaagcaggtttggggtgatcatgttgaacttaacagtacacgcagactttagttttagtcttgagtgttcaaacatgtttgctttaatataaagacgaactttgaaaatgatcccctagcaagtccgatcaatgctcctccaggaggataatctgctctcttttgagaggaggaccctaatttgaaaagtaggccccttggctgccagcgttttaagcaggttttgactttagccctcacaggcggtgtgggcctctcaaggcttctcggaatctttctactgcccctgggcgccttcctttccttctgagggcttgagagggcagggagcctgccatgccctttgaggctggtttcctgggaatggagggagaagggctgatgttgctttagtgctcgctggtggccattcccctaacgggaagccatctgggttgttaaggagcgctggtcccttcagacaggagaagcacgatgtactgcccactggtgggtccccttagcttacaccggtcacctgttaggtggctgccgggtctcctgctgccacctggtgggtgagggtttttaatctttgggcagagacgaggaaaagggaggtacacagggggctcccaaagggtttccattccttgccctttagagcctggagagggcatgcagagggcctgtggcttgtcccagccggaggttccccttaaggggaccagctgccttctctggggagctgtctatggggtccccgcagccctccagtggaggcagaggccctggctcctgaccgcacttgttttgcataggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccagggtg

SEQ ID NO: 46633 - DNA, 1016 bp, Homo sapiens
tggggctgacacggcctctatttcccctcatggcgatgttgggctagtggttccccaactttaaaaaggatcatcctttccagttctcaacattgtgattatgaaacagcttgcacagtttctagtaaacctttggaaggaaggtaagacacagtcactgttttgcttattgcagtaaaattcacatcacagaatttatcattttagccgttctgaagtataagtttcagtggcttttagtacattcatggtgttatgcaaccatcgccactatctaatttcacaacattttcattatccccgaaagacacctcatgcccattaagcagtccctccctgtttcacagtctccccacccacgctgaccctgacaaccactcatctgccttctgtctctggatttgcctattctggacattttatacaaatggaatcatgtagtacacagccttttgaggacacagtcccttgagtcttgagttttactggaacctttgccgagagcctgacatgagtcagttcatggagtaaatagagcattttatttatttgaaatgatgggaggtcagtttggaatgaataaagaaactgtatagccttttgactttgtaagttctaaagattctgcttatctttcaaagagaaatctctgcaaccccctttaattttttctcttgtaggggctggttcataggcaaagccacagtgaatttgggtataaatacacaagaaaagctatatgatttgtagctctcataaatgtttaaaatatttatacagagagaaaaaaataattctttaattatttttaacagttggcttggctgggcgcgttggcgtggtggctcatgcctgtaatcccagcactttgggaggcctaggtgggcagatcacctgaagtcaggagttcgagaccagcctggccaacatggtaaaaccccatcacgatcagtgacacgatctcggctcactgcaacctccgtctcctgggttcaagcaattctccagcctcagcc

SEQ ID NO: 46634 - DNA, 1049 bp, Homo sapiens
tcttattataaaagtggggtgggattagaaagtgatggcttaatgaggaaggaagcacagctcaaatgccattcatatgaccagggtctacctcacatacttgttagaatgaaatgtgaaagtgccttaaaagacgtcacctgctacatgaatgtctaccgcaacattattcgtgataaccaaaaggcggaaacatctcagctgcccattactggatgaatggataaacaaattgcggtatgtacataatggaatattattcaaccgtaaaaagggacgaagtgcagatgctacaacttggatgaacctcaaacgtgttagtgaaagtcaagagacaagaggtctcatatcatataattccacttatggggaatgctcaggataggtaaatccatagagataggaagcagtttccaggttgccagaggttggtgagagtagggaatggggaatgactgcttagtggccatgggggtttattttggggcactgaaaatgtttttgaactaggtagaggtggtcattactcacattgtgaatgcactgaacgcttctgaatcgttcacttcaaagtgattttgtcttatgtcaatttcacttcaaaatataaaacacacacatgcataatctgcatcaatgtcactatatatggtacaccctattcatcaccaggacctgtcagcctggatgtacttggtccccaaccctgtgtcagagggagaaccaaacacacctttacacataggggacccgaacagagctcaagggcaatggaacttgctcaaggccaagtcattgggaagtgacagttgtaggactggctcttgggttttcctgttttctatgcatctttattcattatttctacatggtgtttgctggcaggggaggctgacacattgggtagactagtgaaagatcagtgttcctcaagaagcttctattctgcccctcggagggcagtcaaagctcctccacatacctgctgtgaagcggaggctagctcagccttgttgtttcctgacttcttggagctggctttctctgtt

SEQ ID NO: 46635 - DNA, 1049 bp, Homo sapiens
atcccaaagcttctgaactgcctgagagactgcaatgttgccatccgatggctgatgcttcatacagcagactcaggtaatgcacaaaaggggtggccgtttatattactccacataaagactctcagaatcaggacctacttcacgatgcagagtggtttagcagggagagaggccttggatgagaatcaagttgctttttaaagttagtcattttttgtcaacttggataggccactagcatacctgaaaagctctcccctgtcaggtactgttaggtgctagggaataagaggatgtttatctctcatgttcaaggagcttgtcactgatcagaatggggagatcaaatgtagacatatgaaaaaatagaactgcagatctgtggtaggcagaatagtgccttccagcccacacccagagatgttcatgccctagtccctgaaccggtagatatattacatgaaaaagggggattgaggttgcctattagctgacctttaaggagatgtttctggattatcccagtggactcagtgtaatcataagggtccttgctgtgtgtggtggctcatacttgtaatcccatcactttgggaggccaaggcaggaggagagcttgagcccaggagttcagaaccagcctgggtaacacagtgagatcccatctctacaaaaagtaaaaaaattagctgggcatggtggcacacacctgtagtcccagctactggggaggctgaggtgggaagatcacttgagcctgggaggttgcagctgcagtgagccaagatcatgctactgcactgcagcctaagtgacagagcaagaccacgtctcaaaaaagaataataaaataagagcccgccccccccccccactttttttttttttttaagacaggatctcaagttccccaggtttgagtgcagtggcacaatctcagctcactcagacctcctgggctcaagcgatacaacttccgcaatccccgcaagcagctgggactacaggtgtgtgccatcatgcctggctaagttttttgtattttt

SEQ ID NO: 46636 - DNA, 1061 bp, Homo sapiens
attttggaaaagggattatggacctttacatagtatgaatacccatcttctaaacaggctttcaaaaatataattttgaggccgggcacagtggctcacacctgtaatcccagcactttgggaggacaaggtgggtggatcagttgaggtcagacatttaagaccagcctgggccagcatggtgaaaccccatctctactaaaatacaaaaattagccaggcacggtggcaaatgcctgtagtcccagttactcaggaggctgaggcaggagaattgcttgaacctggaggcagaggttgcagtgagctgagatcacgccactgcactccagcctgggtgacagagcaagacaccatctcaaaaaaaaaaaaaaaaaaaaaaaaggttatatatacatacatagcgagactccatctcaaaaaaaaatgtatatatatatatatatatatatacacacacacacacatatatatacacataattttgaatcttgaggatatattgaggatatagatggacctgtgatcatatctgaaactatattgagtcaaagtagaatggaattctactttattggacttttcagtttctaatatgtgtgttttgggtctttgtttcccattgtgaatatgactcagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtgggaattaaatctattaagacctattaagacagtttaacagactgatttcacttccctctttaattactcctttccttccttctttcccaaaagagtaaaagcaggtagaaccttttaaaaccttttgagctacaccccaggatgataaaggaaagagggttattaattttgccagaatcatatatttcagggagaagatggaatttgagctattgggaagaagatg

SEQ ID NO: 46637 - DNA, 1085 bp, Homo sapiens
ctcagttccttgtcatatgggcttctccccagggctctctcacaccatgatatgttgcttcccctggactagcaagctacagagggtgcccaagccagaagttagtcttttcgaaatctaatctcagaagtgcactgtatcttttgtttctatcctatttccttccccccctcccccttttttttttttgagatgaagtctcactctgtcacccaggctggagtgcagtggtgcaatctcggttcactgcaacctccgcctcctgggtttaagcaattctcctgcctcagcctcccgagtagctgggattacaggtttttgccaccatgcctggctaatttttgtatttttagtagagccggggtgatcccggctctcctaacctcaggtgatccatgtgcctcagcctctcaaagtgctggaattacaggagtgagtcaccacacctggccctattctcctctttaggagggagtcagtaagtcagcttatactcaagggaaggaacctacatagaacatgaataccaggaggcagagatcattagggaccactttagaaagctgctgaccatacccagatatccatactgcttgctctctcatttccttctgacttctgcccgaggtgctctatggaaactagcatatgccccatcctttattatgttttttcttcacggcacttatcacagcctaatatataaagctcattttcacaaatttcaagatacatttgtaatcaaaactttttcttctcctttttatgaaacatttttctgtattttgtaatcactctagcatttttcagatatgaactattcttaatagcaagaatctcctatacttgacatgtgagaaaatttttttttttttttttttttgagagagggtctcattgtcacccaggcaagagtgcagtggcacgatcatggctcactgcagcctcaacctccagggctcaagcaatcctcccacctcagcctcccttgtcactgggactacaggctcgcaccaccatacctgactgatattcttttgatttttagtagagacaaggtctcgctattgttgcccagactggtc

SEQ ID NO: 46638 - DNA, 1019 bp, Homo sapiens
caaagacttaattctaagacctgaaaccataaaaattctagacaacccacagagtgggagaaaatcttcacagtatatacatctgacaagggactaatatccagaatccacaaagaacccaagcaaatcagcaagaacaacaacaataaaaaaaaacaaaaaacaaaaaacaatcccattgaaaagtgggctaaggatatgaatagataattctgaaaagaagatataaaatggtgaacaaacatatggaaaaatgctcaacatcactaattattggggaaatgcaaattaaaatcacaatgcatacctcctcactcctgcaagaatgcccataatcaaaacatcaaaaaataatcgatgttggcatggatgtaatgaaaagggaacacttttccactgttgatatgaatgtaaactagtataatcactgtggaaaacagtgtgaaaattcattaaaaaactaaaagtagatctaccatttgatccagcaatcccactactaagtacccagaggaaaagaagtcattatacaaaaatgatacttgcacatgcttattcctagaagcacaatttacaatttcaaaaatatgaaacgagcccacatgcccatcaattgagtggataaagaaaatgtgtgagagagatatatatacacgtggatgtacacatgtacatgtgtacatacacacgtggatgtatatatgtacatgtgtacatacacacgtggatgtatatatgtacatgtgtacatacacacgtggatgtatatatgtacatgtgtatatatacacacacacaccacggaatactactcagccataaaaaggaattaagtaatggcattcacaacaacctgaatggaatcgaagactattattttatttgaagtaactcaggaatagaaaaccaagcatcatattttctcattcataattaggagctaagctatgaggactcaaagccataacaatgatacaatggactttgggaactcaggggaaatggtgggatgcgggtga

SEQ ID NO: 46639 - DNA, 1078 bp, Homo sapiens
ccccgatgtggctgaagggattcataatggtcacaaattagtgttactgataaatattttaaaaacttgatcaaagttgactttttctaccctcacacttgaaaggtatttatctaaagcttactggcttcccatcctagcattgattagtagtttgtaaaagttaaggttaataattcatatttatataacattcagtttcacaatacgccagtgtaaatagccttactgactactatccattgatttctatagagctatggcattggaacttttatgtgaacttaaaatgctactgtggagactgaggcagttttgtttaggttaacccagatttgtttcattcctaagaaaagcctcttgcaacacgtttattattctgagaaatgatggcatttttggaaacttttctctcagaagcaggagtcatacaaatgaaacaatagattaaattcaaaaatgtggattctatttgagtccatgtttttctacgtatgatcacgacatagggttaaggtatccttctcccactctgcaaatgtctaaagcaaaactaaaaaagtttgtacttgctgaacccagccacttgaaagtaaaccagcacagtgttgccatcaccccaataaagctgtaagattaatcacatgcaccagacaaatctgcagagctagttaaagaatttattttaaacctcctgcaccacacagcatgttttaaacacttgacatgtaactccaaagtttatcttactagaaagaagacatactatcactttaagttctatgatttgacaaagcattcatgaaataatctgcagactgtttttgaaaagtaacacctgtaaacagacataactatcctaaattgtttattagatattaattatacaaacatatattagtggtgaaggtggagctggagagcattctaccttctccaagctgcatggcaagaaccagacatagttttgtggaatttagggaccatccaagccattgctctttcagctggcagatgtcagcccacgcatcaccctgtgcttatagactggtatggtgatctgttgggtgtcaggact

SEQ ID NO: 46640 - DNA, 1027 bp, Homo sapiens
aacaaagtttctttacaatgttctaagtaaaggaataaagaaatcattgtgtatttgtggtgaggtgaaaaggagcagaaaagtctagttaactaattttatatgattggtagacaaagatttaccaaaaaccttcttgtttgttaaaatatttttaaacttaaaagaccagtgtgatagtattaaaaacgttcttacttcatcttataaatttggactgattccttttccctcataagagaaaattttagcatggaggaattctgccagtcatttttctctaaaatatgataatcataatgtttatgattttaagtgctttatgccttacctgtggtgctgaatgtggcctagttggaaagatttgtaaagaaaccttcatttcctcttagagtccacctttttccttaaaatataaaagatttgtccttagagaaacaaatgaccagtattattaaaagcaagatttctgttaacttgagtcaagcagagagaaatccagatttagtcattcattaacatatgttttgtggctaacaccacaggtggtgaaaatgcccatatgtttgtgtccttgattctgctttttataactgtaattcttccttcatttttctcttactcccaagtgtgtaggaactcagattttctttagtatttcaaaatttcagtagtagtattgtagtgtagcttaaagtatctagttttcagcagctgagtaattgtggagcagttttataacttgaaatcctctgcacaggattcttgaccttctgttcatcagcagaatagttcagtgatactctcttgggtttgttgttagatatatatatcctctcttctttaacctataatatcatatatgttgagacactttcgaagtgattcctggaaaagggggtgagcacctaaaaactattaaagtttttttacttttttatatcaaaactcagtcattaaaagtaaaatgaactttataggaaaataaaaatagtttgtcttaaactatacatgagcaacatgtttt

SEQ ID NO: 46641 - DNA, 1032 bp, Homo sapiens
cttttgatgtcatctggccctgatgccatgttttaaagaggttctcaaaagctgcactgccagagtcagtggattaagccccacattttttttttactcatttgctgctttgtccaagtcaccaggttgctctagtctttatttcccttctttcataaaattagggagttgagctcgttcaagtcatttcacaaaccctttagtctgggctcagattttctatcctttgtcatcccctttctccgtttttttagcacctttagacatgtggtagtgaaagtcttcagaatcaaaatggagttactaatgttaaggaaacccagggaagctgtgtacagagccagggaaggctgtgaagagagtgttctcacacttgtatgcctgataatgaaagagactacaaagaccatatccttacacaaaggccatcaccaccttacacaaaatagtacttctgcaaggacatctgcccagcaactgcctgttcagcctccaactggtgtcacccttgttattgatctttgtagctaaggatatttatttcaaaactattatataacccttgtttctcctttaaaaacctttgtcttcctttacctccctgaatatgtatggcatagtttactatgttatgcatattcctattgcaatgctctgttctgaaataaacatcttttctttgtgatcctctctctgttatgtaggttgacagtaaaaattcaaagtggtttagtgatttgaactttgctttatataaacatttcctttttatatgctttgtgaaactagaaggtgtaataattaatggcatacttagttaaaaaaatttatatgatatgcacatactgcatttggtcctaataatgatctcaacatttcatttacaattagcttattccacagtattaagaaaacataggtttcttcctattttatataaatcagcctttaaaataaaacaaaccagcttttgcaaaattatttacaaagatacctggccttgtcatttgtcatttgaaaataattatggga

SEQ ID NO: 46642 - DNA, 1071 bp, Homo sapiens
ctgtaagactaaagaggaataactaactttccttttcttaccctttgcttcataagctatgatgagaattgtgtacttgtcttcgtacactttttactctctgagtatgttgacggtgacaactgggttgtcttacctattgttgtttccagggcttaatatgatgccttactctaaataggtcctccataaatggtggttgagttaatccaaggaaataaataaatatatgtgtgtatgtataaaatgtgcacgtgcatgatggcattcgtaaactttaaagttaactgtaataaaaacttgttttaaagtataataatgttttagactttcttcctttttttctttccttaaacagatagaaggacaaggacagaatcaccagcactggctgaaggtaaatatgtctttgggggaaatgattattcaaatataaatgaaaagttatgatttcaataaaaacttatattaactatatataatttaagggaaatgttctatacacaatattgagttgctaaaaatgttgttaggaaatattgattgtttagtttttggcttagaataggacctggtggggaaaatgtaaattaattagaactttttttaacagctttctttctttaggagaggtatgtgttttcctttgaattaagtcattttagctgtcaccagtatagttgatcaagaaagttctaagccataattttagtagtttaaagtatatatatgtacatatatattttttttcattgaaaacagaagggaagacactttacacataatcttaagaattctatctgttactggttttggtcctttttttaaaaaaaaattttttagaaacaaagaatcgttaccataaaaggtagttactgttaaagggtcctgagtactgaaacatttgtaatcctgcagttgttttaattataacaagttattaagtattcaaaatgtaattttttttacaggcagattttgtgttcttaagtgaaaatgactagcttaaaatccctttccgtgttcttcttagttataaacagagtatattttttcaaaactagctcatca

SEQ ID NO: 46643 - DNA, 1084 bp, Homo sapiens
ttttagtagagacagggttttaccatgttggctagcctggtctcaaactcctgatctcaagtgatctgcccacctcggcctcccaaagtgctgggattacaggcatgagccactccacttgactctaagacaattttttaaatgtgtgctctatgaatgcagcacattatgtgtagaacttacaacaaaattaattcccaaatccagttttaggcatttaaagtttttataaatctgctcttgagtattagattaactttttggcagttggtgataatgagtgtggagccagtagatatatgtgtagtgatacagaattttatttgcaatcatgtgaggactgatccccactgcaagcttagttttatcatgctaataaagaaatagccacctttgttcttttgcatttcagaatttggtcccagttcctgttgaaaatatctcaggatccagcttcattgaggggttacaaggttgaattcgcaaattctgaaatgtttctctccgctagtgtagatcacatcccattattaggaactcctctgacacctgcatttttcttgtagtatgattttatatggtgcatacatggttcaaaatcatatttagagatgtaacagctctaggagactgtagattacactatttaaaagactgaagtttaatctctggtagggagccattaaagggtttggacttcagagtggcacagtgagacacattttagaaagagcagcacactagttcagtggaaatttgatgcttgaaaaaggtaatgtgtttaaattgggtgataaactggattgcttaatgaaattatataaatgaagtgttattgtacaaggttttaaaaaatataaacttacatttttaagtggcataaagggacagtgttaaccgtggctgagtggtaaggttgtggatttttattttattcctgcttttcatggaaaatttagaaaatacagaatacgaaataaggtgctaaaatgggtggaactcttgtattctgagtttgaccctaagtcaacagatgcatatttctaaagtgagttttaaggacaccatgtgggtgttcaaaaga

SEQ ID NO: 46644 - DNA, 1095 bp, Homo sapiens
gtagattgtcttatctccatttcacagataggaagcaaagatcaagtgagtgggtctagttcactctggcagatttaggacctgagctgcagctcatggatggctacccagtgggtttggtcagaaactcaaggtacagctgggtgcagtggctcccagcaccttgggaggccaaggtgggcagatccacctgaggtcaggagtttaacaccagtctggccaacatggtgaaaccctgtctctattaaaaatgcaaaaattagccaggtgtggtggctcatgcctgtaatctcagctactcactcaggaggctgaggcaggaaagtcgcttgaactcgggaggcggaggctgcagtgagtggagattgtgtcacagccctccagcctggggcgacagagcaagactctgtctcaaatagataaataaataaaaatacaaaaaaaagaaactcaaggtacagtggtgggagtcaaaaaagcataaggagaaaaccaagactgaaaactgttattgagcttagtctgtgcctagttcagtccctagcattttacaagttttctctgagttaacaaacttgtgggggaaactgaggctttcagatgttgaataacttgtgtaagttgtagagcaggtttcagagcctaagttacatccagagcatagacatggtttcagctctgctgtgttgccctctgcattcacaggaatgctttgtagaaggagtgaatacatgaacacatgaatgaacaaatggattagggagttaggacatgaaaaccagcttctgtggaaacttggacctcaggctccccatggatgacaggttcttttccatagttccgcattttttacctgcaatacagcaatgcggttgcccaggcccctcccaggagagttgcagcttccccggaggccacacttctccaacaccttttgcctaaaggctctttttccctaaaggctcaactcatcccttgcaaaatacccaaagccaaatgagtctagagggtaaaccagccatgtaggatgtggacctttagcaactgaaggaaactgaggtatttcagtatgatgaaatactctgtagtcattaa

SEQ ID NO: 46645 - DNA, 1034 bp, Homo sapiens
tctcgctctgccgcccaggctggaaagcagtggcttgatcttggctcactgcaacctctgcctcccaggtttaagcgatcgatcttggctcactgcaacctctgcctcccaggtttaagcgattatcctattctcctgcctcagcctcctgagtaactgggattacaggtgcccgccaccatgcccagctaatttttgtatttttagtagaggcggggtttcgccatgttggccaggctggtctcaaactcctgacctcaggtgatccacccaccttggcctcccaaagtgctgggattacaggtacgagctactgcgcctgatcgtgatttgttaagtttcatttcattcatttattttaaaaagtacttaaggagggcctgtgtacagaaactctgtttggccctgggtgaccaagattgaccagggtttctgctcccagggaacttaaagtctgagttaaataattggaagtgtgcagtctttcattcagtgatttattcagccatgcaccaggatgtatcagttagatgctttgaattgcaagtgtcataaatcccagttcaaatgggataattgataaaagcagttaagtggctcacataaccaaaaattgtagaggtaggataggtcagggctccgtcttcctttccttaagatcctcccagctctgtacttctgtctgtgggctcttctcagattgacttccttcatagtcgtgagagaaaagagctaccatctctccctagagccactgaacaaacttcctgaactttgtcctgattggatcatttcaggacatgcattcatctttcaattaattgtggtgggaaatgggataatactgattggcttagaccattcaggacctgcccttggaattggaggtaaggtgtgcctgactgaagaatgcctcttgatggggaaggagtggagtagatgtggtaggattggcgtacaaagatgggtaaaagtattatctcttattagacactcacctttttcttattttttaaaatattaataatagagat

SEQ ID NO: 46646 - DNA, 1046 bp, Homo sapiens
gacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgtcccggtcattcatttacacattttaacttgcattaaagagctgttcttttctgtggcctagactcttttcactgatctcaaaataaactggtttttttcaaaaaaaaaaaaaaaacaaaaacaaaaaaaaaacacaaaagctgcatgtctaaaattacatggagttagtgtctattctttttccccttttgcagcaacttacacagcatttttaacaccttttttttctagtttttttgttcggttttgttttccatcaggaatttgagttctctctaacccagcttactgtgggacataggaaaactcagtagaaatacctttggtgatcttgttgagtttaagtctgatcttgatcttaaactcagtaagccactatctgcaattttgtacattatatagtattttgaagatatggaaccttatgaaaaaaaaatagcaaattagttctttttcccccagaggggaaagttatgttctgcaaatagtgtgtgtcttattttactgttgaacagcaattgctatttatttttttattgcctagaacttcaacatgttgtataggaatcctgtagtgccactagttaaatgccgaattctcatctggatgttaccatcaaacatcagtacacttgtcatttcacatgtgtttaatgtgacagtttttcagtactgtatgtgttaatttctactttttttaatatttaaaattgcttttaaataaacatattctcagttgatcccaaacttctgaaatcaggccattttgtgagttgttcactaccctgctgacaggagagaatcaaggcttcctctggctgtgctttcgggtatat

SEQ ID NO: 46647 - DNA, 1068 bp, Homo sapiens
aacatggaagtaatagttcccattgttctagggccattggaggttgtagaaaaaaggccttaggtcactgaaagaaacatttggtgttcaatatttacagctgtcttattactaagaagtgctcatggggaggccatgaccaagaactgttgaggttaatgttagttgcaacttggaggttaatgatggctatagaatccactcccctgtgagcagtacttaatagaccttcagtccatcactgtcagaggtgatagtggcagtgagggaacatctctcacaggcctagaggtgttgcatagggtctcttaaggaaagcctttctcactttttcacaaggataaagtgcttaattttgttttcagttcagtatcaaagggaaacttttatggtagcccctaggctaaacctcaagagtccatttcttccatttaagtcttttcttcatagttcttaacaatttgtactactgttttagcttcctctgtagttggcacactaaaattagatgtcttttttgtttcattgtcttcaacattctttccacagaacccacctggctttcaaccaacttgggtattttgacctgtatagaatgttctggcatccatagggaaatgggggttcatatttctcgcattcagtctttggaactagacaaattaggaacttctgaactcttggtaagtagtgacctgtacttgggaagaatgatattattgtcatgagtaattttaatatattgttttggattttttttgtatgtctgctgagtacaaagaattataattcctgaattttgtgagtttgcgtagacgtttaaaatgtaacttttgtggtatgtaatgctgactttctatttcctgtttgaagaaaggatgaatcatacatgtctataagtagctcagtgaaattggctcttttcttttgggatggtcttcttcaaaactacatttttctttatgaattagttttcatataactcgtggaaatagcagttaaactcaaatgttcacattacctcatggcttctgttgtaaataatgactaaagagtttatctcaattt

SEQ ID NO: 46648 - DNA, 1026 bp, Homo sapiens
gtcaacaattttcctgagatagacttctttgtcactaaagtatagtggtgcaggaaagaaagaaaacaagcatttgtctctttgatgtactgggacttatgctgttataagttagagaaaacaaaatgactccacacaaaaaagttcatttattagttttgataatggagaaggctggacattttctgtggtcttctatttggaactctggaggcagtgaagtttgtaatgatttagatcacagacttagaaatcattaccagttttgtgacattgagccaaaatacttaattttgatgatccttacttgtaaaataatataaaaattacctacttctcagggtttttgtgaggacgagataaggtagtgtgttgaagcagttgtcacagtgtttagcatagggaagtcacacaataaatagtttctactaagttctctttaagaatcaaatttcatttggtcaaagtgataaatgtacgtaaactaaaacatcagatagtgcttttactagttaagacttactctgtcagcatgtaatggaaaccccaaataacagtggcttcaacattgttaaagtttatcatagaacagagcattctaggatggaccaggtaccctttgtagcacttctcacttatctgtattgtcctccacaatctaaactcagtgattttatgtcatacctaatggtacagggttctttacaaatcatgacagggaaaatattaagtaggcaacaaatgtgcttctaatggaaacacagtggccttctgcctgcccctcttgatcctgttagtccctcccctttttccaactcttttacctgcttcctgacttatctacacgttcctcagtattttcttgctctttctagctttagctgtgatgtattgctgtggtagacgaggattacattcccttgcatagacaccccatcactttcgcacccttgttcatccattgtggttaatagaacaatttttattaaactagtttcagtgtttacatttttataggtataagca

SEQ ID NO: 46649 - DNA, 1032 bp, Homo sapiens
gtttgctacgctgcaggttcctttcaactgtgtgtatatgtgccatacacacagctcagtggccattcaggccaacattcatcatctgcgtttgctcacctaatacatttgtttgtctccatacaaaaccatctgagatttattgaatgtttttgatgaacctggcagtttggtgggtgtgttatgtagattatttcattgaagacattacaacaatcctgtggttactgtacctttaatccagatgaggaaactgaggcaaattgagatatataacttgttcatttaccctattagtatgtgttacagacttgaacccaaacattctgtctctgaacccgttgcctttgctcttctacaatatcctgcctctgtcacctcatgctctggttgtgctgtttccctcagcagaagtactgatcaagctactcccatatacatacctcaagctacagccctttttccacacccactcccctttaaggagtagaagtctaagaaaaatctaaaggaaattgctggaaaacctaattcatttagtaaaggaaaacaaattttgcctttgaaagtggtggtggcattcctggtgagggagccaagtagaagaatcagtttctactgtagtttggttactaagaaaacattattctgattgaataaaaggcagtcccaggagtttacacaacttgacaacagccagcaactttctgcttccctttttatgcttttcctggaaagggaagagcaaactagacagattgatagggccacaccttggattagagggctcccagaaagccaactcaccccgagggggtcagggttctggatcttcgtgcagcacctgcagcccccagctgagcagcactcaacaccctcctggggctcaggagtacccccgtgggaacccatacttctcagaagattcccaaaaatcctgttctcttaggctagtgaaggccagaaacgttaagcaaactgatacagtagaaattaaagagaaggtgctttggtactttatagactttgtaa

SEQ ID NO: 46650 - DNA, 1048 bp, Homo sapiens
tgttagaattatcttgcaggccaggcgtggtggcttacacctgtaaatcctagcactttgggtggccaatgtgggaggaacacatgagcccaggagttggagacgagcctgggcaacatggcaagaccccatctctacaaaaaattaaaaattagccggtcatgatggcatgtgcctgtagtcccagctacttcagaggctgagttgggaggattacttgagcccagtaggttgaggctgcagtgagccatgttcatgccactgcactccacgcaggtctacaatagcaagaccttgtctcaacatcagcaacaaaacaattatcttgccttctgcaacaatgtcgtggatgccagaagtttcttaggaatattgggaaagaatgtgtcttcttaacggatggatcacatttctctgttcttttcttttatccagtcttcttttctcacctacttaccctaactcccactgtactatgtgcccaaaagtcttctagcactcgcatgtagtaaagatcttaaaacagagctgcatcctgctctctgaaacctcttgaagtgagtgggccattttctgccttatcagtccgtctccttcagaaacactcattcctgtggcagtgtcccaccaccgcagccttctttccctcctcttccctatacctctgaactgacattcccctcagatggcttactgtactctgcagtgtgttcctcccttctgccgttgcccttgctatttcctccaccagaatcatggttctttgctgtctcactctctgtgcctgttgaaagtctgctgggtaaacccttaattttgtacacaagtgtgtgtgtgttaggggacatgtgtgtgatctttctagtattgactttactaactttataatacagtatgttaaaaaaaaaaaagacatgtgagacctgtgtttttattctgtttgatattacagacatcgctctgtattgtaagtagtcatggatatatagcggtaacagtagctgacattttggggcacatgccacatgccagacactattttaagcac

SEQ ID NO: 46651 - DNA, 1032 bp, Homo sapiens
ctcactgttgcccaggctggagtgcagtggcacaatctcggctcactgcaacctccatcccccgagttcaagctattgtcctgcctcagcctcccaagtagctgggattacaggctcctgccaccgtgcccggctagtttttgtatttttagtagagacagggtttcatgatcttggccaggctggtcttgaactcctgacctcgtgatccacccactttggcctcctaaagtgctgggattacaggtgtgagccaccgcgcccagccggtactcccttttttaatagcactggaaacatgaagacaatgtataaaatacattttttccctcatatgctggttgttagcaagtgaaaaaagtattcatagtttgtattctccatatatttatatattgtctagcagttaagttttatacctgtttaccatattccttttgttcattctgtttattatatatatatgatatgtaggaattgtgaagtagcttggggagaggttcaactgtcagtagtcatagaactaagaacaaaaactaacatagggagggagggagatcccttgactataatcctaactccttcagaatctctccgccccaggtcccttgcccccctccacacaggcttccatgtaggcactcacactatttgcatgaactctcaagattgtattgtgtatcagagttcttactctctgttgactatatgattgcctcagggtacttccacctgaggagttatcagcctctaatttagatgggccagagtgtgtgttaggtatctcttgtatgaggtcttcctggtcatctttactcacaatcaaagatgccctgggtttccctaagcctaccccaagccacttgctcactcatcaccccattcccgtattttccgagcctcccaccaccctacatctcccttctagtccttttcaaacctaccccctggaagtagagttggaatttattgggtggttaagtcatcacattaggtgcaagtagcatataggcagaaatgcccttgaaagtt

SEQ ID NO: 46652 - DNA, 1045 bp, Homo sapiens
acagtgtgatctggggtaaatcatttatcctttataaaatggagactaatgtagcttttgtcacagtagcagaatgtatatggaatcactttgtgaacttagaggaaatggaagagattgttacagctggagcggcccagtgccccccagccttcttttttaaacaaatgaggaacgaagctctaggagtttgctgtgcccaggaacatcataatttattagcagcaatgccagacctagaggtcaggcccgcagggttctttttgtgacatcttttgtcagggcaaagcatccattcatggaactgggctgaatctttctcatactcttcccttaaagaggcttgcctttttgaaacttggttctttccttgatcactctgtcatagaatctgttcttggagccgctgatgaagtccggtcattatcagtacctttacttctgcaaaaaaatgtgactggtattatcttctacttggttgtaacggtttacgttctcctccagttctgttgttctccgtgaggaatgtagttttttacatgccttttccattggagagttacaacaaaaaagcaaaataaatctatcttttctctgatatggcctccttatttgttttaaaagcatttttatgtttatttggataatatttagaaaatataatagatttaaacataattttaaaagcatcaaaatgcttacgtttctctaattgtgcaagaatctttatatacatagtttttttttttaactgaagttgcatcctgccagtaaaatttgaacgaattgctttataagttgataaggcccctttaaaacccttttcacttcttagctcctgtgtgtacctctgtttagaaggtgttttctccttcctaggctagccaggaggagagcttttgtgtgcaggcgctgggacgcctcaggggactggtaattgagagaggggtattgacctgggtcatccatctgaaagtacgtaagtgctgctgcccaaagccattattactgccttccaggaatctttgataagtgaattagtggc

SEQ ID NO: 46653 - DNA, 1051 bp, Homo sapiens
ggaaggaatgtgaggaggcggagtagcacagttatatgacatctaatccaaagtagaatatgcgagccttaagagaagtgcagagggctgtgaggagtatgaagtggctggcaaatagattcagtattatatttcatttattcattctgcagatatttatggaccacccttttatgttgctattgctgtgctagtattggagatacaaagatgaatatgacacctctcgggccgttgccaactgtcgagtaccaggaagagcgcttagataaatgaccatgtacaatggggtacgtgcaattataggtccactgttatttgctgttctgaattccaaatgttaagagttttgacatgaaattttgtttcatgaggcttttagaagctaaactagaaacgtactggatatttaaaaactgtgttaccagaatctgataatggagttctacactagtccctgtggggtatgttgtataataaacaataagtatactgtaatttctttctgaaatctacaaaagtatgaattctaaaacagccagccccagctaaaggattgtggatacaagtaagatacttcaggtgatttgagagtttacctggctgtatgggctaccctgggaatataaccactctttataacatcctttcttcgagaatggtatgtgctaagttataaacagctgacttagggccatcattttaaagtatgaagccttccagtcttcgcctccccagtcttttccattcttaaagtttggaccagtctgcaaggtagctgcctccctaaggatttggggtattctctaaaatttgaatatatgatattcttgtgccctttgaatacgctgtttaaaaataaattttaaagaatattctcatgtaaaagtaacacacatactttggaaaatacaaaacataggaagaaggaaaaaatggccacattcttactgtgaacacactgatgctttttctgtgcatgtttttgtttaatagtgttagtctgacgccttcttattcattataacatacccattttcccatgttattt

SEQ ID NO: 46654 - DNA, 1035 bp, Homo sapiens
atgaaatcttttcagggatgatcctctgagccttctgtctagttactatcactgctgttgcttttatgacttaattgcctttgtggtttaattcacttcatgacacatctatcaccatgaagtttagactcttcacccctatctttccgagtatttgcttgatgactcctggggtcaaggagaggttgataggtggttttatgctgttaaaaataagtggtcttggctaacttatcacttagttaaaacagtccttttaattttaattaatgcattgaagctacttcttcctcataattttctacttcataattctgttgtctgagcccataacaatggttatttctattatttgtagagaattataaagctctttcatatttgttctaccatttaatccctctatctttatctcctcccctcccctcacccccctcccccccccaaaaaaaactgtattagccccattttgtagatgaggaagctgagacaaagaaatcataggcaagtatgccaggtcggtatggttaatgtatggtagaactgggaatttctactatagaaactggacgattgggatattacgatttagaaaagagcctctgtttttttattgtctgctattactgaaattaccatagtgttaacatcataaaaatatgtctaaagactcatgctgagttctggattttgacagattttcaactaaacctaggaaatttgcttggtcagtctttgatttttgtggacatggttgggagttcacctggcagtacagcttgtgattaaaagtccagttttagaggaaccaaaatctgttcttcctttagagccaatctctgtttgcattgagttttctcattttcccctagccatgaatgaaatatcaggaaattccaaatgcatctcaatatcagaactgtcttctttgtgctaccctctgcatagcactcctcggtggctgccctttgcttctgtggtgagagccgcatgtggtggtgcagcccacaaggccgtcctggtcacgcctctgtc

SEQ ID NO: 46655 - DNA, 1946 bp, Homo sapiens
ccagcctcagcctcccaagtagctgggattacaggcatgtgccagcatgcctggctaatttttttatatttttagtagagacagggtttcaccatgttggtcaggctggtcccgaactcctgacctcaggtgatccatccacctcggcctcccaaagtgctgggatgacaggcgtgagccaccgcgcccagccagccatgcctttttactatagaaataaagatgaaaaatctcaagtaatcccatcaactaaagatgattagagttaaaacatgttggtttataattctttataaaatagccttttaaatccaactgatttggactagggttgggggtgcttaggaaataaggagtagataataaggtagtatggagtagatatataattgtaattcccccttgagttttgagagctacttacccaaaatagagcatgacacggtttcgcctccaaacagaatttccatatgaaagattgaaccgctttgtgcttgaatcactgtgaatgttgctgctgctagttctttctgtaatgtgaatagaatttccttagataagttgtcagtgtattattttccctttaaaaaaaaaaacttcttttttagctgttatagatttcttagatttttatatagaaatattttctaaaattttttttacaaaaataaaatgaaaattgtgcctgttgtgctgcatgtgctttcaagttagaatcagtcattgacatattaatggcttcttccaggttggaaaattaataaagattatccttttacttgaagaaagtgataagagaagtagaaagaaaatcaggctgagattaactaaggaagcagcctttttattctactttcagccattcagaagagggaaaaaatccagagtttctaataagaaaacgaaaagttgttttgcattctggaatatttccaaaagcattgctattgatgttgaattccactttggggttggagattaggaaatttttggaagtgttgaagtaaaattagatgttctttgtattattttttatttgacagtgtacaaataatgaaactgtaaactaaagtacaatgacataatcacagaaatgatcataaaaatggttatttaacttgaagtgggattgaatattcaaaaagtgcaggtggtgtggatgggcttctgggtgaaattaggttttctctttcagcaggaaaaaagacagagttttcattatactccctgccattggtgatatggtgtagacctgtaatgataacaagcactcaacatcttcattgaaaagcaccagaaagatgcagagcagaagctgtaaacttcacaagtgccatcaaatcagactgtttcttcaaagttgaatggaaaatttcagatgttggtcatgaaatgtttactctgtgacccaaaaccaagttaacaggcctccaagagaggtgcttgctcttggatttgaaatagtagccatagtgataacttctcttctctgtgtaagccctgtaattttgtgtattccatcattctctctggatttagtggttctgagaaagcaaacctagaccttgggccgagacttcacacagaaatatttggggatctgctctatggttctctgggtttgggcctcagtttccccatttttcagcttttgtggattctgatcattctccccacttgatgtgcattgtgtgtttgcatgtgtgtgtgtatgtgtttctagatatgtctgtgaattttggggtgtattttttaaatgctttgcttgtatttttaatgttgctaataaaatactagctacatgattttgagggcttggcacctcttgactaggtaacagtactgtgctaaactctttacatgtttatctaatacttttctcatgataacctgatgtgggtggacgtcctatttttttacaaatgagaaaaggctctaaaattaag

SEQ ID NO: 46656 - DNA, 1089 bp, Homo sapiens
tatacctttttctgaactgtaatatttgtattgtactattgcatgggtctgttgtgagggtgaggtgaacgaatgcatgtaaagcatcacaggctccttaggtcgtcttatcccccagtgcccaaatatgtgatctagggcaagccacttcaccactctgagcctgttcttcctctgtaaaatgagtgtaatatgtatttcaacgattgttgtgaagcaaaaatgaagtaatggattaggcatcttacactccacattggtatgtagtaaatgcacaatagaaatagttgctataattgccatccccatggggaactggctgtcactattttatatgtaggttcgattttaggatcaagggagtttgctaccaagtctggccattgcctcttctctgttctgacttaagagaatgttttggtggatgggtgagatttcaagttgagaggagaggaaagtaaaagacttataaaaatggaaagaaatgcatgaaaacagatgtattacagaaggtctttgagaagttgtggatgaggtttggctagcctttagtacttcaattttcatgggaaggagagaaacctcttccttcacccccatctatacataaccaacttttatttcctgataggattatgtaacaatttttttctgttaattatcatggacatgttaggatttgattatttggagaggactagcatgcttaattagcgttcagaatttacagtttataacagggctctctttgcagtgtactcatttttgttacactggagacttctaaaaaagcaaaaagttgccttgattatcaatgaggaatcaaatgcaggtggttggtggtacaggaaatcaacccaattactgattaatatgagtgatagagtgattttcctatgatcttatttgaagcatgcaccactcaattggagttaagatgatagttacaagtaagcagatcctaaatcaaacttaaatgtaatttaacatggaaaacatgaacatcttttaaaatatttttgaattaatctcacccttttaccaacctgtggcattattttcttgctgttgatgcccaagcctttcctt

SEQ ID NO: 46657 - DNA, 1028 bp, Homo sapiens
gcattattagattctccttcctccccacctcccccataccttttatagtctgttttgcgctagtagctcagtcctccaagtggttttttactttgggcagtttttctttgttgttttttgtttgtttgtttgtttgtttttttaagagacgcaatctcaccctgctgcccaggctggaatgcagtgacataatcatgcttacttactgcaggttctatctcctgggctcaagtgatctcgcttcagcctcccaaaatgttgggattacaggcatgagcaactgtgcccagccagtttgcttgctgttaacttaaatttttgcacatgcaatagcagagcgacatgtaactatcattcagtttcaacaattgtctgcttttggccaatctttttttcatttctgcctccttcccctgattttttgaagcaatatcaggtatttcatttcatccgtaaatacttcagtatgtacttctaaaagataaggacttgaaaaaaataaacctgaaccataatatgttttctcgtctgaaaaaaacacttcctcggtgtcattaaatattcagtcgctgttcaaatttccctggttgtctctttaaaaaaaaatggtttatttaaacggatctgtatgagatctgtatgttgaaattcatggacatatttcaaatttcttttaatctgtggattcctccctctttttttcattgtaattcatttgccaaagaaagtggtggtttatcccgtagtttcccatagtatggatagtgttgactgcaaccctgcactgtcatttaacgtaagctacagtctactcttaacagacttttgttattaataatttcctcttactaaagaataagaagaacctattccctttgtagaaaatgaggacaagtataaaagaagaaaatttaaaagtcatccataagcccactaaccagaggtagccgctactgtcacttcaagtattttgctcagatacatctctgtcctgcttattttcatttaacacatcatgaacatttcca

SEQ ID NO: 46658 - DNA, 1030 bp, Homo sapiens
caccaccttaattatatctgcaaagaccctatttccaaataagtccacattcatggatgagggggtggctaagatctccactttttgcaagaggacgtgtcaaacgtatgtaatattagaaagcgcccacagtacctggtgcatggtgggccttgttgttgccttccctttctttccactttatctcagcatctaaagggtgagcaccttgagggcaggaactctgtgttactctgagtgagtgcttccagatttcttgccagggaagtgagacggatgtttttcttgtgctgcggcagggacattcttgtgtggtccctggttgatgggaaatgctctttcttgctactgtccttagtttttgcttcttatgctgatggttgatgagggagtcatggggaaagaataccttgattggaaagctgggcctggtgggtaaagtggttaaaccaggctcctctcctggttctgctgtttgctggtcatgtgagcctggatacatttcctcctctctgtgcctccaggcatctcatctgtaccccttaggagtttgtttgtttgttttgagacagagttatcagggaacctgcccctgatagtcacgtaggttcttttctgttttccctaagcgttggccgggttgagaaataaagagacagagtacaaaagagagaaattttaaagctgggtgtcctggggagacatcacatgtaggtaggttccgtgatgccccacaagccgcaaaaccagcaagtttttattagggattttcaaaaggggagggagtgtacgaatagggtgtgggtcacagagatcgcatactttacaaggtaatagaatatcacaaggcaaatggaggcagggtgagatcacaggaccacaggaccgggacgacattaaaattgctaataaagttttgggcaccattgtcattgataacatgtttgagagcaaccggtctgaccaaaatttattaggcgggaatttcctgtcctaataagcctgggagcgctatgggagtctggggctt

SEQ ID NO: 46659 - DNA, 1091 bp, Homo sapiens
tcagttacggggagccaaccattttttgcttagtgctttaatcatgttctcttattaattcttgctatgactgcatgaggtaggtactttccttatggttactagctgtgctgtaagagttcagaaatggacagattgttgcgctgggaaaattggagaaagcttcctagaagaggtggaatttcagctcggactggacaagttgggcttcagatagcttaagaggaatagcatcataaaaataagtttggtctattttcttttaagtccctaattttctaagtacagcttccacagaacaggaaatccaattttaaagatgagagaactagggcaggcacagtggctcattcctgtaaccccagcactttgagaggccaaggcaggtggatcacctgaggtcaggagttcgagatcatcctggtcaacatgatgaaaccccatcactactaaaaatacaaaaaattagctgggcatggtggcacatgcctgtaatcccagctacttgggaggctgaggcaggagaatcgcttgaacctgggtgacggaggttgcagtgagcagagatcgcgccactgcactccagcactccagcctgggtgacacagcgagactctgtctcaaaaaaaaaaaaaaaagaactaaagtatgaaaggataaataactcatcaaagattcataatctggattctaacccagatgtgtttgttctaggggccaacttttaataagtcatactgttagagtacaggatctggcaaggaagctgtcatcatcattatcatcatcatcatccagtgcccagtactggatgtgggtgacccatgtttatggaatttaagaataatgaatgaatgaatgaatattagtcctttaagatcatgaactttcttttcttttgttctttgctctgtctttaggcagcaggagcagtccctggcacagggtagttccctgcttctaagaaaattatggtaattgaaatgtattctttgttttacccttaacaacaacaacaacaaaaaaccaacagaaagaaaagagtcccagaaatgaaatcgccttagtataggaacagtatttatcttcag

SEQ ID NO: 46660 - DNA, 1062 bp, Homo sapiens
tgaaaacctgaaacctgcctttccaggtgaagtggctccgagggtcaccgggcgtaatttgctacctaaggaaagtccagtggttcttgattaccatcccctgccctccatgctgctcaggtttcctgctcgtcctttgggctggcctggagaagaaagaaacaatacgtcttcttttcttcatgtccctacaatgtgccaggaactctccaagagacttggcctatattatctcatctaactttcccagcaaccccgagaaatgggcctggtaatgcccgtgcctgcaaggtggaagccgtggctggcagaggtgaaataccttcctgggaataccttcacagctaggaatggcagtgccaggactcgaagccaaccctcctgggccaaagcctatgctcttccctaccatcgccatgggcgtgggttgtggggaagatgcatcacaagactgtgccttcctgttctttctctttctccaggcagacccagaaggcactgcaggacttcagagagcaaagagggaagtcaaggaaccttatcctgtggtttcctctactgatgagtggtggagttgagaatgtccatctttccccaacagcatggtagcacactcatttctcttccctactgtcacctggcatctgattcaaacaccaaattacttggactccagagtctagaacacgtttcttatgtggaattcttggatttctgtctttccttcctgctgcctataatcttctgaggctcccaaatgtctctgggtcaaggactaacttgtaggcctgggttttgaggtccctctgcagtttgccaagtttctttatttttatttttatttattatttatttatttatttatatatttattttttagtagagacagggtttcaccgtgttcgccaggatggtctccatctcctgaccttgtgatccacccacctcggcctcccaaagtgttgggattgtaggcgtgagccaccacacccagcccagctttttttttcttttttttgggacaaagtctcactcttgtcccccaagctggagtgcaatggc

SEQ ID NO: 46661 - DNA, 1035 bp, Homo sapiens
tgcttgccagcctcgtgaccttcattcatgcagggccttgttttcttgattcagtggggccaatcccggcccccaggggagatggatgctgcagggatgtgcaagctgtagagggttccagagaatgggcctggcgttctgcaagcctggcacccctcctggatgcttttctccagcccttggagcttaggcagtgtagtgttaggatgattattggatttcctccacagttcctggctcattcttttgtagcccttgttacagccttttgtgataatattgggtgtggcaggcctcaggacacaggatgtctccaactttctcctgccttccttcccctgccctaacacaggactctaatctttccctgactttctgactgtgggtcttgagatcctccccagagagggtcctaccctgtaccctgggagaaggaatgctgatgtcaggaagcttccataaaaccccagaagactgggttggaagagcttccagatagctgagcactggaggttcctggagggtagcatgccccttcccccatacctccccccacgcatctctctatctgtatcctttgcaccagtaaatatgttttcctgagttctgtgagcccttccagcaaattaattgagcccagaaagggggtcatgggaacccaatttgaagccagttggtcagaagttgcagagacccggacttgaggcttgtgtttggggtaggagttgggggcagtctggggcactgatctctcaacctgtgggaactgaccctgtctccaggtagatggtgtcagaattaaattggaggacacccagctggtgcatggtgtgtgggcacagaagtcttctgtgttgaccgttcgggtgtgagagcagaggataggcagggtttcagagattttaggaaataggtgggaataacactttctgagacttggtttccccatctgtaaaaaaggaagtagtaatagtacccacttgggagagttctgtgaggactcaaatgacacgaggactcaaaaagctgggtacg

SEQ ID NO: 46662 - DNA, 1030 bp, Homo sapiens
tctgttacctgcctagcacctcacctgacccagagcaggtgctcacctgagtaagacatcgttttttagggagccaggagctgtggtctctttccccatctctgccatggactctctgagtgaccttgcattgtttgggcctcagtttccctggcatacagtcaggggtttggggttggaggatctccgaggtcccacccagctctcatgcattgtgggttggtgttagccctggagaaggaaggtgtcaactcagtatggaggagtctgggattggggtgatggatatggaatgaagctacattctccagcttgctggctccgcagcctcagacaatgctcagtctcattgagcttcagttagctcgtttataaatggggatgtttgcaccatctgtagagttgatacagtattctacaccttgtcatctagtatacttagcacacagcatgtactcagtatttgatagctgatactactctgtttgctcaaagacagtgttttggtttttcgatcctttgaggattcttgatagagtcatggccttctgcaaccatgtagggtttagcaaatgtttttggtagagccaggtagatattttgttttgttggccatatggtctccaccgcagctattcagctgcaccattgtaacatgaaagcagccatagatagtatgcaaatgaataagtatggttgcgttttaataaagctttatttataaaaataggtggtgagccaggtttggcccacaggccatagtttactgacccctgtcctacatgctctgatctccagggccagactcacagaaatttccagggtatttgtgttatattttgatttccaccaaccaagcacttttacactcataatcaaatttaatttttacaaatggcatgccattttaaagaagaataaactgaggtcactggttgaagagtagagacctttctgctatgatggatgggagatgggaggggatggggttaaccaagatcttattctgcccctggttctgcatgtgacc

SEQ ID NO: 46663 - DNA, 1050 bp, Homo sapiens
gtcaccatgatgatattgactcacctgcattcagcacttctgaggtgacgaggaccttccccactggcaagtttattttatgctcagaacagccttgtgggaggtgaattttcatggttccccctcttgtagttgaagacattgagtgtcagagggaggctcggagggatctgctggtacgccttcaatatccaggaagtgaagaagctaaaacatggacttcatcctttcactcctagtcttgtgcttttctcactacatgttctcagttacttgttgggggcagaaagggagaaattggagaaactaaggatgttgaaaggtgttgcttgtatagctgctttttaaaaccacccgtactgactgtgagtttcttaggtaggactcatatgtcacctagtgggattgtggcagtgtctgaatcaagaagcgtctttagcgttatgcatatttgtgtacgtatttaaaattaagagctttatttcacatttcacagcatataggtgtacttctttgggggactagtgcaattattgtgctagagaatagagagctaaggcaaatttcactttagaggtgagaaaattagacccagtgaggttaattattttcctggcttttgcagcattgctactagacttttcaatcattccttggtttacactgtgaagcattttccttccctaaacagacctagctgaaacagcctttttgccctgaaatccttactggtttttattgttgttgttttgttttgtttttaagattgtggactatctggtttatgtgcagaagaaatggatttgggggtggtttcagttaaggaatcactcacatatgtattattaacttctgccattacatagttggtgtccggtgctgggcctcaggacctgctgcactgagctggacctggggtcatggctggtttcccttggactccctgtggattttagcttcctccctattgagtggtactatagatgggaatgagattcagacctgagtgagaaacagtaaatccagccttagtttctctcatcccacaac

SEQ ID NO: 46664 - DNA, 1052 bp, Homo sapiens
gcttccaaagttacttgggttgatcgtctcctatttcagtgcaattatggttattcatttaaagtatggttttgttcatttgtttgtttgtattttgttttaagatttcctcccatacttgtttattgtatttactttcatcctttgactaggtgaattttggaggtgagcgtatttcagtgaaaggactgagtttcgcttctttttgtttgtggggcatgaacagagaatggcagaggcctgagggtgtaagtttccaggaaggagtagaagtcctgggcggccatggccctgaagggacttgccccattgaggtagggctggggcgcacctgctgacacctggattctgaaacccttcagcgagagtctttcttccagtgctttgtcttggttctggtttctcttccttcaaatcaccattctgatttgcatttattcccattttatagatgaagagtcagagagtcagagaagttgtgttttctcctctgctggggattggactgggggctttcccaccctgagcctgatctttcttccttggcacaccatcttccttttctagaaaatgagcgttaagaatgacttagttcaggccgggcacggtggcttacgtctgtaatctcagcactttgggaggctgaggtgggagttcgagaccagcctgaccaacatggagaaaccctgtctctactaaaatacaaaattagccaggtgtggtggtgcatgcctgtaatcccagctacttgggaggctgaggcaggagaattgcttgaacccaggagggttcagttagttcagattattctcagggtttcttaagtgaacactctggaaatgttctggtcttcatgataaaggaaatgcaggtaaatatcttttatagctttaacatggatcttttaaagcactttactatattttgaattaaatgatattgatgattttggagcttacaatctattgagggagacaggttaaaccaataagcacagcattaaatacatgattacaaatcgtggtcatattacaaggcaaataagcaggagg

SEQ ID NO: 46665 - DNA, 1060 bp, Homo sapiens
gctggaatttttccccttagtatttacagcagttagcacctgtcttgtaactttgagcagatgtttatttaaaattctcgtatgttctcattgtaatcccatccccctccttccttcaccaattagactgctttttgaaaagtatccctggaacctagcccaatgctgcacacataaaacatctcaataaatgtttgttaatgaatagttactgaataaatcaatgaatggatactttcattcacacctttattcctcccagcatttagtactgctttgcacattgtgggtacttgagaaatctgcacactcacacccccactcacccgccactcctgcaacttctccaatatatgggagaggactgacaattttatctagtcttctgggtgattcctgagtgattctccaacagagaacagatagaaatgaggtaagtgtggtcctctctcattctaatcccttgtaatctgggcctgccaatagaattgttgtgtttaccaaatcaatggtctggttctgactttcttccctatggatgttctttagcattttgcattgcttataatccatgggaagatgtttgtttgtttgttttttgtttgtttttttttttttttctttttgagacggagtctccctctgttgcccaggctggagtgcagtggcatgatctcggttcactgcaagctccgcctcctgggttcatgccattcttctgcctcagcctcccgggtagctgggactgcaggtgcccgtcactgcgcccagctaattttttgtatttttagtagagacggggtttcaccgtggtctcaatctcctgaccttgtgatccgcccgccttggcctcccaaagtgctgggattacaggcatgagccaccgcacccggcctctgtttgttttttttttttttttttttgagacggagtcctgctctgttgcccagtctggagtgcagtggcatgatcttggctcactgcaacctccatctcccaggttcaagcaattctcctacctcagtctcccgagtagctggaattacaggtgcctgccatc

SEQ ID NO: 46666 - DNA, 1026 bp, Homo sapiens
tgctttaaaatttagtaagatggatgcataatttatgcagtgaaatttgaaaggtttttcaaaatgataaggccaaacctaagctaaatgagggggtaggcattctttataataaagctgttatactctgcccagctaggccagttatccctagatgctacagattaatggggcaatctgtgttatgtaacatttgttctatattattctgcctctaatgaggtgaatcaaagacgatgtcagttttaattctggatgcccttgcttcagtatagtataatacataggtacagccttttttagtagttttcagatggcttctttatgtttttatattgaagaaccactaacttcccattggcctataaggttagcaattgattatttatagcaaatggcttgaaatgttagatcatcagtatttgtcaataagcctgtaataacttgtttccctagcccttaacttagtgttgaagaaaaaaattgtggtattcattgataggacttagaaagcacagaaattacttattatttaagatttgttctaccaattgatatttaaagtaaaacatttttagttactgaacaccattctgtaaatgacagtattttatcctgagtatatggtctgaaatgacttagggacaactttttaaagcaaataactaattacaaaattgggtcttccaatttatttcaaattagatgcttttgtacaaatattcttggttagaaatagtcatataaatacactgttggacttgttctcattgatctccacacctcagttccttctacatgagtcatgggcttgaggttacccagaaatggactgtgaacctataaaccccagcatgcatgtggtattgcgtcgagcatgttctgtgattcccttctactcttgttacagctttattcattggatcaatgtgcattatttgctgtgtgtgctcaggtaatatttttgtttcttttttttagtttgaatatcagtttgggcttagttactttttaaaataaggctgt

SEQ ID NO: 46667 - DNA, 1001 bp, Homo sapiens
aaaacccactctattcattgtcaactaaattaacgcttttttaaataaaaggagtcatttttaacaataacgtcagggcagcaggcatccatgaaatgtatggtcactgatcattagggttatcattctaatgtgtttactattttgaaactctagggagaagaaaacttatttttgcatatgttggaaaaatgtatcctcatgtaggatatcagggtaatatctttaatgtttcatacttaccaagataaatttgtaatgcgtattttcttttaaaattagatttatttaggagaaattgcacttggtgaaccactttctctttaattattagcattaactttatcatttttgtttcaagatgtcacagctattgttcagcactagaaattatataaattattagctgaagatgatgactggcaacatttatgtctgttcctcctcttaaatttcttgttcagaaagtctgttgttgtaaacatccccgactggaagctgtaagacacagctaagctttcagtcagatgtttgctgctaccggctattcacagacatcctcttgatataattctgtcccggagtggagttgaggaggctataaaatgtgtgggaaaacctcagaaatctttagctgcattcttttactgcactgacagtgcacgtattatgatagttgaatgtagggtgctctcctaataacaggatatgccgtctcgagcttcccagacttagcgtgctgctgctgggccttagagaatttagttaaataaaaagtgtcaccgcctattcctgtttctgccctgtcaatgaaattttagtctttataacctttccaagtaggctggagtttaacatcccaacaattcaggagactgattttctccattgtaaattctgtggaagttctggagaataatttcatcactaccacccagcagtatgcaatctagaaatttcagctttccctatacttaaaagagatgtgtgtgcaacatttt

SEQ ID NO: 46668 - DNA, 1029 bp, Homo sapiens
tatatccagatgcacaccttatattccaaattttgttgcctgggattgactgagtacccttttgagttccctgcatcagagacgtgtttacagttgtgcttcccagtcttcagcatttatggtttcatgtttgtcaaatttgtttgaagtataaaaacgataatcttaattctgttactgatcattccttcattctctagctatttgtcacatcatctttcttttgaaacgtttagggaattaagaaattaataattttatactcattctttttccactcacatatctcactggctttgttcagaattaaattgtttttggtccctgtgtactatttccttctattaattaactgacggttgtttctctcttctgtgtttttgatgcttttttttttcttttactgtttaaaactttttcagaagatgtagcgagtgactcaggtgctagctagtgttactgatttcccccccatgttagttaataccatgtcaaatataactgaagaactctgttgtactcacagattatgcccctcatggtcagcagactattcagatacagactttcagggggaaggttttcaaaaaagtgtggctgcaatctgtaaatgcttttaacatctgcacattgcattactgttttcaaatgtttttgtaccacataattttatttaatattcacaactattctgtgagagctttattcttttatgttgtagggttttcttattttacagattgggaaactggtgtggagcggttaaatgacttactcaagattacatagctagttataagtggaaggacaaggatttgaaggaacaggtgtggcctcttccaggaaacagtataaatagtcagactttatgaaggataaattggtaggagagtcatttatctcacttgtctgtaaagaggattctttttctcaagtagagcgtgaagtagattatttactagaaaagcttgaaaatgcatttcagaaaattaaaactgctttgaaattaggtgcataataagaattgct

SEQ ID NO: 46669 - DNA, 1034 bp, Homo sapiens
cctcaacagaggaccctcactttgaaattgagtccttgtggcatgtagccgggataccaaaagttttcagtaccagatgcagagagagatcagtccgtttgggatcttgttaattctttctgtgcagctacttttgtgctgtgaggtctcttttacatcttgctcctattggccatagctgacatatgtctgtatacagtcctgtagtggggtacttaattgttacaacctgaaaagattatttcttgtaatatataaataaatttttatgtttttctctcttctctctttttcaagggaactgtagaattggacaaatcaacacttagcatgtccccctcctgtaggtcttgttgaccttggtggcatcgtggaggtcatatgttcatggagataaacagttcttgaacggtttactccaggtggtaaaaacacatgggaaagtgatttgggctgtgcgtatcttggttttttaaaaaatcatttttatcgagcgtttattgtgatcatggccaaaaataaaataattctttgactttttttgaaatactatacacacatttctatattacatttttaagaattgcttatttttcaatttttctagtatttcttgtatattctaccacaggtgaacaactcattttttgggtgacatttttagagcttgcttgaggggcactagaaagaagggcagtaatgtgatgtgaatgtttcagcttatgaaaacagctgtgctctactttaagaaatttgacatttaaaagtgtaagattgcaaaacaaattaattactagttggttatattatgtgagaattttaaaaaagggattcactaaaagttgttttcaaatacttaatccctttaaatggtatttatctaatgtgatttgatttgtgaataatcagttggcatacaacaatttaggaacagatttttggcatatgtaagggttatcagtgtgttctttgagttctctctttaccaaaagtatttggggacaaagttaaattcagtgttgttccacttatat

SEQ ID NO: 46670 - DNA, 1049 bp, Homo sapiens
tgcttcagggtttgcatgctccgcaaatcccatttattagctaattggcgcttgagaggtttcaggataaagaacagattggaagaaaggaggtaacacagcataactgacgcagaggagttcgtgcggattcctggcaggtcccgtctgcgactgtgcagttgaaacccagaactgtaaaagccacagtgcctcctggctggaacaggaatcccggttgataaccgtaccccaccccccactttcgcatcccagcaccccattataggttacagctcctggcattttcactgcctctgcttcactcacataacagtggacacagccaagggaaggggggcggggcaggagctccagccaccatgcctccttgggggccaggtgtccctctccataggcatgggctccctgggccccagattcctgccacacccacgcaccactcactggtaagccctgatgcctgcggctttgctcctggtgagcaccctggctcaggaggtgtccgggctgggatgctggggtgtgtggcccaatgtgagcaggaggcatgaactatgtcactttcaggaggatgcatctaagcagggaggccaccagccaagtctccccaggaagaggaaggcattgtgtggtctgtccccaccctcattcctctggcacctcacacttgtccctgtggagatacccatcctatcaacggacagctgctggtgggagggaagatacaggagggagggaagataccagagggagggaagatactggagggagggaagatactggagggagggaaggtgccggagggagggaaggtaccggagggagggaagatgccggagggagggaaggtgccagagcgggggaagatgccggagggagggaaggtacaggtaccggatggagggaaggtgccggagggagggaaggtaccggagggagggaaggtaccggagggcgggaagataccagagggagggagataccggagggagggaaggtacaggtaccggacggagggaaggtgctggagggagggaaggtaaaga

SEQ ID NO: 46671 - DNA, 1035 bp, Homo sapiens
ggtgtgaatcctgcagctgctgcttgagaatcagggttcttaactgccagcaacagaaatggactctggtcaacttcagcagaacagcaggtgcctgggaaggctatcaggcagttcaaggagccactcagagtcaggatgggggttcaggaggctcggctactgccggacccagctgaggtcacacctggatgcctcccggttcaggtacacccttggggagctgctctgggacctgaggctacttctgctccactcttaatcctgttgctgctgctacatattgttttcacgggtccttggtgtcactgccgctgagccccgagtggaaacatccaggtggccaagatcatgtgcctgcgttttagtccaccaaggacagtgacagaggggacagggaagctctccccacagccagtaaaccagccgggacccacataccaccactgctgcgcacaggagggaaatcgacccctcccgccgggcccccacccatgggaaggggcggagactgtgtgaccacacaaagaaactggcaaagatctgctgctccctttgattgcaggtgaccatttgatctccgggagccctggctccctcgcttggaacaggagccacagctgccgcgtgggatgatggtaagggttaagccctcggaatttatgtttagtgcctggcatgatacttggcaggtaggaagctctcaattaacgccccgttctcgagctacactttgcagcccttgactgttccactgagagctcggggcttccttctccagcgtgctccgcgcacacccctgcctctgaaggcatcattatgtgattatatggatacattgtgattacaggttagccttaaccaggcttttatacattgagacacttacaggcttgcattttagttcagtctggagtgggctttctggtactttaaagtgtatcatgagccctccttcttcgttctgtgtattttcgtctatacttaatagctgttctctgaggccgcattctctgggtctgtggttgatctttt

SEQ ID NO: 46672 - DNA, 1027 bp, Homo sapiens
gaagatttaagcatttgagtctcaatggaatcaactcacattccccgaatccaggatcactcctgatccataggagattagaatcaattctactggaaccagtgaaaaatgaatgagtgaggggacatgaaagcggcagaagtttccccgctcctcagctgttcctcagcatctgagaggagtggccattgcaagccacctccctgcaggggaggccagggccgccgcagccacagtgtcacagcagagccctctctgaggagaggcgtggcagtaataaggtctgctttgtgtggttcacatctcctgggcctgctctgccaggccgtgggatggactgcacagtccaggggaatttagtacagactctctggtggtgcccagactggccgaacatttcatttactgtgcttttggtggaaaataactaccctctgtggctctcactacagaaataaagtcattgttaatagccagggtttctttggaacacagtctcagaaagtgaagtctgttggctacaacgtagaaaactgccgtgaaagcaggcatccggaagggagaggccatttgtttgtgtcgctgtcccagtgcctggcaccggctggcactttctgtctccggaataggccatgcccactctccctttggatggtccgtttgctcaccctggaacattctttgaacttggaggcagcacccagcagagctggaggcagcggcatttcagctgtgacctgaaggatgagtaggcgcccctaggaaacaagcagtgggaagaaggaatgcgccatgagcatccgctttcggggagcagttactgtgggttccgaacatgactaatgaggagggatcagtctcctctctgctgagtcccttcacagaggccaaaatcattgaccctactgtctactcccctgagaacctttcttgagcccgccatttcttccccactgtccgcatccccgcagagacggcctgtcagcccctcactacctggtggcctgtctgtcccctcccacagcat

SEQ ID NO: 46673 - DNA, 1069 bp, Homo sapiens
ggcacctggaagtcccagagagcagtgagccagtgaccagccccggggccgagtctcagccctgccgccctcctgctggctctgggaattcacttttctgagcctcagtttatctgtgcataaaacgaggccagtggtctctgccttgtttacctcacatgactgtttattcagcagatgcccaaatgcctacagcatgccacgtgttcttccacttagccctatgtgtcgagtgcccaccatatgccaggcatggtattgcacataaggtataaaccaacaaacaagacagcccagtccccgcccttcagctgcctctatctggaccaccaggcctggggctgggcagtggctggggcaggccaggttggctggaagcatctggcaaggtatgcccagcctgccacgtactgttccttcacctgcccggacctcagcttcctcatctgtgcgatgaaaatctgcttaagattagaggggtgacatgaaatgaaacccggttgtaggacctggcagtgcagctgctacattagtgactgtaagtgcagaactcggaggacccaccagctgaccaggatgccctcccagaagcacaatggccagcaccctgagcccgtctatgggcaggacagcaaacagcaggacagggcggtggagggacacttctctgtgccacaggcccgccccctccccaccccctgccagcccctcctccatgggagtccagccttctcaggcgggggccatgctgtgatcatggccccgggcacgaaggcgagagcggatgttgattcaatttacaaatgtgatgaatcgcctgccgactgtgtttatttgtcagggctgctgtgaagctggtgtcagtgggggatgtctgtgcgatcgaagccagtatctgctttgacaagagttagaagtagggtttgttttttcccttagaaactcttgctgttcactttgaatgtggagtgcggaggcctggctggaagccttctcctcaggacaaagagctggacagcagtggaaattctagagcaagtttccacaggtgggaagctctgggcctaga

SEQ ID NO: 46674 - DNA, 1097 bp, Homo sapiens
ggctccgcaggagttgcgttttccttgaccaaggctcacccctccctgaagcgcagtggcgaggcgagtgtggaaggactcctgaaccagctcgtcctggagcacctgcagctggcgcctctgcagtggggtgagtacccgccagccacccatcgattctgggtggatgtgctccttttctccaaatgcacgagcaaggtcttggggggtgtggctgggcaccccaaatgttggtgggtactgaaggtcatcacgggaaaccttgggggaaaaagacgggctcaccatactgcgccagcacctctgtgtgaggtcatctttgttcacctaggcgggcagctcagcactccggtgacagtgcagacatgagaagggctcatcgcccgttgaaacaggtgcagcaggcggatcttggcctacatcttgacttgcacttggtgtagagtgggccgtcttccgaaatggcaattgactgtgtctggcggggtgtgtgctctgcaactgtttccagaactgagagtggcttgggatggcaaaagagaacagggtgtggtgaaccccttgcgttcaccccactcaccacgactatgcatggacagcttttcatgctgtctgtgtggaaaattgtttggtttgtaaatgcctcaactcaacgttgtgttcaaccccaagagaacgccattactggacacttagcacagtttatttgactgcttcttcttgttgcacctgggaacttccaccctacactgtgcctttctacattgaactcaaaaatattttgctgagaaacaagcttagcatttcttttgaagtgagaatctttattatctggaaattatttaatcagctcatctattttggatcccctgcagacagtcagttgcaagcatacatatcccctttcttcctcttctttacccaagaggtcattgtgaatgagtagctcctctttgatccaggatccggttcattaataaatttgttctgcccctttcatgggctagagacacatggaaatgattccagtggtgtgaggagaaaacaagcctttctccttgcactccaccagcgcccttcagcctggagaccccctg

SEQ ID NO: 46675 - DNA, 1024 bp, Homo sapiens
tttagtttctcaatattttcttttgtgacttgtctatcttcaagttaacttaccctctccccagttacctccattctactgttctccattcaggaggtgtttttgtttgtttgtttttttctgaggcagagtctcaccctgtcacccaggctggagtgcagtggcgcaatctcagctcactgcaacctccgcctcccaggttcaagctattcaggagttttttttttttttttattttaattcattgtatttttaagttgtaaaatgtccacttgcctctcttttatattttctatttctttgttgtaaattcctatttttaaaacttcattttgaatgtgttttcttttgtcacgggagtctggttatagcggctgctttaaagactgtcttgtggctccagcatttgggtgatcttggggtacccattcgttcttctgaatcgatctcgttcctgttgtcagtttcccattgtgtcttgggcattgtgggtgttattttttgcagactgtgggttctcttgggagcctctggagaatagtgatgatttgtcttgtcaggtcctcagtccagttaggttcagaccttaagttctgcctggccctattgggatgggaggtcacatctcagctcctcaagctcacctccccaggcctctgctgcattgttctgggtctctccagtgtgacttggttaatttttaacaaccagccttggatcatagcatttgctgatttttgtagtgcaaatacttgccttctgggcaatttcaggctatccacgtgacgtcactggatgaagagtggagaagagatgctaacagttggctcctgggagcgggaaccagctagctgcagcacaccattgggtctgtcccacccgtgtgcctcttggggagtcaggctgagacacgtgtgtggctcaaatctcatttcacggctttcccatgctgctgaggtctatcctgtacataactcagaggtaaatctgaaacgtgtgtgtgtgtgtgtgtgcgtgtgcgtgt

SEQ ID NO: 46676 - DNA, 1137 bp, Homo sapiens
ctaccgcacttccactgcatttaaagacaaactaccatgcttattaaaacttcgtctttatgttgactttttgctctctttaaaaggtgcatgcttttttcttaccctatgttaatatgtcatgttacagttgactctgtattctcttattcttttctattttcattccaaagactttcatggagcacccagtttgtgctaaaccgtatgtcgggaatggtgctgaggttgcaccgaaatgaccatctgaaacctgccatgatatgtattgatgcacgtgtgtactcagcatgtaaatgaggctgttgttcttttcattggggtttattgagcacttattagactcaaccccctatggccggtacagaaaaacagctctctccctgctcttgagaaggttttgttacagtgggattagaaaggagctggcatttattgagacgcagagtgtgccaagcatcgtgccacctgcagccctaaggaacaggcaaatttatacccatttaacacaagaaacagactgagacaaaaacagaagcaatgcgtgcacagtaggctattctggaagaaggaccaagcttgggcctgtgtgcctccctgcaggagccccaccgctgcaggagctagggctgaggaagggtgcagcatgcatcctgtgggagcagagagcagggtctgatgggtgagaagtctcagccctgggtgagagcaccctgccctggcagagagaggagcttgtgggcccagggtgatcctgcgtttcccaccactccgtgtgccgggaacccagcaaagtggggcttggatgcaggttatctggcatctggtctccttctctggggtggaatgggatgactgtgccccatgtccacctcccttcgaggatgagagatggtcaagccagtggccttgtctgttctgcccccacctctcatactgtgactcgcttggaggggcccagaggcactggctgagcagaactcttcacaacttcatagaaacgtcctatgtgaaagtagtagtcgtagttactgtttttcaaaatggataggtaccaaggacattttccccttgcaaagcctcccgcagacaggcctggtgctgtgccggaaggccttgtggcgcaggctgtgcgag

SEQ ID NO: 46677 - DNA, 1059 bp, Homo sapiens
acactttattcagcacatttttcatccttagaaaacacattgctgtctaatgttatatttcaggttcttccttcctttaaattcttagggaaaaaaaaaaatcactgctgggcccaggtcagaaaaacatgtagcttttatgtggctgttgggtctgataacagaaacatgtggctttcatatgggctggagagaaactcacatttcagataaggaagaaatgggtcaaaacattttaaagctgctgctttccctgacaacatcctttgcttgttaagcacgcttcaatttgatttggttcccaggcttgctttgaagacatgctgtgtgctagagaaggctgggcctgaggagttggaggtgagtaagagtgtgcgtggtcccctgggagaggcagagatggtaccaacatctagaaactgcagtgagtgctagttaagtcatattcacggagttcctcctgtaggccgggcctcgggcgcaatgctgaggacagagatatggactgaggggcacatggactggtgggtggaaggcagccttgtcttgagagaatagcagattgaaacatttgggtgaccatctttttctggtccccgccccaaaagaacgtgcgacttgacatggttttccctcatttgtaagtgtttttatgcgaaatgccttacacaggaatcaaatgtgcatttctaaatgtactgattggccgggcgcagtgctcacgcctgtcatcccagcactttgggaggctgaggtgggcggatcacctgaggtcaggagtttgagaccaccctggtcaatatggtgaaaccccatctctactaaaaatacagaaattagctgggtgtggtggtgggtacctgtaattccagctacttaggaggctgaggtacgagaattgcttgaacctgggaggcggaggtcgtagtgagctgagactgtgccactgcactccagcctgggcaacagagtgagactctgtctcaaaaaaaaaaaaaaaaagcattcattttattcttcaccttgactatgtggagcaaaatactgagaataaagaga

SEQ ID NO: 46678 - DNA, 1032 bp, Homo sapiens
gcttgtatagccagagtgaccaaggagcatctcttgaggaggtagcatttgtcctgaggtctgaaccatgagaaagagatagccatctaaagagctaggggctctggtaagccacatcttccaagcagaaatcacagctggtgcagaggcccagagatggtaccacgtggtaatggaggagctgggagctgaagcctgctctccaggaccttgtcagtgatggtgggtttttctggggctggcggcgacaagctgcaggagagagccagggaatggtgcggttgctcgtcatgcatgagaatggtcactgtgactgctggttggagatggattgcagggtggagagggaaacgtggacgagtagaggcaggggagacgaggtggggagccagtggcattgtccagacaagcgatgacagtggcttggatgagggcggcagcagaggaggttggcgacagtggtcagaccttagatgcactgaagaataagcaagggtgtcttttaaggttttggcctgagcagctggacggtggttgttttatttactgagatggaggaagctcggtggggattagaatgtggggaaaacacaaccatattcttcaggcgagtcatgtgtgagcaccgttcggctcttcagcggggctgtgcgggagcctgttggtgttccatctgtgctccagggagaggtctgggctggagggagaagtgtgagagtcagcagcttagaggcagcgtttaaaatcctgggcctggatgacattcctgagggggttgcagagatagagtgctgtgctttcgaggcaccccgacatctgcagggtgatggggccggggggagggcacgggagacagaggaggaagagccagggactgggaagaaaagcaggcagctcaaaagctggaaacatggggcgtggcttaggagcaaatgacagctgctgagaacgtcaggaagacaaggccaggatgttgaccactggctttgagattggaaagagtcatttcagaggagtaggaggatggcaggc

SEQ ID NO: 46679 - DNA, 1026 bp, Homo sapiens
gctttgtcaacgacagcactgctgcagcagtgcacgagaaccagacctggagccgggtagaggaggtccctccccttctgactgcaacacagctccacctgcaacctgagacctgggtgagcatctttgccctgccccgtgccattgttctggctatacaccagcgacctggacaggttttcacatctctatgctggatgggctggcccagccggttgtgcactgtgaggtgctgcaggaggagctgcgaggacacattcttcttgacttctcagcataggaatgtctcacgtccagtccacgtccctgtcctagtcctcctctctgctccttccacacttcctcacggtggtctcctgcacgctcgtggctgtcagtatcagacgagggcagcttctgcattttctcaattccaaccactcctctccacttacctacccagtatctctactgggtgtcttccagtcatcctgcactcaacgcgactgacaatttacttccaaccggctttacaatttccctgactttgttgatggcaactttttccttccagttgcttaagccagatacgttggagtcattctttaccattctgttcaacttcatacctattcctcaagaattctggtttctctatctctaaaatgtatttggaagcagctacttcttaccttcttttcacggattcaggtcaccattcacactcacttggattattgcaataatttcctaactgggttccatgtttccagcttttctgtctgcagtctgttttgttttcaacatgtggccagagggatcctgttaacatctaagtgaaatatatcatttctctgcagtggctccctagctgctcagagtaaaatctaatgtttttacaatggcctgaaaggctctccataaccttatcccctcccacttacctccctgtctcctctcctccctccgacactcagcccctgtgtattttagctattgaaagaatatgtgggcacactgctaatttattgtctttgtggaggcttg

SEQ ID NO: 46680 - DNA, 1048 bp, Homo sapiens
gctgcggaggaccttggtgggcatcagtaccctgcggattgtagggatgctgaagctgcgcactgagacctagctgcgtatctcccctgcggaaggctgcggaggacttgggtgggcgtcaataccctgaggattgtggcactctttccgcagttccctgctctaggctgcggaggacccgggtgggcgtcaataccctgaagattgcggcactccttccgcagtcccttgctcttggctgcggaggacccgggtgggcgtcaataccctgaagattgcggcactcgttccgcagtcccttgctctaggctgcggaggacccgggtgggcgtcaatactctgcggatcgcggggatgctgaagctgcgcgctgagacctagctgggtatctcccctgcggaaggctgcggaggacctgggtgagcgtcagtaccctgaggattgtggcactcctgcagctgcgcagagacctagctgggtgtcctcccctggagaaggctgcggaggaccagcgtgggcatcagtaccctgcgcgtcacggggatgctgaagccgcgcactgagacctagctgggtgttcctaccctgtggaaggctgcagagacccgggcgggtgtcagtaccctgtggattgcggcactcctgcagctgtgcagagacctagctgggtgtctcccttgcagaaggctgtgggggacccgggcgggggtcagtaccctgtagactgcggcactcctgcagctgcgcactgagacctagctgagtgtcttccctgcggacggctgcggaggatctgggcgaacgtcattactttgtggatcccgggatactgaagcagctgagacctagctgtgcgtcgtcccctgtggaaggctgtggagaacccgggtgggcttcagtaccctgaggattgcggcactcctgcagctgctcgctgagacctgtctcccctgcggaaggctgcggagaactctggagggcgtcagtagcctgcggattgcggcactactgcagttgcgcagagacctcgctgggtgtctcccttgca

SEQ ID NO: 46681 - DNA, 1045 bp, Homo sapiens
tgtaaatctcaattaaaaaaaaatcctcaaagctaaacatttttccttcttctccacttttcttcttgccctttaccccccaaactcatgtcttctgaataatgattataatggctaccatggctcaggctcctgccgtgtgtcatctgccatgctaggcacttggtatttgccattttattaattattacaataaccccattttacagatgctgacatcatcagaggctcagagaagctgagccacttacccagtttcacgtactagtgagcaggtggagccaagactgaagcacgttctagtctgactactggacatattttgctgtctctgatatttccgtaccacattgatgaaatcttcctgataaatatttccaatgcatggatagctaagtttatgccatagtctatagacatatcttagactggggtgagcaaatgcttgcatggggcaagcgagtcccctactggaggtatgtggggaccagaagatctgtaccctgactgaaggcaattcaatcaccaagtttcatgtgacactgagtgggctaaccagaagatttttttttttttttttttttgagacagagtcttgctctgtcgcccaggctggagtgcagtggtgcgatctcggctcactgcacgctccacgtcctgggttcacgccattctcctgcctcagcctcccgagtagctggaactacaggcacccgccaccaagcctggctaatttcttgtattttcagtagagacggggtttcaccttgttagccaggatggtctcgatctcctgacctcgtgatcctcctgcctcggcctcccaaagtgttgggattacaggcatgagccactgtgcccggccacagaagatgtctttaatccaagggttctagtttgtgattccactgccccatctgttccatcttggttctctccttcctggtaattcttgtagtagtcttgtagactattaattgaaagctgttatcagttaatgggttgtgcatacgtcagtataaaacctagtacaaatgcagaccct

SEQ ID NO: 46682 - DNA, 1072 bp, Homo sapiens
aaaagcaagctaatttgaaaaagaacctcatggagattctaaaataaaaaatatatagtgacggctgggtgcagtggctcacacctgtaattccagcactttgggaggccgaggtgggtggatcacttgaggccaggagtttgagaccagcctggccaacatggtgaaaccccatctctactaaaaatacaaaaaacaaaacaaaacaaaacaaaccaacaaaacttaactggacgtcttgtcaggtatctgtaatcccagttacttgggaggatcaggcaggggaatcatttggaccctggaggtggaagttgtagtgagctgagatcacaccactgcagtccatcctgggtgacagagcaagattctgtctccccatgccccccacctctcaaaatagatatatggtggttgaagtaaacaaaaacttaaaacacagagttgaggagttaaagaagagactagatgcaattgaagacagagtaatttggaagatagagcttagggaacttcacaaaatgggttacagtgagacaggtagaaaatgtgaaagaatagttgagagcatagaataagagtctagttggagatccaggaatagaaagcagaaaaaatcctggagagaaaaatattcaaagagatggcaactgagaattagcctgagaaatgcatgcatgaggtcttaaattgaacaagtacatcaagttttgaattttcaagtttaatgggaatgataaatcctcagatccaagaagctgaacaaaccccagtcaggatggacacacacacacagtcacataagttaatcaaattactgaaaactggttgtattgagaaaaatctttagccagaggaaaagccacaaattacatgggaacaaaactgatgataattgtagacctcttgttggaaaaaatgctcctggaagacagtggaatttgatctttcacttggtaaaaaaaaaaaaaaaaaatagctgttaacttggaattctatatccagcaaaaatatccataaaaaaatacaaataaagacaaaagctgagagaattcctctccagaagacttactct

SEQ ID NO: 46683 - DNA, 1049 bp, Homo sapiens
ttttgtaacagtatacacagtaggcattggtaagtaaatgagaactctatgagctgttttctggaaaagtttaaaataaaatttgtcaaatatcaaatgattgttataaaaaaatcagtggaggcagtatccttggaaaaatccagaaacagttttgtttgtttgttgttttttacatcaaggcagatcagcaggtgaacagtgtttgggaaatataggacgggagaccttctctcaagaaactacataaacaactgtaattaattccattgtgaaaattgcattctggtttccaatatctatacctcagcttagaggaagcaaactggctggacccgcaggtttctgttttctctttcggaatattttgctttaggatgccttagacagtcacgtgcttcccagccggccacagtcccgcctctgcctggctgtccacttgcctccgtcacactcttcttccccctctggactcttagaggcctgggtctgtgagccctgcatccggcgttagaatagcacggtggtgacatgctactggaacacaggaagaatattacatctgttttcatctcatccttttgaaaagtacctttttatttcagaatggttttagatttacagaaaagctgcaaagatggaacagagagttcccatgtatccctcatatcagttttctccattgtcagtgttgtacattactagggtacatttgccacacaataagaaaccaacgtgggtgcgtcactgtgagttaaactctatccttgattcagattttactcatgtatccgctcctgtccttttctgtcctgggtcccattcaggacgctcgatgacatctatcctccgggtcttcttagtgtcttccggtttatgatggcttgtctctccttgtttttcgtgacgttgagagtactgaggagtgccggtcagatattttgtagattgcgcctcattttgggtttctctgatattttccttatagtgagaaggagtcgacgtgcccttcttatgccgccgccgcaggggtgcccacctgacttgtt

SEQ ID NO: 46684 - DNA, 1016 bp, Homo sapiens
tgttacttatgatttttgttcttattttgtagatggaatcagtgtgagtggctttcccctgtccagtccttttcggcaggtcgttcggccccgagtggagggcaaacctgtgaacccacccgagagcaacaaagcaggcgactacagccacgtgaaggtgagttggtatggcagacggcatctgccacgtgccgttcgggcttctgcaaagccgtttctgaagcacagctctgagtccttttcagaaaggaaaggctatgtgtatttgaaagctggattcttggtattctttgttcttggacaatgttttggaaagccgtcacagtgaagcttgagtgcattgtttggtgttgcaaactcttatgtccttggaacacggagattccgtgggctgaatccaggcgtgcggtgattaaagcagactctctcctgccgtttctctattcatttgaaaagtttatttattgcatacctcagttcggatgtttaccctgtacatttttcttaatcttttggcaacccttcccaattgttggtttggaagcaccaaggaagccaagacagatatgccggtagcaagtgaatgtcagtgcaaagctacgtgccgcgggcttgtaggccagcagtgagcagaggtggctgctggctccgtggagaggcctacacaagtgctccggggttttgagtcttcagcacatgggaagctctggctgtttgagctggcccagggacagcgtgtagagcaggaggactgcagggcctaagagctgtgactgggctgcaggcggcaatgtcactttcaggcacacttgtgttcaggaccagcctttgggatgctgtttacagtcctcatgccaaatttaagagggcagggactggttaggaacatcagaatcgcttggccaagatgcttgtgagtcagtgatacagtggactttgaggcattggagctgctgtcactcaaccaagaggaggggtggaggagcatggggtgctatctgatgaggtcatggcaa

SEQ ID NO: 46685 - DNA, 1035 bp, Homo sapiens
gagagattttataaattgtgtccatggtgctgagagaaatgagaaaaaagagagaaaataaactcattcaaacttaacagcttttgattgagtctttacaaataagtcttcgcacatatctacctgatgaaatttcagttaaccaggagttggttgttgaatgtgactttgggatgatggaatttttattgagcgtgtgtgtgtaaactgtgtgcgtgtcaactaaatactggatttgaccctgtaatttattcattcatttagttactatttactgagggcttacaatttgttagagcctgcatcagctactatgaggggcataatggtgaatctgacaagaattcagtcttcaaggagtttgtagtcatgaaggaatgtaagacatgcataatttgctgcagtaggaataagaacagctctttttactgaatgcttgccccgtaccaggcgttgtgataaatccttcctatgcaataattcgtttattcttctgtataacctcacagtatatgtgttctaattattcccatttaggggatgatggatttaaagcttgtagaaggttatttgacttgatgaagttcattcagccaggtagaaggggagccgcacctcagccccgacccctctgatctcctaccgggctctctgcatgtatacagatcagcaggaggtaggcacgggtctcaggacagagaagatgctggaactctgaggaagacgtacttgctttccattaggacagctaggggaggcattatggaagaggtagcatttgaactgagaccaaaaattggggcatattaggatatcagattgtcagagggaagagaattaccaatacataaaggtaaaaaaaaatgggggtagaacaaggagtgacaaggaataaattctggtagaaaaatggcctaccagttgcagggactgacatggttcaaagctgggccttaggcccagtgagggctgctttatttacggtctaccctttgctttgtggccctacctgaagcttcccagatttgctatcca

SEQ ID NO: 46686 - DNA, 1047 bp, Homo sapiens
tatgattattttttctttcctaagcatattccaaagtttctgaatgaacgagcatgccgctttctttatggaaattaaggatgagtattggctaatttcttagccaactgcttctactgctttggttttcttgaggatattttatgataaccagatgggcttttttggcacctgtagattttatgactaaatgagaaagcatctttaaaatatattctacctggaacagcataccctgacaaactcccactgagcgattgttgcctcctgttgcctttgttaatgtattttattctagtttatttttggtgcctctcacaagagagtaaaatgtattcaaccttatgcattagtgtctcttttgaaagtgtaccaaaatggacacatccctgcatagatcccaccactggagatagatgctaagcccctgcaagggtccttgtgatcggtttagtggaacgcatggtgtacagttttgacccagtgatgtgctacagaacaaccttggctggtgagcttttctggaagctcagtgtggggactgaaatgtattccttgggtcagttttgctgggtagtgaccaatccagttgtcatgaggcctagttctggctgtgcttctgatgagctgtgtgatattgagcaaggtacttaccttctcagagcctcagcttcttcatctgtagaattggtaagagaatgcctgactttgcagggtgtgaagagttggatggtgtgcactgagcgcctggtgccaggccacggacgtggcccttggccctcacccctttctagaagagctgtttttattgtgactctgctttttctttcccctgcacaaattctgctttcagctgtcattttccccaattgtcatcatggttgggatatggctgaattctagagagaagtattattttagcatacaaaattgtctttctgaatttcccacagagttgctcttaatagaaaagttgagcactataaatgggaagtatgaaattctctctgaaagctcagttttattcatgatgatctaccagactca

SEQ ID NO: 46687 - DNA, 1050 bp, Homo sapiens
ttgcattcatcttaggcttcgcttcagccccaaggagatcacagggaggtggtcccatcccctggggagccggggcccagtacagaacctgctggcagttgttaatttggcatggtttctgcataaagatggcagaagagtagcatttttattctactctttctcttgaaatctcccccgaacaacaaagtgtgaagaaacagtgaaaataaaaccattccctgtgaaacaaggaaatcatttcaaccccccgtaacaaagcatcggccacaggtgtcgtggaaactgggttagagggagggcgagagcggaagtgggactctgggaggactaaggaaaagctgttccccgagtaggcaacgcagcacccaaaagtaccccaacaatgaaagccaggcagaggggcctgggcagatgcctggagcagcaggaatgccgaggggttaccttttctgtgccaggcctttggccaagaaaggggaggcctggggtgggaggggaaggaggcattggagctcactgatcacacaacctgtgtgtgaaaggcttcactgcaagcctcacctgcattttcaataacaaaaacacgggcggcctgtctctaggataagggaactagtggcatagcagcccaagccgagctggatcacagctgtcggtggccaggtccctccttgtgtcactccggggccaggcaggagacaggccacaccagaacagaaagaatcgctatgaacaatggctgacaggtgcagagtgtttgagaggcaaagataatgtaaagcaacaggaagtgcgaggagggaggcagctcctgccctgggctggcacagcctgtgaagaggttggacgagtgtggcccagaagttgagaggaagtacccaggagcggcaactgagacctcagaggagtgtcccggctccggtgctggagtctcagctcggggcacccagacctctggggagggcactgtctggccctactgttctgtaaaataacactaagaatggtacctacatctcattgatttaactgagaattaaatgagat

SEQ ID NO: 46688 - DNA, 1029 bp, Homo sapiens
agtaattagacattttataacaggtcacattggaggctcttttaatatatgtgtgtaaaatatgtaaatgtgaactcttattgaaacgacatgtttaaccacagcctgtggtcttcaccagccctaagtgaggacggaggcttcaagttggatgtggctcgcccattagactgcttgtctccctcacatggtcacgactggccattgcttttatggccagagcccttagttaattcccccccagtgctgtgatctctcttcggtgtatcttctccatgctggaatcctgaggatagtttctttttttttctttttctctttttaaggtctaccagaaatactggaggagaatatatgtttaaaatctgagtttgaattagtcatggtaggaagttttgatccatggtatttgtagagtgagttaggagagattcatcatctcggtttggatgactgacaaagctgcaaccagactcagctagatttcagatcaggcggttgatgggaaaagagaggaggagctgtgatcatgatgtacttctaaggtctgctttcttttggtggattgttagttcccagtgagaaaacagagaacgaaatcactatgcttccatatgggctgtgtttccattagatataaattgcgtttgatttttgatgaaaaggcagcataaccctctagaggtgtcaggtgccccttgtcctgggaaggggacgcacactgtgattgatggggtccaagctgtatgtttttaggtgacaggaaaatttgtttatccatgaaatgctgatagtgtcttatggttatttaaagtcatattaattagtgatttaaagacacttagtttaaaaggagaagaacttgggacacttgatactgttgaacaaataacagtctcttgaaagacctttatataatgatatttggttaattggagtcgtctgagaaaaggacaaaagtcaggaggtctgagaggttctttccactcatctcagcctctaattactgtaacctccgatcaataatta

SEQ ID NO: 46689 - DNA, 1028 bp, Homo sapiens
tggtttcaaagacaatgcagacgtaattggcctttgactttgggacctcgggttactctcactccctactgcaaaacaaactaagggttgaaagcaaagcattctgttcaaatccagggccctttgtttgaaaagaacacagggcccacagctggtgttttgaagtagaagttcccactagtggcgcagtggaccgtctgatgcagacttgcaggaagtcggtcctgggaggctctgaacacccctccctgtgattaaccactttgctgtcagaaatgtcattttcccatacactgtgctgtgggcccggggcctccttcgcttctttctttgggttccatatgttgcccgatcttgaggttagcgctcgccccaatttctccatgagtttactctgagttgacaggcgatgatctgacagttggaggtgtctgggtgtttggaggtggccccgttctcatgttggctgctcatcagacattgagtttggccccggcggttctactacgtcactacctggaagcaattgcctttaacactctgctgtttggggtttcgatgctttttatgctgcgttgcgtgctttcattccggaagagctaagtgtcctttgcagtctctctgagaatgttttgtaattctgccgccacgctgttctgtgcggaccgacctcaagaggcttgggcccccgtgggtgtcccactgcctgccggcccagggtacaggctgcttgggtccgctgggctggccttgggctgtcagaatctggtccagggtgtttcgaggggacactgcacagccgctcgcccctcgactcagtcatgggagctgcagcacgcagatccaccgcaagcttcctgcacgcgcatctccggaatgctgcgctgggccctcccaccatcttcgcgtttgtgagaatttactcagaagtgagagaactgaagattcctggtgcttttgttaacacgtttctatcttattggttggtgtggaaatgttagatgtgttgttaggtttttaaatgctgt

SEQ ID NO: 46690 - DNA, 1044 bp, Homo sapiens
ggacaatcccagtggcccagacaagccatacgacattttcctgtgacctctctctgacccatctctcacgctcatgagaaaaggaatgtacaataaatagaaacagaaacttcctcagtgctcatgcgcctcacttgcagaacgtgagtatttcatttatgtttgaagcccttccccaaagtgaccgaggagttgcactctagctgccgtgccagcagtctcgtctgctgtgacgcttctcggtgcggatgcagtgcacctgtgactttgtcatgggggtgcccctgttacacacacacacgctgactcttttttatgaggaaaatcttcgactcaaaataattgcactgattttttgacaacttctttttacgatgtcccacttcgcatctgctgtacttgtttgagatgattgtaaatagatttgtggtaggagaagtgacatgaatgcaacacgtggctctgttgtggagacactgcctcgtattcagtattatgtgttaaagttgtgtggacttaactctgttccgccctttagcttcgtgtctgttgaccatttatgaaggacaagttcgcctcattttctttttcttctgaagggaagttctagatcggttactaggagaacatggtctcttggtgcctgatgatttagtcctaagcagactcgttgcagtcttgtgaacactgttgtggtctgtttgattcctcgtcgcttaccgtggctctccaaagcatggtctttgagttccacccagcctgggacagtccagacgggaggcatctgctccgcctgctactaggacgcaagggcctccttgcatctctgtggtcagagtcatcttaaagccatgaggttactgtcgtgtcaaagctgtcatttgtgcccgttattttgctggagtagcagcgtgtgctgtagcccccgtgtgtcactctgtggtcaggctaccctgtgtcacacccagcaagaagtttttcagccccagaccagtctgtgtgtgtgtccgagtcacaccagtgccattacggtgccctcgctta

SEQ ID NO: 46691 - DNA, 1576 bp, Homo sapiens
ttgccaatctagaaactgttgcactaagagtgacaccacggacgattttgaaggctaacaacagacaactctgtttgtgctgagtgggctttttgtctctgtacacagttttagtaagactcaaatccatgttccgtgtagaggcgtcaggaaggaggcgagcctcccctagtgctgctgtgcgctccgtaggtcccctcttcctgctgctgttccctccccggccctgcgcgacacttacctcggcactgtggtggggtggggtgccaaaggagctgcctcctgctcagcggcacccccccccccacctttgtgctcagctgctttggaggcagcaggaggggcagcaagccgcaggtcgggggtctcccgatacctcgcctggatattggcggcaatgacaaagggatgactattatttgtgaagatgtgtactcagagtggtgtgtgtgtgtgtgcatgcgtgtgtccctgtgtgtgagtgtcttattaatggcattagtctcttctggctgtatttttttttaatctttttaaatgacagaagctcccactctaagaaatggcagttccttttgttttagtggcaagtggcactttctcctgttttcagaaggatacagacatgctcgtagcttaaattaatggatgcattcaagctaaggagggaatcttgtgactaataacttttcaaatctgaaattagattagtttccagccatttttacaatcatctggaaccatgtgtctcaaaggtgtgtttcttccacctgcgtcaggctgtctgggggatggcggttcttgtttaacatgcagatttgtgggcctgctgccacctcctgcgtgcggtacttcagggatggccagggcatctgtgtctaagcgatggcctgcagccctgggctccctggggtctgaggacccagctctggtggcacccagcagggaggaggtgcttcctgagcagatgcctgagacagactgggctggcagaaaagtaggactacaatttttgttttttttaatcattttgaaggaaaactttcatttttagtgggccagagtacttcgaaaagggtacttttttatagccctatgcttgttttataaaacttttaatactaaaaacattaatagaccaaacatctccagctgggtcagctgcacacctttgtacatgtctgatgattcagagtttaaatggctgtagttacaatttctcaggtaaacaattgttttctcaaatttttaccaatccctgcattattaggataaattttgagacagtgtaaaaacctcaaagtacagtagggtaagtcccagccctgttcacgtgaaagccagaggtggcccttccccggcatctgatcgtctgatcatgtgggtgcctggggccttgccacccttccctgtccactgctgcccccctgggcctgtcaagatttgaggggtgcccactcgctggctttgtccccatcccactgttaagtaaggtgtgccttgctttaagcaaactgaatgtgaaaattatgtgtagaagtctgggtttgtttaaaagaaaaactgggattttatc

SEQ ID NO: 46692 - DNA, 1031 bp, Homo sapiens
tatcatctacttggcacccaggaaagaatacttcagagtgttagactccctacaggcacggctgtgcaaggacacagggaaggtttactgtgcaaatggaaggtgaaacagaagttaagcatcacagtgaggaaaaaggatattttatcacagtaaaaggaatcattcaccaggccaggcacggtggctcacgcctgtaatcctggcactttgggaggccgaggcaggtgggtcacctgaggtcaggagaccgagaccagcctggccaacatggcgaaaccccatctctactaaaaatacataaaattacccaggcgtggtggcgggcgcctgtagtcccaggtactcgggaggctgaggcaagagaattgcttaaacctgggaggcagaggttgcagtgagccaacattttgctactgcactcccgcctggggggcagagtgagactatctcaaaaaagaaaaacaatacccaaaaataaataagtagaatgattcaccaaaaagatacagcaactaatgagcttgaatgtacctaacaccaaattatgtaaagaaaaaaaaagtaaagcaaaaactaacagcattttaaggagaaattgatgaacacgccatcaaaggtggatatttttacacagctcttattatactgtttccagacaaaaatgaaaaactaaggaaaaaaaattggggccaggcgtagtgactcacgcctgtaatcccaccactttgggaggccaaggtaggtggatcgtattagtccaagagttcaagactagcctgagcaacaaagtgaaaccccatctcgaaaagaaatttaaaaattagttgtgtatggtagcatacgcctatggtcccagctactcaggaggctgaggcaggagacttacttgagctcaggaggctgaggctgcaatgagctgtgattgcaccactgcactccgacctgtcttaaaaaaaaaaaaagaaaagaaaccctgaaaattggaagagtgaaatgaacaagccaagccaggtctaatagctagatag

SEQ ID NO: 46693 - DNA, 1059 bp, Homo sapiens
catggtggaggacaaaaggcacttcttacatggcggcagcaagagagaatgacgaagaagcaaaagcagaaaccactgataaaccaattggatcactgtcacaagaatagcacgggaaagaccagcccccatgattcagtcaccttcctggattcctaccacaacatgtgggaattctaggagatacaattcaagtgagatttgggtggggacatagccaaacataacaggcgctgattccccatgcagtcaaaaattcattcataactttttttttttttttgaaacaatttctctgttacccaggctggagagcaatggcacaatcacagctcactatagccttgacttccctgggctcaagcgatcctcctatctcagcctcctgagtaactgggagcacagagatggggtctccctatattgcctaggctggtctccaactctggactcaaaccatcctcccacctcagccacccaaagagctgggattataggcgtgaaccactgcacctagctatgtatgacttttgactcccccaaaacgtaaactactactaatagtctgttgttgaccagaagccttaccaataacataaactgtaaattaacacatattttataggttacatgtattatatagtttattcttcttcttcttctttttttttttttgagacagagtctcactctgatccccagggctggagtgcagtggtgctgtctcggctcactgcaaccttcacctcctgggttcaaatgattctcctgcctcagcctcccaggtagctgggattaaggcgcccaccaccatacccgactaatttttgtatttttttgttttttgttttttggtttttgggtttttttttttttttgagacagagtcttgctctgtcgcccaggctggagtgcagtggcgcgatctcggctcactgcaacctctgcctcccaggttcatgccattctcctgcctcagcctccccagtagctgggactacaggcgcccgccaccacgcccggctaattttttgtatttttagtagagacaggatttca

SEQ ID NO: 46694 - DNA, 1049 bp, Homo sapiens
ctccctccttccctcacaaatggaatgtttgtagtagcctgaggaactcttttggcgccattcttccagtaacatgtgctcacttagtgtctctgtcagcattttttaagcaataaagtatttttaaattaagatatgtacattatttacacactgctattacacacttggtagactacagtatagtgcaaacaacttttgtatgcactgggacaccaaagcattggtgtgacctgctttattgtggcaatctggaaccgagcctgcagtgtgactgaggtgcgctgtgctagaatcctgggattcctgaatgaaaggatttgcctttctgttcccaaaggtttcaaccttcaatgcagagacaagactaacacttatggaagcaactgaaagcccatttaaagcccatttaaaataagactgggtaggacatgtggcagggcgtgccacctgtggcctggggaggaggtgcccatggggtgtctggagagagcgtccacggagaggtggaacctcgattactccttggagcatccttggaggatggaggagatgggggaggatggctgcttccagtgggcctggaagtagtggggaggtgaggtcgagtcttggatgcaggccagggatttgggactcggctgttggacaggcagtgggagccaggacctgctccgtgaatgccagtgtggtggcatcttcttggtgaaggcatcccagatgtctcctccttgtgggctttcgtttctttaacagagagcacatggagagcgcatccctaggtggtgttagaattcccttttggaaccatccgtgtcaaatgtgacaagtgcgtatgtggcccatccgtgtcttgtggcctcttgtacatgtggtccacaccttggtgcattattcacctgtcggggccaggggctcacagcccagggtgggcatccagtgcccttcttgtcatccccatcttcctcgtgcatgggggttgtgtctgcacacttctgctctgtctcctcttgcacgctttggctttgatcctccagcttgtatctgca

SEQ ID NO: 46695 - DNA, 1050 bp, Homo sapiens
tggtcaggttggccttgaactcctgacctcaggtgatccacctgcctcagcctcccaaagtgctgagattacaggcttgagccactgtgcctggccttattacagtatttctaatattgttcagtaaagacagatggtggatcaaagaggatgtttttgacttgtgaggaaaaatgtattcataatttatggggaaaagttttcttcgtaaagatcacaggggtggctttcaggaccatttctcaaagagataatggtggttgcagtttcaggttgaaccacaaacatttattttaaaaaaccccaacaggaaattccgtgttgatggttagtcatctgcgggagcttaggtgtttgtttatagtcagtcctagactgtacgggtgtgtcatgctcttcctgtgcacgctgtattgctcactaaaataaggttaacatattttcaggctattactcattaaaccaaaagaggggagcaagtggtttagggatgatcatcagtctgatctggaggcgcaggctgcctgtgtcggcctcagcgcagcgttccagtcttccctgggggagttctccctgctgtccttgcccagcaccttctacagcccctgcctttggggtgactgctcccctgctcacgttgcctcccatggcccattcttttggtgttgccaagaaccaggctgagacaggttggaaatgctccaataatttctactcagggagaacagaaacgaaagccttccaggaaccgcgcctgcagaacacagaagtgctcaacagaagtgcgaagatgctgctgaggacagctccgctgcccccgctgtgaggactgcccccacccggggctgcacccagagctgcacccagagcttccttccctccttcattccgacccagccttcccatgggcccaagggagtgaaggcaaaagctccttctcagcgtgtggatgcagccagggagcagtggtggatggctacatcctgtgtccccatgcccacaggaggaggggtaggggccatttcctaagctgggacccatgaggtcctg

SEQ ID NO: 46696 - DNA, 1027 bp, Homo sapiens
cacttgaacccaggaggcagaggttgcagtgagctgagatcacgccactgcactccagcctgggcggcagcgagactccatctcaaaaaaaaagttttggtctatttttattgatacgtaataggtgtatatattttcagggaacatacatgtgttaggtaggtcagattcttgtatgttttgggtgaaaaaaggattcagtttggagaacaagactctttctgaagtacaagagatgtcacatggaccctcatcagggcggtcagctgatttgatggctgatgttggtggaggggcaaactggaaatcacagtcctagccctgtggtctgctgcccaggtgccctggctgtcacctcaccccatggagctcctggctcctcagctgtgcaatgaagacaagtccaagagcgaggacatgagaagagacaagaatgtgctggaagtcttgtactggagtaatgttgatgctggagaaatgttggcttcttagttgaaacaggctgggtgctgtggtgcatgcctggaatctcagcactttgggaggccaaggcaggaggatcacttgaggccaggagtttgagaccagcctgggtgacatagcaagacccctgtctctactaaaaaggataaaatataaaataaacaaacaaacagtaaagactatttgtaaaaggtagagtaatagccttcctatggataccttatggttttgtcctaaaaacacttgggattgagtcataaacccataaggcatttttactaagagttggtgtaacaagaagatattcttttattcatctgtgtattcattcagtcaacagttgcacaaaaacagacacagtccttgctatattgcagtgcctacattctagtgggagaggcagatacagagtcggaatcacaaaagaaatctagagttgaaaccagaaaaggctgtagagaagagtcagagaaatgtacgcataaggcattcttcatgtctccactgagaggtgtcaggcttcgagcagccctggaccagcgtg

SEQ ID NO: 46697 - DNA, 1095 bp, Homo sapiens
tagaccccatctttaatctccgccacgccgccgtgggggcctgagtcaacccgcaccatccgaggctcccaccaattctgggctggtctctgaagttggggccagcagcaggcctgcctttcggatagcaaataatagaaagaaatccataattatgtcatataaaagatgcggccagaacactgcacgtggcacggcctgtgatccaaaatgcgtgcaggcatcgtcgttaacttttcttcagtcctctgaggaagtagaataccatttcgatttgttttaaactgtgagctcgtctctcttcaggaaggaaattgatcaaagaagcaaacactcctggatattttgtctgcttgattttcagcaatttactcctaattaattattctgactaggaaaaaaatggtacctctccaggatgccagtgtttagaattgacatttcaaatagctggttggacaaattggagaaattttctgatttctgtcatttgttaaatttgcttttaagtatccctcagggagctgtattcattccaagtgcggggaattaaagttgaatctccatgcaattgaattagcctgagccacagggatgggctgcagaagcctgctgaagcttacagggagattttacttaaagctaaagcttatttcacggagtctgttctgacggttttctaacgccaccgtgatgtacagtttactgttttattaacattggaacagtacttcttttcacaatgtacagtgattgtaatttaagataaatgtgggagtattcttatacctaaggaaatgctgagtcgaaatgctggatttctaaatatatcactggggagaggacagttttttccctttataatgacagtgttgccaacatgaccttatagctatgtaggctggggatattttgatatgcagtaggaaaatgtcacagaagagataacatcaatagaggctaaattttcccttcatgatatttatttttaacatctattctactctgttaaaaaataaggaccctcatgtgttcatgtggaaaacatagtgactagggagagagggatgtgctcattgcgatggatgaagttct

SEQ ID NO: 46698 - DNA, 1030 bp, Homo sapiens
tcggctcaccacaacctccgtctcccaggttcaagcaattctcctgtctcagcctcccaaggagctaggaatacaggcacacgccaccacgaccggctaatttttgtatttttagtagagacggggttttgccatgttggtcaggctggtctccaactcctgacctcgggtgatctgcccacctcggcctcccaaagtgttgggattacaggcatgagccaccgcgcccagccaattatagaatttttaatttgctacgcttccaagccttgccaagatgataactttgtgtgtaactttgtcagaatgtataggcttagtttggctgttcttttcacattgtgctgaaggcatcaacttttggagaatgtttagtgagtccttaatgctgtggagaggttcttggaaactgcgtttttaagcaaaacaaagtacatcaggttcttgaataatgttgttttgttatgatgttgattaggaaaaaaatggatttgttaaacatcatgtcacttaaacttgctgtttccaagaactgccaacagtgttaagtgaactgcatgctcctcgcttgctctcgcagtaggtggggcctccatgctcctgcctgcaagttcttcctgcgctggaaatgggtggaggcatctccctgggtcccctccttaggcatcagaacctacttggtttcttcagacaaattaaaatgtcatcgatgccctggaaggatatacttcagtggtatttcttggcatatttaattatggaaaaaatcttaccttacttatagtagacctttctaagttgcaaatattttactgtgagcatgattgatttataattacgaaaaagcaacttagtctgcataatttgttgatagcactggtcatgttgagtatatttggagcctcgaaggcatggaatattgagcagagtgcggaaaataaagcggtttttgacaccgtgcttcattttgcaggtactaactgacttgtccatttgctaagcttcatcccaccgggcaattttcctgcac

SEQ ID NO: 46699 - DNA, 1017 bp, Homo sapiens
gcttggagaagacatctgcccggcaccctactcgaggtcacagctcgaaaggccacactcaagtgcctctccttggggtagcctcacacttaggggtatgtgggtatgtgcaccccccacttcctcatacagaacattcaaaaggcttaagagaccaggcacggccaggcacagtggctcacgcctgtaatcccagcactttgggaggccgaggtgggcggatcacctgaggtcaggagtttgagaccagcctggccaacatggtgaaacctcgtctctactaaaaatacaaaaattagcccggtgtggtggtgggcgcctgtaatcccagctacttgggaggctgagggaggagaatcgcttcaacctgggaggcagaggttgcagtgaattgagatcgtgccactgtactccagcctgggcaacagagcgagtctccatatcaagaaaaaaaaaaaacaaaggcttaagagtcaatgtggaataaacttgatgctttttgctgctttctgcaggagttttaaggtaggctggcttcgtccccgtgctgtgcacgtgctgtggtggtgagtccagcgtctgagggtactgcctgccatcgccgccttgcactgtgcagatgcacctgcagtttcaccttagccaccggagcaaatgtcagcacagggaaaacacaagccgctctggccctggggacctccctgaagctccccggaccacacttagagaaccgctaagtcagaagactcctaactcctgttctgtttaactctcgaatgatctgcatgcgcgcgtgtctacttaatcccagagtgtttcggagagatgttccactttaattaaattgtatcatgatttacacacatgtttgaataaaaccacccaagaagagcatctgatttggaatctaaaatctcatctgcatggagtggccgcctggctgagtctgtgagagatttgggggactgtgtgtttttttcaaagtctttggatggactgttgctttgagcatatggg

SEQ ID NO: 46700 - DNA, 1051 bp, Homo sapiens
aagggttcttgtacaagaatgtggaagactcagtgcaaaccttgttctgaggaaggcacatgctctgagggtgagcctgttggcttagggctcgctgatgacagggtacgcattgattcagatgaatgatatcagaaagcatgtttcttacaaaatgccctcagaatgggaacagatatcttttgttcttttaagtgactttgcaggtatttggtcccattgtttgcttggatattgtcaaagtttgttttctaaacaaagccccagagagacagagcaaacacatgagtgctccaactcaatagtgtgtttaattcagaacagaccgtgggcaggatctgtggcgaagccgcgtggagagctgccacaggcatgagcaagcaagagggtggtccggttccgaaaagcaaaaccaccttgagcgtggtaaaagtttcatttaactgtggctgccccctaaacatcggctgtagtggacagaagccaccatttcctacctgatgtcagccacttctattctgtccctgaagtgtcagctcctggccaggcggtggggcaggccccacttcatgctggttctgtggctttgaactcacgagcctgccacccttcagagggctctgagcgggctgtgtgccgggcgagaacactgcctgggccggggccactgtggcatgagaagggccgcctgggggcccggggcctagagcaggtgggcaaggagtgggtgctgactatgtctgctctgggccttcggcgctgagtcttacaggcctggccagggggctgtctccattatttcactccatttttgtttattttattttggtttgctttgtttataatattttattttgagacaggatcttactctgttgcctgggctggagtggagtggcacgatctcggctcactgcagccttgacttcctgggcacaagggatcctcccatctcagcctcccaaagtgccgggattacagacatgagtcactgcaccagcctgcttttgtttatttcaaaagtggaacgttttaaatgctgtgtttggca

SEQ ID NO: 46701 - DNA, 1029 bp, Homo sapiens
cccgccgtgatgggggcgttactctgcctggcagtagggcgggcgttcctcctccctttgatcccctttgttgacctctgggtctttactttgcaagcagggagggataagaaaacatttaaaaaggcttatctctgataaataacactcatctgtctggtgtccacagcggccttgagaggctcgggccagggacacagaagatggcctgtgtcgctcagaactcacctctatacagacccaggtgcgccggaccccgacagctcttggggaccttccttgcccgctcgtagacaggagcgacgccgaaagggcgccagctgtgcccccccgggccatgaacccagctgaagccggtggaactagaaggccacgtgctgcccatggctttgccgtggtggctcgagtggccctattggtgactggggcaggggggccttgctgggcgcaccttggtccctgtgcgtgctgctgcttcgtgaagtatgcagtttgccagatgctaaagcgcgtgcctcactgtaagaacggtcacattaggtgtggatggattctcagtgctgagacgctcactcatcacaccttaacttcgctgttggccctggaagctttttggggggtggtccctgttctgtgcagctcccctgaggagtgcagagcattctcctggaatgttctgaaacatttgagggtgaccctgtggacatagcctggccattccaggactggcaggtgaacacaggatctggtcggggatgcgcatggtagagtcggcgggaactctggttggactccctctgggaagctttgcaaaggatatgccattggaaggagccaggccgggggtgaggcccgttcatggtgtgtgattgaggagagggcttgggggcagcatcaaaacaggactcaccagtgagccaggtgtaaagcaccccctggatacgagggatgaaagaccatggttgagcagggtcaggggctggggctggggaggggcgagttgcctggtggtcagcacaggcccaccaa

SEQ ID NO: 46702 - DNA, 1091 bp, Homo sapiens
gaataaaaaatatctgcaggtacacacacgcacacaggtatgtaacacacacacacgcacacacacacgtgcctgcagctccacgtgcctggctccctggtggggctgccgtcctcctcattcctggggcctcacacacgtgggtgttcgttccctggggaagcaaaagtggctcaggaggcagtgcatctggcagccccagtaaggcagtgggtcagggcaggctgggccgagctctggggtggggcctgcccacagctggtgctcagtcagtgggcgctgcggccgggggagcaggaatcacagaattacctgaaagcttcttccggtctctgccctgaagacctaggaagctgatttcacagatgtcccaggtgattgcccattaggccaggtttgggaccccctggttttgggataagggtggggagaggaggtagaagccctcgagcagctccagggagcatcctcctgggagtggaattgagggagggaggagcccatgccagaaacctggaggacagccccgagacagtgggggcagcagccctggggggtgcatctgtgggagatcgcgtgttgggtgtcccacagtggactttgtggtggtctcctttactgatgaagcgtggagctctgacaagtgaccgccatgcttgtgtggggtgccgcctgtggttccatgttgctgtgaacacagctagtccactaccagacggaaggggacttctgaaggtgattactggggcttcagtaaatgcaatgcaaatcggccaatacctgtttttaaggacctatatcccaaaacaaacacaactgcagcaaggcttagaaacagccagactcaggagcccaggcggcccctaacccgaatctcttactgtaattgacatccatcttgggaaaatcctactggggcagtaactcagggcaatgttgttgttttccacgtcatttctgagtgtttcagctctgttttgtccttagagagttagtgtactctgctgccagaaggcagccactagaaactttcatcttgcagctgcacataaaaagatcaaaaactgaagttcataggtcataaccatttg

SEQ ID NO: 46703 - DNA, 1025 bp, Homo sapiens
tacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggta

SEQ ID NO: 46704 - DNA, 1047 bp, Homo sapiens
tgcctgcacttgtagtcccagctacccaggaggctgaggcacaagaatcacttgaacccaggaggcacaggttgcactgagctgagatcgcgccactgcactccagcctgggagacagagcaagactctgtctcaaaaaacaaaaggatgttatttgccttttccgctaatagagctgctgacaccttagcacaaatcagggcagtgggatgaaattgtactagtcatcactgtgttcttcacccctgtgctcacacaaaaagaaaaaaatgctgttttacagaagaatggccttgatgaagcagtgaaaaatatctgatgtgaagacatgggaagggcatgttagccctgctgctgcacacctagacacgatgtcttatcttgaggaaagcactatacagttgagttgcaaagctggactaaacactttttttcatggaagaccagctttacttgaaagaacagctggcagacatactgttcagagttgcatatttggtagacattttctcaaaagagaaagaggtgaggctgtgactttgaagaaaacaactgtttgttaccggtataaaattcgagttttcaagcaaaaattagaattttgaaaaacttattaccgtgatcttgacagctttctaaattcttagactgttatagtaagctcaggatggtattaacatgtgatattttaaaaatatatgttgtttactgaaatgtgttaacattgggaggatctctatagctcagtaaatcagtatcttccaaatgacctacacaggatgttaaaaatcacacatgagtagaagttccattgaaagtacaagataaatagtggatttttttctccttttttccccccttaattctatggattttaatgtaacagatgataccattgtaaattccacattgcaactcacctttaagaagctaccacttgcattttggtgtcaaatcaaaaaacaataccacagttgtgcccagaatctaccaaaatactcctcccttttccagttgtacagctgtatgagtttactttttttcccc

SEQ ID NO: 46705 - DNA, 1063 bp, Homo sapiens
aattcccagattagaaagtctggtgcactgatgtcactctttcctgagtaatttttgggtggttgtttactgcacactatctaccaggagcctagaaactttgaatgagtgtcattattagaactctagagttgtaggaatgtaggaagagctgtttgccacagttaggacgagggtttcaaactgtctgctgagccctggggcatctgcgtggaatgggaaactagcaaagtctcgctttggctgcattctgaggggtttatgtgatggcaaacagccaagatgaagaagctgcctagcagtcgctgcagcggctgcagcgttatgtgggacttcagatagcttctgagtagtcaagcagtggtaagtagcagtgttaccaacttatggggtttccagcttaaagcaagtagtattttcagaagcacttgtaaatactgttgtgtttttgcttattttcctgatcagataaagcactggttaagctgaacgataggaagattgtattgagcaatttagggagattattggccagattgctaattgatcacgtaagtgctggcgtgatcacattaggtgtgaaaagaatctgtcctcagacatgtatatgcttgataaagtgctgcgtgggatttctcagaggaattctgttctgctcaagataaactttggcatgcaaacatttcatcttggcccatccttcattttctgcaacctctttttcttaccagctgtctttttcttacctatggctgtgctttaaatggacttgcccatttggaccaaggctattctagaatcatttcgtggagagttagaaacctgatccttctttcccctgtgtataggatcctttattgttatcatctactgttagccaactggtgttccttagataactcagggtggggtctagtgtgtgctaactctgggttgtcagctcccctaagacaatgtgttgtctctctagcacaatcctggaggaagagaaggctcagcaagaagagcgcatgaggatggagtccagaagacaggccacagtgtcctgggactccggagggtc

SEQ ID NO: 46706 - DNA, 1033 bp, Homo sapiens
taacatttaggcctcatttcattatggcctgagattgtcttctcatccctttcacacacagtagctaaactaaccctcctgtcagcccagaatgcctccttcttcatttggggagatcttacccatctttctcggcttctttcacgcactgggtcttctgtgacttcacagctgactagccttcaccctctgagtctccaaagctctttgttcttcttgtcaggcttaccctatgctgctatagatggctgcaacccgtgttcaattcagttcgataaacactgttgagcacctacagtagctgagcctggtgctagtcactggggcaaagatgactaaaacacttttcctgccctcgaggagctcacagtctagtatgtctcatcccctactagactgaagctccttgaggacagggatggtcatactcacctcggtgttgcccaaacctccaggccagtagcctagctagctagatacaggaagagtcacccaggcactgaattcaaggcttagaacatatgagtgattcttaatactaaggaatgctccactgaggtaaattatctccaaaaagtatccaatacatatttttagaactacatataattactttaaataggtacctgtagtataatttatggatatcttcttatatactactagcacaggtagttgagcattcattcattctgcattgttctgttttagaaatggtgtttaactttgcgttttgaacatatacaattaggctaccaaataggccaccattttatattataaaatgtcactatataatataattgcttacttggacatttgcatataacagtgtatcacaataactaaataggttattaatttttttcaaaatttttattatttccaagattttaacaaagaaataataagtttggatagccctttggtcgttaaaattatggtagttaaaaatgtttcccaaatcccattcttcttcttgacctcgaaagaattctccttccctaccttgaaagaatatttgcaagtagac

SEQ ID NO: 46707 - DNA, 1010 bp, Homo sapiens
atctctctcccctagcttctgacttagcatggcttacaagacccgtaataacttagtcccggctttcctcactaatctcatctaacacaaccctccatctctgtctccctcacactttgtgatccagcaatacctacttataattctcctaacacagctcactgcgttttcacatgctgtcttcactcccagaaatccctttcctgacctttgccacctataaacttttattcagttttcagaacccagctcagatgttacctgcttcaggaaggcttcctaatcaaccctgccccgaaagagagaattactcctttgccaccttttgaatacttctgtttttatatttaaaacatccattgcttgttcaggtgccattttgtggctactactttgtgccaggtactgttaaacccctggaggaagcacgcagggacattagtgtgctgaatccctcagagaagcatgtgcatactctaccctgttgcctggcctggagaggttcttgttcgcttgtgcatgtccccagctacactcagagctcttgacgggcatcattgtgtcttactgatttctgtagccccaatgccaagcttagaacctggcaccatataagtgctcaataaacatttgttgaattgaattgaattggagtctagaatgagacttaatactgtaataaacaagatactgtaatataacacataggcatgagaagctttattatataaacaataccatggttcagtgtgtgctgtgtcacctgttttcacacttggggacttcctccattttatgtgagtttttatgggtttgtttttcatgctgtattttagtctttttcctaaaaatcatcaactgcagggtccaggcctttcaccatctagcccagccttctcaccacatgttcaagctgttcaacctgctagacaggattccttttaaggagagtatttcaaagaagaattaagacctataggtagaagcacaaaggattcatccagtctgaa

SEQ ID NO: 46708 - DNA, 1996 bp, Homo sapiens
aaccgaggtttgctctccctccctgttctttgcctctctatagagggaaggacattggtattttatttatctaccatctaaccattcctcacccctaagtgacctcgaaacaccaaggaaatgaaaagtagttctcccaaataaatggaagcctcaagggttcaaatagttaaagctttttcctttgatactgaaaatctcagctagctctgttagattcttaagcagataacaaggaaaatttattttctaaaattaatcttctagcttccaaaggaaaattgcctattaaatggatggctccagagtcaatcaattttcgacgttttacctcagctagtgacgtatggatgtttggtgagtactcttaaaagttttgtattctttaaaaattatatttcatatgttatacaaaaaaaaattatctctttttggaatatgtaggttgatttgccttccctaacctgatcatctcctcatcagacttcttttgattcatttgacagtaaatagcctgacatctactgtgcatcagcttctgggcacagcttctgtaagggtccacagttctaattgcccagctccttccatcactcttcctttttgttcccctttgctgtctcttctttcctcacagggggatattttgcttatttccttctttcttttctctctctccctttgccatctcattcgttcctttcatatgaatgacattaaacagtaaacacttggcccctccaacccggaagtatctaaaattctaccttgtctctttattctggagtccagcctccttcctgacctatctcaagacttggaagtttgatcctttgtcttctgtagcttctgcttttttgataatctcatttgttcctcctcacctgctgcaaggtcatcattctcctgctctatggttattgcagttccttctagctggtgtagaagtgtggctctcatttattctttgctacttatttaaactactttatccaaatttttaaattactcactatttttaacatgaatggcacttccctccactctactctccatttttcttggtgttattccttctacccagaataccttatcctgataccttcttcttccagttgaaatcctacctaaccctcaaggtccaccttaaatgtccttgaaggcttcttcctttctttacctttcctacactttctctctttgtcataccactcatgttgatcctgtgaatagacttgtggacatgttatctctgctacattagaaactactttggaggagatgccctgttaagattatgtaccttttttctcctataaataaaaataacttgatccagtatgtgttcttatttttttcttctgtttacttactgttgattcttaattatcatttaatgcccccatagataactaggtaaaggaaagaactttcaaatagaacaggatatggcatgacatgattagaaaaagctctgaagtccagttgatgtgtgttcaaatcccaaggccttgattattatctgtgtgatccacagagcaagtaacttatcctttcagagaaatttcatgtttcaaaacttctaagatgcctatttttttacatgttaacatttctggaactggagtgtatcttaaaatcagtggcattttacagttggtaataattggaagcattattttaatgtagttgtccttgctttccactcaagtagagtttgttttgttaatattgttgttactgtaatgtctgaatgactttaaaagaactcttttggtaagaataaaataaaaattctaagagggaagaaagaattgtatcatactttagttttcaacattctcctcccttttttggtcttataaactaataaagtttcctagaatcagtagatgtgatttttgtcaaatgtggtaaaatgcagtgtttaaagaaacataaggttactgtgaggattaagggtaatatatgagactgggcacggtggctcatgcct

SEQ ID NO: 46709 - DNA, 1077 bp, Homo sapiens
tggaaaactcttaaactttcaaaacataaagtttacttatgacataattttatgttgcttccatatttacaaactgtagttatttgtaaaataattgctttaataactgtgcttttatagccttcatatattaatacctaaactaatagttcttaatagttaagcatataatttaatagttggggcaattatttagaaaactatcaaatagatataaaataaatcggaaatttaaaaactcctaggaacaacatgaaaaatatctacctttagtagaactcattgtttcagtagttcttctaataccataactaattacatgaattcctgttaaaatattgtttaagagaattccactgtgtttaaagcattttcatagattgatgtgccacagatgaaattttacttatggatgatcaagaaatacgtcaagtgttatttctacatttggaatattttacttaagtattgatgtgtgaattatgttttacagccagggattatgagattcaaagagaaagaatagaacttggacgatgtattggagaaggccaatttggagatgtacatcaaggcatttatatgagtccagtaagtcttttaagactaccaaacaactagactaattttgactatttaagtttaaattgcttttgtttgtcttcatgagtccttagttcttctaggtattaatatttacgggtgtcttttataaagctcttcataaatgtcagcttatacttggcgtattcagaaaccaaaaaatggcaacattagctcctacaaggctgggcctgtcttttattcattttaatctttcagcctttgtcatcagtaacagtttttataggtgactgttctttggatggaattagcaaatcagatgagagtcagaaacagccagtatacctatttacctgcatttttgagaaagaaatgttaatttgccccagtttaccctccaaaaaagatgaataaattttaaaaatgattgctttaataatagcttaatgaagtatcatttgcttactatgaagttcactcttttgaagtgtacaattcagtgcttttcagtgt

SEQ ID NO: 46710 - DNA, 1031 bp, Homo sapiens
tgtcagggaaggtcccactgagagagtcgcacctgaaggggtggaaaacagaacctacaaggatatctggctattccctattgaaggctggggagtgctaggaagcatgcctggaacagcagagacccaggtcactagaatgcctaagggggtgatcccagggccagtggctggtcaggatgtaaaggcattgtaagggctttggcttgtactcaagtgatttgggaagccattggagggtgtgaagagaggagtaatgtgatctggtttatgttctagaataagtactctggctgctgtgctgagaatagaccatggtaggttggcctgggtacagataaagtagagggaccaatcaggaggctattaccatgatgtaggcaagtgatgtttgggtcaggggttctggaatgacagtgacaagtaagaggactttggatagagttggacagtaaagccttgcatttgctgcactgggtatggattggggagcagcaaggccctgtgatgactgctggttccacctgaacaatgggaagtatgcaggtgcacccaccaggactcagttttgaatatcagcaagtcccagcaaccttcagacatccagagggaggtgtcatgtagacaagttcaggtcaggggagaggtccaagctagaggtatgcatttggagctgcaaagtgtgggtggtatttgacgctttgaaactgtatgaggttaccaaggaagtgaggttaagagatacaggtgtgagcactgggttctctaatcttcatcaggccagggagataaggaagaaccaataaagaagacgaagaggtgccatgagagggcagaagaaaaccaagagaatatagtacaaggttcgggaggcccagggtgggaagctctcagaaggacagagtgattagctgtgttaagtgctaactgtaaatgaacaattgggcttagcaaggcagatgtcattggagatgttcaaaaagtattttccgtgtatgggggtgggggggaactgattagaatgaattcaa

SEQ ID NO: 46711 - DNA, 1054 bp, Homo sapiens
agtgtgtcattatttgggattgtttttattgttgagttttaataacatgtctttaatatttttatcttttgcttagagttttatgagtagctcctaaatttaatcaaagacccttttagcatctattgatatgatcctttttctcctttatcattatagtagattatattaatagttatgataatattgagccaattaataatatacaatattcttttaaaatattgagttatatttgtagaatttttgcaactatttgtgagattaatctagacttttttatgttaactttattagacatggtgttaaagttatattaatttcattaggtgaattggaatctttcagtgatttttttttaaaaaaactttttaagctcaggggtacatgggcagatttgttatctaggtaacctcgtgtcacacagtttatcatacagattactttgtcacccaggtattaatcctagtactgattagttatttttcccaatcccctccccacttttaccctccaccctctggtaggccccagtgtctgttgttgccctctgtgtgtccttgtgttctcatcttttagcttcccttataagtgggagctaaaagatgcagtatttagttttctattcctgtgttattttgctaaagataatggcctccagctccatccatgttcctgcaaagaacatgatctcattcttttttttttttggctgcataatattccatggtgtgcatgtaccacattttctttatccagtctaccatcgatgggcatttaggttgattccatgtcttggctattgtgaatagtgctgcattagacgtacatgtatatgtgtctttataaaagaacaatttggccgggcgcggtggctcacacctgtaatcccagcactttgggaggccaaggtgggcggatcacgaggtcaggagatggagaccatcctggctaacacggtgaaaccctgtccctactaaaaatacaaaaaatcagctgggcgtggtggcatgcgcctgtagtcccagctactcaggaggctgaggcaggagaa

SEQ ID NO: 46712 - DNA, 1034 bp, Homo sapiens
tactgtaaacagttctgcagtgaatctttttgttcctgaatctttgcatgtatctctaatcatttctaaagaataatgtcctggaattttattttatggataagcattgtggtttttttaaagtttttgatttgtgctttccttcagaaagatatactgtttttttccctcctaacagtggaatgtgcaagtacctttatacctttggcctggtgttttctgagtcatgtgcacatatagtacaaacttctgtttaagaaataaaactctatatatgaactttacagttaaaaatggttaagatggtgaattttgtgttatatgcattttgccacaattaaaagaataaagctttgataaatacatttatagttatttgacaagtatactttttggcagtaatttgaatgtaggtgttagtaagtagttggtaggaaagaaatcttaccattattgttgtggtctttactcattgctgatttttacaagatgttttggtaattttgtcatgcaggccaaaacactaagaaaactgatccaacaaacatttagacaatttgccaaccttaatagagaagaaagtattctgaaattctttgagatcctgtctccagtctacagatttgataaggaatgcttcaagtgtgctcttggtgtaagtatgggaatatgggaaatagtgggctagtttgattttactttttcttgtctcttgctgtatatctaaatttctgatgaaaaaatgctaacttgtcccatttttttcaataaaatgatattttttcattttaccatgtgaaaaatagaaaaagaaaataattaatgtgagaataaaatcacctttttaaaaacagcatgcctagcttcatagttaggtttttaaaattttatccctgtgatttgttaattgttctctaagggctagtttacctatttagataatcatcccagagaaacccttggcatcaggcatgctggaataagcacagtgcactttgtgcaggcttaacacatcctgggtcaatgaagttata

SEQ ID NO: 46713 - DNA, 1062 bp, Homo sapiens
gcacattgtaaaccagtcccaaacacacagatcatggagagaggcgacctcatattaaaaatgggacagcctacaagtccctgtttggtttcctaaggctttaaatttagatatctataataggctttccctaaaaactttgaacatagtaccttaggtgggctcagagtcctctatcacaaaacctgaagtagtttgatttcgagattaaattaaaatgtgttaaaggcagcgttgcagaatttttaccatgaccttgtgtacttgagcctcatttttattttctcaactgccaggtatcaaaaaagttctaacatatggacaaacgttacaaattcattattagtcaaaagaagtttaagaaaacctaaactgtatatatgctaattattagccttcaggtttcttttttttttaatggagttgtcttcacctttgaagtaaaagcaatacctagtattcgtctttattttcaaaaaacatatgcttcctttcatttttcttgaatcatacaacacttttggtttatctttaactttcttatttgtgacagcaatgaatatggtaagttctttagttatgcctggctctgagaaaaatagatgtgtagctgggttgattaatagcagttgacagccacacagtggcggagaggatattccctgccctggtctttccctcacccaaatactgacgtgtgtgttgccttcttgaaacatggccagttgccttcttgaaatccctactagaagggcgtgcacgtacaccttgcccatgggtctgttttaggccctcacatgtctaaaacagaactgttgatgcccacccacctttctgttctcggtgcgtagcttcagcattccctcacacctcatgtccagtcactcatccctgttgcctctttgtccacagtagcccctcaatctcaccacttctcaccgcttctcctgtccaccagcaaacctcaggtcaggccatgcctccctctgcagtaaacagtgagacacagggcatgtggaccagaagctgtccagacagcagtgctttcttctaaggcagaac

SEQ ID NO: 46714 - DNA, 1635 bp, Homo sapiens
cacatcattttttcctgttattttagttatatcttttcaaaattgaaactccaaatattagacattattattattttatacagttattatttttggctttccctacatgtatatgattttatttcttaaacatcctatattgggccaggtgcagtggctcataacctataatcccagcacactgggaggccagggtaggaagatggcttgaccagcacggatagcatagcgagacctcatctctacaaataattataaaaattagccaggcgcggtggcacgcagctgtggtctcacctagtcgggaggctgaggctggaggattgcttgagcccagcttgttgtggctgcagtgagctatgatcatgccactgcactccagcctgggcaacagaggaagaccttgcttaaaataaccatttttgtatctcagaccacccttctggtatgcttttccttttattccaaatatattgttctgctcattgtttttttctcaacactgtaaagatactctgttatgacaagaaatgtctgttgacatttctttatggttgctctttcttttaaggtccttttcctacttttcatcttttctagttttattcatgtcttgtgcttcgatttctttttataaatccagttggaataagacatacttctcaattctgtagattcatgtttttcatctggaaaatatatgccactatctctttaataatcaacagatatatttctgatctttgctgtctcttacatttttcgtgttttctatctctctgtctctctggattctctcttttttgggggagatatttctttggatttgtcttataattctttaattctcttaagtagtatctttatgccatacgttgttcattgtttttttcattctaccacttatattttttcatttctagacattccatttcatgtgatgtaatcttcttcatgcttggtaacctctggtatgcccatctgtggtgtttgtgccgtttatttcttcaagtttttatgcatagctgttttctgttctgtatttgacaataaccttgaggtactggggtgtctcaatctgctgttactctgactctcactcaggccaccaaagtggcttggattagaggctggtggccctagactgggcaagctgagttccagggggctttgtttacactgctgcggcttctggcaagagccaggaaatgatgccacttccgccttcgtcaggtccaacctcagtgcccaagcgccgggttcatcatccccaccttgcaggtaccgtcggtccagaaacccaaaaacagtttcccttctgcctgtcgtgctttgtgttagtgtgtgtgtgctgggggcgtcctagaaaccggcatgtttatcaccctgttgcctaaacattcttcattgtagctcaatctgtttccaacattagtttcccttttacttttacttataagttttttttttgtttttttttttgagacggagtctcactctgtgcccaggctggagtgcagtggcgcgatctcggctcactgcaagctccgcctcctgggttcacaccattctcctgcctcagcctccttagtagctgggactacaggtgcccgccaccatgcccagctaattttt

SEQ ID NO: 46715 - DNA, 1023 bp, Homo sapiens
acttcaacataagtatcgttaacctagaattcagtattcaattatggtttttgttttgatttatacacagttaaatatataaatattaagtatacatttattgagttttcacagatacatacaccagaataatctgaatgcctctggaatgtagaatatgaccatcaccccaggaagtttcccactgacccttcccagtcaatccttgcccccagtcattgccccaagcaaccattgctcctgtgtttttcccaccgtagtttagttttgcatgttttagaatttcttataaacagattatgtagtgcgtatttttatgtgaagtttcttttctcatgtttttgagatttcagtagttttcttgttgagtagtattctgttatataaatatatcgtagtgtatttatccatttttctgttgatgaacatctggactgttttgttttgttttgttttgttttgttttgttttttactattattgagatgactgggaacattctttggcaagcatttttgtgaacatgggctgggactttcatgttaaatgaaatttgtatctaccctttgatcctttacagttgtgtgattttatatttcctccagtaatgtatgagagttctggttgctctgcattctatccaacatttgatgttgtcattgttttgttttagccttttgactaggtgggtatgtggttgaatcgtggtggtttttatgttcacttctctgggtaccaactaataatcattgtttatgttgtttattcttccatgtgcatattgaatgttagtaggtctccttttttgaaaatctgcttaaacctttttgtacaatatgtattgtaaaatcgtacgctttttcttcccaattttttttaaattgtggtagaacacacacttaccatcataaaatttaccatcttaaccatttttaagtgtgcagttcagcagtgctacatacattcataatattgcacaaccatccccaccatccttctctgtaactcttttcattttataaa

SEQ ID NO: 46716 - DNA, 1068 bp, Homo sapiens
tggagacagtaggtctacaatcatttcttgagctttaatttaaatacaattattatgcctgaatagcaatgaatttgtcataggtagagattgttgcagagccaactatacccatataaaattgatctgctttgctttttaccccgtaaggcattagatagacaataaatacatgtaaggtaaaatgccaaaaatgctaataaacatcagaaagacatttgtacatataattttgtcattaaatgtacttggtaattttttttgctttaataaaaatatttattaactaactattctggaccgggaatgcagaaataaatcgcataatccacacctttaaattcttctgtctagtggaggattcctgtcatcagttgctttgtgtttgagcctttgctgttagtaagcacaaatgacgtgactgtgcatagaagagtctgctgacccagtatagatttggtattgagatggctccactgaaaagcatcatttgaggagtcttcaactttgtagaaaaggaagagttgtgttttctagacaagaacacggaggggagagagaaaatgtggtgcagtcttagctaaaatagttcataacattttggtgagagagggaccacaaacattatgtaaacaggggtttaggttttctcctgcagatattgggagccatttaaaaacgttagttagcaaatgccgtaaccagaatttttttttttgagaccactctgattagatggcagtatcagggatagattgaatttttaaaaggttgcaagcatgtttagaggctcttcaatcattctggcaagaaattaaataaaagtgaaagtatattataataagcaaatttagtggatggatttgataggacccagagattgaactaaaacagaatatgaaaataaggaagaaaaaggcttattatgtaagtctaggcacttactgccatgaaagagcaatggtggattagattcaaaagaaggaggtaagaaggtaagttgttctatatttttctatgtgagataatgatagatgttaccatttaaaagattcaagctgagagagt

SEQ ID NO: 46717 - DNA, 1095 bp, Homo sapiens
aagaccagcctggccaacatggtgaaaccccgtcgctaccaaaagtacaaaaattagccaggcatggtggtgcacacgtgtaatcccagctacttgaggggctgaggctggagaatcgcttgaacctgggaggtggaggttgcagtgagctgagatagtgtcactgagtagctgggactacatccttacgccacaacacctggctaattttttgtattttagtagagacagggtttcaccatgttggccaggatggtcttgatctcctgacctcatgatctgcccaccttggcctcccaaagtgctgggattataggtgtgagccactgtgcctggcctagtatggtttatttttttaaagaaaatcttggttaaatagttgttttgagacaaggtcttgccttgttaaacaggctggagtgcagtggtatgatcatagctcgctgtagccttaaactcctgggttcaagtagtcctcctttcttagcctcccagttacctaggactagaggtgtttgccatcacactcaactaatttttaaaataatttgtttgtacagacaaggtctcattgtgtactgggatcataggcgcatgccatcacggttggctgattttattttattttagtagagacaaggtcttgatatgttacccaggctgatctcaagctcctgggctgaagcagtcctcctgcctttgtctcctaaagtactgagattacaggcatgagccaccatgccccacttctgattcaaaggtcttatttcaggttttattttgttattgcttttaatggttgtcatagctaaaagtattcttgacaaagatatgcataattaaatagaaggggtaccagtatctttgtgtgcttaatgatgatactgatttttcattgccagtcaccaattatgtaaacatttgttgaaatttggtcaataaatttccatattccatgatcattcctttcagtataattgattttgaaatatattttcatattttaacatcagatttttttatttagtggagaaattttgaaatgttagaaaattttgttttcagattttttatgagcagtgcatccactccttt

SEQ ID NO: 46718 - DNA, 1032 bp, Homo sapiens
ggtcagtaactttgaaggatctagattgattagggtagacattttaaaagacaaacatgttaaggtgaataattttttttttttcttttttgagacagagtctcgccctgtcacccaggctgcagtacggtggcatgaacatggctcactgcagcctcttgggctcaagcgattctcccacttcagcttcttgagtagctgggactgtaggcacagaccgccacgcccagctaatttttgtattgtttacagagctggggtttcagcatgttgcccagacagatctcaaactcctgggctcaaacagtctgcccaccttggcctcccaaagtgttgggattacaggtgtgagccaccatgcccagcctgaataaatcttatgttgaataaaaccctacgccagttacagagttcatcaaagaaatatagctgtattttcaaatttgtcaggtagctggtaccaagctaacaaaatactccttgagaatatagtttcattggttcacatcaatggctagagaagatttgacttccaactatttagtcaattaagcaagtgagcattccaaaacaaaggatatgtaaaagttagataaaaatacctgcagggtttttgtgttgttttgttttttgagatggtcatcttgctgtgttgcttgggctggtcttgaactcccctactcaggtgatcctcctgtgtcaaggtacttttatttaacacaagtctattatcttggtttatatggacatgtcagatgcagactttgttataatgaaatccttagtgctcaataaaatggtcattgaatctaaatctcttagtagattgttgttgttcttttaagccaatttatttactttgtttcaagtaaaattgaataggcactgctttactgactgggtcttgaatcctcaaaaggaagaaaaatttaggtggggttatatagaatttctcacagattgaccctactagatgaaagggtgatcgggatactactgctcataataatactaatgatgatgatgatgatg

SEQ ID NO: 46719 - DNA, 1102 bp, Homo sapiens
ccccactttactgatatctctgtacctagcttattttttaaaaagacattacaaggactagaacaaataatttcatgcccatacaccaggcaagtactgggcaaatactgtatgatgctgcttaagattacaccaccattgagtacttggacagtattcttatcccattcaaaaccccttaaaatttttctgactggtacattgaacttttctaaataaatagcatatcctcaggtttcagtactagtcatgagtcagtagggaatggttggtaaatctgaatctgtaatagtaaatggaaaaaaatcagttcatgtagtttgttaaaatataggtgtgttgggttggattaatactaattactgttaccaagctggtagtgggaagactggtaatgggaagtaacgttgtgttcaatttaaaatcatccttctgataggaatgggaaaatgtacagtgatttgggattctgcaagaacaaactatgctataaacaactggtatctgtaggggaagggaattcttcagggagttttccctgagtttggccataggtaggtgcctggaggacttttcagagcagtccaacggtcttcagtgtttattgttaggtgtcatcactggacactttgtgtgtgttagaagtgtaagctgttctctctgacagaggagcaggtgaatgtatgtttaaaaacatttaaaaacaattgattattaataacaatcaattgaacattgattgttacggattcaaatagttttgattctagaaaggactatggaggtcttagaaaattaaactcttcctttacaggatggaaagtatcatctaggaagaaagctagaaaggaaagctttaagaaaaagcataaaagccatgttaaagaggagaacctaagctaacagagcacgaggaagaaaaaattttgaattcaaaatcctgagagatagtgattgaggtagtgatttcccataggtagaatgttggctcctaaagatgcctacatcctaatccccagaacctgtgcagatgtccccttacgtggccagagggacttgtaggcgtgatgaaggctacagaccttaaggtggggagatcatg

SEQ ID NO: 46720 - DNA, 1074 bp, Homo sapiens
tgccccccaaacagctcagggtcccatgatcacaaacatcacttatcttggccatagctttggccaagtgtcagtaccgtgcttcaggcagctctagagataagtgtggggtcaatctagaacagccaagagaaacccaggctgtacaatgttgaataagaccagtcatctagaaacatggcagtgataattcagaaaaataatgacataaaattccaaattctaccagagaaattccctacttaggagaaagaatgacgtttacaccagacttttcatcagcaatgctggatgcaagaagacattggaacagtatcttcaaagggctcagggaaaataacatgtactttagaagtctatatcagataaattattaatcaagataatgtgaaatgaaggtatctgcagagaagtagtgacatagaaagctaatagcatgggctctctttgaaaaaacaattagatgatataatgcagcgtggaaaaaagttgagcccataagaaaatactgtagcaggatgcaagagacagtggtccattgtcatacttgctgccttgtatgctgtcttgtacctctcttaatgtccccgtagtctcttgaatctaccaccatgatttaatccaaccttctgcctattctccacctgtcgccatcctgtgattggttacattctagatttgcaaccttagtgctacccagctgtcatgctctatccccccatcttgttctctcctagacaaccatttcatacctcgtccactttcttcaacctgcagtacttggaaaagtccacacatttctatatcttccctttccccaacatttgtacctcacttctctgtctttacacttcttgctacaaaataaccatccagtgctccagtcaaagggttacctcatcttttagttactcagatccatttgcaatcgtcttttattcctcttttgctctcaagccatatcgaatacattagctaatcctgtccacattatcttcaaaaatatatccagaacctacccatttcatattgcctccactgctacccctttctttgagctcttcttcagtagct

SEQ ID NO: 46721 - DNA, 1050 bp, Homo sapiens
ggctgagacaggagaaacacttgaacccaggaggcagaggttgcagtgagctgagatcgtgccactgcactctagcctgggcaacaaagtgagactgtctcaaaagaaaaaaaagaaaaaaaagatttaaggctaaagtcttgtatataaattttacataattttttgttacctctaaattttaatattagcaaactattcaaatggattaattattaaaaatatgatagcctctttttttttacaaactctttatgaagctggttagcttttttgcgttttctgttttttttctacttctgtgttttacttttaactttataaaacactgtcatttggtagaaaggcctgcaatgagcatcctgccataaggtttatcagataattcatactggaaaaaaaccttgtagatgtaactttatgtaaggcttttagtgtatgttctagtctttgtagatttcagatacagtgaatgaggaaactctccaataaaaccattgtatcagccctaatgaactctagggcattcatacaggagggaaacctttcaaagattatgaatttgacaagacatttagcaaaaatgttcaagacttacatcagaagactcacctaggaaagattttaacagatgtgccatggttttagtatcaaactttctgcatgtaaggggattactaccatagagtcagtgtcactgcaggcatgttagcctttagccaatgttaaaaacttcctagtcatacattcatattgtgaagaaaaatttacatcagatacaaatgtataagttatcagaactcatttagcaaacttgtgaagatcaatctgatcaaatctatgtggccacaaacaacgtgttttatttcacagtaattggcaaattatcagtcagtgattttcagattgaggcagaaaaatcacagttggcattgaattcaccatagccctttcctgggatagcatgaggttctcatgatactgagtcactgtaatggaagattggatattattcataaccaacttccattgaatgctttaatgctataa

SEQ ID NO: 46722 - DNA, 1057 bp, Homo sapiens
aatatttattctgtaaatcaggtcctactctgggtatggggagagacagctattattttagtggattaggtctctattctcctcagactccttccgcatataacatatcaagagagagtataggacatttgatataaacaacatatcacattgtaattggtagatttcaagtattatacacaaaaaattattttgttcttttaacagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcagggtaagtacgtttttccatgagacatctttaatgtttatttaggttaaaatgtaatggcatgtatgaaaaaagatagtgtaataatttttatttaacttatcggggacttttcatattacagaaatgctatttttaattataagatttattagttaatatgtgactgaccagcgttctaattgttgtaaagtttcttagaaaaataatgactgaatcatattttagtcataaaataccattgacttatttttcccttctaggttttttttttttttaactcttggatgagtactaggcaacaatgcaactaaaatagcctctaacagtcatgaaataaactacttttctagaaagtgtaatttggaaggtatttgcatgacttcagataggataatttcctttaaaactcttgaacatatgctgtgtgtcaggcactgtgctaggttctgaagatgtaaaaggtccctgtgaagtccttgatcttacagcttagagcctgtagagggagagacatcatgaatgtgattatagtacagtgtagaagtgcttcacgggaggttgttgtggaagcttggaggaataataccttttaaacgtagaagttagtactggaaaggatttcc

SEQ ID NO: 46723 - DNA, 1028 bp, Homo sapiens
aaaaaaactcttgggtgctaggcttaatacctggatggtgaaataatctgtacaacaaaccctcgtgatacaagtttacctttataacaaaccttcatgtgtacccctgaacctaaaataaaagattaaaaaaaaaaaacccaaaacttggttctttaagggttagtgatgctgatttttgtaaagtgttcacaaatctttgatttcagattcatctataattgtttaaactgcaaggaatttattgtaaattcaatggttttctgtattttttttaacagttttcagttagagaaaaatctaactttaaaacagttatccctgaatattttaattttgcatttgaacattatttgcatacatttttataatgtcattgattcgtagctcacataattttagagttggatttaggtgtatattaacttctttacctagaaaagtaaactaaaatacatttgtatttttattttatattatacctttcttaaaaactgtataaaatgagtcattttaagtgttttatagaagtttgacgttgaacccaatgattagtaaattttttctttgactaaaacagtaatgaaatctttggttcatttggtgatacctttggttgattttccacgttcttattctcatagattttggttatttctttgttattgattacagtgttcaactgaatttgttggcttgtggataggaagtctcagcagtttataagttgaattaatatattttccttttttaaatattggggcagtgttgaatctatggattgatttgggagaattgacttatgaacaatattgaacaatacagtaatgaacattgtatatccagttatttaagtcttgtttaatttttctaagcaatgtgtgatagatcttaatgtggtggtctgggtgttttttgatgatattgtaaataataatttttggcttttaagtttaattttctggctggactcagtggctcacacctgtaatcccagcactttgggaggctgagctgggcagattgcg

SEQ ID NO: 46724 - DNA, 1035 bp, Homo sapiens
ctagcttgctcatgtttttctggagcccctttcttcccagtgttccctggggtcagagttcatgctggtgaatgatatgttttcagtggagcatagaagaggtcacttgaactctggctactattaggagcctgaaagtaaacctagagacaaagccatcatcaagagtagcatgttagaaatgaaacaactgtcctggggcatcactggacacaaataagcctcttgttctcctcagcctttgttaagctattgttttcagaagttagtgacttcataaacaaagcctcggtcattttcactgttaagtaaaatacttgatttttgattggtttatacaaatgtactactaacaaaattacccacatttaggaaagctagaactgtagagtctcagtgtgtcttatgtacattcggagaacaaaggcaccaggagcctagttactaattatcttactgctaaagtggaatgtgttcagacagctaaatttttgagatgaccttgactgtctcacagtttgaatggaaaaactaagtagctctgcattttaaaaagttgctagtacagattgtaagggtgttttctgtctgtcttctttagtatgagtttattactcacttatgttttgaaacgaagaaaggaaatcatgcctcttggatacctcaatattccctaagctaatgttaaagaatgtggctacctcaaattcttgattttatgttttcgagagagtttttaaaatttatacacttactatgacagtaccaaccaggaaaaatattttacagcaaaaatatttgggtacctatagacatagagacatagatagatcaggaatttttttccagaaaggatttttatttcatcaaagtaattattttaactctaaggtcataaagaattaggttagtaaaatgacaaaggcatgactttgaaaacaaaaaaggtttgagaagccatctacagacatgatctgggtcagacttgatttgcagcttactcaattttagaatcggttgtcagttttgtaaaca

SEQ ID NO: 46725 - DNA, 1035 bp, Homo sapiens
tatttattcattccccttctatcaaacatgtaggctgttaacagtgtttcagtattacaaataaacatattataagcctcaaactgccttaaaactgagaggagatttattggaggtttagtagaccagtctaccagaagttagacttctgggtactcagatttgtttgcttgtcttctgatggtctgtcaactccttatgggatgggactctgtccaattattttgggatccctactgcttaatttattgcctatgcacagaagaggcagacagtaatgatgcacttacagtgacatggagcctttgttatgggcgctctcaaagccctttatgcttgtaatgtttaattatcataactgaaaaatacataccattttaaactttatttaaccgacgagaaactaagttatggagagaaagttaaaaaaaaaaagtgccagggtcacatatctaataccatgtggcagagtttaagttttaggatacttgaaataaactgaatggacctttaaatttagggtgatggaaaagatgatttgggctttggagttgcatgcggctttgacattttacttttacagtctaattgtatcacaagtccttacttgtgtatgtgagcctcagttttctttttcttgaaaatgatgatattagtaattacctccaagtttattagggggacacattttaaaacacacacacataaagccaccttgtacagggctggaacaatataagcccttagtcagtgattggttattgtctctttttcctgtctctttcgctttagacttgttcttaaactctcaaagcttttctcttcatttataaaagtaaacataattatatttgcagatttgttgtaaaatataaatgagatttactctttaaaaatggttttaacattttttaagttaaaaaattgtggccgggcgcggtggctcacgcctgtaatcccagcactttgggaggccgaggcgggcggatcacgaggtcaggagatcgagaccatcccggctaaaatggtgaaacc

SEQ ID NO: 46726 - DNA, 1084 bp, Homo sapiens
tctcttacgtggtctttcctctcccccatcttcctcgtgtagttctagaacagtttttgtttagatccgtattttcgtttttaattattttgacttttaaacataactcagtattgagccaattgaagtagtatggttgcatttcttgttcagctttgtttttcttgttttcttggactgaaaattgcagttgtccctcttgtttgcttaatattcttaggtctggctaaggtttcctactctgacagctctgtaagtagggcctctcaattagtttccatgcagtcaagtgtattcattttgtcttcaccccctagacacacccctcctggagctttccttctccttttccctgcttcagtctagagaggttgctctctagacctgctgtaaatggtaccagggtggagaaacctgtggtaccagcaaaaataaggcgagaacaggtaagacaggtgagtagaaaatactgattgaaaaaactgatgggaaggacagaggaggaatggagatgatgtcttcttggggaattgtgttaaggagaaactagagttgaggaagagcattctaggtagtgaaaatggtgccagaaaaagcatggagatggaagtgatcttttattttttggtgacttgaaaagcctgtgttgtgttaccttcttagattatatgtatattaacttattgactttgccctgaagagcttttaaaaaagtttaaatgggaattgtgacaatcaggccctgaggagctttaaaaaagtttaaatgggaattgtgacaatcagaatgttaaacattgatatattttttgttttgtttttttttgagaaataaaggtctcattttgtcacccaggctgtagtacagtgagtggcatgttcatagcttactgtaaccttaaactcctgggttcaaatgatcctcctgcctcaacctcccaagtagctgagaccacaggtgcacaccactgtgcctggctaatttttaaaattttttgtggaggaaggctctcactatgctgcccaggctaatctcaaactcctgggctcaagtgatcctcctgccttggcatcccagagtgct

SEQ ID NO: 46727 - DNA, 1051 bp, Homo sapiens
agtaaactagagaaaaaatattaagaagatcataagaaatattaagaaatatagaaatattaagaaatattaagaaaatatacttattaaatggaagtggatcttcataaacatcttcattctcattgtcttcatgttgagtaggctgaggaggaggaggaggaagaagaggggttggtcttgctgtctcgggtggcaaaagtggaaggggaggcaggagaggcaggcacactcagtgtaactattattgaaaaaaaatccccctatacgtggacctgtaccattcaaatccatgttgttcaagggtcaactgtactttaaatcatctctagattgcttatattgccgaatacaatgtaaatcctttgcaaatagttgttatactgtattatttgggggataatgacaagaaaagcatcagtacatgcttggtatagatgcagtcattcatttttttcctcaaatattttagatccatggttggttgaatctggatgtggaacccgctgacgtggatggctgactgtattgtatgttaaactttatcatttgtgacttctctgttttaaatgacctgttgattttctgatttgggatataaaggtttagcttatttatgttattccccatatctcttcctgcattacttattgttaaatagttgatatgtgtatttttcttttagaagtcttctgttgtaattttaccaatatctttcctttgcttgggttattgattcatgtcaatatcttgattccttttaagataaagatagtattgccctaaatattgacccttccccccagttccagcatgtctccctgttctgcctcatattttgtttttgttatttcttttatgttgggatttttacatttgtattttatctgcaactacaagtgttctggggactgctcatgggttgaactctaaaactagtttattatttttaattttaagttttcttgagctttcccagcttagctttctttcaaggccagtttttctctttgttttctccggtatttgtttctttttcatgaaggtggta

SEQ ID NO: 46728 - DNA, 1028 bp, Homo sapiens
tgtacttaacacaaagaatagggtccccaggagagcacttaaagggcaagcagaggaagcctaggtaggttgggttggggggggggacctacaagggccaggaagtttgtaggattgccatgagtgaggagtgtcactaatgctgggaaaggagggtggacattctgtggtttttttttttgagggagtctcgctctgtcacccaggctggggtgcagtggcgtgatctcagctcactgcaagctccgcctccccgattcacgccattctctgcctcagcctcccgagtagctgggattagccaccacgcccggctaattttttgtatttttagtaggtttcactgtgttagccaggatggtctcgatctcctcacctcatgatctacacgcctcggcctcccacagtgctgggattacaggtgtgatgactgtagagtatgctcgagctgtgtgtcctatacaggaggcccctcaggcccctcacagagtatgtgtgtttgtagtaggcatagtatactgatagagcttttggcattgctggatgcttgtacacagttttctttagctctttactatgggactgctgtcttcattgccacacaaaacagcaagaatttgttgaaatgagtaaaaataaccacataatttttttccctccctccctcccttcctccctcccttcctccctcccttcttcccttcctcccttcctttcttccttcctttttttttttttttaaattttgagacagagtcttgctctgttgcccaggcagtggtgtgatctcagctcactacaacctccacctcccggattcaagcgattcccctgtctcagcctcctgagtagctcctggctaatttttgtattttttttagtagagacggggttttgccatgttggccaggctggtcttgaactcctggcctcatgtgatccacctgtctctgcctgggattacaggcatgagccaccacaccaggcccagatatttttgagtttaaagatactaactcaataaattg

SEQ ID NO: 46729 - DNA, 1075 bp, Homo sapiens
gtgacagggtgcaatgtgcttatttttccttatctaaacctgaagctgttcacttcgcaaactgcttctgttactcaggtaatggtcaccagtttcagctgggccatgatgctcaaatgattttgcgtccctgatcagttacctcttccagcccccataggagttgctgctcgaattatttcttgaatttggcttatagatagatcctttttttggtgtctgttcccatagtttcttttggtgtttttctcaggtagacaacatggcccttaccatatatcatgatagccattagttttctcaagtatgatagaagagttgtcttgtgttgaatgtattgactatgcctattgattagtttaagtagaataatgtctctttgacattttaagcctttcacacaatataattttgtggggatattttttacaatgcagaatagaacagcggtgaagagcacaagctgtagacagatttttgctttgcattcatatctgatccttgctccctgtatgatgttgaccaagctccttaaactctctaatctgttttttctcttctgtttagtagagattattgtgaattgtaactcttttgtaaatgtgatatatagttcttagtgcttggctagtcatataaataattaaaaacgattttttttttgggcaggatcaactcgatgttcataagtacagttcctaacagtgtagttatttctactgtgggaatttaagggctaatcttcatcattccctgatttatattgatctaaaaactggaaaacagtttatattcgtcatttgctatgcatacaaaatgggcaagttattactgttaatattggtttttaaaattcaataattttacagcctcttttagggtattggtttagtcagtagcttagtaccagttagatggcaaaccgtgtactaagcatcagtgcagagatagtgaatgagacacagtattcccacctttgagcagtgccagtctagtattagaatatttttggctaaaaaattattttgaagcataaagaagcttttgtttgctctggtgattttcataacatatt

SEQ ID NO: 46730 - DNA, 1050 bp, Homo sapiens
ttactctccagccccatccaaaggtcaagcctggtgtttgctgtgggtcagggtccccaggtaaacaaagacagctttatcggacgagcttccaagagcttaaagattacctcccaggatctgggcaaagggccaaacttttctttgagcaaggcggttaatcctttactgcataagccctagcaaagcaaattattatttctgtcattactagggagttcaagaaattattattgctcctagatataagatatgttgtaaccacatacagtaacatttaccacgaaactgaaaaattagaatttctacacacaggtgaggatgtctccagaagtgtgtcatacttgacatctgttctaacatttctatcagggatttgaataaagaacaggagtcacactgggagacagttcatttttagaattttagatttttaaaatattttgacaggtggtaatgaagtggtaaaatccatagggtgaaatttgtcagcaataaatgtaaaatggcagacttagtttaaaaggaaaagcaactgagaaagctaaagctggacaaaacgtgtcttaactctaccagtgtgcggaagacctgggaatctagttgactaaaacaaggatcggtgaacttttttgtaaaggggcagatagtgaatattttaggttttgcagatgaataggcaaaacaagaatattatgtaggtatttaaataatgagagaaaacaaatttccacaaattttcatcgactgaattcaaaatataaaaacagtaattgaggctgggcacagtggctcgtgcctgtaatcccagcactttgggaggcggagggaggcagatcacttgaggtcaggagttaaagaccagcctggccaacatggtgaaaccccgtttctgctaaaaatacagaaacttgccaggcgtggtggcgtgcgcctgtagttgcagctactcgggaggccgaggcaggtgaatcacttgaacctgggaggtggaggttgcagtgagccgagatcatgccactgtactccagcctgggtgacagaatgaga

SEQ ID NO: 46731 - DNA, 1038 bp, Homo sapiens
atagactgtatgttcttttaattatgttgtacatataaatgaaggacttaagggcacaactgaggaaatggagagtagggattgatgtgaagcctgtttctgagttcatctacaggcgtgactaagtaagtgaaatggcaaggctgagagagaaggaatccagcgtaattccaggatggcttccagattttttctttggtgatgagttcatgaagatctttttgctcttaattttttttttcctggaatatcttagtgattgctttgatgagggaacattgtctcttaggtccatgaacccctgaaattctaagcagaattgtgtgtgtatgtgagctgtttttccctggggagagaattctagagctttcatcacattatcagaaaggagtccaaccaaaaggaggaatcactttttgttagattgtacacatctggtgtactctaaaggtttgtgttggcaagggaaacatcatcccaatcacaggatttttactttaaatgtaatgcatctcaaactgccaagtaaaatgcaaacacatgcaactgttttctaagttgaactgtatcaaccagcaattggaatgtttttccctagtttctcctcctttccgaaagacagaataagacacatttttggtacataaaaagcgagctggagactgacgggcatggaatgcttcaacatgctatgaacattagagaaagctaaagtttgtagagtattaacgtatcttagtattcatgtggctatgagagatggtgtcacttttaggtaggatacaccagtaccataaatgagtgtagtttcctcagttggattagaaatgtgtaaatagtgagttgtaagacaatccctaaatcgtgctgtcatgatgagcccttagttgagcaaagcaggagaagcagggtggccgccgagcagttgttgagatatgagcatcaggcagattcgtattgtgttctggagtctgcactggattggttcatacttgatgtcagcattattacatgtaatttagggattacagactacag

SEQ ID NO: 46732 - DNA, 1035 bp, Homo sapiens
tgtcaccatgtgtggctaatttttgcatttttagtagagacagggttttgctctgttggccaggctggtctcaaactcctgacctcagaagatccgcctgccttggcctcccaaagtgctgggattgcaggtgtgagccaccacacccggcctagattttaaaataagcatctgtttgtttctttttttagttgccactagtaaggatgatggaaaactatattttgtactaaggattttgaaagatagaattctttcaagtgagaattctgtgacttttctgttaaatgcgtatttaataactaaaaatacaaagcttcaatgtgaaaaccttgtagaagttttcaaacatatacagaaacaatgttgtaatgaattccctgtttattcattaccactttcagccatggttattatttaataagtattgttaactctttaaaggtactggttcatacttaaaagttgtgaagtaacttgcttctgaaaacgtacgctaacattggacaactcctgctaaaatgtgacataattcatgatgcatttctttaaaaaagatagggaaggaattgaatatagctctgctgcttttctaaggttcttctgtgagtgggtgatgcagctgactgtcctgtgtctttctttctttctttttttttggagattgagtcttgctcagttgcccaggctggagtacagtggtgctatctcggctcactgcaacctccgcctcccgggttcaagcgattctcctgcctcagtctcctgagtagctgggattacaggcacccgccaccatgtctggctaatttctgtatttttagtagagatggggtttcaccatgttggtcaggctggtctcgaactcctgaccttgtgatctgcccgcctcagcctcccaaagtgttgggattacaggcgggagcctccgcacccagcccccgtatctatcttaatgatgcagtgtgtatctatcttaatgatccaatgtgtatcttaatgatccagtgagctaagcaaggcggtggggactct

SEQ ID NO: 46733 - DNA, 1056 bp, Homo sapiens
ttttcttttagtctttttcagaaggagggttggaccaaataacattgcttgaaattaagaagccaaaacgcgttcttttttatttcactccagagtctagacctgaacctgatgtttgatatggtaactgctagccacatgtggccaattaaattgaaattaattacagttaagcgaagttgaaaggcccattcctcagttacactagtcccatttcaagtgctcattagccacatgtggctagtggctactacattgggcagcgctggtatagaacattttcatcattgcagaaagttctagtggatagatatggcttgactatcaaaacctcatcagggacttgcactggtacgtggatctgcatttgaaaaccactaatatgggtatccttgctgtttaaagtttgaattttttggaatctatatagctagacagatgattgagttcctttaatagacttactgtgaaatctatccctaaggtacagtgtagattcttagactgatttaggtggtgaaatgtgaatctgtggcacactgagtagataactattaagtattgatattttaacttacaaatatgtcagttttaactgagaaattttgtgaaagcatttattatatgttgatctgtgtcttagacccagtgtctcccattgcacttgccctgccatccctgcccttaggcagtcatagtgctgtgcaaagttgcagggcactgtggggttctggcgggggtgtcacagcacccactcttgagggaacaatgggaattagccaggtggggagaggaattagccaagtggagaggggaaggatgggggaaaaggttctagggagaagaaaaacatgggcaaaagcctggatgttgatgagaaccgtgtggagattggtttgaagcatcttaaatttgatttctagtatcaagagaggtagctgaaaccatagatttttaaaaatgtcatgaggccaggcacagtgactcaatgcctgtaattcgagcactttgggaggcctgggcgggaggatcacttgagtctaggagtttgagacc

SEQ ID NO: 46734 - DNA, 1028 bp, Homo sapiens
gctggggctacgggcgcccaccaccatgccctgctatttttttgtattttcagtagagatggagttttactgtgttagccaggatggtctccatctcctgaccttgtgatccgcctgccttggcctcccaaagtgctgggattacaggcatgagccaccatgcccagccatgtgggtgtcttgtagactctgtgtttttagattctttgattccacaagcactaagctgtctaagttattatagctttataataagtcttatctcattgtggaacccttcctacttgtctcttcttcaagagtaccttggctgttcttgaccttttgcagatcaatatatgttttagaattacttgtcaacttctaaaataattcttccagatgttgtttgggattacattgaaggtctacatctattcgtggagaactggattattatagatctctgaatatttttgtacaaggctttgtatgggtgtagactttcatatctcttgggaatggttggactaggactggaatggctgaatcatatggtaggtgtatgtttaactttttttttttttttttttgagacagggtctcactctgttgtccaggctggagtgcagtggtgtgatcactgctcactgcagcctcaacctcccaggctcaagtgatcctctgacctcagtcgctggagtagctggaactacaggcactcaccatcacacatggctaattaaaaaaacatttttgtagagacgaggtctagtcatgtttcgcaggctggtgtcaaactcctgtgctcaagcaatcctccagtcttggcattccaaagtgctggggtcataggagtgagccacgtcacctggcctgttgaaattcttaaagtgccaaactatcttctagatttgtaccattttgcattcccaccagcagtggatgagagttctggttgctctgcatcattagggcaacactcgttattgtcagtcttgtacattttagccattttaattcagtgtgtaatggaatttcattgtggt

SEQ ID NO: 46735 - DNA, 1119 bp, Homo sapiens
aagtgtttcttgttccgtgagcgctcactcagcctcgctgcagtgcggatccctcggttatgtgcacggatctgactccagtgtgaaatcgtagcattttctttgattgtgtgtggggcagccccgctggcatcagcactgatttcctgtcaccctgccgtgggagctgatgctgattattaccaaaatcacaggagatactgtgtccatccctcgatcttgtcacttaatacattaatgaaaaagcactcatcttacttttccagtgcttccatgattgtatttcagcgtgcttttccgtctgcaatcctgtgtcttttttcatctttaaaaaccttgttttgagaaggcttcatgagaaggccagaggacctggggctcagacaaggttagaggactcttctggagggtcgggggctcggacgtaggagaccgggcgcagctcgcactcttgttctctcctctgtgtgtgattctgcatttattctgcttgtgctccttgggtgcctatcatatcctagggcacggagggtggacagaacccacatctgtgggccagggggcttagctctgtggcagggggggcgcttcgagaaagaaagtgacccgaccagcgagggaaagaaatgggctggaccagtgtgggaaggccttcatggagagcagggcaagggctcttgggcatcacatccagaggctgagggaggggagacctggctgtgttcgtggaactgaagaaccactttcgcgactagaccttagccagggggaagttgggtagcagttaattttactaaacatttatttcgtcccttcagtatgtgaggacttggcaccgagctaatcatgaaagcactgtcataacaaagctgaggcgcttggaattaccaattgggcaccatccttcagtttctggacaacgagttgtggtcgtggtgacaaatacaaaatttagaacctccggttcctgagaataagttgatgtgataaagagtcattaggaactgcttttccctaattttctctatggcagatgatgtgtattgtggctttgaaaaccctaatacttccacaacaccttggaattttcatactttatagatggtgagtctcaatttc

SEQ ID NO: 46736 - DNA, 1034 bp, Homo sapiens
aagacagtggaattgtgcctcgggttaaattttaatttgacagaaaggtgtgttagaagcagagaagactgacatggccagactttagatttgctagaggtttttgcctggcaggaatctggtcaccctgctccgcccttcttcctgcacagggcatcgctgtgcctgttccggagcgaggcagctggtctcaggccatcaggttgccattaggatcagggccatggggtgggttgggaaggtgggcctctgcccgagaaccagatgaggctggtccggggcgttgacacttggcatccctgagaatttgctcaaatctggagatgctcaaaaagtagaaagatttactatttttagcctttagacctaatgaaatttggtaagaaaatcagtttagtaaccaaaaaaccaccacttcccatcccactcagaaacagcacgctgaggactgagagcagtagaactttgcgttgtgtgatggttttatgacataagaggagatttgacggacctggggtctctggtgtctcccagctttgttggaggaaagcaggctactcgcccaactctgtggaatcggtaatgtgggtccggctgaagttttaacctgtcttctgtcctcagggctggccattaggagtccactaagaatgcgtcacttccaattcggccatgcagctatttggggaggcgatgatgtcgtcagatcatggggccagtgccttcattccagggatgggtgaggagaagagcagttccacggtcgtgttctaggaatcctgcggtttaaacagtgaagaacgggaccaggaagacaggccagcccctaattacccccacagaaccggattaaatcaccctggaaaggggatcctccattggtcccttctccaaagcagcaaatccttatattttcgtggtattttgggtattaatactgaaatcaatgtttcagtctcttaaaagactttgagaaacgttttggctgctgaagaagaacaggtacagcagagtccagctggttctagaaattc

SEQ ID NO: 46737 - DNA, 1032 bp, Homo sapiens
ccagcgatacaccactcgcgaagtggccccctctcccctctgtctggaccggtcctcccaaccgaacacactcccttcttccccttcttccccttcccttcttcccctcctttccctctgcccagtgcacacacgaccctggcagcactgctagccagtgtcccccgcctcggacccccagcctgcaccgccagactgtggctctgccccggtctcatcggcactgcgctcccttgtgtccctttgaagataccttgatttcctgagaccgaccttgtccctggaggaaagaggccagggcatcagttcatccgggcccagattccctgctctgtagaagtccccgcaccttctgcgtctcagcacccgctgcccctttcccctttgcgcttaacccgttcctcccccaggtatcctgctctggattggagcacttccagcagcggcttttccagcggaggcggatccacacggggcccagcctcctggttagctattcagaatgattctagaaggcgggggctagggagggctgggaagggccgcttgacctcctaaggagcctgaggtgtttgtgtctctccagtgcgggtcactgatggagtgtggcttcaggttcacagacctagccactgacccccatctgatacctcagctgactccagcaaaacagggcttgtcgtttttattactgttttgggggctgtcttttccagtctatgacccggagcgaggagggtttaccagatgagtgattgaactaattgttgtggggtcagatgattcttgtgggctggtagattctgaatcgaagcccatttctgctggggaaaagccactgcatctgcccagcattactgagagcgccctgcgcttccattccccagacggtctcatccttcctgtgtcattggcagacaggtagaatgtggtaggaatcttatccttctgttattttgtgctggctttaggaaaaaataagaaaacaaaaagctggagtattggtgtacaggttagggagtgtaacacatg

SEQ ID NO: 46738 - DNA, 1072 bp, Homo sapiens
gggcccagactcagcaggtgtggggagcgagccttgtctttgatgtgtccatctgccacctgcctttcccgcagacctccctcgggagtggttgtccaggtgggcaggagctgccctatgcttccccgactgcctcatggctgctggcacaaagcctagctctcagctttgctggcatggcagcttggggtttagtcacgtcctctccatgaggccctcagaggtgaccctgtctccctggggtgaaccttgccagtgcttgagtctggtttcttagcgccctgtgggagccaaacagcatttgctctatccactctgagctgcccctcctggccatggtgccctggcccacaccccctgcctgcccgccctggcttcccctgcctcatccacggtataggtccacgggcctgtgattctccctggcctgcagagacccatctctgtggtcgcctgggccagtgtaacaagagccgtcacacatcacgtagctgcccagcttagtcaacgtcaacttcgctttgagccgcatccgattcttcgctccttcggcatgggctggcccagggccagctggggaagtgatcatcagccttgtcagtcacacactaaggttttggggtactccgtttctccttgaggacccctagtggtgctctgtggattttgaagcaccatcatggatgtgcagaggcccagagtggggcttcagacctctgtccctactacctctttcctcacgtctgtccatcaccagatgagtgggcaagaagggtcctcccagggtgggaggtgggctggccacttgtgccctgcccaggtcacggtagcagaatctggcagcagctcacgtgcagggtagcagggccaaggcatctcaccgcagggccagtgtatggtggctcccagatggcagagggagggccggccctgggctattcttcccttccctggggccactgcatatggactcgggcacacaccatgccctgtctgcagccgtgggacggggttagcattgcatgtgaggcacccagcgctagctcaagccaagtcaggctgcacactgtct

SEQ ID NO: 46739 - DNA, 1221 bp, Homo sapiens
gtggggagatgacagaagatcctcttccgtgctggcggcttggagactggtctgtttgagtgtagcatggtggctgtgggcttctggggggtcaggaacccttctagatgtctatgagttaggatggggccaggacccgagcgtccagggatttggaagttgggctttgagctcctgcctggacctaagtgtggctcacatgtttcatctcactggtcttcacacccaccctctgagatttcccttcttggtcccatgttacagagaaagaaacagattcaagggccaggacttgctgggacacagcaggctagagagagatccagctagaggttgagctgggactttgccaggtcttctgctcctggactgggactgtgctgtggtgtgaatgtcccctccaaaactcattgaaatccagtcaccattgtgacggtatgaagagtgggacccgtgagaggtgattgggtcgtggtcactgccgtatctgggggtgatctcctgatgagaggaagcgctggcccccacttgatctcggcctagtgtgcttgtatgctcttccaccggaggcccctctgtcttggacttcccagcccccagaaccacgagctgaggaaatctctttccttacagactcccctgtgagtgacattctgttacagcagcagaaagtgggctcagactgtgttctctgccttacgctgaatgcttttagggattatacagagaagtctaaagaggccgataatgtccagggcagggaggtgacctactgctgtcaacgtgggtctgttgaggccaggtaagggagtcagctaattcacggtgggaagacagctccagcagcaacccctgaggccacagctccgctggggtcctggttctgtctcttcccgcctgggagtaggatgccagacaaggtgctcacttttcctgggactgccccttcctgtgccgctgtctgattcctgcctgtggagaggctgtgttaggggtgtggtgaaagctgcgcacccggcagaggagctgcagcgtggccatccatgggggctcctggtgggcagctgccctgctgacagcaagccctcctgctgcaggccatcggggcgcctcatccatcattcagtttctcctcttgaactttgcagtttcattttgccctggaaactggtttcccccaaagggtaggctttggagagcagaaatttgtgttgtggtttc

SEQ ID NO: 46740 - DNA, 1044 bp, Homo sapiens
ctcgctgtggtttctcgtactttcacatctctgtagatacaggggcaaaagtcattgctgacagagccctatctatgtcctggaagtgtgtgtttcttgctttgaatgcatgtgtgaagattataaaagccaaatagtttttaaagatctcggtgctgaacgacagtcccagttcccatttgtgtcccattgtctttgtggtgtcacccgcactgtttgcttcattgtctggggaacttctgcacatccatgtactttgtgccatttctgggctcacgtgtcactcctaatagagcctcttaaccaagactgctggattgcagctgcttgaggcaacacaggaggttagaacatgtcccgagggctctgaaacagtaggacatcctgggtgggtggagctggggagggcatgggcaggccagctggccgagctcctggctggctctcctgagtcctctggacatggcttgtccctgtgagactgtagctcttcaggacctgagctcttcccgttcttgacctgctcttgtgctgactgtgctgggctgatgggtaggcgcttgtccccagtgagtggctgtgtcctcagggtgcccctcttccagaccaactgcagcaaggcctggagcctgactctaggtgcagcccttgtggctggaatcccttgtgccacccaggggactcgggccctgctcctcctgcagcccctcctcacctgggctcgctgctggagtgaggtttttagggagcccagagcgtactcatctctgagctgctgggcccagctgcctggtgcatacctcttgcctcggtcctgtcccccagaacgctttatggagactgccgtgtcctccgagcactttgttttcacttcctgacccgtctcagaagctcaagtggttgaatgttttagcctcagaatctttttccccaagccctctcaggtggagccccgctgtaccagacaccacagcacagctctgtgaggctgtgtctcttcactctgtttctggggctgctgaggcccctgggaagccctggagc

SEQ ID NO: 46741 - DNA, 1680 bp, Homo sapiens
gcggcgtggtgccctcggggctgtggtcaaggttgaagccctccaggagggccctggtggctgtggggccacagctcagtctcccttgccctgctcatccacagcaggtgacaactgatggcttctctgccctgccctggccactggccctgtttctccccacaccctggagtggcatggtcctgtgccccgaccccacctgaggcaggagggcatgtgcagacactcaagagcccttccaggagtgggtcgcccacgggtgtggctcgggtgcccaggacggtctgtgcccgaggttcctgtcaatacaggttttattttatcacttgccgtgtcatccgaaagtgaggaaatgttttggaagggtccaccctagcctagaacaagccagagccgcaccctggctggaatgggggccaggctgagccgatctggtctcgtgttcgctggctgatcattgcagtatcagagggtggagatgtcagtctgtccacgtggagagaagttgccctccaggccgacaggaggccatgcccaccgcccctggacaggcttcgtctcagaaggctctatctgctgggctggcggccatccccgtgttgggtggaccccgagcacggttgcctgaggtccgatggcccgagagctgggactcagttcttggcctgctagcggctgaacaggccgcacatctcacttcagttgtggcctcattcagcagaatgactctggaaccatcctctgttacccgcagatcctgtcccatgggctctggccccaagatgttggggggccccacggagagttgacttggtagagttcctttctgggaagaaagtaggagtggctgaccaggccctgctcatcacccggatagaggacacggaccctgtgtggtattttggcattttggctcagagtccaatgtaccatgttgcccagaatttcatacttacggcctttacatgaatacgtcttgatcagacattcagagattagtcttaggtttccacgtaagtcactgaaaacagtaaaacaggctgcttagatttctagcagtatgtgtgctcttatccccagctgttagcacgttagtaatacttttggggaggagttgtctgtcctggtcagttttcacagaggcggttgtaagaggatgtggttattttctccatgtctgtagttgctttgcggcatctccatttcacgggcaacactcactgcctgcagctgagattccagaacgccctgtgtccacagtgattagcctcgtctttcagcgagcataaaataggtgcattgtccttttcttttcttgaggcagggtctcactctgttgaccaggctggagtgaagtggtgtgatcccagctcactgcagcctcgacctccctggcttgagtgatcctcccgccccagcctcctgagtagctgggactagaggcacgcaccaccgcgcctacctttttattttttttgtagagacagggtctcactgtgttgcccaggctggtcttgaactcttggcctcaagcgatcctccttcctcatccttctaaagtgctgggattacaggtgtgagccacagcactcggcctaaataggtttttcttgctatgttattttcagtgctttgcccttgaattcttttcctctcttaaattcatatcatttggccgag

SEQ ID NO: 46742 - DNA, 1050 bp, Homo sapiens
agaatttacgtatagtgggaggcataaatctaacagtctgtgagttctaacaaatgaatcaccaggcgcagtggcttgcacctgtaatcacagcacgttgggaggctgagacaggaggatagctgagcctgcgagttcaagaccagctcgggcaacatagtgagacgtctgtctctacagttaaaaaaaaaaaaaaaagaaagaaaagaaaaattagccaggcatggtggcatgcacctgtaccccagctactcaggaggctgagtcaggaggatcgcttgagcccaggaggtcgaggttacaatgagccctgactgacactgcactccagcctgggtgaaaaagtgagactctgtctcaaaaacaacaacagaaaccccaaaacgcatgcacctgcgcaacgcatacctcgtcgagataaagaacgttgccattgcccttctctgtcctcttcccggtagaggcctccatccccagaggcagccccagctctgagtctctcactgtggattagctgcctgttctggagcatcctgtggctctgagtctgtcactgtggattagctgcctgctctggagcatcctgtgcctctaagtctcactgtggattagctgcctgctctggagcttctgtcaatggagtcagatgttctcgcattgcttccagcttggctcactcacttggcatctgattcaggctcgtgtcattgctggcttcacagtgcatttcccatccttgccagggagccttcctttcttgttccgcactttattaattttacttgagtcacttgcagtttggggtgactgtgagtagagcctgctgagtccttgtgcagctctttctgtgcacctgtgtttccatgactgtcgcgcgtgggatcgctgggacgtaagacatctgctgacttgatgtgacatcaccaaactgctttccagcgtgccgcgaccctttctgttcccctcagacgtggtgttaccgcctttctaatctgcattctcacgtgtgtggcctctcactgtggttttcatttgcgtttccctggtgtc

SEQ ID NO: 46743 - DNA, 1026 bp, Homo sapiens
catgagcccccaggacccctctgcagttcctctcagctttcggttggagagccccaggccctgagctattggccctagctctgccctgggcactggggagggctcagggtgattaggcctgttccctcctctgggaagctctagaaactccccttccctgcagcccgagggaaggagggtaggcaagtgagtgcccggcctgagtctaggcctctgccctgtcccagggggtgatttggcacacgcgccctctctctccccctcctaatttaagtagaaacttactgtcggcctggtggtcatgttgggcccatgtggaaggctggaggacagcgtcagggcccgttgatggctgggtttgtaataggggctggggcctctcctccctgtcagcggctttctctggacctgaacatggaggaggcggtggggagccagctgggtgctggaggaggtaggtggtcgggagatggctgggtgctggaggaggtggtcgggggatggctgggtgctggaggggatggtggtggagccggctgggtgctgggggaggtggtggtggagacagttgggtgctggaggaggtggtggtggagacagttgggtgctggaggaggtggtggtggagccggctgggtgctgggggaggtggtggtggagccggctgggtgctgggggaggtgttggggagatggctgggtgctggaggaggtggtcgggggatggctgggtgctgggggaggtggtcgggagatggctgggtgctgaccagtggcctcaggtttgtggccggccagtgctcgtcgttgtcagatggaaggcagaggctgctgggcagtagcttctggggcttctgtgtgctgccagccagggtctctgaggatgggcacaccattgaggcacacgccagacatcatgtgtggagactggggtggggcagagggtgggaggagaaaaggagcagtgcctgtatgccaagggcagaacgggactcctgcctcaacgggtggcatccacggtgccacc

SEQ ID NO: 46744 - DNA, 1034 bp, Homo sapiens
agggctcagcacagggcagaatctctgccttgcccagggtccctctttggctgggaagctccccaagtcccctgtggctgtcacatgccagggctgagaagataaggctacttataggggcgggaagcattgaagctggtttctggccctagcgctcccctgcgatgagatgtgggagccagtgtgtccctgcctgtccatcctgtgcacccccagctttccttgtcacctgaaaccacctctgagggaaggtggtggcgtctcagatgcatgggcatgtggctggtcaggtggcctccatcccagggtgccccgtctgtgtgacctccctctgggtgctgtgggcttgctccagggtgcaggtgcaaccccagcagcggtctctggggccaggcaggtgggtggacgattggacttggaggggaatacagagggcatggaagtggcgaggctggcctgttggcgagggtgtcctggtggtggggcgggctgagtcagggaaggactctgaaggtcccaagcagctgctgaggcccccaaggaagtggttccaaccttggacccctaggggtctggatttgctggttaacaagataacctgagggcaggaccccataggggaatgctacctcctgcccttccacctgccctggtgttcacggtggcctggtccctccttgccgagagagtgtcctgggtcagggacgcagaggacgctcacagactccagccctttgttaccgagaggacacttggcaaggtccagcgatggtccggagtccacacacagactggcggcagggcaggagggggacagttctgttgtgcttggttggacagtaagagggtcttggccagtccagggtggggggcggcaaactccataaagaaccagagggtctgggccccggccacagagtcatctgcccagctcctctgctgctggccagtgggagtggcacgaggtggggctttgtgccagtaaaaccacaggctggatttgcctgcgggccatggtccctgtctagggcagc

SEQ ID NO: 46745 - DNA, 1538 bp, Homo sapiens
ggtgaaggaagacggatcccagccagggctctcgggttgatcagcagtaggaggtggcccctcctgcccagtcccacccaggacatgggctggtggctgggctttcagctgtgcccagctgcccttcgcagagcttgcagggtttatgaggtggctctggtgagattaggggcaggacacctagtgtctccagccgaggagtgaactgggtggaggtcctgtccttgtgtgcacattgtgggagagtcagtctgggaggcctttgtagcttgtgctggggcccttgggtgccagccctgtcttgacggtggctcctgctgagagagaggccctgtattaatgtgagccctgggctgcctcccccttgagggtccttgtcatcttccgggcctccttcagcagaccggacacaggggcagtgcaggtgaggggcttgggggagctccttggcagctccaggggatgcttgtgggcgctggcttatcttgtctcaggctaccttgctcaggtgacgacagggtgggtggatttgggaaaggttggctcagatagtggtccctgcttgtcccccagggcctgcctaggctccaactgacagtaatcccaagagctcccctttcaggggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaagtaagtactcgcctgtcctcatgccccattccccttcatttgaccggggaacccccagccctcgctgcacctgagggaacccagcaccacctgcgcatggcccagtctgcccagagggcctcagtttcccatctggaaagtggaggaattgggttttctggatggggcagcagcaggtgggcaccctgtgtggccgtgagcagggtcctgtcctgggctggcgggtcagcagctgacatgcggctccctgcagggaacaggtggcagtgccaggtctcggtaggagccttgaagtggcttcccctccctgagcggcggcttctgcccggagcccccaagaacatagtctgaggccactttggccaataaagtctggtagggcatcaacactgggggccagctcagtggcactgctgatgggacctgcacggctccatgggagcagagagactggtgggggtaccaccgcacgatgtcacaatgccctgtctcctgggctcttgctcccaccccacccccaacccacaacccctgcctctgcccatcagcctggccttggtaagtgctgccccagcctggggaaggaatgagcaggggagcctagggagcgtcttcatgggccctgtggcctcccatgggccccggttcctcgttggtgccattagaact

SEQ ID NO: 46746 - DNA, 1050 bp, Homo sapiens
ggcagtgccagtccacagactcaggccagccaggtgggccggagaggggtgctgctgggaggggtgggcgtgcacaggctgagccggtggctgaccccgtcccctgcccacctccctgacttctccctgtggagggtggacaatctgggagcctgtctgtgtgtgcgactgtgatggggtggcgtggagggcagggcctgggagccagctcctcccagaaagcttccgtttgcccagatgtgtggagacctccaggccgtgcagcaccttggtggccacagctctccaggatgtcctcaccttcctcagggccctgccctcctgacctggagtgttctgggtaggagtctgccggggctgctcccaggacagggacaggggaggctgtgagggccatgccgctgcagtgggtcttgctggctgccacctgtgtcacaggccctgttagctgggtggagccttccagagccaggaccccagggcactctcaaactctgggcagctgccagaggctcaggtgcttggcagacactgtctacccctcagggaagagccttggtggtgagcctggcctgcttccaggagcagagtagggacactttggccacttccccctggggcctggctctggcgtttccaagactgcttctctggcagccagctgtctccctgtgttctctttagaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagctttgaagctcagacttggtctctgttaggagagatggtgcgctgcgtccggcaggtcctcccatgcttgggaatgcgggaagcggggaaatgaggaggtgggctcggacgtgtggggggctgtgctggctgtcctgggaggctctctgcccgctgttagtggccagctccccaggtgacgggcctggcctccaggtctccagcatggcttactgtggtgtctc

SEQ ID NO: 46747 - DNA, 1050 bp, Homo sapiens
gggcgcacgcgcgctgacctagcccggcccggccccgccccgcgcctgcgcgctggccgcctcgtgcgtcactcggcgcttgccggctgccggacccgcccccaccggcgacaccactggccgcgaagcgcagggggggcgcgcgcgctgccgcccgttcccagcacttgtgcagactcctccggggaagagcggcctccgcggtcatctccaacggaattctgcctttgaagtgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgtactgtgactgggtcaaaatttctgtctcttgatttggatagggtggtcgggcagtctctgaagggggcggggatgctgttgctaagaagtagtactttcagaggctttaagtggaagg

SEQ ID NO: 46748 - DNA, 1035 bp, Homo sapiens
ctgccacgtggggggcatcccaggtggccagcctgtgagtcgggagctccgtcgaagcctgaccccacttcccgccgcaggagaagcggctgagtgccgagtctggcctgagtgaagactctcgcccatctgccagcacagtctctgaggctgagcccgagggcccgtcggctgaggcacagggtgggagccagcaggaagccacgactgctggcggggaggaagacgccgaagaggactaccaggaggtgtggattggcaggaaggaggcaggaggctgggcctgctgggtgggggctgcctcccctgcggggcctcagctgggatcggttttggtgcaggcagtgcctgggccctgctgatgcttcggggagctgccctgtacagagtggctacgggtggtgcagggccgtgctgctgggggtgccctggagagctgcctccctaggtggggttaaggtctcccctgacggctgggctcacagagcccacccccaccctggactctcttctgacccccgtgggctccctggtgtgaggccttggcgcaccccttcgtttccacctggggcgctgcgtgtctccaggatgagcccctggccttcagcttttctcagggctgagacacgcgcccctcactgggcagttagtgctgagtctttgtgtggcggggaggctttcggagcccgtctgtggccacactgtttagtagggtcttcctgtggaagcacagccacagagctggggccaccctcacccttttgtccgcacagcccacggtgcatttcgcagaggacgcactgctgcccggggatgacagggagatcgaggaggggcagcctgaggccccctggaccctgccaggcgggaggcagcggctcatccgcaaggacacacctcactacaaaaagcacttcaagatctccaagctgccccagcccgaggccgttgtggctctgctgcagggcatgcagcctgatggggagggccctgtggctcccgggggctggcacaatggcccccacgcaccctggg

SEQ ID NO: 46749 - DNA, 1046 bp, Homo sapiens
ccccggccccgagcccgccgagcgccgccgccggagcccgcgccgcccacccgcaccatgctcaagtgcatcccgctgtggcgctgcaaccggcacgtggagtcggtggacaagcggcactgttcgctgcaggccgtgccggaggagatctaccgctacagccgcagcctggaggagctgctgctcgacgccaaccagctgcgcgagctgcccaaggtgagcggccgcccgcacctgccgcccaaaggcgcgcccccagcccgtgattcctccggcggcagaatctgcccgggcgagtcaccgcagcctccagccggccctgctggtttgcactggccaggtccccaccccagccagccccacccttctcttccagccgccctggctggcgcaggtggcagcggtcatcaggtgcttgcctggggatagcgattgtcaccgagcctggaggcggagcctcagagtgaaacccgtggggattcagggaggtggatggggttagggtggaacttggattcaggtggctgatgagtactagcttcttgggccgctctggaggtgggtccagacctcctctccttttttgctgggtgcaggggtgagtgggggagccctcttgatgtactctttgctctcggatctgttcgctgtccccctttctttacccttgcttctcgtggtcaggtgctctcctaaggctgctacaagaaaggaggctggagaaagcagattaaaaagtatttcttttctggagatggggtgctgggtgatcagtacctaggggttgggtgtcccaaagaatgtgaccctgttctggccgtggcagtgacagctcggtcctctgtggccacctgcaggcctcgcgcgtagcactgtgcctgtggtactgtgttattgtggggagcgtttactgagttcttgctgcagaaccaggccaggcttgttgtcaggatgcagtagcagaggccagtgtgggcccctggagggtggcagaagtggttcaggggctgggtgggccctgaggtaagacacagggtaggggattg

SEQ ID NO: 46750 - DNA, 1052 bp, Homo sapiens
ccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgc

SEQ ID NO: 46751 - DNA, 1021 bp, Homo sapiens
cggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaagg

SEQ ID NO: 46752 - DNA, 1061 bp, Homo sapiens
ccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaa

SEQ ID NO: 46753 - DNA, 1013 bp, Homo sapiens
tttcctatggtggtcgggtgggctgggcaggcccagaagctggccagaggcagctccgccccggaccccagggagccggaggccccagccagcgcaggccctttgccctttgccctttacagcatgagactgcttcccttgagccccacccagctgcaaacagcaccccccacccctggggtcgcccaggtcctgcctcaggtgtggcttcccctctgtgagtcacaggcttgggccccctccccatccctgactcactggcgaggcccctcctggggcttcccgatgctccattcccccatgaggcccggcctccgtgagtcagccctcagctacgcgcctccgacgtgaggtgtctgcctggggcagggtgggctccgcaggtgggcactgctccaggatgtgccaggtgggcagcttgggaggggccaggcctggggtgggaccccactggccccagggccagggcaggcaccatggggcagggtgtgctccccgcttcatgcaggtctgtgaagaggtgtgattggggggctgcaagagctgacaggcagcaggtcccctcccctcgccaggtatcagcggcttcttgagtccgccctggcagggtgggtgggcagaggctgaagcagggcctggcccaggcctggagggagctccaaagagaggcgtggcctcagagcccctcccgtcgggggagcccttcagtctgttggggggtccttctgggtggctgtggggacggcctgtgttcctctgcggtcctggcaccatttggtgtgcagtgaagtgccagctccccgtgtccccaggtccccctagggggctgcagtggtcggggtgggtgaggaaaccccggtttcctgtttctggcgggccgagggcgtgtctgtgggggagggggctgcttgctccttcccgccgggacactcccctccctggcggcggcctgggcagggtggggcctcgggggcgggccggcctcgccggggagtacagcaggcagggagtgg

SEQ ID NO: 46754 - DNA, 1027 bp, Homo sapiens
caggggcatcccagacagggtggccgacattggtgaaggcggggagagcgggggctttgccaatctgatgggtggaaagagttgttttaattatcaccaagcattttttccttctgtgaatgggctattccagtcctcgtatgtgtacttaatttttcttgtgtgtagtgttttaagggttctttataccgactcagtcgtctccaatgttgcaatgggaaagttctcagctgcacgcaggaagcaaggtggggggcgggcaggggagcgtctcggaggcaggtcgccggcccggcggggaacagacaggtcgcggccgcccctgggcgggggccacccgaggacccccgggcgaccgcggtgtcggcggccgcgacccgggcgagaacgggaaagggcgtgcgtgcgggactcggagcccgcggaaccggcccgccgggaggggcccagacgcggctccctctgcccggccgcggcggccccggccccgccccgcccgtggggcatcctgggtgcgggggcggggcgggggcggggcgggggcggcctctttaagcggcgcgcgcggccgcggggacagagtggccgccgggtgctggaggctccgctgcaccccgcgccccgcgcccgccggcatggccggcccgctgcccgacgagcaggacttcatccaggcctacgaggaggtgcgcgagaagtacaaaggtacggccccccgtcccgctgcctgtcgggccgctcctgacagcccagccgccgagcaccttgtcgtccacggtggcggtcccgatcgccggcccgagcgcggccactccgccggcctcgtccgcctggatcgcccccaacggctgccagtgcctagggaaggggaggactcgctccgctgagcccccgaggccatgcccttaatagggcatcgcgcggctcgggtgggtggggtgggccgcgggcgggtgggggcgctcagggcttgtcggggtcggctgtctgagccaggatccggtgtctgtggccagcagacacatgg

SEQ ID NO: 46755 - DNA, 1104 bp, Homo sapiens
tgcctctccctatcagttggccagtggagctcgagaacaaactgttgctgccagataaagcagcaaagcctgctccactgcccagcgcaggcccccttcccttcctccaccaggctgagtggagaaccctaaagctacgggacaggctcccgttccccgtgcctacacagggtgctggctctggcagaaagacagtgtgcccgccccgcatcacctgtccgagtgcgaacaccttgggaagggggttcctggtggtcctgtgacaaccagagacccccagggccaaggtgaggcgcccacccctggtccctcaataaagaactgcaagcacatgctggtcctggggagtcgggcaggcacggagctagctgcaagcatccgtcttcccccaggaggccactgcagcccggcccttctgtgccctgggcccctcctcattgcagcaccacccaccgcaccaccctgggacagaggaaacacatggaggccatagcatagagcctgtctgtttatagatctctgcctgtcttgtccgtccatccactgtgtgtatatatctgtgtatctctgtggagcggggaacgggacagttgtgtaaaaatccaaaatacaattctgactatgaacaacctgcagggtcagtccaggtgtggctgtgaagccccaaccaaaccacaggacacggggttgggggaaggcagactggcaggccagggtgaccctcctgaccagaggtgctgcccagacccgagcccgtttgtcctactggggctatggcggccgacccaccagtgcccaagaccgcgaggctgccctgcctccccaagaccagccctgcactgggggtgggggtgggcggctggcccagctcctccggggcctctaggagacagtggggtccttggctttgggaggctccgagcctgtcagcagggagatggtggggtcctcggcgaagccgtccccttcggagaagtaggagccctctcccagctcaaacagcaccggcaggtcgttgctcccggtgtccacggagccggggtccagcaggaacagcggctgcgctgtgtagtgcaccagctgcttccctgcgggggtgggggt

SEQ ID NO: 46756 - DNA, 1070 bp, Homo sapiens
gatcctgcagacggggcaggagatcatggagctggacaccagtggcttcgccactcagggccccacggtctttgctgggaacatcggggacaaccgctacattgtccaagtgtcaccactgggcatccgcctgctggaaggaggtaggtgggggggtggttgggccctgggcatccgcctgctggaaggaggtaggtgggtggggacggtgggggggaggtggttgggccctgggcatccgcctgctggaaggaggtaggtgggggggtggttgggccctgggcatccgcctgctggaaggaggtaggtgggtggggacggtggtggggaggtggttgggccctgggcatccgcctgctggaaggaggtaggtgggtggggacggtgggggggaggtggttgggccctgggcatccgcctgctggaaggaggtaggtgggtggggacggtggtggggaggcgcatgctgactgccccatgcctacagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatgtaggccccctcattcccggcgccctcctgtccctgccccttgcccgccgctgagcccacccctctccccacagcagtccaaggtgattacgctgtgcctgtaccgagacctcagcggcatgttcaccactgagagccgcctgggtggggcccgtgacgagctcgggggccgcagtggcccggaggccgagggcctgggctcagagactaggtgcgtgggggctgggggcgcaggtaggggcttgagtccctggggctggcaggccgcccatgaccttctgctggcccccagccccacagtggatgacgaggaggagatgctgtatggggattcgggctccctcttcagccccagcaaggaggaggcccgaagaagcagccagccccctgctgaccgggaccct

SEQ ID NO: 46757 - DNA, 1022 bp, Homo sapiens
agtggtgtgggcccttggtctgtgcctcccacaggacagctgcttcaatagcatctgtgccccctcctgcctgtagtccacccaccactgacccctggacttggctggcggattttcacaccttctcctgggggcaggtctcagcttgtccccaacccagtcagagccagtctcactccctgcctcaggcaactgtgtatgttttaatttttatttatttatgtattcatgagatagagtctcactctgtctcccaggctggagtgtagtggcaccatttcggctcactgcaacctccgcctcccgggttcgagccattctcctgcctcagcctcctgagaagctgagattacaggcgctcgccaccatgcatggctaatttttgtatttttagtagagatggggtttcaccatgttggccaggctggtcatgaactcctaacctcaggtgacctgcctgcctcggccttccaaagtgctgggattacaggcatgagccaccgcctgtaattttaatttttaaccaaactgagaacttgaggattgaatgcaggtaacgggtggtgttcatgtggatgtggattccatgaaagagggctttgtcctcactgtcggttctccacatgtaggtcctttgactcagcaggccttaggcctagtccacaggtgctgagtgaacagccccagcgtctgacagctccttagcttggggtgcacaggcagctgaagcagtaggatggcagctcagacttcccagggccccacgtgtgcagggctggcctcccagcaccaccaggcagggccggcctcccagcgccaccaggcagggccctgtgagtgtcccctccctgacacacaccttgtagagaggctgggcctgggcaggctgctctgctgcaccacatcccattctcaagagggtcccaggtcccaaaggaagcctgtagcccagtggctttctggaggtttgcatggctggcaagcctgggccggctgctggagaggcatcaggacaggagcaa

SEQ ID NO: 46758 - DNA, 1047 bp, Homo sapiens
tctcgagccagccagtgtcaggaatgcagcaggttccaccctctgttcctgctagaacgcttttcctgaccccagcagaacacatggctcagggtgggcaccagccaagctgggggctgacttagacagtccctgactctggtgagaagaggggagtggccatgctgagctttgtgtgttctccctggcactggggctgtgggggacaactccatgggcctctggaattggctgggtcctcagtaactcgagagcttgtcatccagataccagatgccaccagtgctggcagggaagcctcgggtggtgccccaggtctgagcctttgggcctgcagggccagctgacccatgggcctgtgcccgtacgatgatgcctcacaggctgggaaacctgcttgggtgtcagactgaggccctcatgcaaaaggtttccgccaccgccgagtcctgcctcacgtcaggttggggctgcagccagtacagcaagactcagcttttatgttctctgtgtgggtgttagatatgttctgggggactggcctgacaaggtgtgcagccaccttctggagtctcaggtgggtggcaggagggctggtggggcagcagttacacctgtgcaggagcttctggcctgaccaggccgcgcaggtggtcaggtcgttcctgccggctccctgctctgcggcccgagggcagtgtggcctgttggcacctctgcccatggggcacctcctctgggaagagacagcctcagcggtgcccgggacgttgcagccgcagcctcatccctgacttctctccctccattttggcccttcagacgaggcccagtgtgatgctgcgtaagacagacctggccctgacccttcctgctgctgtcagatgaggccctgggccttggtgctggcacctggaggaagggactgcgcattgttcccacccctcatggggcattcttaaggcaaaaacgggctcactcgggtgtaagtgccgggcaggggcctctcacagatgtggtccagccgctccctctaactcggccctg

SEQ ID NO: 46759 - DNA, 1052 bp, Homo sapiens
tggtcctgtccctttccacatgactcgaaaggaggaagagctgatggacaggcaaatgtttggggaggccggccagatgaggctgggagacaggacacctgcagccctgttttccctggcttcgggtgggctggctggcttagcccagatccctacttttaaaactgggctccttgttcctgaaaccagaccccagccttcccatttctttacgacaagtacatgtatatggtcccccagcaaactccctgctccttgctgatctcagaggtcacactgctcccagagcccacttgggaagccacaccagaaacccagttggtggcccaaggcgtcccctgtcccaccccagctttcccagggccccatctatccccaaagacaggacacctttctggggaccggcatgggaagcacagacccatggctcctgaaccgaatttcctattatttttctcatcccccaattctctgacaggttacctgagaaaaaggcccaattctagttaagctggtcccacccctaggccagcaggagcaggtgctggacaaagctgtgccttgacttccctggggctcgtagctcctctgaggccagctctgcccaggcccccacaggataacaaggaggcgtgtctgcccagggcctgctctccccctcctagccatgcttgggtaatgggaccccgggctttgtcacctaagcaaagttctcaagccataccctgtacttccagcttcttgcaccctagaaccaagcagcagccacttgcctgggggtagagtcgggggcagcaagcgacacacatccacgtcctgagcaggaagctcctgacctgctgggcatgggtggagaaggagaaggtgacagggttgggtggctctccctacatggtcacatcctgtgaagacactgaggacaccaggaattctaaatttgaacctgatgccccagagctttaagaaaatgtttttgtcaaaggagaaaaccagaacgttttattagtttcttgaacctatttatagcgtcaaaagttagacgcaggtgcagg

SEQ ID NO: 46760 - DNA, 1097 bp, Homo sapiens
gctccctctggacctggcggggagaagaggccttgccactgcattgggcggggagaagaggccttgccgctgcgttgggcggcccagcccagtgtttgctgtcagtagtgccgtgcatccctgagggtgatccctggcccttggccagtgtggtgatggcagcctggcctccttcagtgacctggttgggggctgctccacaccaggcagcttggccacctcctcatgcccctcccctgtcactgtcatcctgtcgctgagaccttgggacagaggtccagtggtgtctggaagaagaggctgggtcgacgggagtatgagggaggcctgccagtgtgcagcagcagagtactgcctcggggggcttgtggcctggggtgatgcatgcatgtttagctgggaaggtggagcagggtggggaagtggatagccagaccctgtcctgagacgttctcagtcctttttgctgaaacgcgcgtgctctgtgtgttctcatgatacgtggaggtgggactcacgctcgccagagttgcacttgtagactggttgagagcaggcacccagctgaatctgccaagccagttcttgctatgatctagggcttctggaaagcgggaacttaccttccttggggagtcagtgagagggcctgccacggcaagctgggcacaattacagcggtgctaacatctcctggggtggagtgcagagtgtgccagggtcccattgtggccgctcgtgggagatcccatcctcagctaacctggactcccaccaggagtgaagctttcctctggacatgctggaggcctaggtgtgagctgccacagccatgcgggtgcttctgggaagagggaggagagctggtgtccagccccatgccagccccacaggggctgagagcagaacagttgagagccagccaggcccgctgggctcggaaggccttggaagccccactctgcccccagagcatgcctggtgcttcctttcacaagttgccatcagcataatggaccagtgtgatgccatgtgagatggcaagaaataaagtccctgtgaaataaattatatggatgcagttcgctcagggaaaa

SEQ ID NO: 46761 - DNA, 1053 bp, Homo sapiens
tcttctgccagataccctaagtcgtctctctcaagttcaaagttccacagatctctagggcaggggcaaaatgctgccagtctctttgctaaaacataacaagagagtcatctttgctccagttctcaacaagtttgttatctccatctgagaccacctcagcctggaccttattcgtatcactatcggcatttttgtcaaccgttcaacaagtctctaggaggttccagactttcccacattttcctgtcttcttttgaaccctccaaactgttccaacctctgcctgttacccatttccaaagtcgtttccacattttcaggtatcttttcagcaacaccccactcaagtaccaatttactgtattagtccattttcatgctgccagactgggaacaaaaagaagtttaattggacttacagttccacatggttggggaaccctcagaatcatggtgggtggtgaaaggcacttcttacatggtggtggcaagaaaaaataaggaagaagcaaaagtggaagcctctgataaacccatcagatctcgtgagacttattcactatcgcgagaataacacaggaaagaccagcccccgtgattcaattacctcctcctgggtccctcccacaacatgtgggaattctgggagtacaagttgagatttgggtggggacacagccaaaccacataaccatggctgagtcctgcagctccatctcccattaccacacattggatggcctgtctctggggctagcagccaggtgctgaggcaggaagtggcagagtcctggggccactgtttacgtggccttgcccttcacagaatggaagctgaagttgggtagtggccatcacccaaagctggggaaaactgctgccttgtctgttttaaaaggatcctgctggctgccatgtggagggagggaagaggagaccagttaggagctgaccgcagcaacccaggctctactcaggtggcagaggtggaggggataggctgttggaatctggaaatagtttttatttttgtcctcattttttttcttt

SEQ ID NO: 46762 - DNA, 1050 bp, Homo sapiens
atggcagccacattccagcttccagggcaccaggtgagttaaccctccttcctgcccacctcttcatcttcatccccatcccagtcagaagctactctcctctggagccgtgagcccggcaactggtaaggccagccaggggctcatagcaaccgtgaggaaagggttctgagaggtagactcgccctcctgcagggagaggggctctgagctcagctgggtccccgtgtagctgaagttggctggtcctcagcgctctcagctgccccatcagggacctgctgatacacagttcatactgaccacagcagggccctgggtagtggggccccaccaggtcagggcccttttagtgcaggctgctgccccgtgggcatggcctgggcagcggcgatgttttgttgcaggagatgccgctgaccttccaggatgtggccgtgtacttctctcaggcggaggggcggcagctgggcccccagcagcgggcgctctaccgggatgtgatgctggagaactatgggaacgtggcctctctgggtgaggctctctgcacttggcctggttcgcagtgggggcctctgaggagcttgggaggctgctttggctctttggatcccaaagaagagggtcctgccccttgtccccgggtatcagtctgatctctacagaaggaacatttcccatgggaaaagcctgccttgctccccagttctagggacttcactccctgttgccagtggccccactggtgtccctccagtggcaggagagctgatgagtggattctccttcagtacttagtctcagcccacgggccccctgaccaacacacgtgcaggcgtacacacgtgcacacagggcccatctctccacacctggcctggaaggcccagtgggccatgccagctcaccagtgtcctcatcctcaacaggattccctgtccctaagccggagttgatctcccagctggagcaggggaaggaactttgggtcctgaatcttctgggagctgaggaaccagatatcttgaaaagctgccagaaaggtga

SEQ ID NO: 46763 - DNA, 1049 bp, Homo sapiens
gggttttgccacgttgcccaggctggtcttgaattcctgggctctggtgatctgcccacctcggcctcccaaagtgctggttttacagcaatgagccaccacacccagccatgaaattttaatttcatgtgtcacaaagtatttttttccattgaaaaaccattcttagtccaggcatggttggcgccaaccccatgagcccactggacccctccagtacagagcacctgtccatccttgtcagtggccagtctccattagacctggactccagggcagaggccagccctgtccatctttgtccccgtggcttgcacaaggccttgcacagagaacggatgtctgcatctgggaaattactcccttggttttcttggccttagttctctgtggaaacttgctggtgatttccctctcctgtggcactgtcctgagctcaaagcctggatgcctccccacctgcatcactcactcattcagcaaacatttctggggctctgagtcaagctgcatgcactggggacttgaggatttataaaatggcctggacccggcccttgctctgcttcactttgtgaagcttccagaaaggtccagatagtttcaattcagtgtcataaatgaaagattattctgatagttgagataaaaagcaattccaggcctaggttatagatttaatttattgtctccaaaacagaaacccaaaatgtttttatttatatattgtggagacagggcctcactctgtcacccaggctagagtgcagtggtgcgatcacagctcactgtggtctccgaactcctggggtcacgtgatccttccttggcctctcaaagtgctggaattacaggcgtgagccaccgtgcctggcctggaaactctttagatgagcttaccgaagcccgaattgcagtgcagtgtgaacaggttaacaggatattctagcacctgcactaccccatgagcagcccctcttcctctccctctccacaaaagaaccaccagcctgtgtgccaggggccacctggatgcttccatgtgatac

SEQ ID NO: 46764 - DNA, 1029 bp, Homo sapiens
ctgaagacagtgaatttaaatttttttattaaaaaaactgttaaattctcactgtttcaatttgtcaatacacttaataaattcctctgaatagaataaaaagacgcagaattacccaaaaagaaaagtaggcacaaatttctgcatagattaggaaaaccaaagggccaataaataagaaaactgctcagcctcattattcatcagtaaagtggaaatcaaaaccactgtgacatgatgttacaccttcagaatggaaaaaatggaaagatctgacaatataacatgtgggtgaggatgcagggcagctaatagggatgtaaattcacatagccactttggaaaagtttggcattatccaatgaaattgaaaacatgatcacattctgagagaatggaggtaaaaaaaatgaaaaaaaaaatcgaaaacatgaattcctatgttcaccacttcccactcttgcatatgtatacagcaaggacatttgtgtgtaagcaccaggaaacataggagaatcttcacagaagcatgcttcatgatttaaaaaaacatttgaaaagaattcaggaccgggcgccgtggctcctgcctgtaatcccagcactttgggaggccgaggtgggtagatcacgaagtcaggagtttgaggccatcctggccaacatggtgaaaccctgtctctactgaagatacaaaaaaattagccagccatggtggcatgtgcctgtaatcccagccactggggaggctgaggcaggagaatcacttcaacccgggaggcagaggttgcagtgagccgagctcgtcccattgcactccagcctgggcgacagggtaagactccgtctctaaaaaaagaattatgttcataaacagaatagacataaataaactatggtattttaacttaatggaatatactgcagtgaaaatgattaactgctgtacaacaacatgatggatctcaaaaacataatgctgacgggaaaacgagttccagaagactgtgctccatgaaactatagaaa

SEQ ID NO: 46765 - DNA, 1047 bp, Homo sapiens
gacattttgaccatggtaccatgcaggtctggtttgcacagagagggggacaggtggtactgggaccctccttgatttttttttttaataggcaatgtctcactctgttgcccatcctggagtgcagtggtgagaccatagctcactgtaaccttgacgtctttggttgaagagatcctcctacctcagcctcccaagtacctgagactacaggcatgggccaccatgcctgtcttattttacttttttagagacagagcctctgtgttgcccaggttggtctcaaactcctagcctcaaggaatcctcccaccttggcctcccatgcctttccaaccctccctgatttatagaaggagaatattattcattgcacacctagtacctccctatcccctgaattaatctttctgcatcttgatgatcggtggtaggatacacagtttataaacgaacctgaggctaacaaatactgtcacttttcttaagtttacacagcctattggtggcagatctgggatatggatctgttcggtttcagagccctgctttcctttcactggaatgtgctcttcgctttagcccttttttttttttttttttggtttctgctagcctttatttgagaaaatttacacaaaaatccccaatgcaacatttacaagtgaatctgtataaatcccatatgcctctttcccaaactgaaaaatggctttatgacaggggtccatgacaatggtataaaaatacttacttaaactgcatcattctcatttatattatacagaccattttggataatatgctcaaaagtggaggaaagcacataacacccctgtttttaaagattatttgctcttgtatcagtcttttgtcaaaggcaaatacttttacttcttggataaaaccaaggtataatatcaattaacttttaaaccaaaagcacaaaatgtcctagttgatagttttggcatgagtaaagggaagggacatgagagaacatcagctcctacaaagcttaagtttagggtcacacttgggaacaaa

SEQ ID NO: 46766 - DNA, 1032 bp, Homo sapiens
acactaagaaagaatcaaaagaaaatgctagaaatcaaaaacatcatgacagaaataaagactgccacctgtaatcccagcactttgggaaaccaaggtgggtggatcacttgaggtcaggagtttgagaccagtctggccaaaatggtgaaacaccatctctactaaaaattcaaaaattagccgggcatggtggcacacacctgtagtcccagctactcgggagtctgaggtaggagaatcatttgaacccaggaggcagaggttacagtgagccagcctgggcaacagaacaagactccatctcaaaacaacaacaacaaaaggactggacacaactgaagaaagaatcaatgatcctgaagacatgtcagtagaaactttcaaaatagaaatgctaagagaaaaaaagaataaaaaggatgaaacagaacatccaagaactgtgggacaactgcaaaaggtgtaacatatgcatattgggaataccagaagaagaatgaaggaaaggaacagaagaaatatttgagccaattgtaataaaattttgcaaaattaataacatgcaccaaaccacagttccagaaagtacagacaacaccagcaagataaataccaaaattctatacacaaacataccatattcaaactgcagaaaatgaagaacaaaaaaaatcttcaaagaagccggagggccagacacggttgctcatgcccgcaatcccagtgctttgggatgccaaggcgggtggatcacctgaggtcaggagttccagaccagcctgaccaacatggtgaaaacccgtctctactaaaaatacaaaaattagccgggtgtcgtgatgcatgcctgtattcccagctacttgggaggcctgaggcaggagaattgcttgagcctgggaggcagaggttgcagtgacccgagactgcaccattgcactccagcctggccaacaagagaaaaactccattcaaaaaaaaaggcaagaaagaaaaaaactaagcaagggtaagcattatatcagtttt

SEQ ID NO: 46767 - DNA, 1034 bp, Homo sapiens
agaagtttcaaaaaatatagaaaatacagatgataatatggcaagtatctaaaggtctccacttaacagaattaacatctgttaacattttgtcacttttgctttagttgttttttttttaattaaaaaagagaacattacagataaatgtgaagtccctgttattctgttgcccatttctgttctccctgctgctccctgagagtactaacacaaaggtgtacttctggggtgtgtgtgtatatgcatatccataaacaatatatggtatagcttctggagggatccaaagtcattagcactcaagcaagcctattaaataaaataatatcagcttgagttaaagataacatatagccgtgaaataacggagctgatttttaggtaccttgtcaaatagttctgaaagtaattgcaaagaggagttccaaaagtgagttcagaaagacagctttatcagaataaattgcatggtactgcatacaggaaactataaagaacaacggttatttagaactgttcattctgacagtgtttttcaattactccttaatattataaccacttactcatttcctgaaatcaccaggaaatttttcaaaaagatttttctcccccgatgaatatacccacgatttgcatttgacccaagataagcagttgagtcgataacatgttaatttttaaatacatggttttaaaacacagaataaaaattctacctcattgcttggagactcaattaaggagagtatgcacattagcaaaaagaagatgtgatatttgctcagaagtcttgaagtggatattttggccttcgtatggctgaatggtcaagcttgactctctcgtttgctcagggaggcccagtccctctgctgccacgggtagaaatactttttcctaaatcgctgcttcttctcactgccatacagagcaatattcaggacacagccaaaaccttctttggcagacctttttgagttctctctactcagctttctgctgtgtaatatgagcactctagagaagtt

SEQ ID NO: 46768 - DNA, 1048 bp, Homo sapiens
gcacttcccgggtgaggtgatgccttgccctgcttcggctcacgcatgttgcgctgcacccactgtcctgtacctactgtctggcactccccagtgagatgaacccggtacctcagttggaaatgcagaaatcacccgtattctgtgtcgctcacgctgggagctgtagactggagctgttcctattcggccatcttggctcctccccttatttatttttttcttacataacaagaatgccagtggttggccctgcaggcttggtgtcatggcccccaaggtaccactggagactctggttctttgtgtctttgtgtcccaccaaccttagtgtgtggctttcatccttatggtcacaggatgactcctaaaactctgtacagtgaatcagtattggagacaggaagaagaaaggaggtaaaaaagacatgccagctaactttgctcccattaggaagctcttctagaagctcacagaattacatttgtttatgtatttcattattcagagctgcgttagctttgtctacaagggagattggcaaatgtagttttcattagcccagcacattgtcacccccaacaaaactagggttgagttagaatgaaggggctagtgcatattgataggccactagtagtttctacacagcctccaacaattgctgtggatgtagattagtaacagaacttccactatggcatcatagcacctctatcccactagtacctgtagtaggtccaaatcatctaattccaggagcctggcttaaagaagaggaatattgaggcttctaggtccagtattaatcaaggtaagctagctgtgagaacaaacaatctcaaaatctcagtgaacgaaaccaacaaaaacttgtttcatgtttatatcacagtctgatgcagatcgagtggttctcctccaagcagtgactcagggacccaggctgcttccatcttacagctctaccatcttgtgactttcagattatgttggcatcattcagccagtgactaggaagaagagagaatgaaagattgtgcaccc

SEQ ID NO: 46769 - DNA, 1053 bp, Homo sapiens
tgagaatgaggatggttcagagtggagagacagggacaaggtaagttggagtgtgggtctgacttgttagccatgtggaggaaataattatcataataactatcatgtatgtttttagggggctctataacttcagtatgttttcagtgttcacatttgtaggtttacagagtttgtacttgataaggtacagaagtaagtcacttctcaaaaatcatgcctttagaagcatatatcatgcttctattatagtaatgataataatagaagtctactgctagtcataaaacttatctgttcagagaaggctttttttttttttcagagaagtcttccaggtttcagctgttgctcattaatgctcaccacagccctttgaggtcgatgcaattatgctttggaaaagctaagtaacttgccaaaggccatgcagctaaaagaagcaaaagctggattcaaatctcagctctctgcctccagagagaacaccctcaatcccgcttaacagacattagctctgcttatttgattggtggcagtggagatgaacagaagtgaacagtgagcagagaggggtctgtaccccacacacatccctgcaccccaactgtcaactgtcttccatcatcatttactatatccacgtccactcctgacagcatcagtggctcagtcttaccgacctgcatcagggttttgggctctgcctctgtttagacagagcacgatttgggaagtgctgctaagtcagccagtggctgagtagaaacagccctgcagtgggcctctgcctgctctgtggctcgtttatcatgtgtctcatctttaaaagttggggctcagtctaggtgcctcctggcctgagcaccccagaattctatgctgatcccttcattgtgacatggcctgtcatctactcttctgggaagaccatctgcacctcactgatacttgaagctcattgagtattgtcacatatcagcccagaaagtcacagggtacagcaactcatacttgctcccagcaccaggccagccccattctgcctccagg

SEQ ID NO: 46770 - DNA, 1143 bp, Homo sapiens
caagtatcatcatcttcctcattttacaaaagaggaatcagaggttcagagagaggagataattttacttaaggtcacacagacagttggcagcagagatgagctcaaaccaggtcttctgaatccaaatagtccacatgtccatcaatgtgctgatattccactgatgcactagagtcccagaggttctttgcattggcagtcattgtaatgttacaaatcttataatatcttatttttagaaacttaaaaacatacactgcctcaaattgagagaggcaagttctaaaaccaggcttttcaaaggtattatcctgtgacagttccccatgtcagacaagtctcatctctgttccttaattctgcagtggagctggcttcaagagcagtcagttaggaactgggtctttggtcaaagccttgtaatttattgcaatacagacagatatattgggtctcctatggtcctaaaaatatgagtatgaaggatgtgatggcatttcacctataagagaaaaggacttcagaaaaatgtgtagcaatatttctttctattcaaaaccttagagaagaatattaagtataagaatatcttcacttggcagatggggataaaggagactaaaagtttgctaaattcagtgaaaactcatcaaaatgctagcatttgtgaggttagagatatctcctccttcacaggcttttgcgagaggtccgcaattttgctgcatatacaggagacacactgtgccctgcagtgaatcacagccgcttggtaataggatgtttgtgtggctttgcgtgtttgtatttgtgcatgtgtgtgaacatactcacagattatcttgattaatgttttgatatttgaattgtttcctgtatttgacaacaattctgacagaaaaactagttgttgttgttgttttttcagtacataatacgtatcttttaaaaggctagaaaaatatttggggaattattttattattttattttattttgagacaaggtctcactctgttgcccaggctggagtacagtggcataatctcagctcactgcaacctccacttcccaggctcaagagattctcctccctgagcctcccaagtagctgggactacagacgtgtgccaccacatc

SEQ ID NO: 46771 - DNA, 1041 bp, Homo sapiens
caaaaagtttctaaagaggatcgcgtggaacccagcaattgattaagaatctcaatggccctaatcccctgagaattgaactaagggctccccagcaaacacagcgatttacatggggcctagagagagcgagcactgccgggggcggcggcgaagggcagcagtggtgggacgggcggggtagggggagttactgagcatgcgcccgggtaggggcgtgggggagttactgagcatgcgcccaggtaggggcgtgggggagttactgagcatgcgcccgggtaggggcgtgggggagttactgagcatgcgcccgagggtgtttcggggcgtccgaagcgggcgtgctccagcctgctcagcagcgagtggttggaaattagcaaagtgagagggtgcgtggcctgagggactcggggaggctgagggctttttttctcaacactgtgaagctcagggaaaggagtagaactgggaaccaagtaaagtaaaatcgtggcaagtgggcatagacctgaaatctccttcgtgagggaacccagaacgtgcagctcaatgtatgtttggaacgaacaggtgaaaggaagcaggaggaggagggagttctagcgaagacttcggagggaagcaacccatcccctgccacaagaaagcaccgccactccagtgggaacggacacgcgtgcacacagccacgagtgaggtttgaaagaggccccaccctccattacacctgtgctccaccgtggcccccagccaagtttaatctcccattcagcacttacttctggaagcttctttccctttccttcccaccactcattggcctttcaccccctagttttttgtctgtgtgtgggactgtcttcccccactccccttgactgaagttccttgagagcagcagccctctttttatcagggaagagatttgaagctcaggacattcttatccaagtaggtgctagccacctgggtagtcaagacagggccctgcacagttaatgtgaatcttgtcataatgccagggttattgttttg

SEQ ID NO: 46772 - DNA, 1029 bp, Homo sapiens
catctgtaaggtctcagttcttgatctcttttctgtagacactcattctcgtggtgacctcatcttctctcatggctttaagtgtggttgatattccaatcattatcacatttaggtctccagctctgacttttttctccagttccactctgtaaggcccaactccttccccagtatctacacccgagtgtgtggtggccacctcaaattcaacgtcacccaaacagaatttcttatttcccccaaactccttctccccacagacttctagtggtaaaacccctaaactttgtaatcatcttcactcccctatctcatacaccctacctttaattcagtagcaaatcctgtttcaccttcaaatatatgtagaatctgcatcgtcctccctctttccactgccaccatcctctctcacctcaattactgcactagcctgatacctggactctctgcttcccttgcaatccattctcaacagccatcttttaaaaacaaaagtcacattgtggcactgcgtagactctctgttggctccttgtttctatgggaggaaaagtttttacagtgaactccatggctgtccttgcccggtcccttgttattctgtagcctctcctgtgctcgcccccacctctgctcttccacaggtgtcccttttgcctcccttagggcctttgcactggctccttcctggggctggagtgctctgtcctcacctcagtgaggtccttgctcagatgtcaccatgtcagtgctgtgattattcagagttataacctgtcttctcctggcactccaggtctctcttaatccgcttggcctcttcttttttttttccatatcaaaaattaaccagtattattatggaatttacctattatatttattgtttattttcagcatatcccagtagaatacgggcttttccagggcaggaacctttagctggtttgctggttggtggtacatcaagctcctagaacggaactggaaacgcagaagacacttaaataggtatttgctgtt

SEQ ID NO: 46773 - DNA, 1051 bp, Homo sapiens
aatctgttaagtaaaaaatggtatctcatctgtttttaatttgcatttctcttaggagaatgagcatattttcataaatttataagagctgtttgtatttgtgtttctgcgaactgttcatatcctttgccattgggctgttaccaagttgtatgacattatacctaagggaaataagcccctcatgtgataagaattggagttgtttgcagtttgttcatcttttgattcgggttatattacatttttccatgttggtgaatttattagcagcttattttaaagtctttggatttaatatcatgaagagaaaaaggcgttccccatcttaaaattattatttttaaaatgtccagggtttcttttggtacttttgtagtttcaatatttttatatttaaattatttatccatattgaatttattttagtacatatggatccaagtttactttttttcccagatggctactggttttcccagtcatttattaatagtccattttccctctgactaaatcccccatgcctatgtgtctgtttcttgacttctgtttcttgacttctgttgtgttgctctgcctagctctgtgatgttgagctattcatgttttagttgtgacactattctaattgttaagaatatgtttgtattagggaggattgggcttgtattaaatattttattgttgatgttaattgtcagttttgtagtggtatttaaaaatgaattatgtggctgggagcggtggctcatgcctataatcctagcactttggaaggcccaggaaggtggagtgcttgagcccaggagttcaagaccagcctggacaatatgatgaaactctgtctctatgaaaaatacaaaattagccagacgtggtggggcatgcctgtagttccagctacttggcaggctgaggctgcagtgagtcatgattgtggcactgcactccatcgtgggtgacagagtgagacaacatctcaataaaataaaataattttaaaaaatgaattatgcaaactttaaaggaaactgatcatattttatgt

SEQ ID NO: 46774 - DNA, 1028 bp, Homo sapiens
atccgccagggaagagtcccagctttttcttggtgttattttaggtattaactcaggagggcttcctgaaggtttgtcagtgagatagttggggggttcctgagctttttattgttgtacgtgaacttggtacttacttctttggcttttaaactctcagcagcacgtacagatgccctcacatgctttctgggatgactttaacgctaaatagcaggggtgtttctcaagaatgtttaagaaaagaaagcagacatttgtttgcacaaacagatatttgtgacttctgtgaaaaaattccaatagttgtaatataggaaatttttataaacaaacacccctaccaactaacccatcgtgtatttttatgtgtgtatagaaaaaatgaaaggatatactaaaatgttaattgcatagtttctctgggaattgaatttaattaaaatttttttatcaagatttttaaagttttataatgaccacgttatgtttatgtaataaaaataaaatagaggctaggcacagtggctcacacctgtaatcccagcactttgggaggctgagatgggaggattgcttgagtccaggagttcgagaccagcctgggcagcatagtaacaccctatctttatttttaaaaaataaaataagagagggggacaataaatgcaaatatataaatgacagaaattttatggtctggtcaaagaactatcattgcatgaaattatagatatggtcatgtaaggttaccttttttcattataattccaccaataattctaaagtttcttttctttttttttttctacttcttccacagaaaaacaggacaaagaaacctgtgtgaattttcagcttttcaccttctctgattttatttcttcctcactcttcctttgacagtcctcgcagtccgcctgagagagtagagaagaccccctcccagaaccttcctgtaaggtctccccgctgacttcctgtagtggatgtgactgtgtgccaggtgcctgccgaagacccctgtc

SEQ ID NO: 46775 - DNA, 1035 bp, Homo sapiens
gatgaaattgcgccagtgcacttcagcctgtgtgacagagcaagaccatgtctcaaaaggaaaaaaaaaaaaaaaaaaaatttattcattagttataaatgcacactgatgttcttataagtgaaaagatatattgttttggttttgctttaagattccagcaaatataaaacagaaaaagagggaatatattaaaaaggctggcaaaatatgtatcattgttgaagcttagtgatgggtgcattgtattcaatatagtattctcttttgtgtatatttgaagtttttcatgatagaaggtttaaaaatttagaacaaaaatgaatgtggaggttcaggatcctaccagatgtttctaaatgaactttaagtgacaatggggaaaaatgtccatatcatcctggagtttaaggcagggaattcttggtagggggctattgaaaaatagccaaactgttagtcaaaaatgtacatatgatctcatggccacagatagtaatgtagaagacagatcacgaaagtactaatccttgggtgaggaagaacaggagaaggcagcccaagaacttaactgaggccccaagaactaaggaaatctgttttgtaaaaggacctgtacggccaggtgtggtggctgacacctgtaatcccagcactttgggaggctgaggtgggaggactgtgtgagcccagaagtttgaggccagcctgggctggtttaattaaattagctgggcatggtggcacacgcctgtggtctcagcgacttgggcggctgaggtagaaggattgtttgagcctgggtggttgaggctacagtgagctatgatcgcgccactgcattccatcctgggtgacagagcaagactctctcaaaaaacaaacaaacaaacctatacgaacaatggtaggaatgtcaaggaacccaggagtgaagatcggattagtcagatgctgtgagaggaggtggaaaaaaccagtgtagaatgggcaggcacctttgaaaaggctagaggaaaattttggaagggcatt

SEQ ID NO: 46776 - DNA, 1124 bp, Homo sapiens
tgagtgtttttcccaaagatttgtcaccttcttgtgagttgtctagtctgttcttttggttttatagatttattctaaactaaaagttaatggtagttgccatttataatttcttgcagaggtttttgcagagatcatccatttaatatttttgtgcattgaaggttttaattgtacagtcaacactgtcattcacttgtgattttcattttttccaagcttagaaaacttgaaggatgatgacttttttattggagaggttaaaaaaaaaaagtaggtaaaagtgatggatgcttaggctgagggtggtgactgaatatgtggtacttgaaattgagtttgagtgtccaggcctggtttcattatatcttgggacacttaaaaaagtcttgcagaggcaatctgcttgaaaatgctgtataaaccttaaacctctaaattgtaaaatgtaagtgcataataatttctgatttgtagacttctgttgacaatctttcaagacgggagaagggtgaaaaagacggaaaagacaaacagatatttttcagaaatgaaaaacatgtacattttctgacatagggaatgagagatttttctaaatgtgacccagaaggctttcaggtgatttcctaacaagatttgagttttctcggattaaatatggttgtggctctctaccatgtgccccagtcttatctttgttatgccccttcacacatactctgttcttcacatactcttccttctgctggctagtgcttccctgtttctggaactttcttaagcatttttaccatgtattatagttatttgtattgtagttacgtgtcatccttcttcgtcttagaagagaagtttccatctgactccatgttttctattgtagaccctagttcagtgccttttaaacagcagatatggaataatcctctaatggaataaatggggagaagaagggatagtttgtggttacctgggaaagcagtgtggttaagtcagcatgggtttctcaagaacaagcctttcttgaattaacctcatttcctgtataaatcagatacttattggagagagaatttgggtaatgttgttgttagaggatatcagaataaaaaaactacatg

SEQ ID NO: 46777 - DNA, 1034 bp, Homo sapiens
attttaactctgaaaattaaaattaatgacaaaagtcagatgtgcccattctcacatattcaaacaataaaacatacagacaaaaaaaggattcttgtatcccactttttgatcctattcctaatataaccactgctgagtttattgtatatactttcagacattttttatgcttagtggatatattagatctttatacattccccccccccatatacttgcatttttttttttgactaatgtcataaactttgttatacacctcagtgggatttaaaaacacctgaagcctttgttttttggctggtggcaaaaaaaccagagtaacttagagaagttacccattgatgttttcacagggctttaaacacgaagacctgatttgtttgtgtaaatcgttggatgtaatcttacagaggaccagggcttgagcaccttcagaaacatggtatcatctgatcatgatgatttccatcccacgacagaggaagaaatggagactccaaagggacagaagtgaattcttccaaatttatgaaaatgaacacttagctaaaatgtgttcactgggttatgacaagtaactggacttctagggaatgggatggcaggtggggtgctatcagtttataaaattttttgtaaccttgtctcttatttctgcttccctcccccagccatgggaacacaagataaatttggagtaggtgagggtggagagcaaagtgactccctgggctgtgcccttcacactggttttagaaagcatgcagctgactgccctggggtctgatctatggtgctgcgctcgagagaactgtaaggtctgctgtaagtgatgggggctgtggacttatgcagaagtgcacttgttgggggttttcacagtacccaccttattatactagagaggcaggtttcattgcttaaggggacaatttatggcaataggcttatctccttgttttagctctttatgtttttctgcctttaataaaatgtgaagtcacaaagcaattaaatagtagtgtagt

SEQ ID NO: 46778 - DNA, 1074 bp, Homo sapiens
ctgaatccaggtggaaaaatgctggcctacttctggtccttggtatgccaggatccaaaggtggtgccagctgatagcatatgttcaacagctgtgttgatgccatttgcctgcccagacaagcctcttgaggcatgaaagcctaaggaaggtttctcatattaaggatcaacagggactcttctgtatccgtcctaccagtgtcacctccccacccagcatcagccgagcaccacatccactgaagctcaataaagaaatgtttaatgctgaagagtttcaatcaacaagatgaaattttcaggtttaggtaaacttaggaactggcttgggttactagacttccaaattttatccggtcctaccttattgcatgacataaccgtgaggactaaagtgaaggcttttcagcagtcacttcagtgagtcctcagcatttaggtgatactgtatcaactcgtgtctgaagcaacttggatttaagatagtagatcttgtgctgattattagaatggacatcctgaacaccacttaaattaccatcaaactgcatagccagatctttaatttacgaaacctctattttgtcacttctccaagctgtcatttaagctaaaagctgctgtctttacacatataaatcaaagaaatatttcatttatattcacttgatacctaccaaatttcaccactggaatttctgaatactttatatcctctatccttccatccaggcttggctttactaagtgtcctttctaagccactcattatcaatcaagatagtaattattctgcaagaccccaaatctcagtggctttcaacaacacacactgatttttttactcatatgctacacgtccattatttgtcagctgcagctgtgttcagtgttgacctcaacctgtgatggagcagcctctgcttatgtcgctgctgttctttatagcagaggaaggaaagaaagcaaggcaaagttccacactagcccttaaaacttcttcctggaagtgagacatggtatttctgctaccacttcattggttaaagcaagtcacaatgccacacccgag

SEQ ID NO: 46779 - DNA, 1029 bp, Homo sapiens
tgaaaattacaacaaaaaaaaaagaaaaacacagaatctgactaaaggagcattcagaatatttgtatctagaataacaagtataattttattggcacaatgcttttacagtatataaaacacttaaaatacagttgcttatttcatttcctcagtaatcctagagagtatttcctgcatcttattgatgaggaattgaagctgggatagcttctctcctgactcttgaagtccgaaaacaagtggacggagctgtagcactaagcctcagcctgctcgtcttcaacctgctcctggctgcagagtcttgattgactctgcctgtctccagtgtgctttcattcccttcagtgggtaacttgtcagacctcatcttgtttttgagactttggtttctgtcttgccttcttcctaactttggtattcttagttccaaatcctgaataactcctgtaatgggcctcccagtagggggggttcctgtatttatattcacagatgtacgtattttaatagttaacatctgaaatcagtatacatcttaaagttgccatggaagttcatttcttcagtgtctgcctctgctcgtcacttgaggtgctggtaaactaagaccaaagtttagattccctgcttgagggcacttgaaccacagtggtggtgagttcagaatgcaaatgagagtaactactgacttaggattcaaatcttcaggggagattcctcccctctctgcccagttcccaggttgaaacatccaaggctctttgccatccctttctgcatggcgggtttctttgtggccatttggttccctggattcaagtggtccctgatacctgttcagtttaccatcttgggccgggcatggtggctcactcctgtaatcctagcattttgggaggtcaaagtgcgcagatcacttgaggccaggagttcaaaaccagcctggccaacatggcgaaaccccatctctactaaaaatacaaaaaattagctgggcatggtgatgggcgcctgtaatcccag

SEQ ID NO: 46780 - DNA, 1028 bp, Homo sapiens
ggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgtaagctgtctccattgggcctcctggccaggggtctgggggactctggacgggagctctgggagtgccttttggccaggagcgaccaaatcctcctctattctcctctgggatttgtgtcgccatctaggtgcctcccttcacagccaagcttggctacacttactgtgtgtgtgcaaactaacacgctcataaactagtacccaaagcagaataaataggccctaccccaaaaattcatgaaatgaaaaagtgatttaacgggcatgtccaagagcccctctactaaagggaaatcaatggatttgcactgcagaatcaaattcagtgtaggtgacttctgacaggtgcacttggaaatctggattatcattagaggctggggttacacggtgactaaaaccagttcctactatagtgaaccttttccacccaaagtgaacacactgacccatcaaagtgagtagcttgtgacacaacatatgccagagcctgcagagtagcttgacttcttgaagcgttttcccatttctgcttagtctgtcccatcaacaccactctgctctcttctcccagttcccaggctgtccacatttccagataactccttgaccgggaaactcaaccaaagggggtacttttgcgtgtctctaggccaaaggacaggagtggtgataggtagaaggtaggaactggcatgtaggcagtgagatggtgtaaaggtcacagaggtcgggttggcttggttccgtttttgaaagtttatctctgtggatcacaggtttggatcagagcttctttagctcaaaacaccaaaaagttaggaaaatatcctttgtaggtcagattcttctgggcccaagccag

SEQ ID NO: 46781 - DNA, 1007 bp, Homo sapiens
tctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctcttttccttgtccctgtttcatctctgatagctgtccgccccgagccgattgacttacggcagtggcagcacacgctgatggattgagctgagcagggagggtgagtgcgccagttggctccgacagggagacagcatcttccgagggcgcttgtccacttgcacagcttggctcctgactcagattgcaagtcgggaggctgaagtttgaggcctccttagacaaagcgctcttccgatgggtagccggagatgcttcttctcaggtgcagaagcactagtccttgactctgagtacaactgctgggtgactaggtgatacgtgtagtgacaagaaag

SEQ ID NO: 46782 - DNA, 1049 bp, Homo sapiens
cttggataattcctattattccaaacttcatttttaccattttttgacagtcaaggttatagaatctgaaaaaggtttcgaatccagcaagcgaagtggaggttgaatgcgaacagtgcgaaatctctagctttctgtctccatgttctcactttcgtgaaagcctgggggtacattaatttttcttaaaatattactcatttttaaaagcatctctatttgggtatggaatttatttattgacctcaataatatattgactatttttaaccgtttctctttaaatttttaaaaatttaaataagggacaattaatgtttgctttaatcactgccacttcatgaaattcaggttgaaagtaaacaaaaatttttaagtagacatttggattctgtttttttcttgtgtagcttctgaattttgttggttctggacaggtttgtgtgtgtcctataaaaatttttaagtagacatttggattctgtttttttcttgtgtagcttctgaattttgttggttctggacaggttttgaagtttgtgtgtgtcctatcatgtgttgtatacttctgaccatagagtggtttcttatgaattaaaaatgaatttggttacaaactggataaacagatttataataatagggccacattgataaactgagattatgcaaagcaacttgtgaagtctgaggactaaatggaatagtaaattcaactaaataacttcctggcaaaaacttatcatagaaatgtaaacattaattttcaaattttattttatttgcaaatgagtataatgggtttgtcactatgtaaacacaaatataacaatggatgcttcaaacaaatatgacagaggtgagtgcttgggggtgatgaaatactccaagtattttatgcctccaggaattctatttatgttacactaatctttgtatttgagtttgctcctattcgtgcgatgacttagcctgtgttttaatgattgcttgttcaaccattttggtatccggccaaaatgattagagcttgggaagaatgtttcaga

SEQ ID NO: 46783 - DNA, 1021 bp, Homo sapiens
catttctcctgcttaactaatgtcaggttccccatctgtaaaatggggataattacagtatctgtctcccagattactgggaatattaaatgagcactcagaacagggacagtatatcctcagtgctatataagtgtttgctaacaccttacccatatcctctgctgataatacctgtaatttgcaacacagattactttttatttttatctctagtattaactagtatgatgcctttgaacttcctgggctggcagaggtcaaggctggattcctatgaggtatgtaaatggcaactcctttattggggaagagaataggttccaactacatagatttgttcaagaacactaatcccagaggaagaaattaaggaagaggaacagtgatgttctggggtcatgggatcccgagggctctggaaggccctccctatcttctcccttgtagggaaaagatattccctcttcttcaaacctctccatctgcatagaatacagaagtattattgcctctatcaccatagatgcattttgcttctccttaaacttcatataaatggaatcctgtactaaaacttactcttctgtatctggctttttcacccagtaacaaaactaagattcatgcatgtttttgcacatatcagtagttcattctctttcattgctgtgtagaatttcattgtataagtatgtcacagtttatttactaattctactcttaagttgtttgcaacttttggatgctataaatacatttgaagattaatttttaaaagacattttaatagtaagcttcattaacacttttgtagaagtgtatgcactagcttttctttttgcttacactcgagttgaattcaggaagctttgatgttttctaagcattttggtgggggttctttattgtctaaatcagattgtctctttaagaagggtttaatttttattacgtggggcagtgccagccatctttattaataatgatagctgaatagtcacaaatggtgatcaggtga

SEQ ID NO: 46784 - DNA, 1461 bp, Homo sapiens
aagttttcagcatcttaaatttttttaacgtttaagtcagttggctgcttttccttgttcatcataaaatcagaacgttgacaaattgaccttctttttcattcatagcataaataaatgtctgcctatgagcactttgctgcagctctgtacaagctctctagttcaaacatttttcccacttaaattggatcctttctttttgaccatctttctcttataatggaactttattacttccatagtaagtgtcagagagatgtttccctgtactgctttttttttttcttttttttctttttggcacacttttgatgccttctcattgtgcctaacttcgctttcttctatttagagttagatgtctgatcaaaagtacctcaggaatcatcacattggcatgtaaactaattccacacatgtttgcctggaagatgtatttcacacttgaaggggtttatttgggaagaacatgtctgaattatatcagccctcttcggaataaagtcagactttagtatgaaaagagcggtatatcctctttgtgtcaggaagcaggcataggctgcttacctgtgatttttttttttttttgacctgcccttgtcgccattgcaatcctgaaaattccttctcaaaaattaccagtagctgctttaccagcagagttacaaaaagtcacacacgctctctttttaaagtgtcactcagctccttgaaggaacaaaatgtaccagtgtcattttctgttcagataactctcctacaggaatcataaacttctcctctggacctgaacaagtatctgttgcatttaatgcaactctttttcttgccagaacagtaacccctcgtgatttactgttcaatctgtatgaaaaacctgtgtgacctaattctgcatcaattttctgtactcgtgaggacgctaaatgagtcccctgcagttatgcagtattacatcttgttgttgtttggggaagtttagaatcctgaatctctttatcggactacctgctgaatctcactgatggggagatgaaattgtctggagaggaacattatttaaaatgaagatttctattaacaacaacaacatcaacaaagatataatcttctgtgttaaagaagcccctcctgtacctttgcttcttccccaccatgtgctgaatcaaatgcatataattttactatggagtctacctttcctcttctcctagagtttgcgctttgtacttcttgcctcccttccagaaaagggattcttttgtgccagggaatcagattcactgacaaataactgggctccttggagaaggagtcatttcagggagaggtgcacccccctcgctcccactctctctctccagtgcctaagtcacacagtgccccatctccccggggttcccaccccccatctcctcatttccgctccacttccctgcttcccacctcccagtt

SEQ ID NO: 46785 - DNA, 1033 bp, Homo sapiens
ttaatagcacgggccaggcatggtggctcatgcctgtaatcccagcacttcgggaggccgatgcctgcggatcacctgaggtcaggagtttgagaccagcctggccaacatggcaaaaccccgtctctactaaaaatacaaaaattagctgggcgtggtggcacgtgcctatagccccagctacatgggaggctgagaggcaggagaatcgcttgaacctgggaggcggaggttgcagtgagcagagatagtgccactgcactccagcctggccgacagagcgagactccatctcaaacaaacaaagaaaaaacaataacgacagcacggtagcagtgataatattaacacattatgatgacaaatcatttaataaattagaacgaataacgtgcgtatagcaaataaaacaagaatcagtcttagatactatttttagtgaagtccctgaaaaatagttttccttaccaccatttttaaatttttaaaaatgatgacattttatttcccttccaaactaagcaactgtaggttttttaaaaaatcactcattttgatatttgggctatatgaagtattagatcttctacagcatttaggtccaggaggtttcactttttcacgttaatgaaaatgatggctgtcgtcatcagcatcttggcaaggaagacaaatggtctggttgccttaggacagaaccagaagttagaaagaaaaaagtctgtcctcccagctctgtactctggcaacatcatcatgtttggaaaaaactgtaatattcattttttaagacaatttcgacttttattttagattgaggggattcatgaataggtttcttaacatgggtatgttgcatgatgctgaggtttggggtgcagttgatcccatcattcagctaatgagcatagtacctaaaagtttttcatcccttcctgcgctccctccctcccccgtctagtagtccccagtgtgtattgttgccatctttatgtccatgaatacccagtgtttagctgccacttaaaagtga

SEQ ID NO: 46786 - DNA, 1529 bp, Homo sapiens
actgattactctaagaaatgtgctattaaagatgaatatggttgactttttcacttaatttaatctgaaaaagattaccttttattttcagcgttaaactagtgtacaattttttttttttaattccctagaaggacagaggcctctgtctttctttgggagtttattgtgttgacttgttgctcgtgaataatagggtaggtttcctttaacatgttatgaccttgtttaattttctcatcattacagacatttttaggaagtacacatttataaatcattttgtaacttctcattttcagcctggtcttccattaaagcccttgaaatggaagaagaagaagtgaactacatgtatctccttaagtgtcagaggaggaataatttttaaagtattgaaaacctagttatacgaaactaatttctttgatgttacaagatgaatgtgctattatgtgcgtttagcgtgaccttgaggtttcctacagggtacaaaagagaatggggctagatcaagccaccagggcctgtagaactaggattgaacatggctgaattagaaaattggaccactgtctgagtcgtgttagcaggtaatcttttaaaatcaaaactacatgagaaaatatttatactaatttgctattattctcttgtaggctagttcgttaaaagatctattaccatagtgcttcagtctcatgatctgtaagaaggcaataggaatgttgtctaccccatagatttgtagtgaggattacacgggaaagtttatctaaagcatgtagaatacaccctaacatatagtaagtgctcagtaaacattatttcatcaagcaattctatgatacgaaagtggaatcataattataatacggttatgtttttctgaaaacaaatgtctttttaaacctttactgcatattctttgtgatgttgaatcaataataattggtcaccactttttttctagttggaaatcagttgaatattagtgtgtaggatatctttgaggacagtgacagattctttaaatactgaggcatgcagaagaaaaatgaggctttatcacaggtgataaactctgcctaccaccctgttcccccaactcctacaaagagaattttctaattacatggcctctactttactagggttcctggcgattatgaggcatctctcacagtactttagggtacatttttccttaagctgtggttaggagcccataccaggagcagccctgcctattgcttaaaagtttagccatcagctgggtgcggcggctcacgcctgtaatcccagcactttgggaggccgaggcgggcggatcacgaagtcaggagatcgagaccatcctggctaacatgttgaaaccccatctctactaaaaaatacaaaaaattagccgggcgtggtggcaggcacctgtagtcccagctactcaggaggctgaggtgagagaatggtgtgaacccaggaggcagaggttgcagtgagccgagacggcgccactgcactccagcctg

SEQ ID NO: 46787 - DNA, 1040 bp, Homo sapiens
ccctgtcttaagctctttgggtccctgaagacacaatctacaaatctctagtgtgctggcctcagatcacatctgactttaagtgactctctacaagttgctaataaaatacatgttttgtctcagcaaagacaaatgaacataaaaggcattaacacttaagctgtgttagataataatggggtaacaatgaaatcctattacataccggagagttaccaggaagtcctgtaccccatcatcttggttacttataacattcgacattgttgttttgcagaaggctgaggagaatgcagagggtggggagtctgccctgggaccggatggagaggtaagggatcgtcatcctttccactgtgttctgctgaatggagtctgtgccatacctggcagcaccattcttcatgcatactattttattcttactgtgctatttattttaagtaaaaatagtaatacattagcatagtagaaaattagaatgatacaaaagggatacagtgaaaaataatctacttacatgtcagactgtcaatcaactgatattaaatgtcttgcatagtatttcagaattttctgtgcacatataatcgtatgtttacaaatatataggatgtgtaagaatcttaaatgattctataattatattgcccaataaatgatacagaagcataaaatatgacacagtttctctagtttattattaatttgaaattataaaaatacataaactaaagaagtcacatatttggttaacttatttttgaaatttttaatgggcttgccatatagcttctatgtgtatgttcatcagcctagtcctaaaattcatttcctagtagttccagtattctcctgaattatgaggatacaattaatttattggatttttttctgaagaatttaaggttccctgccagcgattcacagtgaggaggcacactcccagagcaggatgggaagggagtttgtttcaaattatcttcattttgtctcataaattctgataaacctacttggaggatcagagtgggtgg

SEQ ID NO: 46788 - DNA, 1024 bp, Homo sapiens
aaggaatcctttgctgaacacctaggctattcaaatggggtcatcaatgggtaaatctcaaatttttttttcttttaaaaaaaaatgttgttggccttacataaactcctcctctctacagtgtttcctcttgtgcaaatacttacttccagccctctaagggctcttcagtggagaagttaaccaaaacggtatcagcattctcttttactttactggcataaattattacttgccttaagcaagtggctattcaaaggacatagatcttatttaatagacttaatagtatcctagtgttctaaaaatgttgttgaagcttcaaaggtttgttatttataaccaaaagtatagcttgggcttgaagagaatgtatcttattaaatttcacattgacatttgacattaatgtacatgagaagaaatctctcatctgctgtaaatgtttacagttttatagtcatttgttagagtgtggtctgtgtaagaaatgtttttcattagcaatggatgttaaagagaatcttgacttgcaacaacaaaaatgaacactgcattaacagaaagtgtgtgtgtgtgtgtgtgtgtgtgtgtgtgtggtgtgttgcaaatttgaaaaatttattattaggatgtagtcatcatttttggatcccaagggcggacagtttcactgggctaagaaccaggaactatagcctatcctgaagcagtgctgctaagctttccctacctctccttgcctctctcttctctgggttctgtggttactcctgctcccatcagcttggccagggttgcatggtgaaaacacagctatagggtatttggagaacagttctcagagtggaggatggatgtcgggaagacatacgtttgaaaatgtgtctgttagaaataacatatcctgtgtcataaaatcaactaccagatgagacatttcagtactatagattacatgtgcactggcaagttttccaaacagtatcacctaaaattcggttttaattgtataacacagtcc

SEQ ID NO: 46789 - DNA, 1058 bp, Homo sapiens
gtgagagtaaggattttgtaaaatttgtgaagttgcgaagatgcctcattagaaatgtttaagctgtttctttctttttttttgtaattgcaaaatgttcaaagttttttatccagaagtacaaagccctggaaattacctcaccagtgttaggaggagtctgggtatatttcttgaaggaagcaagcctttttgtctcattctgtgccattttcagacaagagttaattggcaaattaatttttctgatcccctcaggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggtctgcatgtcccactcaggtgcccaggcctccctctggagagcaactaaaagatgatcagtttcattattcacatttacaggacagagcaaatatctaaacgagtgggctgttgctttcttggagccaattcttctggctgttttcttatctcccttagagcatagatacgaggtcccacatatgcctttgaagagctgaagtttgaggtagaaaaacttagtttctccttagttttaatcccatctcttgggattgccattgaacaaagtatatttaatgagggataagtcaaaaatgttgcaaaatcatagcagtaagaacaatagcaaccatcattcatgggacccttaatctgtgtcagcctcttgggcattttttcattcagttttacgacaaccctgtcagacggttaatatgatttgaatctttgcagtcaaggaaactgaatcctaggcagggtaagtaacttccccaaggccaaatagtattacagtagttaaccttttattttgtgttttatttaaagtcatcatcaaaacatattctaatgagcatttattgttgtaaagctcttttagccaggtaagttcagggctatccttttaaagcagtactttgatgttttgttttttt

SEQ ID NO: 46790 - DNA, 1029 bp, Homo sapiens
tttgtaaggatttgaaaataagcatttatatttggcataaggtaaatggaattaaaagaattaatgttaggtactttttcatatggatgtccttattaaaatcttacatccccatgtgaaatagatgtcatacccatatgaccaatgaggtcactgaagcgaggagacattaagtaacttgttgtaaaagtaacagaatcaagatacacatccaggagaactcatatttcttatagtggaccacagtttcctccctgaacggattttgctctgggaagatggttttaatagcttgtaaaatagtaacgtcaaggactaaatccagcaaccccttcccttttctttctgccttgagaaatgggacccctctggtctggaggacagatcacttacttgtttgtaccttgccccagctgtccactggttaaaatcactctgtttttaaccccaggaagaagatgaagtaccggacgatgagactctgaaccaaatgattgctcgacgagaagaagaatttgacctttttatggtaatgttacagaaaatcatgaacacaaatgctttatacctctgcccctttttctgttaagcagaatgtctgcagcctgcgtgcctggcagaacttcatacgtaaagcctatgcctttccttcagttcagaggctgcaaactggctggagttagcctgcagacatattttgtttggcccacgcagcgttttttaaaatttcccattcattgccaacataaaaaagaatcctgatttctggcttctcttgaaaaatgagatcgggcagtaccaggcccacatctttgtgtggaaacagttggccagggctgagtagcagctgcactctctggacaggcctcgcggtctacagcttaccatagacgccctcctgttcccagttcgtttctaatcccaggccagtgtcattcaggaagcctacctggctcctataggcattggaacttacaacagtgcccttacaggatcaaagcaacatgctccttagggagataggtggac

SEQ ID NO: 46791 - DNA, 1032 bp, Homo sapiens
tgggtaacagaatgaggccccgtctagaataaagcaaagcaaagcaaaatactctggatagagtttttttaatagggaaatgaaacattttaatgctcaatgtttttaatattttaaattactgtactaagcaaatgcttattttactagttttttccttcccctctacatgtatgagtttttaatgtttagacataaattttttaaagttgtggaacagtaatcccattgactattaaaatgacttgtgcactttgaacttgcatggttacttttatggttccacacgtctatgcaaagctgtgtgtgtgtgtgtgtgagagagagagatctttgctggaagtgtgtttatctgtgtgtgatatttgctgaaagtcttcctaagatgtatcatgttatgtttttacttgaattattcacctaagcctggcaagtataacttagccttttcctgatggtgcagtcatcattaataataagttattgttttctgctataacgtagaataatctggtagttaagggtgtggtttatgcagccagactttgagttcaaatactgagtcatcttcttactatgatatgatctggaacaagatgctatatctctctgtgcctcagtttcctcatctgcaaaatgcagagagtaagagtggctacctttttagggttattgtgaggtttaaatgactaaatgtacccaaagcactgagtggctgtcaacacagcaaacgtgttagccaatgttgctgctgctgctggcagggacaatggtggtagtagtagtagctgcatcagtagtagtagaagtattaatgatgctgtgtatctgaagatttattaaaagttggggctatttttttctatattagacagcctcaaactactatgcttttgatttcttctgttgctttatttacgtgttttcctctctcatgattgggctgttaatggacattctttgcattggactcaagcagaacaactacctcattctcatcagtatcttattaatttgatgttcttaaccacg

SEQ ID NO: 46792 - DNA, 1042 bp, Homo sapiens
tgtattcttagggattgttttttcataacccacccctcgttttgtttaccttttccttcccttacagtaatgagaacattagggtcttgttcttaaactgagctaaaatttcatctggattcagttatcatcaaacacttgaatttatagatcttttaatatttgtcatattctcctttactgtgagtgttttgggccttcagtgtgttttgctcatgaaacagacttgagttaaagatgcatttatccaatatggtagcattccttttttcttcttcctccactgattactgttaacttttacttttttttggttaatttctttcattttattctaattgttggagctatatataaatatacacatactttttttgtcttggttattctcttgtcttgaatttgtctcctttgtttccaacgaacaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgagtgtttggttccttcaccttgatcatctctcaccaagacgccgagtggcgctccctgaggagcaggagttgttaagttgtgcacttaggttttattaaggttctttctagtttgtgttttatggctttctctctttgtacctgtttaaaatggccactgttgctattttgtatgatgtttcatcaggtattatttaagatagttgaaaatttagtttagattacaaaatgtttaaaatatctaaattagaaaaggattcttaaggacctctgaaataccatctgaaaatgaagatatttcagatgaaagggattggaatgatggagtaatattattttttttaattgaattgttagagaaagaagaatcctaatatatttaaggtaaatatt

SEQ ID NO: 46793 - DNA, 1227 bp, Homo sapiens
ctagcttctctgagttagttacaatctactctgtaaagcgttctaaggtagcacttgttgttttcaggttttcctcccgtcactcgtgcacattcggagatgacatggtctacttaagcttctgtgtctccttggtcagcaccatcattagcccaaggtcctaaaagtgaaataatgaagactttcccaattctgtgccttattgctgacactcagagtcccctcaacctgctcctaattgtccctacaagacacccgttcacctgcctcctcaccccctgtcttcctgaggcccttgcactgctggcctggcctggcaagctgcagggtggactgcgtgccctgcctccagtctcttcctgtcctggcttctttctgaggcacctaacttgtcatttcatattgtaactttagaactcttcacagcggccccgttgcctacccgatgatgaccagacttcttagcgtaggagaattgttatcttccacagtctgaaccttcggatcttcccaactttttttttccaacgcacccctcccagctctccttatatttcagacattccaaagaattctgtgtattttgaagcgagcacatgcgcttccacccctctgttgatttgtttatgggtttatgcttttccctctctgcaacaccccgaccccacactgactctagagcagaatggggcagtgactccgagaagggatttatacatggacaggcacaggctgtgaatcccaaagggtgctgtctacacctggagggagatctagagggtatggagggtcttcccaggatctgtgaaacctggcagctgcttccctgccaccacaaaaagggacaccaacctagcagtttcaaaaatcctcaactgaagaggcttttctagaggcttgtagaagtgcccaagacgccaggtggtggtttattttcatttcccactaaagatcatgaattcagtgatctctcgaaaaggaatagagctcttggaagcagagctgactagttagatggtgttcagacccaaattggctgatgcttggaataccttctttgtgcaggctactgtaagaaagcactttatcctatttaatttttataactttctgaggtaagtatttcccccattttacaaatgaggggctaaactcagatagactagcactaccttcccaagatcacacgcacctctagccagtggctgcctgtctcccaccttctgg

SEQ ID NO: 46794 - DNA, 1045 bp, Homo sapiens
ctttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatggtttgtgcctgttcctctaggatgaactcctatcctgagtagtaccaagtgttctaactaaatgtgtgagctgtagttcttgatgttgtataactaagcctgtaattgggctggtttctcttacaccctagcacagttaaaaaatgaagtactgtttaacatttgctcccgaaatatttcttactgtgtaaaagaagctagcttagtctgtacctagaattcctcttggttagaggagtgagtttcttttttttccattaacttgtttcctgatcgagaaacacgtgctaagatttctatgaattctgcttctttatagttaagtctctgttttccatgttctgtcatttatataggtcaaggacaagtgccttctaaggcatggataagggctttcttcttatgaaagtctagactgtcttactgtgaagatggccagggaggatagcaagcaatggcattcttgaacagtctaaggcaggtttctcagtgtggtcctgagaacagaagcatctgcatcacctgggaatgtattagaaatgcaagttcccagccccatcccagacctactgaatcagaaactctgggggcgagggctgaaacctgctttcataagcccttcaggcgatactgatgtaaactaaagcttaaaaaccaccgttttactgtgacttcatgaagaatataattgcaatatcacctaaatttttatcctggctgggatggggcagattcttactatggacaatttctggaacttacagtatgaagagcagatgaggagtttgagacaaagaaaaaattgtacagggagtt

SEQ ID NO: 46795 - DNA, 1050 bp, Homo sapiens
gaaattatgagagctgtagagagtgagttgagcatagtttgtgattttaagggcctctaaaagtattagggcggcagcagccgctgcacagagacatgatggccagcctaaaacagtaaggtcaagttgtttggacaaaaaggctacaggacgcgatcccggtccttgtgtaagaattctgactgcacagccctgcacttcagctgtgtgtaatgaaaaggggtgggtgagtcagggagagctagggtgggggcagtctctaaagctgtcttcaaggaatggaaagaggagtggggacaggatttaggatctatggggtcagctaggtttccttttgtgagtttatataatggttttgttaggatggcaaaaccaggtatccaaaggcgaaagtatccaaccatgcccaggaaggaaaggagttgttgttttgtagaaggggttggggtttgagagattagtcgggcacgatcggcagggagggctcttgtgtttttatgagaattatgctgaaataggtaacggataaggaagaaatttgggcttgactgaagtaatgggggctgtctgtgaagctttgcggcagtatggcccaggtaatttgctaagcctgatgggtgtcagggtcagtccaagtgaaagtgaagagaggctgggatgaagggtgcaaaggaatagtaaagaaagcatgtttgagatccagaacaggataatgggttgtggagggaggtattgaggataggagagtatatgggtttggcaccatggggtggataggcaaaacaatttggctgataaggcatagatcctgaactaacttgtaaggcttgtctggttttaggacaggtaaaatgggggcattgtaaggagagtttatagtctttaagaggccatgctgtagcaggcgagtgataacaggctttaatcctttcaaagcatgctgtgggatgggatattggcactgaacggggtaagggtgattaggttttaatgagatggttaggggtgcaagatcagtcaccaaggagggagtagaggtatcttatactt

SEQ ID NO: 46796 - DNA, 1463 bp, Homo sapiens
ttttgcttaagtggaaatacttgagtaatgcttggttgcttttttaacctcaagtcagtaactgtgaaagactggacttactgcacctaagatctagaaccctgaagttatctaattggtgctcatcactgagcttgtgtaggcttcctgaagcctattcagggccctgtgtactagggaaaagggttggcagatcacagtgtgtggagtatgcagccagtaattctttcttagattctctctcccctcttagaacctcccctcatttcccagggaacatctgttttccatgagggcagtactaagggggctgaagattcccacagacatataataaaaggttccaagagtaggctggcggcagtggctcacgcctgtaatcccagcacttcgggaggccgaggtgtgtgaatcactaggtcaggaaatggagaccatcctggataacatggtgaaaccccctctctattaaaaatacaaaaaaaaattagctgagcgtggtggtgggcacctgtagtcccagccacttgggaggttgaggcaggagaatggcgtgaacccgggaggtggaccttgcaagtgagccaaagtggcgccactgcactccagcctgggtgacacagcaagactctgtctcaaaaaagaaaaaaaaaaatagattccaagagtaaacaaaatcctcaagtgttactgtgcaaagattatactcaccatgtttgatttttttggtctctggtggtcatcccagatgcattcacagtcatttctggacctttaatgtaatccactgttgttattaaatgagctgatccacatggagttactttttgaaatcatgaagttccttatgaatgtttgttattgtgtcttaaattctttaaattcttaaaatatgtcttaactcacttaaagataaaagtaaatgtttctgtggtccttctgggagtggggaaagttacaactccacaaatgttaagagagaagggtgaacagttagcagtcaggcagcatggttgggagtcatgaggaagagcattcaagatgacacaagttttgtaagcagacctaaggaacgggctgaagaatgttgtggagacccaggtacttcgacttagcattctgagttcagagttcgcccaggagttccaggcttgtggcaggtttagaaaatccaggatgatcggccaccttctttctcccagaggtcgatctgatcttaagttgtacctgactaaaacctgctgcaggagagatggtcagattttatttacacacagggagatggcttcctaagattgtgtagtgaaccaagaaggtgtttacaggcatgtgaaactggctattgtaaagaggcagtgatctgggacacgtgatgttagttaaagtggaggaaaaggtgtacccttcaagcagaggattccagggcctctccaaaccgtacaagtctgagccaagggacagaa

SEQ ID NO: 46797 - DNA, 1068 bp, Homo sapiens
gaaaatctataaagagtatatagcctacaataatagctaacatgtattagctgtacttacagtgtgagccaggtactttttattctaagtactttacatatagtctcattttaaaatctcctaatgactccatgaggttgatattttgttcttcccattgttataggtgaggaaacagaggcacaggctacagggtattttgtccaagataacacagctaataaagtggtgaggccaagatttgaacagtctcttcttaaagagcctgcctcctgaagggttactgatgaattcctttcttccttcaaaatgcttcatgtgatttaacatgccttatttcattgtgtatattaaaggccctttgtttatacattactctcatctatatttccccatttggccaatgcattgtataaattaggtgatctgtaaatgattgttggctaattgatcctatgtgcatacatgggaatacttggaaaagcaatgattgttttaatataacaagttcttgatgtagcaagattgttcctatacattgtggaactctcaattttaatatttactgactccattatccatcttaaaatgggcatatcggaaagggtaaggaataaataattgatggtggtgtcacacatctagtaatatgatagttgagctaatatgaattggttctcccaccatctcaaacacaaagaaatataaaagtcccctccagaccaatgcagagccaaacccaaactcaaaagcaataaaggaaatgcccttgtgccagaaataaaaagggaactcaaagccagaagtataaacaagatctggtgctaaggtctagacctgtcttaatctgttttgtgtggctgtaatagaagacctgagactgggtaacttataaagaaaagatgtttatttaggtcacagctctgtaagttgggaagttcaagggcatggccctggcttctggtgaagactttcgagctgcatcaaaatatgatagagaaagtcatctcatcttgggccatgtgtatataatttaattttaataactaatataaaattattgttaaa

SEQ ID NO: 46798 - DNA, 1022 bp, Homo sapiens
cacccatgtttctctgtggtcttatttgtacttatattcttcagagtttttcctaacttttcccttatacaatttgttgactgcctttcttgtgctgcttttacccttacaattaggtggaatttaccacctagtggtaaatggtacaatatatcatggactattataaagcattgaaatctgactttttcctctacatttgtatttagtttattaatttagttaattcacgttttataaatataaaatattaatttaaaaacaaaggcttttatctcttaaatttcacaaccgttatattcacagttatatgcatgtttgacatcactggctttatggtcatcagagctgctttttgagtcatctaattttcagagcacatcatcttcactttcagccaaagttagctgtgattcagctttttttaatctgtgtaggatgttgtcactggaaattttaccaagagctataaaagtttgctcaaatactatgatagaagttttttcgtttgttctgactatgaatatttacaacctcttcaatgtaattgttcattgcttttaaaaaacatatcaatatcttatttttgaaaaacatttaatataaagcactcttacatatgaagtgaaatgaatagaaaatgtatatgattttaatgttttttttttttttgagacgaaatctcgctcttgtcccccaggctggagtacagtggtgtgatctcagctcactgcaacctccgcctcccgggttcaagcgttcctgctgcctcagcctcccgagtagctgggattacaggcgcctgctaccacgcctggctaatttttgtatttttagtagagatggggtttcaccatgttggccaggctggccttgaactcctgacctcaaatgatccgcccgcctcggcctctcaaagtgctgggattacaggcgtgagccaccactctgagccttaattttggttttttaaaaagtcattcaaaaatatgcctggaaggaaatacatcaaaatgttaaca

SEQ ID NO: 46799 - DNA, 1037 bp, Homo sapiens
aagtaactgggactacaggcctgcaccaccatgccccgctaatttttgtatttttagtagcggttttgccattttggccaggctggtcttgaactcctgacctcaaatgatcctcctgctttggcctgccaaagttctgggattacaggcatgagccaccatgcccggcctttgtcacatttgaagactgaaatgtttaagtcttcaatgtacaactctacaatgtacaactgagggggaaatgataggcatgtgtcatgggttgaattgtattcccccaggagatatattgaagtcctaatccccagtacctcagaagatgaccttacttacacatagggtctttgcagacataagtagttaagatcaggtcatagtggaagatggtcagctcttaatccaatatgacctgaaaacatagcaggagaatgccatgtgacgatggaagcagatattgggcttatacagctacaagccgaggaacaccaaagattgctagggacactagaagccaagagaaagacacaaagctgattctcccctaggatccttgggagagaataaccctgcccttaccttggctatgaattgtagtcactagaactgtgagagaataactttctattgtttcaagccccctagtttgtggtaatttgttactgtagctctagggaactaatacagcttgtttccaagaaacatgtatatgtgtttgtatgttgcttcacactatgtgttacctaggtgagaacaaaagaataggagggttcatgtttgagaaataattactaggattgtagtgattgtagtaagacaaagagaaggaaggtacatcagttatccactactataaaaatccactccaggccaggtgtggtggctcacacctgtaatcccagcactttgggaggccaagacgggaggatcactagagtccaggagtttgagaccagcctaggcaacataatgacaccccctcctctacaaaaaaaaaaaaaaaaaagaagaagaagaagaacattagccagtgtggtggt

SEQ ID NO: 46800 - DNA, 1029 bp, Homo sapiens
catcctcccatgcttgtgcccagccacaccattccctcccactgccaaggtaagcattaaatttttaacaccatggattaggtttctaaaatattaactataatttttgtaaatggaatcatatagtacgtaattgtttgtgtgcctggcctctttagctctgttgtatttgtgacatatctccgtgttgtagcagcagtttgttgactttctttactacgtcatgttattctgtttttttaatgtgccacaatttagttttgatgaaaatttggcttgtttccacttttaactattaaaaacagtgataccaagaatattcttgtacagtcttttgtgcacatatatgtgtatgtctcttgcctgaatgctggatcgtagggtgtgcctatgtttagttttcccaagtggttgtacaaagtgactgtaaatatatctgaggtctagttactccacatcctattcagcacttggtattgccagtctgtttaattttaaccagttttgtaggtgtattgtagtcattcattgtggttttaatttatattaccctgtgactaatgagactgagcaccctttcttttgctttcattgtttttaatgatcacaaataattgtaggtatttagtatttattgggcacagtgtgatattttgatacatgtatacagtatataatgataaaatcagggtagttagcatatccatcacctcaaacatttctttgtgctgaaaacattcaaaatctgttctagctatttgaaaatatacaccagcctgggcaacatagcagaccccatctccacaaaaataaaaataaaaaattagccaggtgtggtggtgcacacctattgtcccagctactcaggaggctgaggtgggaggatcacttgagcccaggagttggaggttgcagtgagtcatgatcacaccactgcactgggcaatagagcaaaaccctgtatctttgcaaaaaaaaaaaaaaggaaaaaagaaaatatacagtaaattattgttaattatggtcact

SEQ ID NO: 46801 - DNA, 1051 bp, Homo sapiens
ccagggctccggaactagctctgagtctgcttctttgaagtgctgcttctgaagcaccggtttgccgtgatcagggatggtcctgcctggagttctctttatgcccattctctttctacttttgttctgctgggcgtttctggttttgtttgtgtgtaagagtccgtgtggattgcaaaaaacaaaatctagaaagtaaagtcatggtttcttccttttttcttttctaatttgtaaaaatctgtggggtttaatcttaggctttatttgtaggtgcttgttcctctatcccatttagacacttagaaagtttgaacaaatcaagggctttccttttttctgcagagcacgttagattttctataaacctaagtagaaagtggcattgtggtagagattgtgcctgatttgtaaagaatgttaaaaagatcgtagaaataatttctaattcaattccgtcgttcagatactttcaaactcctgtgatgctacttacatcacaacctattacacatacacatatgtgtaaaacagactgaagtttcacgaacagcatccttagtatatacagttattccaacgtagtttattctgttctaattttttttaatgttgattagagatccattaaattaactataagatccttcaagagatcagtgcctatagttgaaggtaccatgattttctagaggaagaggttagctccaaggaattaaactgaacagaggcaaactagtgtcgtggtgtggctaagagtgtggaacctttaggttgtgtgtagtagcttatgcctgtaatcccagcgtttgtgagcctgaagcaggaggatcacttgaggccaggagtttgaaactaacctgggcaacatagtgagatcctatttcttaaaagagagagagagagcatggactttggagaaggacagacttgggctcagatcctggttttgccactttctggtcatatgatcagggcagtctgtttggcattcttgggtctcagtgtcatttgactagggcaatctagttggcattcttggatcctagcc

SEQ ID NO: 46802 - DNA, 1039 bp, Homo sapiens
gtctcaaaacaaaacaaagctttttgaatgatacgattatgtgagaagtgaataaagatagtagtttccactaaagccgtaaaataatattaggcatgtccctgtatcaatattaaattaaaagacctactattaatggcactgaatgccataaagtacttgccttttcttggcatcatgtttggtgaatgaggtatatgagaaatatcatttcaggggccctagaggatgctggttgctggtgtgatgatttaagcacatcatttgtaattcccctctgtggtcagcctagtctgagaatgtgctgttgggagactagggtgcttattaggatctcttttctgtgccctgccatgactctggcaactcagatggctcagagaggggtttactttattactgattattaaattacattcacagtttattattgttacaggggcttgacagtagtgagtcagcttttggagcgaagtgtgggctcttagcaagatggcatttcgagcactcttggatgcccttgtcaggctttccccttggaactcactgccttcattacctttgtgacattttagtttttttcctgctgaatgtggctctttttcttctggtttaaggaacaaccttatattatcagcctggcctcctgtatggtggatctgtggaacatgactgtagcgtccttcgtggcattgggtattacctggagagtcttctttgcttggctccatttatgaagcacccgttaaaaatagttctacgaggagtgaccaatgatcaggttgacccttcagtgagtattgagaacaaaccgtggtgtggtttttgttttgtctcttgtcacaacccaacttgtgagaaaaaagttccttataaggcacagttttattacaaatgtatattgcttttgttatttactttgagatttagaggttaatcactccaggaggcagatgaaccaaaacttaggatcatcaaattcaggactattgttaacagttaccaaggtgccttttgttgttacctaagaaccttcaaa

SEQ ID NO: 46803 - DNA, 1070 bp, Homo sapiens
atggttttcataaatgggctttaggaggttcataaacctgaaaaattttctgcaagattgtgagtatatatgtttctcaggagagggtccatagctttcatcagattctcagagagttctctgattcttgaaagaataagaacctctgcttgggatttgaatcttggataagtaataaagaaaagcaatagctgacatttgttgggctcctactacacactaggcattaagagctttacatgcattttatttcatttgtgcctccaaactctgtgaggaaagtgttatgattatccttcttttactgattaggaaatgacagcacagagaagttaccacaattaacctggagtgatgcagcttgctggagcttggacttgaacggagataatctgattctagaacttgggggctgttagccattccttagtaggacatccatgccaagccagatggttctaagcaactggctttaaagttcctttgccttcttcatttcattgcctgagttctagtataggattctgtaggccctgaattcgtactgtttgttaaccttcgtgtttttgtattgggatgggtgagaggaggaagatgctttttgggagtcagatctgtttaattttgagcaagtgtcttagtttttttgtcttagttgtctttaatgtaagtcctagaactcggagccatggccctcaacacagggttactgtgagcataaagtaaggtgataatagatgtgaaagaactttgggagccgtgagctctgtgggattatgtgctaggatggtgacatctcttgtgctttcctggggacagtgggcagcctcagacctcagaaggacagcacctgcttggtccaaagggtatgagattcaggactgtttgtctaagctgtctgtggtcaaaagtacattctggactgaagagatggtgatgtaactgggctgtgtgtgtattgaaaaatccctctttgctctttcctcatttcaggtttgtcctttgagtcaagttaaatatttattgagcatttctgagtacaaaagtggtgtattggagagttgggaggg

SEQ ID NO: 46804 - DNA, 1082 bp, Homo sapiens
acaagttcatacctgatatctatatttacacagatcacatgaaaggagtcaactctgggaagtaagtatctgtgtttttgaagtctgtttctgcagctttttcacatgcctgttctagttgaagttaaaactgccagctctgaggttgcgcagccagaggaagaacaatttcagaattaatttctttctgccttattgccgttgtcaccaacaggcatttcttgagtgcctgtcacatggaaagcatcccagtggctagagctggaagctaagggtctggttcctagccttggggaattaaaacctttatctattaatacacaatgctttaggctttaaattccatctgcactctgttccaacaaaaaaattaaagtggacaggttcttccaccctgagtaaataacagtatagggttaaaatcttttgttatctaagtgtaagtcagcatctctcttcatcagtggaaacaacatatttacatccagagaaagttgttattgcagacgtgaatttggtttagtgaaagcctttgctttgctaaaaaataaaaattttaaaaattagaaaaaaattctaagtaaggaaaataagttcttaaaaaatgatgctctatgtaatgaagatacctgttttaggctttgcttgtgtatttagcaactaggaagttagagaagcaattaaagccactttcttaaaataggaaagtgttaaacatacagaaaagatcaaagaatagtacagtgaacacggagatatactcctgctgcctatagttaacgataaatattttgccaaatttgcttcacttgtttgtgggttttgtttgtttttgttttttactgaatcatttcagtgtgaatgggcatcatttcacttcacatctgaggctttgcaggttgtgtctcctaaaaataagaatattagagtctggggttaactgttgtaggttaagaagtcaacttcttcttaagtgatgccacagctgatcctttttcacagctgtttcacctgtggtttcttttaatttcagcaaaaagaggaaaagagagtaaaggaggggggtgagtgttttatacaac

SEQ ID NO: 46805 - DNA, 1054 bp, Homo sapiens
aacaaaagaagaaaggcaacctaagcagttgtacctcaggagaaagtgtttgaagagaagtctgttctgcttgttaatttggaagaaagggaaggaaaagggggtggaaggcataattttatacataagtagtaagaataaagggatctaaccttaacaagtcttcagttttaaggaactcaggaagagataaaggagagaagttaatagagtatggcaagcagtttcctgaatgtatttgaataagtgtaaaagtaaggccatgaaaaggccgtttcatgtcagatagactgtgttgttctgtgacagattcaataaatatgagcgtcatccacttaacccttggaattaactctacatcttctagaactgattaagatttttttttttttgcatatactcaataaagatgatgtcctcctgctgctgctttaatgataaagggaaagtttcatttttttttttttttactagattcacttaagaagatttgaatctgatagtctcattctgatagtctcaactattacagttgctctaattaactgttagtttaaccctctacagttagttgatacaatgattactcttataagacctgtattctgttttattgttgcttgaactttggattttgatattatgagtgtatgtttctggttttttttttcctcctctcttttgttggctttccattttctggtttgtacaattattaatttgtgtttacagggtggatgcgtagactcgaccaaccaaagcctggcgctactactcatgacccttggacagcaggatgtttccaaagtcctgctaggccctctctctccctacacgtaagttattctttttcaacctcgttattctgtccagtgtaattttctcattgcccaaaatgacaaagggtgttgtgctgcacagagcctgcactatgaacacctgcttgtgtttatcctcaaatcagccagcagttgtcactcttaacctggtgtttatttttacatacaaggatttttgcatttctttccttccttaatcccaggtaactgaaatt

SEQ ID NO: 46806 - DNA, 1048 bp, Homo sapiens
accatccagaatcctccagcattatggtatagaatcgagtaaacaaggatgaattcaccttaacaaatgatgcccaacaaaggcaagatcattggactcagaaggccaaagttatcttggatgcttggcaaagatttgttatattagccagtggcattcttgggctagaagggggagcagtactctgggtggtaacccagagggaggaaaagtggcaatgaccaattccatgtgtgggagcagcatgggtgttgtgggccaagaggaggggccggggcacagcgtaaagaaaaatgtcagttgatgttcttgttctctatcatggtcctgccttttcttttttcctttttttttttttttttttttgtcctaagacagagtttcaccagagacaagctatagcacctgcaggtgggttgaggtcaaactgtcccatgacatatgatacaagagttaaagaggccctacaggcatctcagtgagttcactgtgtagacatgttgcccaggctggagtgcagtgacatgatcttggctcagtgcaaactctgcctcccaggttcaagtgattctcctgcctcagcctcccgagtagctgggattataggtgcccaccatgacgcctggctaatttttgtatttttagtagagatggggttccatcatgttggccaggctggtctcgaactcctaacctcaggtgatctgcctgcctttcagcctcccaaattgctggtattacaggtgtgagccactgcatggttctgctttttctaacctctggaaaacagattcaggagctggggaggaagaccaggattttttgcccattgccaagatcatgaattgatggcaacaatgtcaagagctgccggcggaagagcaatgaagacatatcaaacctatgactcctccagtgggcgggagtgtgagaggtgcttctcattttcaaatgatttgcactattttttttttttggagatggagtctcactcacccaggctggagtgcagtggcatgatctcggcttactgcaacctctgcctcct

SEQ ID NO: 46807 - DNA, 1031 bp, Homo sapiens
tatccaaaactgaaatcaatgctcctcccaacccctaccccaaaaaatctcagacccagaatgttattcctctcctccatagcaatctccatgaaagagtcatctttggtggccttggaggtaccaacctttcccatactggtgaagaacatggtgtggtgtgatcctatcccatagctccttaatcttccctatatcctagtacccagattttaaaaaatagggctcaggctgggctctgaggtgagggaagaggaaagttggggctagccagggccctgaggcatgggcggggcgtggtgtgacatggtaaggggtgggagtgggcaggagagactgcctgggtgaggcttgcctcagatggagaagcctgacctggatccacttgctgcctgtaggagctcagtcgccaaaacctgtctggcctaaagacaggcacagtttgatttaatagttggtactgacctcacttgaacattaaatcaataaatgccaacttaatggagctgttgctgggaaactaaggagtatcaaatatccaatatctgcacagaggagattgttttgatctgttttgtttttctaaagctgcaacttgctccttggtgcactttaggttattcctttttggtaggaaagtggctcccacactctcctctccacccaccctttgaagaggcttggaaatgcactcagcagctgcccccatgataagccgaagggcctgtcctgtccaggttggcaggtcctcccagcaggcagagtgaggagttcatgaatgagggaggagactatggtgtctcagaaggaaaactctagaggaaaaacacttgagtaacaatgcccagttcaacctctggatctctcttgcagcttgctgaggctctatttccagctgaactgtgtagctctcagcgtgggtgccttttatccatcactggtgtcatgccaggtcatcttcatcttttcttagctaactgaggaggacagtcatccaagctggggtctcctctcctgtgtgtctctcctag

SEQ ID NO: 46808 - DNA, 1050 bp, Homo sapiens
aaaactacaaaaattagtcgggtgtggtggtgggcacctgtaatcccagctactcaggaggctgaggtaagagaattgcttgaaccctggaggtggaggttgcagtgagccgagattgcaccactgcactccagtgtgggcaaaagagcaagagaggaagacatcatctcaaaaaaaaaaaaaaaaaaagaaagaaagaaagaaagaaagaaagaaattcattgtaatgaattgtaattcaaataatgacaaaaaccacgattatttttgtaccagcctaatataaccagaaaaatctgggaatggacctagttttaggtagagcagaatctaaggttcaaattatgcatttggaagtgtctctcctccctcctcccttcttccctccttctctctctctccttcccttcctccctcccttttttcttctctctgctctctctttacctgtccttctcttggtttggcttgtttctgcttggtttcattctacaggcagggcctcttcgcaaagagggttttaaaatggtggctgaacattctgaaaacatcatctcagtttagctaccccagcagaatgagaacttctcttcccaactccctagatcaatcctggggaagacactgattggccttgcttgaatcatgtgcccacacacaaaccaatcattgtggccagggggatagggtgactggccagtctggatcatgaattcaccctctgggggctatccatgacaatttgtcctactagataggacctcatgagaatctggggaaaaccaaagaaggaggaaacaagttactagactaacactatagctactacggtccactacatattccaaccagcttaaaggaaagggggaatttatcttaaggatacaggagtatcttgtggaatacgagggaaggcatacagctgggcctttggagagaacttggaagctatcaggaccctggcagcttctttctgcccagatgcttcattctctctctctgcaatcctcctttttctgcttcttagtgtacccagtgggaagaaagtgg

SEQ ID NO: 46809 - DNA, 1030 bp, Homo sapiens
tttcataatatgaggggattatttaatgactctactgtacatttcttggaagaaatactctattaatatttaggatattgttgggtgttgggtgaagactcattacttaatgacaccgagtaaattaagaaaaagtgtgccattcacataattaacagcagagacataatgtaatactcatttgaaaaaaacctttaatttgaataattgcttgaaaagacctaactgaacactagattactactgtgacctggaaaatggagagaaatatgttggttttcatactctaagacccacatgccatttctgaatgatcacgtattttaatagcttgactgtaagtaagtgtcattctaaatcatcagagatcattggccaattccagaggttccttgaatatgtttaacttctaggcttttgaaggggaagctgttgggtttatttatttcattaaaaaatatttattctatttcctcattaaaaagtaatacatgttcactgaagagcgttggagagaaacactgaaaaacaaagggaaaaaatataaggattatgtataattcttagagacaactcatatcaacattttggtgttaagaatttgctttccagtcagttttttcctttttaattgttttaaaaattacacaagaaatattttctcattataaaaaaattgagacaatatagaacaaaatgtagaagtcaccctattatggtctaaattgtacctccctaaaattcatgtgttgaaaccctaagctccagttcctcagaatgtgattatttggagataggggctttaacaaggagacgaagtttaaatgagggctttagggtagacccaatctgatgtccttataagaagagaaaatgtggcctgggcctataatcccagcactttgggaggctaaggtgggcgaatcacctgaggtcaggagtttgcaaccagcctggccaacatggcgaagccccgtctctactaaaaatacaaaaattagccaggtgtggtagcggacacctgtagtcc

SEQ ID NO: 46810 - DNA, 1041 bp, Homo sapiens
cttttctctttttttaagtgagatgatatcatgtgtgttgctctgcagcctgctgcttttactcattcatacgtcatggacctcaaagtttagattagcccgatcctagtgcattgccagatggtcgcttagaggtggtgatggtggctttagcctcctaataaactgtatcagacatcccaataaatatttagttcaagtaaaaggtcctcaataaatacttagttcaagtaaaaacagagtgcttggtaaacaatgttgcttcagtataaattcccctgtgggactggcactgcccttccaactagattgtcccttttagaccccttccacagagccatcactgccagtctggaatgataaatttgaataacctgtgtgagattgggtgaacaattaaaaacttcgttttactgtttctcacacctccattattctcttgaggtttttttattgtcgttcttttcacacatactaataaccaaaagtgattttccctccaatccacttaaattgaccatctccactccttctagtacatgcgttgtcaaagctcacaagaaaatggggatgaattaggcttcttctttcctggcctctctcccatcaacatccttcagacaagactaaacattccagacaataacatccatacaagaagttgctttcttaaatcttaaaggaatattacagtgtaaagagaatacgtattgaaatactagcttccgtttaaaaaaagtggtggaagaaagaccaaagttcacccttgtccttgataatcattcaaacacaacaaggagaatgagaaacaaaaaatgcaaatgctggctcggtggctcatgcctgtaataccagcaccttgggaggccaaggcaggcggatcacttgaggccagggattcgagaccagcctggccaacatggtgaaaccctgtttctgctaaaaaatacaaaaattagctgggtatagtggtgcacgccagtaatcacagctacttgggaggctgaggcatgagaatcgcttgaacctgggaagcagagg

SEQ ID NO: 46811 - DNA, 1743 bp, Homo sapiens
atttcttcttgtgctagtttaggtaaattgttttaaaaggaacttcatttgtttttaaattggagaatattcctgttgtcttttacatgtttcaatattgtaagctctggtaataatgtctactttttaattcccgatattgataatttatgttttatcttctttttttcttgatcagtctttctagtgttttatcaattttaatgcttttaaaaagccaacgttttactttgcttttctttattttatttttatttttctctgatttctgctcttaagtactttcatttttatggtttttggcttaatttgttgcaacttcttgaaatgaaaatttatttaataacattgttcagcctttcttctcgtcttgtgtatgaatttaagattatgaatatcttagtatacacttttactgcgttttactcattttcattattgattcaaagtatttttaaagttattctttgtaccatgggttctatgaaaatatattgattaatttacaaatatatgcgggtttctagttatttttctgtatatgctgtggtacttttgtcagtggttatattttccataagagatttttaatttaggtgccattggcaaatttccattaattcaaatgcagaacttcacatttttcaatgcatacgtgagttttttttgttgaggtattaagaatagcataaatttataaaatattaagtaatcattgaatgcaaaatatgtcctattttgcaacttaatatacttttattaggttgacgctaaagtaattgcgttttttactcatactttaatggcaaaaaccacaattacttttgcaccagtctaataatgagaattattattattattatattgtcttttttttttttggagtggagtctcactctgtcacccaggctgaactgcagtggtgtgatatctgagccttggctcactgcaatctctgcctcccaggttcaagcaattctcctatctcagcctcccaagtagctgggattacaggcacgtgccaccacgcctggctaatttttgtgttttcactggagaacagggtctcactacattggcctggctggcctggaattcctgacctcaaatgatccccccgcctcggcctcccaaagtgctgggattacaggcatgagccaccgcgcctggccctaataatgagaattcttatcaaactgtttacacagaataacatgagtgggtaatggtgaagctgagtttcacatttttatgcgatattcttcagtgttgctatttgttcagtacttttaagaattatataaattttttatagtctatacataaagtcaatattatgggtcccaaatatataaaatgtttgcttgttccattgtttatgttttgaatacaaattatattttgtatgatttcattaataatttgttgagaattttatggcctaacatgtggtctactttctaaaatattccagcttcatttgaaaaggatatgcattcttcagttgttaggtgtttgcttttgattgcttgtatttctcagtcaaatgtaggaagtggagattaagaaaagggctggcacttttggtgattgaggaggagaaagtatgagatagttgtcttggatagtggaagagtaaatgttctaaagaaatataaaatgatagttgagcagcactaagggcccatttgagtatgaatctaaagagggaccaatctgaatgcatgtgttttcatcagtgat

SEQ ID NO: 46812 - DNA, 1049 bp, Homo sapiens
aaacctcatgaaccagcctctactagcttcttgcttttcttctgcagcttcctcacctctctcagccttcacaggtttgaagacaattagggccttgctctggtttagggtttggcttgagggaatattgtggctggtttgatcttctatctagaccactcaaacttttgtcacatcatcaataaggctgttttgctctcttatcatttatgtatttactgcagtcgcatttttaatttcattcaaaaactttttctttgcattcagaacttgattgactggtgcaggaggcctggcttttagcctctcttggcttttaataataccttcctcacttagtttaattatttctagcttttgatttaaagtgagagatatgaaactctttaatatatgaaactcttcctttcccttgaatgcctagaggccattgtaggattattaattggcctaatttccatattgttgtgtctcagggaatagagaggcctaaggagagggagagacacaggaatggctgttgctggagcggtcagaacacacacagcatttgttgcttatgtttgtcatcttatatgggcacggttcatagcggccccaaatgattacaattgtaatgtcaaagatcactgatcacagatcatcataactgatataataataaaaaagtttgaagtattgcaagaattaccaaaatgtgacatagggacacaaagtgagcacgtgctgttggaaaaatggtgctgacagacttactagattcacacttgctctaaatccttattttgtaaagaaaaaaaccccacaatatctgcaaagtacaataatgcagggtgcactaaaatgaagtatgtttgtataaaaaaagattgtgattaataattcagttgtaggggttggtatatcaaaagatttcgactgctattacattttgttccgattttaagagttgttactttagcttcatttcaaattataggtgctatgtaaaaatattctgttgtgtacctttaataattcctttctctgcttcttttctaggtatcaca

SEQ ID NO: 46813 - DNA, 1025 bp, Homo sapiens
gtggtttctactaatgttaattgaattgaagagtgccatagcacattttagattcctggcatcatttaatgccctcatttttaagtcaagcaagatacagcatagtcttagggttagattgatagagtaaatcacgtttaatgcttatctattgttatcaataccttttttattttaaagaatttggaaagaatgttgtcttcttaagtcttgttttaaaatggctctgtaaattctacccgtttttaattttacatgcttttaattataggatttacagttatattgcgattttcctaatattattgatgtcagtattaagcaagcaaaccaagagggttcaaatgaaagccgagttgtaactatccataagcaagatggtaaaaatctggtaagtttgctttatgattgaataatggtttcattttatagttctcagaaatgtgtattttagaatcttagtaccaaaattattttctggtaggaattttgattgtagttttaaatataactctaaacatcagttcagtaaactttttgataacatctagctttttgtattactatcaacaccatcttcctacagagtttcttgtacattactgtactttttttactcatttttatgattagcaaagcaccagttactttctcccccatccctactctagattatactagttctctgatgtaatgctcacccctgactaaaatattttatcaacagggatgtatatgtgccagttatactgcctaattaaaggagaaaaaataaatcaatgatgtctggaatttatataacaaaatgtaaatcaatcccaggtcagccccacccaagctgtaggacatggttgattctaaaagattaacgctttctctttttttaaatagcttcagaaatctaatttattttaatgtaaataggagaaatgaattattttatactttgctcttaagtttctcatttatcttctctgtcttctttttaactcagatgcttcttgacccttcctggcttaaactag

SEQ ID NO: 46814 - DNA, 1027 bp, Homo sapiens
tgaaaccctgtctctaccaaaattacaaaaattagctgggcatggtggtgcgcacctgtagtcccagctactcgggaggctgaggtaggagaagcgcttgaacccgggaggtggaggttgcagtgagtcaagattgtgccactgcactccagcctggcgacagagcgagacacggtctcaaaaaaaaacaacaacaaaaaaaaaaaaaaacaagaaaggttatttggcataggaagaacctgattgaccttgaggtattggtagattttatataaatgtttctgagtagaatgaatatgtttataaaatgcaccttaaaaataggtgaacaagttcataatatagtgcataagacaaatatttaaaaactgcaaaatattaaaaatgtaatattaaagataattatacaaatacaatggtggtgcagtggaatggctgtatgttcacctttgcttgtgcaaagaggtgagcattagagaggacctcttagaaacagtggtacttgaactgagttttgatgaatgaataaaggttcattgctcagaagaagtgggtatacattcttaggtagaaagatagcatgaagaattatcaaggcatgaagcagcatggcatttgcttgaaatgatttaagtcatttaatatggctggaacgtaggttgtatgttggcagtggcaggagctgagattggagatggaggcagaaaccagctcatggaaggctctatatgctacatttgttttaggctttatcttataaatgatggaaaactattaaggatggtattgttgctattaattatcattgccttcttacatgctttttcataaaatcaacttttaaaccacttttgtaggctgagaaattgtaaattgcccttttgaggaactaagtacttctatcactatactggcactacatcggattcatggttcaaatgtttattctgttgcttgttcttgtgatatcattttgtcagaataatcactgtgatgtccattgtgactatccctccctttctttata

SEQ ID NO: 46815 - DNA, 1038 bp, Homo sapiens
tggaatcttaattttctttttggaaatttaaaaatgattcttcacaaatctcaaattaaaaattaaaaatctacaaagacctatatcgcaactcccaagttctcaagaaagtaagggaaattcaaggggttaaaaataaagaagaaactgagaaaaaaatccagccatctctcagtgtccatgagggattggttccaggactacccatggataccaaaatctgaggatacttaagtggaacctgtggatatgaaaagttggccctctatatacatgggttttgcatcctatgaacactgtatttctttttttaaataactaattattttttaaaattatttatttatttattagagcaggacttgctgtgtcacccaggctggaatgcagaaatactatattttccaactgagtttccttgcagatgcagaacccgccctgccagtacagagggcccactggatttattgaaaaaaacccacatataaatggacctgtgcagtccaaacccatgctgttcaagggtcaactgtagtacataagatctgataatctggcagtcaggtggtgagggttgatgatcagccacatttatcaagggggttaagatttaagagcaatttaaaagggccaggtctcagacctgtgcaaggccacgagttaaaagtgagactatccctgagtaaaaccaggacacttaagtaaatacatcctcagtaaaacaatatatagaatgtgaaaaattcacccactagcaagcagagaagaaaaggaatattgtcatttttaactgcgcttctggtgaggaaaaggagtctctcctaagaatttgtcatcataagctttggaatttgggcttcattatactacctacatagactgagaaatcctaaattaaaagtggtactctcctaatattgtgtggtgcttggaagaaacaaaaaaatcttttcggaaccacatactcttaacctaggcaacccataattcccacagataaaagcattgcaaacacaagcttttaatagaaaatttaga

SEQ ID NO: 46816 - DNA, 1071 bp, Homo sapiens
cgcagtctcagctcactgcaacctgtacctcccaggtttaagcagttcttctgcctcagcctcctgagtagctgggattaatttttgtatttttagtagagatgtaaccacacctggctaatttttgtatttttagtagagatgggtttcaccatgttggccaggctggtcttgaactcctgaccttaagtgatctgcctgccttggcctttcaaagtgtagggattacaggcatgagctactgcgcctggcctgcaaatgtgtttataatgacaaattccacttttttattgctggtatatagaaaatttattgacttttgtatattaatcttggatcctgtaaccttgctatagttacttattctaggaggatttttgggtcaattctgtcaaattttctacatagatgatcacattatctatgagtaaagacagttttatttattccttcccaatctctttaccttttattcctttttgtggtcttattgaattagctgggacttccactattctgttgaaaagctgctgtgagtggagacatccttcccttgttcctgatcttagcaggaaagcgttgagctgtaggtttctcatagatcttctttatcacgttgaaaaaatttctttctattcccgagaggtttttttaaaatcatgaatgagtgttgttctgtagtttgctcagtgttttttgtttatttgttttgttttatggagacagagtctcgctcttttgcccaggctggagtgcagtctcacaatctcagctcactgcaacctccacctctcaggttcaagtgattctcctgcctcagcctcccaaatagctggcattataggcgcctgccaccacaccgggctaatttttgtatttttagtagagatggggtttcaccatattggccaggctggtcgcaaactcctgacctcaggtgatctgccaacctcagcctcccaaagtgctgggattacaggcatgagccgtggcgcccggccttgctcagcgtttttatcttggttgttagatttgttaagtgctttttctgtgtttattgaaataatcatg

SEQ ID NO: 46817 - DNA, 1024 bp, Homo sapiens
gcaaagcaggtctgatggttacgaattccctcagcgtttgcttgtctgaacaggatcttgtttctcctttgcttataaagcttagtttcgccagatatgaaattctgggttggaaattctttactttaagaatgtttaatattggccaggtgtggtggctcacacctgtaatcccagcactttgggaggccaaggcgggcggataacgaggtcaagagatcgacaccatcctggccaacattgtgaaaaaccccatctctactaaaaatacaaaaataattagctgagtgtcgtggcgcatacctgtagtcccagctactcaggaggctgaggcaggagaattgcttgaacccagaaggcagaggttgcagtgagctgagattgcaccactgcactccagcctggcaacggagcgagactctgtcaaaaaaaaaaaagaatgtttaatattggccccaatctcttctggcttttagggttttcactgagaggtctattgttagtctcatgggcctccccttcgtaggtgacctggtctttctgtctgactgcccttaacatttttctttcattttgaccttgcagaatctgatgattatatgtcttggggttgatcttctcagggaatatcttactgaggttttctgcatttcctgaatttgaatgttggcctgtcttcctaggttggggaagttctcctggatgatatcctgaaatatgttttccaacttcgttccattctccccatctctttcaggtaccccagtcagtcttaggttcagtttatttacataatcccacatttctcagaggttttattcattttcattcttttttctctattcttgtccgcttatcttatttcagcaagatagtcttcaagctctgagattcttttctccacttggtctattctgctattaatagttgtgattgcattgtgaagttcttgtagtatgtttctgagctctaacaggtcggttatgttgctctctaaactggctcctcctagtattgtcagtgg

SEQ ID NO: 46818 - DNA, 1044 bp, Homo sapiens
atttgtttatttgttatgtgtgtgtcttatttggtaaaatgtgtgttcaaatcttttgcccatttttttagatgggatccttgatttcttgttgttaagttcatattttgcatcttgatatctgttccagtacaattggttgaaaagattatcccttctacacagcatatcttttgcacctttgtcaaaaatcagttgtctacatatgtgtgggtttacttctatatacttcattctgttccatgatctatttgtatatatttaacatcattttgattactctagatatataataatttttgaaatcacacagtgttaggtctccaactttgttcattttcaaagttgcttttgctattgtaggcctttgtatttccatattttatgttcatctcaatttttttttgtaaacattaaaacacaggaaaagaattagagcatagatataagggttatttttacttatagcattatatgtaaattaaaactacattgttttgaaaaaacttccactgaacaaacatttttctcaccatgtttactctttttttttaaattttattattattatactttaagttttagggtacatgtgcacaatgtgtaggtttgttacatatgtatacatgtgccatgttagtgtgatgcacccattaactcatttagcattaggtatatctcctaatgctatccctcccccctgcccccaccccacaacagtccccagtgtgtgatgttccccttcctgtgtccatgtgttctcattgttcaattcccacctatgagtgagaacatgcggtgtttgtttttttgtccttgggatagtttgctgagaatgatggtttccagcttcatccatgtccctacaaaggacatgaactcatccttttttatggctgcatagtattccatggtatatatgtgccacattttcttaatccagtctatcattgttggacatttggcttggtttcaagtgtttgctattgtgaatagtgccgcagtaaacatacgtgtgcatgtgtctttatagcagcatgattt

SEQ ID NO: 46819 - DNA, 1033 bp, Homo sapiens
tacttttatataaaagagatatataaattgccaataagcacacagagattccagtagataaatagggaaagtagtctcattaaaggaaatactgtaactaacaaactcaagagaaagtatttagacccagtagtaacccaaataaaataaacgttaaataaaataaacccaaataaaataaacattaaatataaccatttttattttttaataattaaagaattattactgctcgcagaggtataataaaagttgtgttgcacacttctgatacacaaaggtgtgataatagggagctggttaacaagttaactgtggtacatccttctcttatagtgatatgtagtcattatgtctcagaaaaatgtataaacttaagaacttgaccatattataatgccaagtgaagaaacaagtcacacaaaattatatatgtaatatgaccatgactgtataaaacaaaacaacgcaagtcatctaaagacaaaatctagagcaatacagtacaaatatttatagtaattgttcctgaatggtagaactgtagtgattcttctgcttttcaactcttaaattttcaactagttagattttcttgatgctatagccacttgtttttgtaacaagtatagtgctaactgaggtattcggttttggaaatctttaaagtacagacttttttgatgatgggattcaatttaacttgtttatttttcaataaaaatatttagtgcaaaaatttttgacacataaatatagtgcaaaatgataggaacatcatgatgtatttagaaattttaaattcagttttatgggtaaaactgaaaaaagaatttttttgcattctaagtgataattttgtgattcttttgaagaactgttgtaatcaatgactaaaattagatttactggtgcattttaaactactatgtttgttttattgcttaatttagacatgttcctataaataaaaagcagtaatcagaaacaacaatttaactccattaatttatgttcctgtgggcatggtaga

SEQ ID NO: 46820 - DNA, 1028 bp, Homo sapiens
tcatattcttaaaacctgaaaaatagtggttatataaggttttgaggaaagtaaagtttggttttgacagtggtatcttcattgtcatctgtgccattataaacccttctgtagtttgagacactgttctaagcattttttaatacgtatttaatccctttagcaaccctatgaggtagttaggtataactgttttacaaactgctgcacagagaggcagagtaactcacccatagtcacacgcgaataagttgtacagctaggattcagacataagtgttgtagctctaaagtctgtgctattaatcagtaatatactgtctcaaccctgtttatgctccatccagctactactttggggtttatctgggagtagagaatggaaaaaggagaaatgatctggagtggtttctaatagtcctgaagaatagaggcagtataattactgaggccagtggttaatcatcctcttctcacttagttatagaaatactattgtctctcgtttctcttctgtaaatcttacaagttcatcacaggagtttttctagagtatcttaacttccctgtattatgtgacagcatcttaacctcagactgcatatccttttccactatgctccatctgagaacacagttcagatgcctcatgatctttcctagtttccacctagtgttgtttctagcatccttctatagatgttgggagtcagtctataacaatggtggcagtcttattaagtgactctgtacctcaaagatcatttattctttggtgaatgaattttccattttagaaatcttagattccattgtatattacattatctcttcatattagttacacagaccagtggaccagactagttgaaggttgtctggacattttattttatggcttggaaattttagtgaaattaatgaaggaaacttccagggataagtcagaaataatttgtgtttagctttaaaatgtgttcatatgcttatgtttaaatagaagtttagtagatttctaaattgcacat

SEQ ID NO: 46821 - DNA, 1044 bp, Homo sapiens
gcacttattaataggattggcaacagtgttattatataagttctggatagtgaaaactcccttattggccacacttccaaggatggcacctgaatccaaagaatggtaggactgcccaaatcagagagccctgcacattgtttctgtcagactggaggctgtctcaatgtgtgataatataaacgataagcagttttggtttttggtggcttttttttttttggttctatgaaaagtctggtgaaagggtactacgtctttcaaaaaactcttctgaaaattattttcatccatctgtctatccatttaaaaagtattgaattttgtccagctctaggcactgttgtagatactagagatctaacagtggaaaaaaacaacaaaacaaaaagccctgctgatagatcttgttattcttctagtagagggtgataagtaaaatacattatgagttaggtgatccactctatggagaaaaattaagcagggtaagggaatagagagtggaatatgacttaaaatagtggtcagtgtcttcactgagaagatgacatataaaaggatctcaaagatgatgaggtaacaaaacatatatccaggggaagacaattctggattggtgagatttagcaggtatgaaaattcataagaagataccgtgaataaattttaggtcctataataatttatagttagtaagaaatgatgaactttttttattagctgtaaaaatgaaaatacagtctgatttttaggtaactgaatcctgggaaagtcaagagcgcacccgcttttttcttccagtaaatggcaccaccgtgtatttgagtttattcactcttcctgcccactaacatcaatagccagtctatatccagtctagtatattctaccttgtatgtcatttcttttccctcctcgtaattcccaatgacactagttcagtttaggtcttgtcacttttctcctggattattattatatctttttttttttttttttttgagacagagtctcgctctgtcgcctgtgctggagtgcagt

SEQ ID NO: 46822 - DNA, 1030 bp, Homo sapiens
atttttgtaaataaaatgtaattgttggatttttcacatgttagatttttgcaataatctgagatttacaacactttctgatgtatgttcactctgattctgaaactaaattatattattggatttcatatacagtattaaaattagtggtggtttaccaagattaaactttaaagcatatctgaaagttatctatctgtaaataagacaaattgtctacagaattagttttatatagtcagtgatgtgtaaacctcttggctttaagaaccacaacaactttgaatgcattaagaaaactgtcacacaattgatccgaaactgcattaagaaaaaaattcctacttttttttttttttttcctttcactggtttcttgtctctcagggtcatcgttccatgggctgtccccacccaaccccaccaagtttccttcattgacatttctgttctttccttcacaaattctgccatggcttgtagggagagcacctgattaaccaatactgagctgggaatgaccgacacttcttagctagttctataaattttgttagtttgtttttgttagccccagttaatctcaaatagatagaaatttagaacattattgaggggattataatgggattaatcccttttgcctatcccataatgtattcagctgtttcatttctttttgttcatttgtgattttgtgttttcaaagtaaaaaatctgaatatttatttagagtttactttggattaaaaatattcaatttattagagcttcaaaataataactgtagctcaaacttttaagttccatctacaaatcttaaaaatctattcgtaaatctagcaaatttcaacacttttagaggggaatcttacaaattaaattctcttacgtatattaatgtatatttataaatatgccttataaatatataataaattatatattttgtttcttcttaaaatacttgaattgtctaacaagctttgtaccatttcatgagcaggtatttttgccaaagcatgatata

SEQ ID NO: 46823 - DNA, 1026 bp, Homo sapiens
ttgttcttcttttcaagattattttggctcttcggggttccttgcctttctgtatgaattttaggatcagctttcccatttctgttttttttttttttttttttaaaagaacattgggattttggtagaaattgcatttaatctatagctgtttgggaagtattatcgtaacaatattaaatattccattcatgaacataatatacctttccaatttcttagttctcccttaatttatttacgcatacaactcttactcatccttgggtcagtttattcccaagtattttattcctttttgatgctattgtaaatggagttgttttctgaaatttttattgctagcgtagagaaatatatacgatttctgtgttgatcatgtactacagctttgatgaatttattagctctaataactcttctgtggattctttagaattttctatatatactatactattatgacatctttgaataaagagagtcccattttttccgtttctgttggatgacttttctttttcttacttgattgctgtctagaatgtccagtattatgctgaacggaagtagtgagagcagcattcttgtctcatgcatgatcgtagcgggaaaactttcagtcagtaaacagtcatttactgttgagtaagatgttagctgtgcgctttatcatatatgtcctttatcattttgaagaagttcccttcctttcctcatttgttgagtgtttttatcttaaaagattattactattttttcagatgctttttctgcatgaattgaaatcattctgggatttttccccttcattctattaatatgattacattgtattacattgattttcatgtgttgaaccaccattgtattcttaggctaaagcccacttggtagtggtggataatccttttaatatgctactggatccagtttgctaatattttgttcaggattttttttacatctatattcataaggtatattgagccatggtttccttttcttgcagtgtctttgtctgac

SEQ ID NO: 46824 - DNA, 1032 bp, Homo sapiens
ctatttgttttctattatgtctgtatcttttttgtcctgggttcctccactgctgcctttttgttgttgttgttgttgtttttattgttgttgttggtttgatttttttgcattgtaccatttcaactcctttctcatttccttttttgtacatgttttagttattaatggttaccttggggattaaattaacatcttgcatgtacaacagcctagtttgaagtaataccaacttagcttcaataatatctcaaaactatgttcccgtacatctccctctctccctttttatgttgttgttatgacaaattacatctttatacattgtgtaactgttaacatagatatataattactgttttatgcacttgtcttttgagtcatatagggaaaaaaaggcagatttctgaaccaaaaatactgctggcttttatatttacctatgtaattacttttatcagtgttctttattttcttacatgggtttgagttattgcctcttgttttttcaggctgaagaacttcctttagcatttctggtagttcaggtctacttgtgacaaattccctcaactttttgtttatctggaaattcattaatttcttttttgtttttgaaggataatttttctagatatttcagcacttgaaatatgtcatcccactgttctctggcctccatggtttcctatgaaaagttggctgtcagtcttacttgggatctcttgtatgtgaggagtcacatacatctcttgctgctttcaagattctcttcgtttttttgacagtttgaacatgatgtgtctctgtgtgcatcttttaaaatttatcctacttggagtttcttggaagaaagactcttggctttctcagatttggaaagtttgtaaccatgatttcttcatatattctcttttctctctccttgcctttggacttccatcatacagacaggcgttggtatttatgatgttgttcccataagtctttaaactgggtctatttttttttcattcttttttcctatttctt

SEQ ID NO: 46825 - DNA, 1055 bp, Homo sapiens
ttattaaaagcaagctctcagcaaataaagatgatgtcctgctaacaggctcccacttcacagattgattaccaaaccccagcacacacgcgcgtgcacacacacacgctgaagagccccagggtcctacccgctgaacaaggcgtgaacttaaccccattctcctagtgcgcttgtgggcattattcagaaagaatcactcaggaaacggcaaacgggcagttatttatccctctggatcaccagtttcatctgggacaaggagtcccatctttcagccttcaggcactttttgggcttgaaagtgggttttcactggggacccttggccaactcctgtctctgtcagtataattatttttcctttactgcagatttttcctcctgctaggaattaatgattgccttgttctttacatttgcttaatttttgtgtacttatctcttactcaacccaaactgtcagttgtgtaaatatcctcccagctttttcaaacatattagctgttctgttcatttcatcttttttgttttcttttttttttttttgagatggaattttgctcttgttgtccagactggagtgcagtggcacgatctcggctcaccacaacctccgcctctcgggttcaagcgattctcctgcttcagcctcccgagttgctgggattacaggcatgcaccaccacgcccgcctaattttgtgtctttagtagagacggggtttctccctgttggtcaggctggtcttgacctaccaacctcaggtgatccacccacctcagcctcccaatgtgctgggattacaggcgtcagccatggtgcccagcccatttcatcttcttcttctttttttttttttttccacagtaccacaaaacaatttaatggaggaagagatttttttttttttttttttaccccgaggaactatatcacttaaggatggcttacagaaggaatgagcttgcaaaaactataagagagagagagtgtgtgtgtgtgtgtgtgtgtgtgtgtgtgtgtacctatgcagtgtatgtgtgggtctatag

SEQ ID NO: 46826 - DNA, 1185 bp, Homo sapiens
cttttaatcggagcatttagtccatttacatttaaggttactattgttatgtgtgaatttgatcctgtcattatgatgttagctggttattttgcacattagttgatgcagtttcttcctagcatcgatggtctttacaatttggcatgtttttgcagtggctggtaccagttgttcctttccatatttagtgcttccttcaggagctcttgtaaggcaggcttggtggtgacaaaatctctcagcatttgcttgtctgtaaaggattttatttctccttcacttacgaagcttagtttggctggatatgaaattctgggttgaaaattcttttctataagaatgttgaatattggcccccactatcttctggcttgtagagtttctgcttagagatctgctgttagtctgataggcttccctttgtgggtaacccgacctttctctctggctgcccttaacattttttccttcatttcaactttggtgagtctgacaattatgtgtcttggagttgctcttctcgaggagtatctttgtggcgttccctgtatttcctgaatttgaatgttggtctgccttgctaggttggggaagttctcctggataacatcctgcagagtgttttccaacttggttccattctccccgtcactttcaggtacagcagtcagacgtagatttcatcttttcacacagtcccatttttctgggaggctttgttcatttctttttactctttttttctctaaacttctcttctcacttcatttcattcatttgatcttcaatcattcgatcaaatcggctactgaagcttgtgcaggcatcacatagttctcgtgcgatggttttcagctccatcacgtcattttaggtccttgctacgctgtttattctagttagccatttgtctaatcttttttcaagattttttgcttctttgcaatgggttcgagcatccttctttagcttggagaagtttgttattactgatcgtctgaagccttcttctctcaactcatcaaagtcattctccatcgagctttgttccattgctggcaaggagctgcgttcctttggaggtgaagaggtgctctgatttttagaattttagcttttctgctctggtttctccccatctttggttttatctgcctttagtctttgatgatgctgacatac

SEQ ID NO: 46827 - DNA, 1032 bp, Homo sapiens
ctcctacctttagagccatacccttccctctgtccctcccttctgctcccctctcccctctctgtctccagtgttccttggaaaagagtcctgcagtcctttctagaggatatatacttggctaccccagtattctgggatttgagttacagaagagttaagctagcgggtccaaattcaagatgtgaacctttattttctatccctgttttcagtgtggtccataggcctctggtggaggtggtaggggtgggggtgttttgttttgtttttctccaaagaaaaatatccagttttccgtaggagtggaggtagggtatttattggctgctcagctttggggaagtgctctgggaggacctggttgcttctttaagtaggttttgaaccacttctactacatttaatttagcctttcaaagacccctgaattcccaagcctttcgtgtaccctacaacttaaatttagacgtttctcagcattcttccctgtcagttaaggattctactcattgatatgctttccagcttctaaaattttctaatgccgcctcctattatttttgtctttgctgctttatgtttttttaaacaaaaactcttttctcttctagaagttacagttttaggagtccaagaagctaaatatttatattcagtcatctctctttaactggaaaggaatttaagtttttaatggccttttttaattgttgtcattctgtttggtatcaactttaatattcctatctactatcttccgttatcaactttattcagatagtaaggtactaaataatgtatttgtgatcacctgtgtcagaacataaataagaataaaaataaacttttgatgaattagaaaaaactcttttttttttcctataaggtgcatatatatttgtaattatctttgggacttaaatgtttagactggaaataaaaatattagagctgaaaaagtgattgactcttttccaagtactttagagttagtacaaaatatattctcagtgtttattagtatgtaat

SEQ ID NO: 46828 - DNA, 1033 bp, Homo sapiens
aaagtgcttggaaccagaagtatttcagattttggaactttttggattttggaatatttgcaaatacattcttggggatgggactcaagtctaaacacagaattcccttatgttttatatataccttatgcacatagactgaagctaatgtaatgaatttgtaataattttgtacataaaacaaaattttgactgcagctcatcacatgaagtcaggtgtgggatttttttactgtggtgtcatatcagccctcaaaaagttgcagctattggagcatttcagatttttggattagggaggcttaacctgtatttttattttttacctattttcaagagtttctgtagaaaacagagatataaaacccctgtctttacataacaagtttttcttgctatagcccctctgcataccatcctttttaaattagtgactatgaggcttgtcgcttctcttctctcttgctccacagaggaagacattcttctgatcttgagtttcttgtagaattaaaaccgccatggttgcctaaaatagtggttcccaaactttcaccaccaaggaccccttctgatgtctttgcccacctccatagtttaaaataagttttcaccacacatttctataaataccaatcagtgcttctgaatggcatgcaagaaccagtgttgtccgtctcactaagttgatattttaaccacaaactaagaatctaagcattattagttaaaacttaggcagctttatcataggaaaacataaaagttctattaaacttttgaaattttgcaacaattcatgggctacccctgccccttcaccattttcttggcttgaagattgagaatcactaatctttaaaaatactatcatggagtctagttacagaatattaaaactgaatggttctggaggaatttatttgaaccttctcattttacagaggaagaaacttatatcccgagaaacgagacagcttggccaaggtaatatatacaaaaagccaagctataatgaagactctagtctcac

SEQ ID NO: 46829 - DNA, 1068 bp, Homo sapiens
gaaagagagatctgacttcgttcttctaacgtggctattcaattgtcagagcaccatttatggaaaggatttttttcccattgtcaaaaatcaactatagaggtatgggtttatttatagattcttaattgtattctaatgatctataatatcttcttatgccaataccacattgccttgatttctgttgctttgtaggaaattttgaaagcgagagtcctaagtttgttttttctaggttgttttggctattctaggtcccttgtatttccatatgaattgcaggatcagcttgtcaatttctatactaaaataaaggcagttgggattttcataagcgttgtattcatgacataaagcaaatgtggagaatattgccatattaagccttccagtccatgaacatgagatgtctttccatttattgggtttttaatgtcttttaacagtggattataatttttgctaagtctcatacttttgttagatttatttctaagtattgctactgtaaaaaaaatggaatttcctgtttttggattgtgtatataaatacaattgcttctgtatattgacattgcatcatgcaacatcaaactttttcttttttgtggattccttaggattttctacattgaaggtcatgttgtttgcaaccagagatagtttgaactcttccttttcaatctggatgccttttctttctttctcctgccaaacggtcctggctagagccactagtacaatgcttattaggtggcaatagtggatatccttgtcttctgatcttagggagaagctttctctcatcactaattatgatgctagctgtgggttttttattgataagctttatctggttgaggatgttgccttctgtatagtttgtcttttacaaaaatccaaatcccttccatgataaaaacactcaacaaacatacattgcatctactgaagtagtcatgtggtttttatcctttattctattaatatggtacattacactgattttcaaatgtttttgttttaagacagagttttgctctgtcacccatgctggaaggaagt

SEQ ID NO: 46830 - DNA, 1045 bp, Homo sapiens
tacttttaaaataaacttattttagaacagttttagatttgtagcaaaattgaagatagtagagagagttcccatatatcccacacctagttttccctcttaagatcttaagttagtgtggtgtatttgttgaaattaatgacccatattttcttagcttttacctcatgtcctctttttgttccagaatcccactaggatactatactgtgtgtagtttttaaatctcctttgacattgactgtgacaatttctcaggatttttttttttttttttcaattaccgtgaccattttgaggagctctggtcaggtattttgtaaaatctccccctgttaggattcatttgttttccttatttgtctgggtttgttttggggaggaagaccgcagaggtattttcatcacgtatatagggcacatactatcagtattctatttgctaagtataacttaggttttacatcaatgataacattaacactgatgtgaaccttaatcatctggctggggtagtgtttgtcaagtttctccactattaaactactcccacacctccttcctgtctttccatactgtactgttggagagaaagtcactgtacagtccacacttaaggagtgggaagttaatgtacttcactgccttgagggcagagtatctacaaaaaattatttaaaattactcaacatgggaggtgtatttattcagacatttacatcagtatgaactcatgatcaaattgttccacttttggcctttagaaactcgtttatttgatggctatgtccctttgacatacccccattattgtgggtgttttgtttttcttaagcattatcttactttctggcactacaacatgcttcaggtacatcttgtatatttcctgcttcagtcctagaatcaaccatttctccaaggttccctgtttcctttaattgtcaaaggatagaggccgggcgcagtggctcatgcctgtaatcccagcactttgggaggctgaggagggtggatcactacaggtcaggagtttgagatcagc

SEQ ID NO: 46831 - DNA, 1031 bp, Homo sapiens
cccagcactttgtgagactgaggcgggtggatcacctgaggtcaggagttcgagaccagcctggccaacatggcaaaaccccgtctctactaaaaattcaaaaattaaccaggagtggtggcacatgcctgtaatcccagctacttaggaggctgaggcaggagaatcacttgaacccaggaggtggaagtggcagtgagctgagatcacaccactgcactccagcctggctgacagagtaagactccatctcacaaaacaaaacaaaaaacttgaggcctgacatggtggctcatgccggtagtcccagtactttgggagtccaaggcagggggttgcttgaggccaggagttctaaaccagcgtcatgaacatagtaagaccctgcttctacaaaagaaaaacatattagctgggtgtggtggcacgtgtctgtagtaccagctactcaggcagctcaggctcggggatttcttgagcccaggagtttgaggctacagtgagctattatcgtgtcactgtactgcagcctaggtggcagagtgagaccttgtctcagaaaccaaaacaaaacttgggttaaaaaaatgtagagcaagagcttatgtttttatcaccctccccagtcccctactttcccagctagcaatgaacgtcttaataagactttaacaagaatagttttgctctgggaagtcaaatcatgagtgtatatcatttaagtgccattacaaatattcagtctcccattgcgaatatctagattataacagtaatacgtgactgaatagatacataacatatagtttattctagaaaaattgtatatagctccctcaaagtagatgattgtggttcttgaatgcgggctgaacacttacttgcctgacaacctgcaagccatgaagagatccacatctccaaggcctagtgggaatggggagacagttcatgctgatatagaaactaccctgtaggtatcgcagtacaggtgagaaaccaacatgaagtaataacacctgctatttaag

SEQ ID NO: 46832 - DNA, 1047 bp, Homo sapiens
agctctatattgagaagaaactggtgggaataggttccaaactaagtaggaccaggagaatagagacaaaggaaaaaggagtccggttagaaataggggaggagaatatagccaaaagatttcagtaagtaagcttccatgctgtctttttaaaattgtttttgaggtataacttacatacagtaatatgtacttacccttaagtgtatcttaaatacagtgaacattgacaaatggatatacgcatgtcaccactaatcaaaacacaatgttttcatcactcccaaaagttcccttgggtcccattacagttaccgctaccatctgtagcattggtcccagaccaccactgattggccttctatcagattagattttagtctccagaattttgactctttctccaagaaatgtgtactctagctgctagcaaaaagtgaagttagaccctttaaagggtttaggaaatttatcttatgaaaataagcgaaaggatcgatgttaaattctgtatgaagttagaagagagtgagaaaataaggaacagtataacatgcttacaaggaaaacattccagaaaagcattagtcaagtaaaggagagccaaggattttaagtcaagccaaactagcctttagtataacagctatagacaaattgtcattaacttccaaaactgggggaatattgttctcatgaacccttcctaaggaatcttcaggagaactaggttcagacaatcaagatgactgaagataatttgaaataaagagttgcgctaaacatttaaaatatttttacatttagaaacagaactaactgaacataaaggagaaagtatagtatgtactggctctatgacctgacacagttagctatattataactaaaacgtagaagggaaatatgcaaaaaatttaaagtgttttcagtaattgacagctggcaacaatgtcttgcgtgtaatgtgggataaagcaaaggagtatttgtaatattctaattttggtgtccttaagaactgggatttttctggttgggggaaaa

SEQ ID NO: 46833 - DNA, 1038 bp, Homo sapiens
ttctttcacatactctacctcaatagattttgacagttcttaatatttctccattctcacctcccagcccaaactaccatctcttccttgaacttctgtaacggatgtctaactagactctttgcttccatgtactatccgttctcccatagcagcagaatgagcttaaaaaggcctgaattagatcattcatctgtttgaaaccctctgatgtcttcctatttcacttagaataaaaaaaatctaagcccttaccatttatgacctggtccatatctactctctaacttcggttgcttatcactaacctgtttacttactaaccttggtctctacccacctttgtcttcctcaaagcataccatttctttttatgcctcaggacctttgcacttaactgtttctttgccaggaatgcttttcttaggttatctactgtaagaagcataccacttctagtcactcttgtcacatataaccctgatgtatttccacttaacactttctgaaattctttccgtatatgttctggctttccttcactactatgtacaaacatttttatcacaaacatttatccccagcacgaaaatagtgccttgcacataggaggttctgaacaaacctgttgaaggagtgaatcaatcccagagatgactttaggatggtataattagaagagtgttttgtattactctggaatatatctctacattcgtatcaaggtctttcgcttcacctgaaactccttaaccttaaatcttttctgcttctccaaatcatgttgtctggatatttaacctgtgcactaattttctcatcagagagataatacttgctttaaatcacagaatctttaatacagttagttataaagatgagcccatcagataaaatacagcttttctttaggacagtttatttttggaagccttcctgatttcccaactagaaaggactttacttcatagtatttagtgccttctcaaacataatttgctcaagatcagggactgaattatttaaatttttctctcc

SEQ ID NO: 46834 - DNA, 2186 bp, Homo sapiens
ttgaagtggtattatctataaagaacctacaagctagtattgataagttttaacattgaattgaataaaatataatatttaaatccataagaccttaccttgtttgtaacattctgttgattattttactacatatatagcatgagactaaccatatttggagatgttgaaaagtataatttaaagtgaaagtgttaggtcaagttatatgacttgaaagtatactacacacaagattgcatttaaattttgcattattttgggagatgcctcaagagaaaatgtcaactcataacatcctaatgaaatgttttgactctgaaataagaattgatgaaattatacttgggtttagctttcttaataaagaaaatcttctctgacaggaccgaggtgatgagttcacatacactggaagcggtggtaaaaatcttgctggtaacaaaagaattggtgcaccttcagctgatcaaacattaacaaacatgaacaggtactactatagacactgtttagaatttgaacattgaataaaagtttcattataggactgtaaattgtaacttacgttgcagaggagaatttcaaactgggagttaaagatctgaaattaaaattccagtgcctgattatgtaattgtttttcagcatcctaacatatctttatactgttattttttaaatgccataatttctagtcttactgaatacatgtgatatgcatttgaaaatgttaacaactttgaaggaaaggagcctgtgtaatttaagtgaaattgagaataaggtggcttgtctactactccattggtcaaagctaaaagtgacaaactcctttttagagtaaactcagtaatttgaaataaagttatgtttgggagccacatttatgtacataaatgaaacataaggtaacttaatcagatctgtactgaatgtacttttagaatgtctgctaatcagatatcttctaagagttgttaaagggaatgttcatttagttacaaaagtgatcttttctaactaaatccccttaagacattacaaaagagccaccgtgtgctgatctttattctatagaaatactaatgacatctcagctcccgtgggtacagaaaatttattaatttcaaaatgttttattttataaatgcatgctaataccaatattaataagtaacccagaccaccagatagcaaaaatcacattatagtttgtcctgctgaaatttttgtgaacatttcataaagttaacagtttttatatcctgttactaagggtattttgtcgattgagtaaaagtgagtgtttttcactttgagtctaaatcactcagttttaagtagtgtccccttaatttctgattactgtgtgatgtaaagaatataccagtatgatttcaagactttcatgcgtatcaatttacatagaatctctgtttttatgtgttctatattgtttctgatagtaggattatttttactgaaccagcagaggagacaggtcagatttgctggtgaaaacattcttgagacaggagcttagctattcttttctagcaagaaagcagtccttcaagaagagtgtcttaaaataaatattttgatgtgtttttgtcaatgaaaatgtatctcaaatttgcaaaaggactctttcaagttgtcaaatctgaaaattatttttccctttaataatcgataattttgcttgaaaggaacttccttcataactacccaccattgtaatgtacatgttaagattcctttcacacttttggacaatctgataagtaccgctacaatctcattagaaaataattgacaagcagtaaacatgttttctataaagaggagatagtgaaaatgaaatatcaactgaaaacaatttaggattgaattatcagagagactttaacatctggtcagtttatacgttaagttgtgaatacgccttgtgattgtaaaagtgcttgggcaaaggtacctgtatgtcttacaaacatgaaaactgaggtgaaaggcactttgctctgacccatagtatactctttgcccagtagtgtatggttgaattcatttttgcttctttgctaagaggtagttcgacaccttcttgcttctgagtttattcctatttcttcccagctcttcaaactttaagaaactgaagagggcagcaaagtaac

SEQ ID NO: 46835 - DNA, 1049 bp, Homo sapiens
atctaataagctcattgatttactactattaggtgaatgcatatactaaataagttccagctaagtcaggtactacttccaattcagtgttcttctttgaccatgcattaatgcattatcagtaaaatgtagtgatctcaagcagccagaagtcttcattgtcattagcacaggcatttggatgcttcaggcttattgaaatttatctttttatggagacctttaaagaacattctcatacaccacttattcttaatatcttttaaactttaaggattctctattgtctggaatgtggaaagtagacctgggaaggtcatttgtaccttgctgacaaatttatatttctggatttctttctacattattccagcaattcaccttacacccttaccaaagatcactattgaaaaaatcatttgctttagttttccaacgttctcccttcccccaacaaacgttatttaaagaaaaattccatgtatttctagttgttttctattatacgtggcacagatgttattactttcagaagaaccctacaggctatctgagaaccaatcccctggcttgggggtgacatcagaaaactgatttgtcttctctgctggtgggggaaagcataatcctattatctggaataatatggaaagaatcatagaatcttaaccatcaggtaaggtataattcaccttttaattgagctaatgactcgattgtgtacttgaagaaaaattacatggtataaagacttctttgttgttttttagggcattggccctaaactgtgatgctccattggatgataaaattggagcagagtctcggaattggagagctggtaagccagtcagagtgatacgcagttttaaagggaggaagatcagcaaatatgctcctgaagaaggcaacagatatgatggcatttataaggtgctctatctggcatgacatcttgtttgtcattcttcctgggctttcaaggcagggttgttgcaaggaactactgtgggtgggctcgaggaaacagtagccatcttatattgcta

SEQ ID NO: 46836 - DNA, 1050 bp, Homo sapiens
ttccttaaactttaaggaaatctaatcacaactcctgaagacttacctttcttagatctgaaacttaagatcagtgtattataaaatggaatctcttagcagtcacagctacataaattgggattttaatagttgtctgtgctttgaattcttttcctttaaatgtctgtttcttttatgtaaagtttttcagtttggggaacgtgtagtcttcccctcccttttaatttctcaccaggatctaaaccccccttctctgtgaagcttaaatctgcattgtactctccctcctccccccccatcagtatccagcaggttacccttcagataaagaagggaagaagcctaaaggacagtcaaagaagcagcccagtggaaccacaaaaaggccaatttcagatggtaggtaatgattgcaaaatataaataataataacatacttttgttgttgttgttgttgagacggggtctcactcttgtcacccaggctggagtgcagtggaaagatcttggctcactgtagccttgacctcctgggctcaagcgatccacctacctcaacctctgaagtagcccacggctgtacaccaccacacctggctaatttttgtatcttttgtaaagatggggtttctccatgttgcccaagctggtcttgaactcctgggctgaagggatcctcctgcctcagcctcctaaagtgctgggattacaggcagaagccactgcatccagccaacatactttttaataaagagaaatattaagaaaataaattgagacttaaatgaaagcaaaggatttggctgggggggcatggtagaagatggatcttttgtttaatagtgtcagagccaaatagcaggaaataacagtatcctaaattttaggggaaattagatgctgttttatgttggttatctttctgctaaacattacttgtgccagttaactcttttgtttcatagttctgcttagaaccacttgtaagtctgctgatacatttttaaaataaatctagatgactgtccaagtgcctccaaagtgta

SEQ ID NO: 46837 - DNA, 1049 bp, Homo sapiens
aggcgtaagcagagtctgactttgttaggtcacactcattttcacttataggaaattaagatacaggaagcagttgttaatcagcctaattattctctgattgggaaagatagggcttgttagtgataactgaggtgagtttccactgtaggtgggagagaagcaattacagatggaggaaaaagccacctgagtggtgtgaaagttgtcttccctatgggtagtgtcccactgggacagattctgaccttcctaggtcatattattgtgaccttgctgctagtgattactttggatgttatgtactattgccctggacaagtttcatgcccattctcttcagataagccaggaacacatttattaagccagaaaaaaacaggtgttagccaacagtgactttaaataaatacatatgtgtatatatatttatgtccaaactccttccaaaggccctgtgatcagcagccctacctacatctgtagtctcctcttaaactggtactcttgtgcccagattgcttgactgcagtggtcactgttttatttaaacatgctcgacgtcttgatacccctgggcctttacatacatactgttactctgactggaattctcttttcatgtgtctcactctttcatatcctttaagtctgtataaatagattcctcagagagatcttcccaaactaccctttctaaaatggcaactctttaaaatttagtttaaaaagtccaaacagatggggttactatgttgcccagactgatctcaaacacctgggctcaggcaatcctcccgcttcagcctcctaagtagctgggtttataggcatgagtcagtttgctctgtttcatcagttattactatctgaaacagtttttgtttgtttactctgctgtaggaacgtaagttccaggagagcacagactgcctttttattaccactgtagatgagtgcctagcacattgtagctacctgtaactcaaaatacctgtattagatatacccgtattataggaactgtggaagtaccaggttaaatattg

SEQ ID NO: 46838 - DNA, 1021 bp, Homo sapiens
ctaacaaatgggagggttttggccaccataatggaaacagggctgtccgtgaagagtgggtccagggtgtaggaagctgactagctccagaaaggtgagcttgggggttggtgggagcatcgaaggggaaggacagagcaggccagttgctcctgtgtggtggaggtcagaggtcaggttgagggatctgagctccagagctatctccaggggttgggtgaggggaagtgagttagcatacagtgttcaagcaggctgtttgggaaaggattcaaccacacagatccaaccaaaccttgagggtcacctatacttgagcgagagcaaagctccttaaggaagcaaagaagtcttgagagagaggaggcagggcagcatagagtcctggagaccaaagaggagaaaatgtcataaatggggtggggacactgtgaccagacaacccggtgaggtcagagggaagggaaacaggaaaagactgcatggaatgtgtgcgcaggagatccctgtgacctctgaggtaacaattaaccccaggtcagcccatttgtgcaaggctacagagtgaatgacaaggaaggaatgcacccgattccaatcactgcttatgatggccagtgattaaagatgggaggaaatcccacagtggctcaagggaacaggaacaagttttcagaatggtcagactttgccccccttgtggcattgggcaaaacacttaagtgggtcacctcactgaggcctttcccttccacatggagtttcctggctttgctggccatggtggtgtaatccagcactgcctggacagagctttacaccaacaggtatcagagtcaattccaaagttcactcagtgaccagcttgtgaaaagagcaaataaaccatgggtgttttatctcaaatgccattatctctgcaaaaatgacctctggaatagcacatagaacatcctctatgcattttagaaagtgagtgcattggatataaagacactgcaatggccaggcacagtggctg

SEQ ID NO: 46839 - DNA, 1032 bp, Homo sapiens
tagttttagttcctttttttgcttcactccattgtagcttaggaagctagtttcaattccggattctaccgtctatctgtatgactgggcctttggtcagtctttctaaaatgaagattgctcattttacaaatgagtaaaaactacctgacatgtagtgcaggctttgtaaagcactcatcatgctgcttgtcatactgtaagcactgatatggcataggaaacccaacccccaaacatagcaccttggaagttgagaaaacagcatatactggaaggccactgtcacatctccctcacccgtctctgaagcaggccataaagcctaggaaggtcatcctcttatctctcttgaaaaccctcatgtggcaggtgtcctgccctatatcagggtggaaggaatgtcacacagggacaccaagaataatctgaacaaacaggtcttgctaatctcatgcccccaatttattaccgtgagatcatacccgctttgttcaatcatacttctgcacaactatccactttctcaaacctatgcataaaagtacacagacttttctttgggtcatttccttaggaagactccccatcatgtaaaacttatattacacaaatttgtatgcttttctcttgttaatctgtattttgttataggagtctcagccatgaaccttaccatggttaaggaaaacttgctttttcttctctacacactcaaataaattagtttgcctccttttccatgcttacccaatataaaatagtaaaatgcctctttttttttttttttttttttttttctgagagggagtctcgctctgttgcccaggctggagtgcagtggcgcgatctcggctcactgcaacctccgcctcccaggttcaagcaattctccagcctcagcctcctgagtagctcggattataggtgcctgccaccacgcgtggctaatttttgtatttttagtagagaaagggtttcgccataatggtcaggctggtctcgaattcctgacctgaggtgatccaccca

SEQ ID NO: 46840 - DNA, 1124 bp, Homo sapiens
aatgatgagtcatcaaagcctttgtgctaatgacttctttttttatatctccatccagttccaggtattaatttggcatctctacttgttaagtataacaaatgtaactctgatctttcctctcagctctgcttctctggaatttctcctgcatctcatctcatttcattgctcactcatttcattatgagttatccaacacttcatggttcctcagccctcacatccaaagtatcacttaacaccttgtaacttctgcttcaggaataatattgtggggatcaatccgcttgtctccacctccaatgcattatcctaccattcactcccatcctccctccaatctctttccagcatgatctttaaggcctattgccttattggattgttctcataggcctcaggatatttaaaattcctgccatatctctttctaccccaagctccacccatgtcttatctagatggtttttcatgttctctctacctattggcttttcttttcttcaaactgtatacaaccttcctgaatgtgctgttttttgcctgactgatttctcctctcattttcccccttttcatacatctttctgatctctacttgaaagtacttcttcagagaaacctgacctgttactcatttctcttctctgattaaatcagcttccctaatgatgagctgtcttaattccctgtatttttccctaacacttagtggtttataattgtatatttttgtgattatttgattgtttctacactgtaaagattctacaagggcagagaccaagtatttttatttccttctattctatatagcacactgttccctcactagcactatagtataggtgctcaacgaacatttattgtgcaaattaatgacttttacatatatgcaaaaatgaaggaactgtaaaaccaggacacgcattgggaaatacatcttacccatcgtgacccaacacacataaatatataaaattgaaacaaaagtttcacaaaactttatcaactatgctgtactctattttctttttcttttttttgcagggggatggagtctttctctgtcacccaggctggagtgcagtggtgtgatctcggctcactgcaaccttcac

SEQ ID NO: 46841 - DNA, 1004 bp, Homo sapiens
ggttagtttaaggctttctgagattcatccatatttattttctttttttgagatggagtctctctctgttgcccaggtcagagtgcaagtgcagtggcacaatcttgtctcactgcaacctctgcctcctggactccagcaagtcttctgtctcagcctcccgagtagctgggattacaggcatatgccactatacccagcgaatttttgtatttttagtagagatggggtttcaccatgttggccaggctggtcttgaactcctcacctcaagtgatcagcctgcctcggcctcccaaagtgctgggattacagacgtgagccatcctgcttggtgattcatccatattcctgggagtagctatgatttgttaattttcactgctgtgtagttccatcgggtgaatatattgtgattcatttccttattttcttgtagattgatttttgagttttcagtttttagttcttatgaaaatgctgtaatgaacattattgtacatgtctattgttgaacttacgctagaatttcttgaggccctagcaaatggtttttttttgagatggagtttcgttcttattgcccaggctggagcgcagtggcacaatctcggctcactgcaacctccaccacgcaggttcaagcaattcttctgcctcagcctccggagtagctgggattacagacattggccaccacgcctggctaattttgcatttttagtagagacggggtttctccatgttggtcaggctggtctcgaactcctgacctcaggtgatccgcctgcctcggcctcccaaagtgttgggattacagcatgagccactgcgcccagcgacaaatggtttttaaacagttgcactgctgatgttttggtgcttggtaattccttgttgtggggacttttttatgtttaacagcatctacccattagatgcaacttgaactcttcctcttgtgacaaaaatgtctccaggcattgccaatgtctcaaggatac

SEQ ID NO: 46842 - DNA, 1035 bp, Homo sapiens
caataaattttgctattgaataacatcatattgctttattgcaaatattcatcttttttttttttttttacacatttgtcatagagatactgagaaattcttcagttgtagtttatcagaatacttaaaagctaaattacttggagtattttcaagatgatattttatttcattattttatttttaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaagtgagtagaatcagtttgctatttctgtttccttcaaagatttatgtaaatatgttaagaaacaaagtagacagaggagcttataaatgaaaagcaggagtctcccatgcaatttttcacccttcattgaactgtttctgttttctgttctttaggtggttgctgaacatttgacttaaagaaattgctctttattttattatctcgttcctagcagttataagtggaacttcttatcctatagttgccatgagttttcgtttctacacatgattcatgtttgttgggcagtttttttggtgtgtgtttgataatgtttaagccttaaatgatttatatgtattagaagattagtacttttaaaagcaaaccttgaatgacttgaaaggccaccattgcattagttatttattgctgtgtaacaaattatcccaaattggccaggcatggtggctcatgcctgtaatcccagtactttgggaggccaacgtgggcggatcacctgaggtcgggagttcaagaccagtctgatcaacatggagaaaccttgtctccactaaaactacaaaattaaccatgcgtggtggcacgtgcctgtaatcccagctactcaggaggctgaggcaggagaattgcttgaacctgggagacagaggttgcagtgagccgaga

SEQ ID NO: 46843 - DNA, 1032 bp, Homo sapiens
ttacacctgtgtgcaaaaatcgtggtccaattgtgagttgtttcagaaaacagatgcaggatacgtaaaggaatggggcaggacaggctccaactgggtaattggcatgaaaggagaaaggggccggggcacgtagactcccaggcttaggactccagttagtccattggaagtcaggtgagttatgaatattgctcatgtgcctgctgaacatgtgtgggagagttttgttcgagggagacagaatccaggaggagacttttgtctgtgaacttgggctggtgtgcagcctttctgctgaaacctgatggaattaagttttaaacagttcggcagattctaacttgtcattgtggggcttgtgtgtagctggggtttggagactgcttttacactaaatcattcctgtcacctgctctcaagtgaagcagtctgcagtgtaagccttgctggtatttgtgtagagtggcactgcctctggtgggaagaatgcagcagcttcacgtgtttgctgctcctgaacctcagatctttgttgacaatgatgctgagagaagaggatgatatgttgtgttttgaaaggatcaggactagaagcataaacctttaaaagggaaggtccaggagtcagatagatttaggttaatcattaccatctacttctagctaggagtgttaattttttcatttgttcatttgggaataacattacctattttataggattgtttagaataaatgtaagatacaagtgtgtatagtgtaatgaggtagtatattgtataacacttcactttaatgataactaggtgcatttttggtctaagtatatgagacagacctggtactgttcagaagagcctttgtggagcctgtttttggagtcagatagctagtttaatagtagagaacaaaaattggagaaagaattttgaaacaataagatttatctctgttggttattcttaatatttgcacaactgcttaattgaaattatatgactttttattttagcaaaataaattactttt

SEQ ID NO: 46844 - DNA, 1028 bp, Homo sapiens
aggctctgaatgtgaacatacagcatttgctaaatactttggcaatatgtgtcaaggagaaacattgcttcagtggccaaatcctatgagtatttttatattactttgcagcaactgaaagaatttaaagatataaggggtctatcctattgggtgctgctgggttagaaacattttaagatcagataatccaaaacaaatatattatattattccatttgaaggagtgagcaataagttttataatttttgtatcggatagatacttttttaaaaaagaaacaacactacatttttcttcactttttctgtagaccatgggatattttgtgttgctttggtgattgtaaaaaaaaagtctttaatctaaaaaatagaaacagggtaaatacatttaaaattcttttttaaaggctcaggcttatttatgcgagttattttaattatacttaaaaatgcactcactctaacatacatatatttgaataattcttttaacagaagttttactgtgaaatggactgtgcttaattgaatgttttctaggtgctaggaaaaaataatttgatgaatatcaccaactctttaccaacaagaattcatgatatagcctgccaagcatgtattatcaaagtttctgtagctgtagctttaacaatgtcagttattatatgatttttatatgtaactccagtaatgcaagttattaaaatataagaatatatagcttgatagctaatatgaacaaatttacttgaataacctgaagataccttcaattaaaatgtaatagctttgagtatggattgtttgatttaattcaagtgccagcaagccacatcctatttaggaaagtcttttaaacgtttcctgaaaaagcactattaaaggattaagtaatgaatctggtggaactctttttggtagtgctctgatatcaagactttttttctttgttttttaatgggaaatatattttaattgtattcataatttaggaagtcttatttttacaaaatattatatgt

SEQ ID NO: 46845 - DNA, 1063 bp, Homo sapiens
aatgagagtaaactcctggagtagtgactgacacatggcatgtaataaacatttttctttctacgaggtattgatatttattaacctcttaaaagcaatttggactccctttgtctcttattgtcctgtgacagttaccatgagtgcattctcccatttttgtttaccagatctgccccaggaactttttaaaaaattgatttctttcttttgaaaataaaacaaatatgtgaaacatactgaaaatgctaaaacctacatgagagtattagaaagtaaagaatgtaattctataatcagctacatatggataggcagagagaggggtctgcttcttgtccagctgtagctctgtgctagtggaagcatgtcctggagttcacgatgtggccaagagaacagatgtagttaggcaatggaggtgggacagagagctgcaaagtgctgcacttgcccctcttactggacccaaaaggctctcaagtgtaacacctttctgtagtgctgtagatcattaatctgggtgtgtgatgaccatctgatctagcacatccagtggcattgtgcatattgggataggaatttgattttgtgaactcaagctattcagcagggcccatgaaaaatcaccagaagggtaggtgggtctttgccactgtctgatgtttcaaagatttcttgtattaaatgctgtgtccaaaattatagaatactctccagtttgtatttatgtaaaaaaaaaataaaaataagctttcactcgtatttttaacatggcagactttgtaaaaacatttaatgaaacaagtaaatatatacacttattttgaagtctttagtattttagagtatatttgacagcaaaagagggtgaggaaaaacaaatttggatttctgtcccgctaaaaaattcttaaaaaaatatttaatgttaaatatattagaagaaaatataggggagtatttatttgatccttgagtggagcaagacttttgaagcggcacatcattggtggacaccatgaaagaagatttcacgtatatctttgaaaattgcaagctg

SEQ ID NO: 46846 - DNA, 1046 bp, Homo sapiens
gaaatgagtgggccatttaaatggccctctaaaggtcacagtgactgtcagaagaagtaagaagagagtataattcttcagctcctggacttccataggaaagcttgaaatcttatacccagattaccaaaaaaaaaaaaagacaccaaaaaacaaacaaaacgtttgtaagaattaggactataagatatgatatccaaaaaaaagttgaactaccacatgttaaataatttaatgtttggtgtgacaaatattaacaaatgttaacattttaatatttttttctgattataaaagtaatagatatttgtcaaaattctacaccaccttttaaaatcacctttgtttctgtgttattaccagtgcagtgcccctcagaaggagtagtcactgctcttgaggctgcctccacaggcctatgtcttggcttctctagtccataagtgcttccttaaagatttaacgttacccacatcagtcccaaagggtttttgagagaacagcagggaagggcagcaggattatttcatccacattcagggtgttatatctagaaatatcataattgcaagtaaagatggtgaagcttgtcgctttcctcacagtgctgtgcttcatcttgatagtgcatatcacatttctcatggaacatttccttccttaagcagtcggtacctttaaaagagcatgtcttaactgaatgtcattatcaccaaaagtctattcaaatgataacatagagctatggttacagatgtaaactgagatctgtgaaatatttttggatgaaaatagcagcctcttgaccagattatttttcatataatgttatatttatggaaagtttcttagaatgatcctcatcaaaatgcttgtagtagttatctttagtggaataataatacgaggagcaacttcatttggggggaagaatgtctaagtttgtaatagtttgacaggggcaatgactgaaagtctggattctttttcaccaagagtcctcaggaaggaatcatcacccttgtgagtccactgcagtccagtgt

SEQ ID NO: 46847 - DNA, 1053 bp, Homo sapiens
aaagcagagtagttttgtgtggtatttcatccaggcaaaagtaagtccaggtaagctattttattctgcctatttcataaatatatatgtgtctgccagtgtcagtttcaatatttttttctggagctgtgggcattccttttctgaactctagactgtccattctgccttcctcttcatacaactggaaaataataagaattatttagatgtcataatcaatttatttcaccaaacaattatcacttgtcttgccatgtagtatacatttttgaatcagacacagtttttgttctgtcaaccttggcattactgacattttagagcagataattcttcgttgtggaggactgtcatgtgcatcataggattccagcagccttcaccaaacaggcattgccagctatcccctgggaggcaaaatcaccctcatttaagaatccacgggtctacagcgaagatatagacagaaagagaacattttcaatatttgtcatttttagagaatatcttggttggaagaactgaattcaagactgacagaacagaaattgttaaatgtttttaaaaacaaacctggatttttttcttttttcaaatccaaatttcttttttgttagcaaagcaataaagtctggtaacatgtgcatatcagctactatatacttattaattatataatctcatttaacaatttaacattacctgttcttatggaaattgaacaaccaaattgaatactaatcaagtttcacctaagattaaaattctgtgatgtatgtgtatatgcacatagtagtcactgagtaaatatttatgaaatgaataaaaggcagcaaatcattattcattatttgcacgtcaggcttataatgactgtggctggaggagtgcgatcagacaataacaaatggcctttgcctttccacggtttctcctttaaatgtaacagatctaattcacacacatgtctgcatattgctctaaagcaaggcattactttacttatctgcatcacaggagacatatgattaaattgtagagcccagcagt

SEQ ID NO: 46848 - DNA, 1026 bp, Homo sapiens
cctattgctcctagccttcatggggctgctacagcatgctattgtactgagtatggtaggcagttataacacaatgctaagtacttgtatatctaaacatagaaaagatatagccaaaattaggtattacaatcttatgggaccaccatgggatatgccatttgtcattgactgaaacgtcccatgtagcacatgactgatgtgtgtgtgtgtgtgtgtgtgtgtgtgtgtgtgtgtcaaggtgattgcattgtttaaacagtaaaattgttggatagattatgttccttccctatcatcacttctttcaaaggtaagatagaagaggttgtgtccactgtaactctgtgagaatttgatttgaattcctcaacggggatttttcatttgggcaaagatcctatgagtaaaaacattatatagagagaggacaaaaaagctatggagaattatagtgtgcagggcagagttactcaaattatcatctttggatccttgtaatcaaatgctgagggcagtcaaggctctgggtaacctagtgtttgctgtcttagaacattttagtgaaaataaggaatttaatggcgttagtttcttgcttctaactgtgctggggagcttaggaagaaaagatcatgagctctgggcttctaacttaacacaggtgttgacgacctgtgccactactcagctgaagctttcggagccactacatggtgccaccatctctctttgttttcccatttgtgagaatggcatagttcatataggggctgctctctcagcctgggtcctagcttaagcaagacctggagcagagccacaaccaagattcaacatgagcaagacaaacgttttgttagccactgtggtgttagagatgattgttactggaacatgaatgatagatagtctattatgaagtgcttttagaaaatgcccacatagtgccctagaatagggtccattatgttaataggccttctccttaataactttcaaagcattgattatggctttgtgtag

SEQ ID NO: 46849 - DNA, 1040 bp, Homo sapiens
gagttaccactgagtgataccctgtgtcgcttgcttctctcatttgaaagtgtcccatcagacgtcatttaaaggaaatattaccttattgttgagtaaatgctttccttctcattttattctctccaaattgtaattcctccaactttgttattttattttcaacattgctttgagtattttcggttcttcacatttttgtatacattttagaatcatcttgttaatttctacacacacacacacacacacacacacacacacacacacacactgctgttaatgattgagattgtgggaatatattgctcttcctaaattatattgttggcacccaagaagcctgaagaactcctgaaataaaaaagcccaaggcagagcttctagggtctagcatctgggaactcactgattctctagcaacagtaatgaaattggatgtgactgtaggcgaagctcatgccaggttttagcttagcagtggcccactaccagctccacctgtctaactaatgtgaactctcatctctgttctttatgaattaaattgcttactctttagaatacgtagcaagcaggtggtatgttcctgttgagaggtttacacattaacacagtgaggcaaagattctgctatagctaaagatggttctctcttcccagttctcttcacttaccaaacagggccactacctccgaggtgagctcatgattcagatggaaaaaaattagttttttctcagcatctaatgcagcctgttgtttgtgcttctacagacattaaagtgaataagaccttaaatctgctgggaaactgcttaccaccatttcccactgtattatatgtttgtaattaaaaacccatgagaaataaaagtacacgtgaacatacacacatgtggaaaattaaatacttgtgacgttttgatgagtcatatgtgtatttgtgctgtaagaacaagtatttcttcatgaagccccagggatttaggtttttctgggcagaggatttttacctagctcttgtaatttacaaagaa

SEQ ID NO: 46850 - DNA, 1037 bp, Homo sapiens
gccctgacccctgctccccgggccatttctctagtttctcctactttgcacaccatagcaagacctcttgcattccccacaacagaatggctgtttcctgcttctgggcctttggtcatgcctgtcactctgtctgtccttgattgtgttcttcccctaattctgactgctgcaagcccaggaatgaggagtcctgctgtagatggcatgctagaatgtgttccatcagtcttctctcacgccacctgtgagatggcttcatggcacatacctgtgtaggcctgttccaggaaacagtaatatagccttagtggttttgtgtatttgactctccaacatcagatgtggtgcccactggctagctacaaatgactgttgaggaaattagtgaatgaatgactctctgggaatgtctttgtttggtttctagaagaaaaagataagcataacactctgtacactacaaggtgttttagcttttttgaaattcacgggggaaacaaaagcaaagcctctgattgactagtgattctggatgatgataaactgtatttcccaggagtgttctaaatatccatgcaagaaaagactggggtttaatgagtccctgctttctgtaggtacagatgacatgtcaggctaattttggtcccttggggattatgaaggcctggaccttcccatgagcttggttcagggccttcccagcaggtcagagctcatgacatcaaacaaatcagagttgatacctgagcttttgaggctggtataaagaagatccagtcttgagagcagactttggcattagatgttggctgcagtctcttcctagtaggtacaggctttgtaggagttcctgaaaggggaacggggactatagccttatcttgaaaatcaaaacaaacaacccaaatgacaacaaactaacatttctagagcacttaatatgtgccaatcactctgcagagtatttctgagagaagtcatttattcttaagtcttgtttccttagcatgatgtatataccctgaggccta

SEQ ID NO: 46851 - DNA, 1095 bp, Homo sapiens
aaagagcaccatcaaactgggaatcttgtaaactatcactgtgccccagatgttacaaaaatgagcaagaggaaataaaatctaacgagagcttgttgcagataatcaggaaataactgtttatacagatcaactttggagactacctgttccactcggaaacaggtaaagcctgttaagtctagccggtcgtggtggcgggcgcctgtagtcccagctacttgggaggctgaggcaggagaatggcgtgaacctgggaggcggagcttgcagtgagccgagatcacgccactgcactccagcctgggcgacacagcgagactctgtctcaaaaaaaaaaaaaaagagaaagcctataagtctgtactccaaacagaattgaatatactcaaataagcatttgagggtataaaaatgtttaccttggcttagaatttttaaaactattaataagaatggaaatgatgactaaaggagaaatgaaaaaagagttgatgaaacaaagggaagaaatggaagaaaaagacaattacctcataagtgaataaattgtaagatacctaagggaaaatagactgaaatgaaagcaagaggcaatgaagaaaggcataaaaacaacgaagagaattgaaaatgacaaagaaaaaagtaagatgaatccgagaaagtagggaatggtaggtagataggcaaagacataatattcatattatcagagtccctgaagaagaaaaagaaatggaacataattcatgtttaaaaacataatccagcaaaagtttccagaaattgaaaaaaaaactaaatctagaaagggttccctaggtacctggaaaaattaacccagacttattgacttttgggatatattttagtacaactattagatttcagagataaagatgaaatcatcaagtcttctgtgcaaaaagaacatataacttacaaaggcaaacttacaaaaagcatcacatgttgaaaaactgacatacaaagcaaggcaacatagagcagtgtttttttttaaagctcaatgaaggtgtgaattgaaggattttatatctaactgaatgttctcaaatgtcaaggttatag

SEQ ID NO: 46852 - DNA, 1081 bp, Homo sapiens
cttattctgaggaaaaaaaaaaaaaccaaaactttttaaacttattttttgacatagggtcttactgtgtcacccaggctggagtacagtggcgtgatcttggctcactggagccctgacctccctaggctcaggtgatcctcccacctcagcctaccgagtagctgagacatggtggcacaggccaccatggcgggctaatttttttatttcttgtagatacagggtttcactatgttgcgcagaatagtctcgaactcctgacctcaagtgatccatccgccttggcctcccagagtgctgcgattacaggcatgaaccacagcgcccagcaaaataaactttctttattttcaggtctagaccatcagatagatttattcaaatattttctgggaacctttatgggtagaacatttaatactgtttagaagacttttaggaatactatagatttcaaatgcatcatttaaaataaataaattccactttctctctcctaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctggtatgtctagtgttctcattcactgattcagtcagtacacagataatcagtatagagaacttaagaggctggcttatgttatacctaaatttttactttcttgtatacaacaatgctaaaattgagcagattgataactgccagcaaaccatagatttaagataaatgaatgatttacccaaccctaaaattccatgggtaaaaattttgattcctttattttcaatactgcgttccttataggtcttacatgcatatgcaaggatattttatcttattcattcatttcatactctcaaaacaccaaacttcaaaaagttaattattgtcataatgcattattccatgtgtggtgtcaatacattttagcggacaaagaagaaacatgccagttaaaacattt

SEQ ID NO: 46853 - DNA, 1084 bp, Homo sapiens
gaagtatcctacttgctgagaagtgccaaatgaccctaatattcaaaatatcttagaaatgctatcctttagttaacatacccttaaattttgtaacattgattttaccctggatttagtccatacacgtcaatgtacagacttatcaaagtacaatgctggaacaactagtgtttgtatttttggaatctagaaaataaaaacaatatagccatgatttcaaataggtgagtttccttatataacatttattcatatttattgtataagcatcatgattttttcttccaattaagttttagtgacttcctaaagacatttttaacaacattcctcaaaaataaacttacttagttttcagttttagttactagtgcctgcctataaaaggaccttaaatgatttaaccctaaagccagattcattcctatatatacccagtcagttgtctgcaaagaagtcctaagacttcactgaatgcccagccacaaaactaaattaccttcaaaaattaatgttttatagtttgtagaattctcagttccatgtcagttgcttaattagttgtcataccaaaaaaaaccatacagagcacacattgttccaaagaagctggataatgtagcacaatgtagactgtgagattaaaattaacttttgataaaaagggagtgagtacttgtatagaagtaacattttatctaccataaaaatgtgtaacttctacaaaacccacaaacagtgaaaagacagtctggtaaatccaaggtttgtaaaaactatgcacaaaacccacagtatttgggaaaagaggcaaggtttatacaagtagcagttttaaaaatgtaactttgttctactatcaattacacattaacatacacacactaattgaaaatatgctacaaccatgtctggaaaagcagtttaacattttctaaatggattttatcccacatttactgtataatgtagctgttaatactgcacaagtacacttagcgataatgtttactttactttaaaacaaagggattttctccctcaaaacaagttttcaacatcaaacctatgcttataaaaa

SEQ ID NO: 46854 - DNA, 1052 bp, Homo sapiens
gattttaaaggttaattttttgatcctttagagaggctgaaaatatttttaaaaagaatgttaagacatataaaaataagaataataagacatatattagcacctagataatactgttttaaatacgggactcaactggaaatgaattaggaaattttttttgaattggtaaaaattgagaattttttgaaagcgatacagcatgtctttaaaaaggaatgaaagaagacagtcccaaagtaaaatgtcctgtaaggagtttcgagaaactaagtatacctgggcaatatgcagagagttccaagtggagcaaaaagagaaattggcagaggagaaggaagggttggtgaaatgtcttgaagcttctcattctgaatatgaatttaatgtgtgtagtaggaagctactataggttgctcagcaagaagggggtaaaaatgattatttaaccagttcttgatgtttcaaggtagatgttagtagaaagaggctgggggtaactggagtactcatgaaatgacgcatttctcagtgagaatggtgactaagaaaagggaaggaagagcacaactaagtaattacacaaaggaatgattgtcaggtgttggctataaattatgcataggaaaaggtggaaaaagatgtattgaagaaaagctcaagatacagagtaagagagaccaaagcagcatccagcaatcatttttttgtgtgtatgcactttatttgttctaaaccctgtaaggccttgctacttcaagtgtggtccaaggcccagcagcaagggctttacctgggagctcaggtaaagctcagaccttccccaggccttctaaatcataatctgcgttttaacaggatccctaggtgattcttacgcatattcaagtttgagaaactgctttagaggatacctcagactgtaaaaacttcaaactaagaaaaacagatatataacaagttataattaacgttaaagataactttttattagtactaatggtaggattaacaggtaaagagggggtagttagtgttagaggggacctcag

SEQ ID NO: 46855 - DNA, 1035 bp, Homo sapiens
aaaatataaaagactttatacaattaatgtcaggcgggtttaacattagaaaatcaatcaatataattctaactcaatgtagtcagttaattaatgtaatataacttttcttcatatagaatttctaagtatctctactcttgagtagaattcctaaacatctctactattttaggaaaacatctttttccgtgaaaacatgtttgtgtgtttgtatgtgtctatatctgtgtgtgtatttatattcatatccaagaatacaatagaaattatcatataatattaagtgactaccagacctctgcattgaaaatgtgattgttaggtcagaattttatctaaatcttgaaatactcttaaataaaagccatttggcaagtaatattaaatatagatcaactatcatagcagtaatatagtaatatatcaccaaaataaacatcataagctctaactgattggcctttgattttccaggttcttttttttaaaaaaggattaaatttaaacttggtggaatagtgggcatactctttgtttattgcaatgggatttaagtgattatgtgttgtgtttctacatgatttgtcagtaaaatgggaatcacgtgtgattttttttttttttttcttcagacagggtctcactctgtcacccaggctggagtgcagtggcatgatctcagcttgctgcagcctctgcctcctaggcacaagtgatcctcccacctcagccctccaagtactgggaccacaggcatgcgccacaacgccagctaatttttgtttatttatttattattttgagatggagtctcgctctgtcgcccaggctggagtgcagttgtgtgatcttggctcactgtaacctccacctcctgggttcaagcgattctcttgcctcagcctcccgaatagctgggattacaggtgtgtgccaccacacctggctaattttttgtacttttagtagagacaagtttccaccatgttggccaggttggtctcgaactcctgatctcaagtgatctgcccc

SEQ ID NO: 46856 - DNA, 1095 bp, Homo sapiens
atttgaatataagcatagaccagatatggtggctgacacctataatcccagcactttgagaatctgaaacgggaggaccattgagcccaggagtttgagaccagcctgagcaacaaacgtagtgagactcccatatctacaaaaaaatttaaaaaaaatgagctgtgcgtggtgacgtgtgcctgtagttctagctacttgggaggctgagatgggaggatcacttgagtctgggaggttgaggctgcagtgagccatgattacaccagtgcatgctagcctggggcacaaagtgagaccctgtctcaaaaaaaaagataaatgcaaccacaatccagcatttaaaaaacaaaacaaaatcctgacacttttactgtgtgaatgaagagtggaatcttcattaataaaactgaaacaatttgttaggaaaaaaaacttgtcaactgtaaaacaagttaataatgtaattattaaatttaagctaactttctactggctatattatttgtaagactattagccagacatctctgtagaatgatgtgaaaattataatattaataattacaaatgtaatagtaattttcaggtagatgaacattagcttctttttaagcctgatgagtgagtaaatctcttttttgctctttgaaaaattttacactattcaatcttttctgcctaatttgaccctaattttgatctcatattgtaatagtgtggaaatattagctcatattttagttaagattgagctctatacttgaaagagaattatttttgaactaggaatttaattgaaccttgatattaagctcactccaagtatgcagtttatctggctttctatagatatattcctgtaaatttttataccttgatattaatggggacttcagtcagctggcataatagaaacaacataaattttggaggcatattgatctgggttttaatcccagaccctatctcattttagttgtgtgactttagtgatattcttcctctggatccatttgctcatgtgtaaaatggtgctaacaatcttggtcatgcagggtttttgatgatcattaaagataatatatgtatcgg

SEQ ID NO: 46857 - DNA, 1020 bp, Homo sapiens
aaacattggagtgcagctatctctttgacctactgattccatttcctttggatatatacccagtagtggtatttctgggtcatattgtagttctatttttaacattttgaggaaactccataccgttttccattaatagctgtactactttacaaccctaccaacagtgtgtaaatgttccctttttctccacatccttaccaacatttgttttcttttgcctttttggtaataatgattctaactgaaatgaggtgatatctcattgtggttttgatttgcatttccctgatgattagtgatgttgagcattttttcatatgcctgttatctacttgtatgtcttcttttgagaactgtctattcaggtcttttgcctatttttaaattggggtctttctttctttctttctttcttttttttttttttttttttttgctgttgagttgtttgagttccttatatattctggatattaaccctttgagaggtgtatagtttacctatattttctgccattctgtaggttgtctctttactctgtccatcatttcctttgctgtgcaaaagctgtttagtttgatgtaatcacatttgtccatttttgtttttgttgcctgtgtttttgaggtcttactcaaaaaattcttccccaacccaatatcatgaagcatttctcctatgttttcttctagtgttatcatagctttgcattttacatttaagtctattacctattttgagttgatttttggatatggtaagaggtagggggtctaatgccattcttttacatgtggatatttagttttcccaatactatttattgaagagattgtcctctccccaatgtgtgtgcttagcaccttaggtgtatgactttatttctgggttctctgttctgttgcattggtttatgtgtctgtttttatgccagtaccgtgctgttttgcttactatagctttgcagtatattttgaagtcaggtagtatgatgcctgtggctttgtttcatttgc

SEQ ID NO: 46858 - DNA, 1033 bp, Homo sapiens
ctagatccttgtcctttcacttgtttgcctggcacctgctggagatggagaccaacttactgaactttagacatggcactctgtaaaagtaactaggaccttggagaactttcttgctgacttactcttagatgactatttccattctgttgtttatgtcatttgtttgttcatatatggtcattaacacagattctataaggattctaagagactgagaaatgtagtaattaagtaaagtagtaatagaaatattatgagaatttaaggtgtaatatttcaaatcagtggggaaagatgtatcctttaatacatggcattagaattacttgcatttgtccagaaaaaaaacctacattgtttatgctgaaataaactccagaaaataaaatatttaaatacttaaaaatgagaactatgaatgtactagaaatatacataggtgatttgtttttcataatattggcatagagaaggcatttctaggcaagactccacacctaaaatctgtaacagaaactattgaaaaaaatttactatacacaaatttcaaacttttatacagaaaacaccactagcaaatgtcaaaagatgatgaacaaagtagagaaaaaatttgtaacacacatataagaaaatgaactaatttctttagcatttaaagaactcctaaaaattggaggagggtgaggattgaaaaactacctattgggtattacgctgattacctgggtgacaaaatcatccatattccaaaccctcatgacacaacttacccatgtaataaacctgcacatgtaccccttgaacctaaaataaaagttggaaagaaaaagcaacaatattgtaacaaatgtaaaaaaaaaagcatgaaaaagataaacattttaatttaaaaatggacagagatttgaaacatcagttcccagaaaaatgaatacaagattgactgtagccttgttggcagtagccaaatcctgaagataaatgttcttcaatggcatgacttgttaactaaactatgataacagct

SEQ ID NO: 46859 - DNA, 1155 bp, Homo sapiens
cctgcctctgtccaccctctttctttccatcacagcctctccagtcaggccatcattatttattccctggaaaaaatccaagtttctctctagctttctgcctctcatctctcttatagttagctgtcagattaatattcccaggtgtagttctctttatatcattgtgctgctcaaaattctttcctggatctcttctatttactcactaaggcctacctttgcaatctgacgttcaaaggttcaacccacttctcttcccaccttcctatgggaggcaggagcatgtagcatgcgctcttgggacatacaggcacagccagatgcaggctccaatgcctacggggcaaattatttgccctctctgacccgtacctacctttctcatctctaactttaagataaaaaaagcacaggtatgcctcggagatattgtgggttcagttttgggccaccagactaaagtgaataccacaataaagtgagtcacagataatttttaatttcccagtgcatataaaagctatgtttacactatactgtaatctattaagtacactatattgtagtctgttaagacattatgtctttaaaaatgcagatactttaattaaaaatattttcttgtaaaacaaatactaacaatcatctgagccttcagcttgtaatcttttcactggtggaagatcttgtcttgatgttgatggctgctgactgatcatgatggtgattactgaaggctggggtggctgtgactatttctgaaaataagacaacgaggtttgccacaatggttgacttgtgctttcacaaaaggtttctctgcagcatgtgattctgtgtgatagcattttacacatagtggaacttcttttaaaatgtgtcagtcctctcaacccttgccactgctttagcaaattaagtttatgcaatattctaaatcttttgtttcatttcagcaacattcacagcatcttcaccaggagtagattctatttcaagaaaccattcttcgctcatccataagaagcaactccttattcattcaagttttctcatgagattgcagaaattcagtcacatcttcaggttccgtttctaattttagttcttttgctatttccaccatcttggcagtgacttcctcagttgaag

SEQ ID NO: 46860 - DNA, 1050 bp, Homo sapiens
tcttttcgttgtacagctgaacttattacacagtttctaggatgccagattatccgtttcttttttgtcggattattttcaagtattttttttctcagaaaggatggacaggtggtacgttttctgactccttaaatgaccgaaaatgtctttcttttgcccttaagcttagttggcacttcagctgaacataatattttatgtccatgtatttttgccttggatttttgaaagcatagttctgttatctaaattgagcatacagtaatgctaccaaggagcccatcagtgtgattcttgtttcttcctagataacttgcttgaagcttgtaggattttctctttaggtgcactattgtaaaatctcaacatcatctgtttatttgggtcctttgaaaatttatccttcttagcctttggtgggcctttccatttcaaaacctaagattttcttttcattgataaaatgttctcatattttttcttcattgtattctttgttttagcactctgttagaggttggatcttatggatttgaccttcttctctcttttctctcttatctcatgttttccatctttttatcttttgttgtatctcctcagtggcctttgtactttttgttccatcaataagtggaattcttctgtttgctctatgctatgatctgaatgttggtgtccccccaaaattcgtatgttgaaccctaatacccaatgtgataatattgatgaggccttttggaagtgattacatcatgagggctcggccctcataaatgggattagtgcccttataaaggggtttaaggagcctcccttctcttctgccatgtgaggatacagaaggtgtcatttacatggaacagacccttaccagacactgaatctgctggtgccttgatcttggacttttcagcctccagagctgtgagcaatacatttctgttgtttataaattacccaatctaaggtattttgttatagcagcccaaatggatgaagattctctttgattatttgaattttaaaattttagaaatcaaatta

SEQ ID NO: 46861 - DNA, 1029 bp, Homo sapiens
cctagatatcatgctattttacctacagttactttagtgtttacagacaattctagttattaacagtaatgttctgtaaagtcactacaaatacttaattagctaacactgaactattactcctagaggaagtaaggggttaggttcctgtaagcctctggtcacaacaattttgtcaactgatcaatacatagcctcattttatgtgtgtttctgtttaaagatacttcatttattgttgattcattgacgtcgaactcttggccaaaagcactgttaactcatgcctgaacaaagcttatctaacccattgttttctccctatggcatgtcacaaccttcttaggaacactagccagcacttcagcactgtgcttgatgatcatttgaaggactgaagtcatcaaaaacaagcaccaaaatgtgacaaatgtggtactaaataaaccgtgaaaaggaaacttgtgtttatagtataagagctgaagcagagtgtcactttatttgacatcagttggaaacatgtgggttgtgtgactcaaattttttgccactttgtgtgtacctgcaaatgactacaatagtgccacaataatttttttatttttatttttatgattatactttaagttctgggttacatgggcagaacgtgcagtttgttatgtaggtatacatgtgccctagtggtttgctgcacccatcaacctgtcacctacattacgtatttctcctaatgttatccctcctgtagcccccacctccgacaggacccagtgtgtgatgctcccctccctgtgtccatgtgttctcattgttcaactcccactaatgagtgagaacatgcagtgtttggttttctgatcttgtgatagtttgctgggaatgatggtttccagcttcatccatgtccctgcaaaggacataaactcatccttttttatgtctgcatagtattccatggtgtatatgtgccacattttctttatccagtctatcattgatggacatttgggttggttccaactc

SEQ ID NO: 46862 - DNA, 1047 bp, Homo sapiens
ggcttcactcctgaagtcagcaagaccacgaacccactggaaggaagaaactctggacacatctgaacatctgaaggaacaaactctggacacaccatctttaagaactgtaacactcaccgcgagggtccgcagcttcattcgtgaagtcagcgagaccaagaacccactagaaggaaccaattccggacacagtatctcctagtcagtatacatgggagtcagggacccatttgaggaggcagactgacccttagcagacctggaatgctgtgctgggaggtccgctgctctctttagagctgtcagacagggatgtttaagtctgctataagcccctgactggggctgctgccttttttatagagatgccctttccagagaggagcaatctggcagtctggccacagcagttttgctgagctgcagtgggctctgcccagttcgaacttcccagcagctttgtttacactgtggccgtgaaactgcctactcaagcctcagcaatggcggacgcccttcccccaccaaccttgactgtcccaggtggatctcagattgctgctgtgctggcagccagaatttaaagccagtagatcttggtttcttgggctcagtgggggtgggacctgctgagccagaccacttggcttcatggcttctctctggcttgtgttctgggcgccagtagggtatggaaaaaaaaaaagctcctgcagctagttcggtgtctgcccaattggctgcccagttttgtgcttgaaacccagggccctggtggggtaggcactggagggaatctcctggtttgcgggatgtaaagaccgtgggacaagcacagtatctgtgctggagttcctcagactcagtccttcatggcttcccttaggtaggggagaaaattcccccaccccttgtgcttccaggtgaggcggtgccccaccctgcttcggctagccctctgtgggctgcacccactgttcagcgagtcccaatgagatgaaccgggtacttcagttggaaatgcagaaatcactcaccttctct

SEQ ID NO: 46863 - DNA, 1081 bp, Homo sapiens
tgattctgtatgtgatcttcgattaatttgacagttgcatataagttagcatagcagatttttaggctatttattattttgaaactcttaagtttacttgttgaataaatgtcctgtatagcaacatttattaaccacaggtatctatttattttgttatactttatataccatttatgataaagaccttttttttcagttttggtttatttgaaaccatagatggctctattgaataaggattatgaataagagtgggttatagtagagtaggtgatgaattgtgaagttttgtgttggatctagtgaaggtgatagttttaccgaaagaccaggtcagcaacaaattacaggggcaggagttatggaaagtttgttcactgccgtagtctggcatccattttttaccttttatttgaatagatttagagtctttttattttttaagtgaccgcatcttgctttgtcacccaggatagagtatagtggtgtgatcatagctcactgcagcctcgaatctctgggctcaactgattctcctgcctcagcctcccaagtagctaggactacaggtgtgcacccaacatgtttgtctaattttttaaaaattttgtacacatggggtcttgctgttttgccaggctgttcttgaactcctgggttcaagcatcctcttgcctcagccttagaaagtgctggggttacaggtctgagccaccacacttggccttagaatcttgagtaatcctaaacctgatagaacataatgacagccttgtgaatattaggggtctcttttgattgctccagatatccttggtacattcctttgaattgttgaatatggttctcactctagttctatgaattgaaatcaaatattaaactggagattataaaatctttgacaagaccgatgtcaaggagcttttccctattgttttttctagttttgtgatttcaagtcttaggattaagcctttaatccattttgagttgatttttgtgtatggcataagataagggtccaattttattcttccacatgtagctatctagttttctcggtaccatttattga

SEQ ID NO: 46864 - DNA, 1066 bp, Homo sapiens
ccattggaattttgatagggtttacattgaatctgtagattgttttgggtaatatgtatattttagcaataaccatccttcgaatccatgagctatttttccagttatttgtgtctttaatttctttcatcaatgttttatagttttcagttatagatctttcatgtagttggttagatgtatttctaagtatttatttttgattctgttgttaatgggattgttttattaatttctttttcagagagtatgttttagtgttatagaaacacaactgattttcatatgctgattttgtattctgaaacttaactaaatttgtttactagtttctaacagttttttgttttggaaggagtctttaattttctttatataagattgtgttgtataaagacagtggcagttttacttcttcctttctaatttggatggcctttctttctttttcttgcttaattgctttgggtaggacttccagtagtatattgaataaaagtggcaagagtgggttctcctgatggtgttccctaagtactgtagtctttctttacttttacattcctttttacattctttctgttcctctaactgggtaatttcaaattatctgtttttcagttcacagattcttctgcttgattaaatctgatgttgacactatttcattttgcatttcattgttatattcctcagcttcggaatttgtttctttttaatgatttttatctgtctgttttcattcttttgttcatgtattgttttctttatatatcatttaatcatccatctgtgttctcttgtagctcggtgggcttccttgaaacaattagactcattttcctcattacaatgttttggtcaatgatggactatatatctgatggtagtcccataagattataataccgtatttttactgtactttttctatgtttagatatgtttacatgcacaaatacttaccattgtgttacagttgcctatagtattcagtacagtaacatgctgtacaggtttgtagcttgagagttatagactgtaccatatagcctaggtgtgtagt

SEQ ID NO: 46865 - DNA, 1068 bp, Homo sapiens
ttgtggcatcctctccagctttgtgtgagttttatcatgaaatattttgagtgtgtgaaaatgtataaggaataatttaatatttatatactctctactttgctcaataattatatatacactatatatatacaccatatatatatatatatatatacacagcatatttatgtatatatataaattgtagtttcctttgaattctttcccacttcatgcttttcctccgcaaagtttcatatctgaagataaaaagaattaacaaagtgtaatgtcagttttaaataaagaacttgctagatttttaagaagaattctgaaggattatttctataaaatataaatgtctcatcaatgtttgtgagagaaggcatggaaaaaaatcacgtttagatttgttatttgtatttctgtgtgaaattctgaagattagcccagttctaccatgagggtatatatcatggagcatatttttcatattgaaggcaaagcaaagatagttttcaaaaactatgacccttacatttatattgacaacatctgtagaccataaaaaagcccattgtctttttttggcattctttgcaaatgacttattttaccgataagaattgctagtgatccaaatgaatataatattgtttaggcaatattgtttgggaaagactatgatcctcatttatgaagcagtatttcagtgaaaggatcttaggcaatgggaagcaaataattcaactctatttcgaataatttttattcagtggtttcaagttttctgatattttcttctgtactgtttaatctgctgttcatcccttctagtatatgtttcatataagattctatatttttcacatctagaggttccattaaaaatatatattcactttctctccattatgttcatgttttcttttaaattattgagtatcttttaaatgtttataaaaactgtttcaaggtttttgaattgcttaatttcattatctgagtcattgacttttttttccctccagattatggattatgtgtttctacttctttgcatacctaataatttttggtttg

SEQ ID NO: 46866 - DNA, 1088 bp, Homo sapiens
agtaaagaggtttggggaaaacaatactgggaagatatctgaatcctgctgcatgctaccattatcactgttttccatgttgatgctgatggatctctgctttttcttgacggactatttaatcagcaggcagatcaacaggccaaaattccaccataactgcaaacttaaatgcagatgaatggattacaacatgttcaagccttgcaatgagaggcattataatgtatgatggtataattaatgagaataacctgtctgctagtaataagtacatgggtcattatgtctgaggctgagaatgagttcatcaactgggtagccaccactgcagcaggagccaactgccgtcagtgctgggtatgcctcaagttgctagaggctgccaggaatgggctaccttggagaatcgtccctgctaacatttctggatggatatgccgataccaatgggggtggggtaataacacttgtaatccaacctggacttttttttaaccaaaccaaacagtctatttttgcctaagccctaactaaacacagcacccttgttacttaaattacacattacagcaataagctacatgtagaaaaagatcttaatgatagtatcactggacttatgttatcagatgaatttgctcagctgcgtactgttgtgttgcaaaatcggatgacattaaatacgcttaccacagcccaaggaggggtttgtgccttactgtatactgaatgttatgtgatatacctaacaaatctcacaatattactctccttgcaaagccatggtgggtgtggtttttattaattgtgcttttaattctcctgtgcttatcctgtatctgtaatctatatcaactttgccttccccatgtatctgtaagggtattttcctacaaatgagtatcaaattgagtctgaatgtggaggtaaagttaaatattaaatttgaactcaattgaccatttgaactcaattgaccacaaacagtggtcaccaagtcctggaatgggttgtatgagtgagcccctttaggcgttcatccagtgttgtttcggagaaatctctgtttcaatctattcctatat

SEQ ID NO: 46867 - DNA, 1052 bp, Homo sapiens
atccttgtgtccgtccaccaaacttcttctctgtgtctcagataatgtctgctccattcttccagttgtgtaggcaaaagcttgggagacattcctcacttttctatcaagaaatcctgttagctctaccttaaaaatatccaaaatttaatcacttctcaatgccactgcatctgcctatcatgtacaattcacctttcttttttacctggctgtttcatttgccttctaacttgtctttttgctttctcccttgacccttaaggtctgtcctcaacccaccagccattgatactcttagaatgttatatgttatttctctgctcattgccttcccatttcacttcagatccaaatttcacagggcctagaaggccacatattattttatccccagtgatttctctgttcttagctaccatttccttatctactttactataaatgtgtgtacttccgtgctgttctttgaatataccaattgctcttgctcttgtgtctttgctcttgctactagttccatgacttgacttggaaaactcttccctagggtcttcatgactcttccttccttcctttagatctctcctcaaatataatattacttttaaggagagttacatgttaactattctatataaaataacaacaaccttcgtttcactcccagcttctctaggactgggaattcctttcttcgttaccctaatttattgtccttattatactgatagcaatttgacatactatgtattatttatcttcattatctatgtactgaaatgttaattccatgaaggcagcaacttggtttattttgttccctccaatatctctagtccctagtccaatgactgttatataataaatgtgcaataaatacttgaatgagtgatggattaatgtattagatgtgacttttatttattctggtaggtattccttcaatctgagaactttatttaattctaaaatattcccagcagttacctcctgaaatattgctttatttttcatccccatagttattacttctggaatgttgtaggcat

SEQ ID NO: 46868 - DNA, 1748 bp, Homo sapiens
tagaatattggatatattttcactttattcctaaaatccacttttcatcataatcctggatcttcctctcattttcagtttattcccaagtcctttggagacaatttgataaggaagaaatgtgagagtataaaataaatcgatatttagggatcagcaccagtgatagatcagaaatggaataaaggtcaactgagcatattacttaaaaaaaaaaggtgtttctatcttgatgtgtctctttcttggttgacagacagaaggtgttattgagtctgacttggaggcttccaataattgtgtgaggctagatactatgtgtttaataaatattagttgaaagaatggatggattgataaaagttgaagaagtttaggaaagagatagtatcaggatatggatttcatttttagtaagttagtttgagatagtagacaatccaaagggagaggtcttgtatagctggaaatatgagattggtgattgggaaggtgagggctggattatagattagatagtctttcagacagaggaaagatcagcagccaagagaggtgctacattttctgagagaaaagatgtacagagaaacaaggaaagctaaaaattgagtctggggtacatccacctcgtaggtgtaatttaggtatctcacaggtgagaagaatgttcggttaaaaattttggcagccttaacattctaaatattctgtctacagagcaagatattattagtactaaaataaacttgccattttaaaaattttaaagtgatttatgcttttacaaaatcatagtttatcagaaaagttccttctaaatgacattcaaataaaagaataaggaattatgttagctataaatatattttctttaattagaatggttcgtaaaatcttgtttttctcctgttacacacctaaattttgaaaatttgctttctgagtatgatttaatatttaatatccagtttttatgtgttcttcaacataaataggccctgtacttgcacattttagttaaaaattcatgggcatgttacaggagatgagaattgtggtgacagacattattatgaaagctatttaatcatcacattagcaaatcaaaatgtaaaacctttaaaataaaatactgtttttcttagaaataaaagctcaccagtaatttaaatttttttccacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggtgtgttgacttgtacatagttttgtgggactgttgctttgaagttctgctttaagctttgttagcctttgtggcacagaaagtgacagatttggaggaaaaattgccttaggccctcctgtaccatacagttttctcacatgcaaaaactctgataaagatgctttaaagccagaactccaagctttataacttttagataaatagttaatgatggaaatggagctaagaaagtaggagtgtgaatatgtggcttcttgtaattagattctgatgggactggcattattaattgataaaacccaggtctgggaggatatgtctgtatgggtctcaaaaatagctggggacagcatcaaaggcagcttgatcaattaatgggctctttgcaaatgtgtactcatcaaagctgtcatccagtgaaaa

SEQ ID NO: 46869 - DNA, 1050 bp, Homo sapiens
gtattcttagttttccatttctgcatcactttgctgaggataatggcttccagctaaatccatattgctgaaaaggatatgatttttttaactgctacatagtattccatagtgtatatgtattatattttatttatccagtctgctattgatggtcacctaggttgattccatgtctttgctattctgttgtgatgcatatacaaatacatgtgtgtttttggtagaaaaatttatttttctttggctactgagtaatcccagtaatgggattgctggatcaaatggtagttctatttttatttttagctctttgagaaatctccaaactgctttccacagtgactgaactaattttcaaacctaccaacaatgtataaacattgccttttctccacagcttctccaacatctgttatttttgactgtttagtaaaagccattatgattggtgtgagatggtatctcattgtgtttctgatttgcatttctctgatgattagtgattttgagcatttctttcatgattgttggctgtttgtatgtcttctctttttttttttagtgtaaagctcttagttgtcttttatttgcaattctagaatcatgcagcaactcattctgtaaggcagaatgtgtattcaaatgagccgatctggggaggttggttttatagacagaaaagggcagagaaaagcagaaacagaaaacaaaatgtcgtttaaaagttacttttcttgtacaactcaaagcagaggggatttggggatttctttatccagttttcactggcctgtttcgatatttgactgtttctctctcttgattttttggaaggtcaaataatttagtttctgcttggtggcctggaacttcagaatgaatgattccattttggtttggtttgttgggcctagtgcaggagctcagtccagaccaatgacctcctatacattttgtttaacattttttttttattattatactttaagttttagggtacatgtgcacattgtgcaggttagttacatatgtatacatgtgccatgc

SEQ ID NO: 46870 - DNA, 1030 bp, Homo sapiens
ttttggtggataaaaataagttgttttgtttttactgtgaactgtgctatagttattttggtataaatgataaacgtgaattatgtaaaaataaatacatgcagtacagaaaagtacaaagaaggtaaaagaaaaaaacgttagactaaaaatgcatccctagagaattaacagccataaaattctgtgagcattgttctacatttttctcagtcctgatttataaattgaagattgggtagacagatgtttttaaataaaagggactatattgcacatgttcttttggtaactaataattttaggtttttttttcatataatgaaacaataaggctctctgatgtgaaattgaggagattattacatcttagataattattttttctctataaggaacactatctttctaaaactaagaacaaactgatacgaaaaaccttggcgattcatgttattatttttttttaaactacatttcatctgtagttgattttggcactctgctctgtatactctggaaataagcacataaattcaaccattttgactccccccaatttgtatcttaagaattacagcatttatcttctcttgtataaccacagtgaacacagatgtttaggcataattctatatagtacttcagtgttcatcactaaacttttttactcttgatttgttcattccatcctgtttgttttgattcatctcatgagcccatttttaccagggccttccctattgctaccatatgcttttctgcccctgttggcatccaatttagccatgtgacttattttggccagtgaaatgagaggctttgcaaatgttttaaaggagccgttgtttgatttgcctttgcttttcacctttttccaggagaacagcctatttccactatagtctgatgctccagtttggttcttagaacagagaaaagcaaatgtaatgtgaagaagccatagatctttgtttttggaaggtgtcaggtttttttttttttcctgcagaattatgtagagcagctg

SEQ ID NO: 46871 - DNA, 2079 bp, Homo sapiens
gttggcatcataaatgtcttcttttgagaagtgtctgttcgtgtcctttgcccactttttaaatggggctgtttgtttttttcttgtaaatttaagttccttgtagattctggatattaggcctttgtcagatggatagattgcaaaaattttctcccattctgtaggttgcctgttcacttgatgatagtttcttttgttgtgcagaagctctttagtttaattagatagcatttgtccatttttgcttttgttacaattgcttttgatgtttttgtcatgaaatctttgcccgggcctatatcctgaatggtttcagtagatttccttctaggatttttgtacttttgggttttacatttaatgagtctttaacctatcttgaattgatttttgtataaggcataaggaaggggtccagtttcagttttctccttatggctagccagttttcccagcagcatttattaaatagagaatcctttccccattgcttgtttttgtcaggtttgtcaaagatcagatggttgtagatgtgcggtcttatttctgagatctctgttctgttctattggttcatgtgtctgtttttgtaccagtaccgtgttgttttggttactgttgccctgtagtatcgtttgaagtccggtagtgtaatgccactggctttgttcttttcgcttaggattgtcttggctatacgggctcttttttggttccatattaattttaacgtagttttttctaaatctgtgaagaatgttaatggtagtttaataggaatagcattgaatctataaattactttgggcagtgtggccattttcacgatgttgattctttctatccatgagcatggaatgttttttcatttgtttttgccctctcttatttctttgagcagtggtttgtagttctccttgaagaggtccttcactctttcacttctcttgttagctgtattcctaggcattttattcttttcttagcatttgtgaatgggaagttcattcatgattgggctctctgcttgtctattgttagtgtatgggaatgcttgtgatttttgcagttgattttgtatactgagactttgctgaagttgcatatcagcttggaaagcttttgggctgtgatgatggggttttctagatatagaatcatgtcatctgcaaacagagacagtttgacttcctctcttcccatttgaataccctttgtttctttgtcttccctgactgccctggccagaacttccaatactatgttgaatagaagtggtgagagacagcatccttgtcttgtgccagttttcaagggaaatgtttccagcttttgcccattcagtatgatattggctgtgggtttgtcataaatggctcattattttgaggtatgttccatcaatacctagtttattgagcatttttaacatgaagcgatgttgaattttatcgaaggccttttctgtgtctattgagatgatcatgtgtttgctgtctttagttctgtttatgtgatgaattagatttattgatttgtgtatgttgaaccagccttgcatcttgggaatgaagctgacttgatcgtggtggataagctttttgaatgtgctgctgtattcagtttgccagtattttattgaggattttgtttgtttgtttgtttttttgagacagagtttcgctcatgtttcccaggctggagtacaatggcgtgaccttggctcactgcaacctccacctcacagattcaagcacttctcctgcctcagcctcctgagtagctgggattacaggcgcttccagtatgcctcgctaatttttgaggattttgcatcaatgttcagggatattggcctgaagtttttattttctcagggtttggtatcaggatgatactgacctcataaaatgaattagggagcagaccctccttttcaattgtttggaatagtttcggaaggaatggtactagctcctgtttgcacctctgatagaattcagctgtaaatccactggtcatgggcttttttttggctggtagggtatttgttactgccccttcagaacttgttat

SEQ ID NO: 46872 - DNA, 1075 bp, Homo sapiens
ccttctgaggcctacttgtgtcagttcatccatctccacctccgcccagttctgtgctcttcctagagaggtattatgatcatatggagaagaggcactttggctttttgaattttcattgattctttctcatctttgtgagtttacctagctttgatctttcagtttgcgaggacctttttgttgatgctgttattgttgttgctttctgtttgtttttcttttgacattcaggcccctcttccggagggctgctgtggtttgctgggggtcactccagaccctattcacttgggtcccttctgcacctgcaggtatcaacagtggaagatgcagaatagcaaagatggctgcctgctacttcctctggctgggatcttcgtcccagaggggcaccaacctgatgccaacaggaatgctcctgtataagttatctggcaacccctgttggggtctcacccagtctggaggcaggggttctgggatctgcttaatgaagcattctggctgccccttggcggagcgggtgcgctgtgctgtggcgaatctcaatcatctggactgcctggattcctcagagctggcagggggaaagtctaagtctgctaatctgtgaatactgtggctgcctctcccactagaggctcagtcccagcgacatcagagttctgtccctaaacccctggctgcagttgctgaaattcctgcaggaaggtcccacccagtgaggagggatgggttagggttccgcctgaagaggcagtctggccatgatctgccatagccatagccactgtgagtgctgtggggaattccatctgggtccaaaccatctagtcttcctggcactggcaggggaaaattggcagactggagctgcagtgatggctgccaccccttgcccctactccccgggaactcaggcatcttaggcaaaaggcagggtggtgatgatgacctccccttccattaggaagttggtagtcgtaggtagtcaccagcccattggctgctgagaggccaccaagaggctgccgagaatctggacagctctgcacttgggacccaaggccct

SEQ ID NO: 46873 - DNA, 1056 bp, Homo sapiens
taacatatttgttagcacactagtatttttcactttaacattatattttaaaaaatcataacatataactattttagatggtcatataatttatttttctactgttggttatatatgttatttgttttactattgtaaataaagctgcaataaacatttctttgtcagttcagactattactattcattatagtgtactgactacacatatgtgtacacacacacacacacacacacacacacacagacacacacacactgacctatccacccagggaagacttccttttatgaagctataacatcatattaaccatatgcaattcacttttttttttttttgacagtgtctcactctgttgcctaggctggagtgcagtggcacgatctcgactcactgcaacctctgcctcccaggcttcaagcaattcccccaccttagcctccccagtagctgggactacaggcacgtgccaccacactcagctaatttttgtacttttcgatagagactgagtttcaccatgttgactaggctggtctcgaactccttacctcaggtgatccatccgcttcagcctcccaaagtgctgggattataggtgtgagccactgtgcctggcccaattcacttttaattagttcgtacataacatacccttttaaaattatgccataataagaatgtacgggggtcatggattctaaggggacctgcctactacatgatcagtaaacgttaagttactgaaacttgagacattgcatgctatgatgtcccactttggataatgcaatttaaaaatcataattgtattttaaaactttatggcgatgtttctattttaatttaaatattactctagtccatttaatgtttgactttgggtggatgaatggttctgcagtggtgaaaaatgtggagaaacaaaatacaagtgagaagtccttccagttagatcacagttataaagacagaatgtaaaattgtactataagccagggagaatctgagtttccatttacacaaattattttagaaatgttttatgtaaa

SEQ ID NO: 46874 - DNA, 1033 bp, Homo sapiens
cagagggtctgatattgatagtgactatttggcattaactaaagtacagtattctggtttttcaggtggtagggagaagatctgattgtagtacctttacttgggctcagaatgctggtaacttttgtcatactttagttgcaaaatattatgccagagttaataattggtttgcttttgtttggtttttatgatttttactttattattgtttctattccatttttttctcattttcagcatggaagaatatcaatcttatactttctctaggtatcttactgtacaggatcaaaataactttcaatatattaggtcaaggtgccacaaagatagtacttttatattatgcttatcatcgtatttttatacttaattagtttcgagtttatatgtgtaaacttaatttgaaaagttgacttgatttattcttcagcattattgtaaatgaaaactgccttgtaatttgttgcttgatttaattatattcagtaatttatatttttaattcagttgtatatgtagatatgaccacacaaatatatgggaaatgatttttggatagtttgatatttaatcaattttcaggagagaacaacttagcagtaaaatataatgttatgatatgatttttagccttaataaatgaaagacatttttatttaaaagaaaaatttgaagtctttatcttttgtaagtcttaactataaactttttttctaaaggccattgtgtattatattcacaaaatttgaacttgttatcattcaactccactatcctgcatgaaaaataaaccatttctgctataaaaagaaggctgccaatagatattctgatatttcaagcttactttaagttccaagcagaatgaaacagcccaagatattaaaatctagaaatttagcatatctaatggaaactgcaactcaactttaactactctatagtggcacttctcttgccgctgtaataaaacttaagaatgtttagtgattttttttttcctactattattcaaaattacattacc

SEQ ID NO: 46875 - DNA, 1034 bp, Homo sapiens
atgtgaggcttataacatattttggaaaaatctgaatgtgttttattttgctatttaagataaaaagaaatttatagaaaaatcagtcttttcattctagcttttaagcactgtcaggattagtttactcttaggattggaatctataggtaatttgtaaattgtggagttattctaaaccctcttgtgtgacatgtaaatattactaatttttgtcagtacagtgtgatatttacatgtcatagaataaatacttagcttgtggttgctcaattttgtaccaaagatgctactgtcatttactggatgtatgtatatacccataattgtcatctactggatataagtataattgggttgtaacccactcggtgttaagttttatttggtatatggaagaagttaaagttttggaattaattttcttccattttattttgctgttaacaacttgactgtaccatgtaagtatttagatactaaaggaaagctaaatttgactgacttgtttattactgaattttgctataatgtgatagtgttataagcggagatggtgatagtttattttttactcaaatgtagtcaataatttaattttattttgtgaattacaaatgctacctgaaaatatttggttaaaagtgagtagatggaagaaatgcaaatatttatatttttaaaaggagtgctagatgaatttgttgatattagacattttattactcaatatagtggtctttctaaaaatgaagtataaatttaaactagtacccttagttttatttgtgaatttttattataacactattttgatttacaatattatgttaaattgatattctttttctttttcttttttttacaagaatatatgactattattaaagtcatttattttcaggatatagatgattcagctaacaatgtttactttattaattggtaatagacatattgctgcatttctgaaatcaattttaaatataaagttaatctctgaatatgggcatttcatgagaagaaaagtgtgt

SEQ ID NO: 46876 - DNA, 1024 bp, Homo sapiens
cccaggttcgagctattcttctgtctcagccccccgagtagctgggattacaggcgtgtgccaccactcctggctaatttttgtgtttttagcagagatggagttttaccatgttggccaggctgatctcaaactcctgacctcaaatgatcctcctgcctcagcctcccaaagtgctgggattacaggcgcgagccgctgctcctggcccttttgcataattcttgaaatttgttacctgggttctccagagaaacagagccaatagaatacacacacacacacacacacacacacagaacaattatttactatatttatataattccttatagtaaattagatttatatgagatttcctataaggaattggcttacgtgataatggaggctcagaagtataagatctgtagtcgctcagggaatgctatgcagccataagaaagaatgaaatcctgtcctttgcagcaacatgagtgcagctggaggtcattgtcctatgtgaactaatgtagaaacagaaaactaaatatcacatgttctcatttataagtgggggctaaacctgagtacacatggacataaagatgggaacagtagacactaaagaactgcaaaaggaagggagcaagggctataaaccttcttattgggtactgtgttcactatctgggtgatgggatcaatagaagcccaaacctcagcatcctgcaatatacccttgtaacaaacctgtacatgtgctccctgaatctaaaattaaaaaaaaaaaaaaaaaaaaagattttcaattggcaagctagagagccaggagagctgatggtatagttccagtttgagcccaaaaactatagaaccaggaaagctgatggtgtaagttcaagttcaagtcagaaggcaagagaagactaatgtcccagcttgaaggcaggcagagagaaaggaatctttcttactcagcttttattctattgaggttttcaacagattaaatgacatccatccatattggggttcatgcttt

SEQ ID NO: 46877 - DNA, 1475 bp, Homo sapiens
agaaggatggtcaccagagcctgggaagggtagttggaggaagtgggaataattaatggattacaaaaaaaatagttggaaagaacaaataagacctggcgtttgctagcatgacagggtgactattaaaaaataatttaattgttggttggtttgtaatgtaaaagttaagtgcttgaggtgatggatgccccatttaccctgatatgattattatgcattgcctgtgtatcacatgtcatctaccctgtagatacatctactgtgtacccacacacaaaaattctagagattattttataaggataaatgatactcatttttattattcattgataaagttttcctagttttgtttgtttacagttttgtaggtactatagtgttatgcttaatatcaataattcgttaatattttggttaggcattacattttttgggaaattatttagttcgtatcttttttcctggaatcaaaatcttagagttagaaggaaatttggagatcttcagatctgcaacctccctgacagctagcttaaatatgaccagtaacggggaatgtctcactgctcaaattgcaagaggattatctctttattaaagccaagataactatatttcgtatataacttcagtacctcattagaaaaattaaagattgatatgacaggattttttgttgtttaacctgctacattctaaccactgtacttttaggttttgacaatttatacttaataattagttttcatatacccttcacttggcttttgtcccagttactgttgttgctccaatgctcgcattcaggttactggtgacttgttaaggccaatatttgaacccctccatttaacacctttaatttttatcatatttcaagcttatctctttatcagcttctgaatcacattgtctcattttatgtcctactcttgctgttatcttcccgtctctttcagtggaacagtttttcatttacttcttaataactagggtttgctaagactttatccttggtttacttttcaaaattaatgactttatgtttttttgaaaaattatacatacttacattcgagcagtaagaaagaaaaaagaagaaagcaaagaaaaaactagttcacaacatgttagagataaaaatttttaatattatcatataaccatctcttttttttctttttcttttttttaaattttttaattttttttttttgagacggagtctcgctctgtccctgaggctggagtgcagtggcgccatctcgtctcactgcaagctccgcctcccgggttcacgccgttctcctgcctcagcctcccaagtagctgggactgcaggcgcccaccaccttgcccggctaattttttgtatttttagtagagacggggtttcaccatgttagccagaatggtctcgatctcctgacctcgtaatctgcccactttggcctcccaaagtgctggga

SEQ ID NO: 46878 - DNA, 1040 bp, Homo sapiens
aaaataaagcatttaaaatattaaaatattcattttaattattgtttaccataattattgtagaggtattcttctttagaatggcacttatttttatgctgccttagaccaaggttgtaaggtatatttaaatttatttctatttttaatctagaatgctactaatgaactcactaaacagtcatcaaatgtgaagactttgaaatttgaactcctagcaaaagaagaacacataaaggaaatgcatgaaaagtatggtttttgtatttctatccattgtatttggtgccacctagtggcaaccagctctattaaacgtgctccaagaaactgctaatgtttacgttttccttccctagttcatatttaaacctacctaagatgaaagtttaaggaatactatgtatagcatgattaatggcaagctatttacttttttaaattagataatgatgaagttaaatttccgttattaaacatatttaattttgaataaatacaaattaatggcttcgagacaatgaatgaaaaactttacaacgtggtggttatttggccccccaaatatatgattagtatttgtattggatttaatgcctaagcttataaagctaaggtaaaaaaaggaaagttttgtttgtgtttaaaataactggaggttatggaagtttgtactcttgtgtttatcagtacaaagattttaaatgctctatcccactgaatcaaaattattttctttctgtatctttcaaagctacactattgcttagaaatagtaagatgtttagatagaattccagttgtcactgatacatttgagatatatgtatctcacaaacacacctgtagacctcattataagtgaagagcacttaaaagtgatatgaatagataaaagcattagacaaaaagcttggttaattttttaactgataatattttgaagtttatttatcaattaagagtaagtcttgcttattgtttaacagggctctagattaacactctttgaatcctggcttccctacctactaggccta

SEQ ID NO: 46879 - DNA, 1024 bp, Homo sapiens
ttattttatgactgctgatcttttgcaggatctcaagcttactctcctagtatcaagaataagtgagactgaatctgcaatggcagaaattgaaacagcagcatctaagcagcttcaagaattagcattgcaaagtgaacaggtcctagaaggtgcacagaagacattgctgttagccaatgaaaaagtagaagagttcaccacatttgtgaaggtttgaattacttgtcgtttactaacttgtactttactttaggcagataggcagtagcctacttgagatgatttggggaataaagtttctttctgctttcctaacacagaaagcatcttcttctaccctatttatcacattgctaataattcctccataaagaatttatttttatagtttgaatttaaaattttctaccatcttattaatatttctttcttaatgtcaatttagttatgaaattgtagtagtcaagtcatctggacaggttttaagttgaaagaattaagctgttcccaccctactctccttttgaaaatcgttcaagcaggaacaaccagaaacttgctcagtgttcagtgatgctaagagacatctgaatcccaggccacaaactatcaagacatggaatagacagaggaatggcacatgacaaacagaacaaagagaagacaaactcaagtatctgcagaggtgtaccatctagaaattatctaaaagctgaagagccctagaaagccttcattcccctagacatagaagttaataacattttatgccactattgagtactccacgaagaggaaattccttactttgcttctttggaaatcatagataccttgggagttttctcattttaaaaatatctgcaaaatgaattgataaaacattttatctcctttatctcttttaatgaatatttcaactggtgtgaagtcaagccaataatgcctgcctctgaggatcctaaatgattgcaaagtattaattttagtaaatgtaatttaccttttccagattcaaaac

SEQ ID NO: 46880 - DNA, 1103 bp, Homo sapiens
tttcctgagacgaaatctcctcctggtgaaaacgctgtgaacattgtagaaatgacaacaaaagttttagaatattccataaacttagttgataaagcagtggcagggtttgagaggattgactccagttttgaaagaagttgtgctgtggtaaaatgctactgaacagcatcacatgctatagagaaatctttcatgaaaggaagaatcaattaatatggcaagtttcactgttgtcttaaagaaattgccacagccagcccagctgtcagcaaccatcaccctaatttgtcagcagttatcaaccttgaggcaagactctccactagcaaagtttttacaatgtgctgaaggctcagatgatcattagcatttttaataataaagtatttttaattaagatatgtacatttcttagacataatgctattgaatgcttataaacataacttttacattcactgggaaaccaaaaacattgtatgactcactttattgtgatatttgctttattgtggtggtctgaaatggaacccatgatatgtctcaagtatgcctgtattttggctattaacctctatcagatatgtgatttgaaaatatttgtcttccattgtgtaggttgcctgttcactgttgtttgctgtgcagaagccttttagtttgatgtagtcctacttatttatttttgattacgttgtctttgcttttgatgtcatttctaaaaaaatcattgtccagaccagtgtcatagagattttttaaaatgttttcttgtaggagttttttctttttttttttaagagatggcgtctcactctgtttcccacgctggactcccgactcctggactcaagcgtcttctagaaattttatgctttcaggtctgatacttaagtcttttatccatcttgagctgatttttgtctgtggtgtaagagaggagtctaatttcaatttttttgcctttggatatccagttatccagcatcatttactggagagactgtcctttcaccgttatatatcaccctgtcgactatatttatggatttattactgggttctctattctgttccattggtctatgtctgtctttttg

SEQ ID NO: 46881 - DNA, 1069 bp, Homo sapiens
aaacagtcctttgcacttgtgactttataaaggcaatgaaaataattagtggaaattaagctgagcctgtgctcgggaatcattaaaaaatatatatatgagtaccttctacatgccaggtattatttcaggtttggagaatatggcagtgaataaaagagataaaaattcactactgtaatagaatttacacttctggggacggaggacaataaatagttaaaatgtataaactatgaaatttactaggtagttaacttgagtagaattatgggtgggtagatacattaaaatatgtatatatgtataaaacaaatattacatagttataaccagagtgtgggtctttactaagatttctataaatacccttagacaggaatggctagaaaatgtgttcttgatttatggtgtgttgctttattctttgttatttgctaatccttttttaggtttcattttgtccattttagtccactttgtatagatcattttcttctattggaactatataaaaaattctgtctgtttgccttcagtttttgagaatttaaagtaaagactttgatcagtggcttttctttacctttaaatatctctgttcctattagttgcttcagatcttgcaaatgctgaaatttaaaatggctaactttccccagtgtcctctctgcaaaatatgcttaccttctgtagaatgccttgcagtgtggcagtgggaagggttttataaatctccctggcttttgtaaatagaatatactactagcctgaaggttaactgaaagtttctccttgcatctctgaagccatttactctgtggttatttcctgtgttgcacttataacaaatgcattcagaaactgacatactcactcactcactctgtctcatccatgtaagcctacacactcagtaacccatacagaattaatcctcacatttagatgaagtagcaagagtttaaaattctctactcacagccttgctgttttttttcaatttaacaaagtaagcctactttcgtatcactagaatgtgattacagttaaaaggatccttttaata

SEQ ID NO: 46882 - DNA, 1044 bp, Homo sapiens
aaaccaacaacgttggtatgattcaaaaggagctctctcaaccggctgtctctggtaagacaggcccagtaatgcccacctgcaaggctgttgtgaagatgaactgagaccacctatgtcagatgtagcagacagcatatgccctcagaaggctggtagctttactgtgtttctccataacacttctcatttctcggagacaaggtcagggaatgttttgaaatgtttatttgaaaagtatttattgtgcatatattatttattcatttacttactatgtccttgaaatggagactgtattatacagatattcaggtcagctttaacatatcctttaggcctaatcacttttttctttcaacatgcctaatgtagcataatagttaatagcatagtagtttgacttttaaaattgatttctagggaagaatgtaaatataggaaagcttcctgatagagattatctaaacttaggcataaataataagtaaaactctgaatttaggtatgtaattgtagaatccctttgattataagcaagttgaaaaaaattgttttttacctagatgagtttattttaaaaagttattaagcatttataaaggagccttttttggggtggctcctaattattaccaagtttccaatattataaactctgtgcttgagttgaatattatagtttaggcttctatctcctagtagtgtttccaagcaaacagtttttccagtctctcagaagttcatttcagttaccatctcctcactattcctggagtgtatgttgcttatggtagcagctcaagggacagatgtatgaatgagagcaatccataaatgtttgaattcaaattatagtttttttaaaataaattctgctataaaaagaaatgaaatatttgtccatgctaaaacatggagaaaccttgaaaactttacttatttatttttattatactttaagttctgggatacatgtggagaatgtgcaggtttgttacattgatatacatgtgccatggtagtttgctgcacccatcaacc

SEQ ID NO: 46883 - DNA, 1070 bp, Homo sapiens
cttttgaaaaacaagtttgacaaaaaagcaagtgatagtggctctacaaaatgtacttctgaactttctatatgatgtatttctataatatatagaagtatatagaaatattctataatatagaaatatataatcatatagaaaattcaaaagtacattttggagggagtctggggatatttttcagccactttcatgtataatctttctttcctagcccttcttttttccccttttaattcactcaactgtcctagaggacagtgacattttagaggaaatttattcaaaccacaagggaatatttacgaagagtttctttgcttgaaaaaaaaattatttctttgctttgatattttaaagaaattgatacttttaaagtttcttttaattttaaaatgatgtcaaacttacataaaagttccacaggtagtgtgagatacttccatgtgtactctttaccttgattcaccagtgttcatcttttgcttcattgactttatcattagttctgtctccctcgtacacaaactattttttctctgaaccgtttaagagttcctgtagactaacccttaactgtttcaacgcatacctcctaagaataaggacattttcttatataaccatagtacagtgataagaaacaaaactttttatatccagtccacaatctgaacttaaattttgtcagttgtcccaataataacttttgtagcatttctctcctccactgggtccaggatccatccacttgtattgtgtttaattattatgtcttaagtttcttttaatcttgaatcattcttcatccttttttctttcgtgaccttgatgtttttgatgagtacaggcaaattattttgtagaatgtgtcttaacagatttgtctgctgtttcttcataatagtattcaggtgtttatttgcttatttattcattaacgtttattatgtcctcttggattctcatacagtgttataaactattactgtcaacatttattctgatgctcaaattgttacaaatctggccagtaagagccccgtcagcttaaagaatgatgtcat

SEQ ID NO: 46884 - DNA, 1031 bp, Homo sapiens
aattaggtgctctggcctagaagtgacacttgcttagaactcatggccatctctagtcacatgacctcatctacctacaaggggaccagaatgatgacaacactttaactacctcatttgggacttaagtactaagtgaacaggagattcagaactgatttactttatcttgaacaaaaatgaagactacctaatttgctttgtttcactgttgatcattagatcgtttgtctagatttgctggaacagggcatcatcgatccaaaggaagagaggactggacatgggtgagcagcaagaatgactatcacgagctccatgtctcttgctggttactctcccctgcagatctgcactctagctctgctgatattgtcattattgtgtcattcatgcccttactcatttcaccagatcccattattcaaccagttcttgcatgcagttcactcattcattcctttctctttctcctccccaatgttgcattaatattcaaaatattcttcctcttcttcccttcatcttcctatttcttcttctgtcttcctttacaactcaatgtttccatcatctctttcaggaggcttatctaactgtacccaaaaagctggcttgtcatccattctctggtctttatgtaaaaccttgtactcacttctaatagaaacctaaacactgcactggaaatgcttacttgcctatttgcctcacagcacagtgtaagtctcctgtcttattcactgctgtactctgagtaccttgcatagtgcctggtgcagggccaattaataggcatttagttactctttgctgtttcagtgacaagagattatttatggtgaagaacttagcataattttggataagagaaactactttttctctggttttcagacttgttaaaaatttatataatgagagatgtgttggtttgttttctggataagaacaatacagagaaggaattttggatattccagtagctgaaaatttaactagccacacaggctagaggcataggcattgga

SEQ ID NO: 46885 - DNA, 1028 bp, Homo sapiens
aggatcacagttcctcaccagcaacggaacaaagctggacggagaatgactttgatgagctgagagaagaaggcttcagacaatcaaattactccgagctatgggaggacattcaaaccaaaggcaaagaagttgaaaactttgaaaaaagatttagaagaatgtataactagaataaccaatacagagaagtgcttaaaggagctgatggagctgaaaaccaaggctccagaactacgtgaagaatgcagaagcctcaggagccgatgcgatcaactggaagaaagggtatcagcgatggaagatgaaatgaatgaaatgaagcgagaagggaagtttagagaagaaagaatcaaaagaaatgagcaaagcctccaagaaatatgggactatgtgaaaagaccaaatctatgtctgattggtgtacctgaaagtgacggggagaatggaaccaagttggaaaacactctgcaggatattatccaggagaacttccccaatttagcaaggcaggccaacattcagattcaggaaatacagagaacgccacaaagatactcctcgagaagaataactccaagacacataattgtcagattcaccaacattgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataaatgaagaagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactgggaagaaactgcatcaactaatgagcaaaataaccagctaacatcataatgacaggatc

SEQ ID NO: 46886 - DNA, 1028 bp, Homo sapiens
tgctatggactgaagctagaccacctgagttagtattctggtcccttcacttactagctctgtgaacatgggcaaatacttaatttcattacacttgtttcctcattggtaaaatgtgggtcagaatactactttatagccagtcgtggtggctcacacctgtaattccagcactttggaaggctgaagtgggaggatcacctgagatcaggagttcgagaccagcctgggcaatatagagagaccctctctctacaaaaaaaaattttttttcattagctaggcgtagtggtgcgtgcctacagtcctagctgcttgggaggctgaggagagaggattgcttgagtccaggaggtagaggctgcagtgaggcataattgtgtcactggcctccagtttgggtgacaaagcaagaccctatctcaaaaacaacaataaaaaaccacttgataggatgtttaaaaggattaaattcaacatggtaagtatttaggaatggtgcctagcgcatagcatactctgttaactaccattactacctactgagccattcttccccaaattactggatatgaaacctatttgaatatttgatcccttactaaatgtcaggtgttcttaagcacttgtgcatttatcttactgaatcctcacaacctatgtggtaggttactttgatcgctattttagcagatgagcaaactatgatcttattaaggtcatacagctaaacccaggcaatctgactactgactctcctaatcattacaccccattacttccattgaaaagttaaccataagagtcatagctttttatttatttttggtttgtttgtttgagacggagtctcgctctgttgcccaggcttgagtgcaattgcgcgatctcactgcaacctccgcctcccaggttcaagccattctcctgcctcagcctcccaagtagctgggactacaggcatgtgccaccacgcccagctcatttttggtattttttagtagagacggggtttcaccactttggcc

SEQ ID NO: 46887 - DNA, 1891 bp, Homo sapiens
actctaagctcaagagccactggccttgctgttcctcaaagaccaagttacttactgctttaaggcttttattaattgacttttttcctgcctggaatgttcttcctttattgtcatatgatttgcttgctccttcatgccacttaggcccctgcttagatcttacttcttttttttttattttgagatggagtcttactcttgttgcccaggctggagtacaatggcacgatcttggctcaccgcaacctccgcctcctgggttcaagcgattctcctgcctcagccacctgagtagctgggattacaggcatgcgccgcctcgcctggctaatttttgtatttttagtaaagatggggtttctccatattggtcaggctggtctcgaactcccgacctcagatgatctgcccgcctcagcttccctaaatgctgggattacaggtgtgtgcctctgcgcctggctagatcttacttatttacttcttcagagaggtattccctggtgacaccataaaaataggcccctcccttccactttctctctgttttgatttacttttcttcatagcacctatggttttttttttttgagaccaagtcttgctcagtcacctaggctggagtgtagtggcacgatctcagctcactgcagcctccgcctcctggtgattctcgtgcctcagactccagagtagctgggattacaggcgtgagccactacggccagctaatttttgtatttttagtagagatggggtttcaccatgttggtcatgttggtcccgaacacctgaccttggttgatccacccttctcggtctcccaaagtgctgggattacaggtgtgagccaccatgcccggccacacagcatctatgtttttgaaaatataagtttactaattattttccaaccgtaatataagctccataaagacaagtatttggtattttcattgctttaattcccagcatttaaaacgatgtttgagaccctgtcataagttattaatataccagtagtaatttttgttttttttttttgagatgaagtctcgctcttatcccccaggctggagtgcaatggcacgatcttggctcactgcaacctccacctcctgggttcaaatgattctcctgcctcagcctcccgagtagctgggattacaggtgcctgccaccatgcccggctaattttttttgtatttttagtagagacagggtttcaccatgttggccaggctagtcttgagctcctgatctcaagtgatccacctgcctcggcctcccaaagtgctgggattataggtgtaagccatcgcgcctggccaccagtagtaattttttaacaaacacaagaactcctttccctttagccacaaaacagtaaaatagttatgaataatccaagcaaaaaagtgtgcaagacctgagtgaagaaaatcaacaaattcattttatgtgtgtgtgtttgtttttgacatggggccttgctgtttcacaggctataatgcagtggcacttacggctcaaacaatcctcttgcctcagcctcctgtgtagctgggatcacaggcatgtgccacaacacccagctaattttaaatttttttgtaggggctaggtctcactttgttgcccaggctggtctcaaactcctggggtcaaatgatcctcccacttcagcctcccaaattgctgggattgcaggcatgagccactgtgcctagccaggtcaagatttttttctcaactctttatgtcaaaatactgtcttcaaaagttatatgtggctgggcgctgtagctaatacctgtaatccagtgctttaggatgtcaaggtgggacgattgcatgaggccaggagtttgagatcagcctgggaaat

SEQ ID NO: 46888 - DNA, 1078 bp, Homo sapiens
tgctgggattacaggcgtcagccaccacgcctggctcgaatgccacattttctttatccatttgtctgttgttgaataacttagggttgctaagttgaagcaacttaggttccttccaaatcttggctattgtgaatagtgctgcaataaacatgggagtgtcagtatttctttgatgtactgatttcctttctttttggtatatatctatcataggggattgctggattgtatgatagttctgtttctaattttttgaggaacctctatactattctccatagttaccatactagtttgtgttcccactaacagtgtatgagggttcccttttcttcatatccttgccagcatttgttattgcctgtcttttggacctaagccattttaactggtgtgagatgatatctcattttagttttgatcaaagaaattttgatgcatttctctgatgaccagtgatgtagagcaccttttcgtatacctgtttgacattcatatgtcttcttttgagaaaaacctattcagatattttgcctgtttttaaaactggattattagatttttttcctgtagagttgtttgatgtccttatatgttctggttatgttatgttatgttatgttatgttatgttatgttatttttgagatggaatcttgctgtgtcacccaggctggaatggggtggcatgatctcggcttactgcaacctccacctcctgggttcaagcagttctcccacctcagcctcccgagtagctggatctacaggtgtgtgccatcacacccggctaatttttgtatttttagtagagacggggtttcattatgttggccaggctggtcttgaactcctcacctaggtgatccacccgccttggtctcccaaagtgctgtaattacaggtgtaagcaaccatgctcggcctatgttctggttattaataccttatcaaatggatagtttgcaaatattttctcccatctgtaggttgtctcttcactttgttgattgtttcctttgctgtgcagaagcattttaacttgatgtgatcctatttacctatttttgctttgg

SEQ ID NO: 46889 - DNA, 1022 bp, Homo sapiens
ggttaccatccatttttgtataagatacatagttgaatgtataaaattgcagtggaaaaaatcttgagggatttatatcaaaatctggttatctctgggacagaaatttgggtgagattttttttttcataatttatctgtataagtgtactccaagcaaatatttcttgtgtaataagaaaaaaagagaagttaattttttcaaacaaactcaaatcttataacagaattctgttactctttaggtatatggagctgccattcagttttatgaaccttactctcgggaacttctatcagagaaacagcttatgcacctgggcttgttgacgcctgtggagagaaaaatggtctccaaatccatcaatacaaacaaatgcatttgtttactctcacactggcctttttttgaagcttttaggaaatttcttatgtttatctacaaactttctgtgtctggaccacatcctcttcccattgaaaagtatgtataatgattagaaagatggctggtggaaaactgggtatataaatatatacatttgtttgtgtaatttttagcagcaaagttggaagggaaggaagcctgcatttaactgaacttttttttttttttttttgagatggagtattgctctgtcacccaggctggagtgcagtggtgtgatcttggttcactgcaacctccacctcctgggttcatgcagttctctgtgtcagcctcccgagtagctgggattacaggcacctgccaccacgcctggctaatttttgtagagacaaggtttcaccatcttggccaggctggtcttgaactcctgacctcatggtccacctgcctcagcctcccaaagtgctgggattacaggcatgagccaccaactttttacttactcccttcttcgcctgaatcattgactgtgagcttaaaattggatagtagtggtaaggttggccaaataataatcctttgagaattcagctgaagaagtaactcttataaattatattgtgagtgttct

SEQ ID NO: 46890 - DNA, 1065 bp, Homo sapiens
aagaactaatgtaacacttctgagtaaatacagctatcattttatattttagtacctgtttccaaaagtgtgtttgcatattaaattattaatgttttcaatattacctttgatctaaatatatagatttcaaaagtagttttgaaacttatctcttggtttggttaatttatctttggttaatttatcttttttttttttttaagctgtcagtccatgatgcattaatattatcacagccagtttctacacctttaccactaaggtaattactggtatttaaaatgatatatttattcagttggagcagaatgctttaaaatattttagtgattagtatattattaatatattagtgattgttattttacaattaactttattagttaaaactaggcaaaaatagccttaatgtttctgactttggtaactgggtggatggtggggctattttataaatgggaacaattaagagagttgcaagattggatgtagaggatacttcccttttcttctcatctccccttcccatatccagttcataactaaaggtttaaggtgagctgattttaaccttttaaatgtctcaaatccttttacttcttttcatctgcatcatagtaggcttccttgatgtcttaccagactatttcactattagcctcttaattggtacctttttacttatcttcctttagttctttatccaccctgtagccagtgtgtccttttgaaaacgcaaatataatagtatatttcaatttcagcctaatctgttgctgttttcaccctttcccttactatgctttagtcacaatagatttatttcaatttcttggctatgacaacagctttttcttgccccagggcccttgcatatattgtctgtcaccccttcactcccatccttgtctccattcttctgagctcaactcaaatggctgttcaggaaaatctttcttgataaatgccttttattaccagaggatgagtttaaatcaccccgttatctatcttattaaatttgctacttttcattgataaataagtaaagactagaaatta

SEQ ID NO: 46891 - DNA, 1034 bp, Homo sapiens
gctctttgttttacttgagagtaaaattctgctgcattctcttaggccagctgtcttgactggggtagctgaagctgttgtagctgtaagtatagaattttccttttagtacaaaattactgacataatttttactccaaagggaaattttcttcaaaaacagcaactttgtaaacaacaacaaatttaaaaaaaggaactttgaaaaatttccagcccagtaaaagttgaatataatctgctggcaaagagaagtaggaaatataaagaaaacaaaggtgatttctattttaggaaaaacgtcaatttccaatttttcatatttttgagttcttcccagagtaaaaactatatgattatataataaaacctgagaatgaagctggttgtattgagaggctctggccaatttcagctgttctaaaattatgcaaatgattacatggttaatttctccctattttaacttttaataattgtgaatcagtaatatacaggaaattctaagtgattgtgaaataggataatatacagaggcttagctcttgtgtaaagcgtaaataaaattaaattgttaaattgttaagaaattaaagttgttccctgcttaaaaccctttggcttcccattgcacttagaatgaagtctgattgacaggcatggtggcttacacctgtaatcccagcaatttgggaggctgaggtaggcggatcacctgaggtcaggagttcgagaccagcctgaccaatatggagaaaccctgctctactaaaaacacaaagttagccgggtgtggtggcacatgcctataatcccagctactcaggaggctgaggcaggagaattgcttgaacccaggaggcggaggttatggtgagctgagatcacaccattgcactccagcctgggcaactagagtgaaactccgtctcaaaaaaaaaaaaaagactgaagaatgaagtctgattgtatagggctttataggccattgtatagaactttagatggtccacttctccaaccctatcacccat

SEQ ID NO: 46892 - DNA, 1055 bp, Homo sapiens
aagtttcaattctgaagaagaaaaatgatacttttatgaggctccctgctccctttgggagtttcattttgaaacaaagactgtgaaattcttatgaattagtaatttaccaagaaaacttaaggtagagggccaggaatttattctttattaagataaaggataggatttggatgtgactcttttaagaaattagaatggattttgtagtttttttattgctataaatttaataaacttagaaaatcaaaccaaaatggaaaactaatacatcattctagcaccaatacttgtgtctcttaacaattgtaggtatgtatgtatcatgtggatgtgtgtgtgtatgtattgcatgtatgagttcatcaggtagattctctttgtaatctatgtttgcctttagtggtctgaacattttcccatgccattaaatatttttgtgccttatcatttgtaatgaccacattgtatgcatttattatgatttatttaactagcctcatggatttgtttgtagttctttgctatctatatctttgttattttcttaggctgcatttctaaaagaatttctaaaatagaaagtaaagtaagtacatcccaaaatagagaattaatgtataatatcaagaggactggatcagaatgaggaatgtatctgggattgaatggcttgattaaatactattttgatttcatgttaactatagaattcttttctgctttggcttaactacaagaaattggaatccagatattgacaaacaagataaaatcaaatatggaaaggcgctatattctggaagaaaattggccaaaagaaataagtagacaatttccaagaaatccaaagtcaataatataaaaatatgttatggttttttgcattcaaagaaatgcaaaccaaaatgatgaatagaaacctttgagattgagaataggttatgctagtagttagaatgtatgtttaagtataatcttttttgaaataatttgatattaattataataattttaattcttttgataaacatggacctagcaaattctattat

SEQ ID NO: 46893 - DNA, 1022 bp, Homo sapiens
acaacctaataatgtccagcagtgaaaaactgcttaaattgtggtacatccttaaaataaaaattttatggattttttttattttaaatacctatgcaaggtaattttatgaagaaaaacataaaattatgaagtatactaaaatttttttaaacataaattattgaatacatggattatcttgaaagagttatttctccctttaagtaagatatcagagttttctgtgttttagagattgattgaaaataacaaatagggtggggaagagacaaaattttcatgaaggtagtctctgtatgttatatcatttaaaaattttgaaaaagtattttttctatataagcatttaaaataatgttggatactatttgaagtttagaaatatttgcctaaacgctggaataatatgaagagttggtgtgttttaaatcagcagttctatttttttttttattttagttacaaatactttccaagactggaccttaagctttttgacagaccgcaggagttgaaactttgttttagtagacaccctactgggaatagcattacaaagagtccacctctcatggctaagagaactaaacaggtcagatattctttatctaatacatgttcatttaagatgtaaaatatgtatatgtgatatgcagctcatagtttagaatgatcacccacaacaaccatttgaagactcactttggttgttattgaatttaactagatttcttgcaagcctacttaaaatatcaagtctgggccaagcatggtggctcacgcctgtatcccagcactttcagaggctgaggtgagcagatcacttgaggtcaggagttagagaccagcctggccaacatggtgaaaccccatctccattaaaaatacaaaaattagctgggcgtggtgtcaggcgcctgtgatcccagctactcgggaggctaaggcaggagaatcgcttgaacctgggtgatgcaggttgcagtgagctgagattgtgccactgcactccagcctgg

SEQ ID NO: 46894 - DNA, 1038 bp, Homo sapiens
cctcctgattgctaggactccaggcgtgccccaccatgactgctaatattttattttttgtagagatagggtcttgctatgttgcccaagctggtcttggactcctgggctcaagtgttcctaggtctcccaaagtgctgggattacagccatgagccactgcacccggcctttgttttatttttgaaattttattgaggttggttatgaggactcatgcctgtaatcccagcactttcagaggttgaagtgggcatttgcttgagcccaggagtttgagcctagcatgggcaacatggtgaaaccccatctatacaaaaaaatacaaaaattagctgggcgtgatgtcatgtacctgtagtctcagctactccagaaggtgaggtgggaggatagcttgagcccaggaggcagaggtcgcagtgagccgagatcacaccactgcactccagcctgggtgatagagaccctttctcccttgcctccccaaaaattatctgttaaaaacagaagtacattacacagggatatgtggacttggaatatgtgacactgtaaattccaagtcactgtggatcttgtcttgtcttttcattgttacatccctggcaccagtaagcagtacctggcaaaaggcaaataggagatacctaataaatatttacacatgaaggaatgaatgaaaagtctataaaatgtttttaactttcatcccgagtttaaggaattaattagaggtatatgtaaaaatagaggaatttaccaatgtaatttatataagattgaagcattttgaatgtttaagcaacaggggagttagtaaatacataatagtatatcagtaaaacagattagttcacaggtgtttaaataattagaagaaaatttaatgacattaaaataattacataagaagtacaggtgaaaaacaatattctaatttgtaaagatttatatgattttatatgtatgttttaaatgactagaaagatgtatatcaagattttgattatattctctgactgttgatatcataag

SEQ ID NO: 46895 - DNA, 1050 bp, Homo sapiens
caaggcgggtggattgcctgagctcaggagttcaagaccagcctgggcaacacagtgaaaccgtctctactaaaatacaaaaaaaattagccaggcgtggcagcgtgcgcctgtaatcccagctacctgggaggcggaggcaggagaatcacttgaacctgggaggcagaggttgcagtgagccgagattgtaccactgcactctagcctgggcaacagagcgagactccatctaaaaaaaaaaaaaagaaaagaaaaaaaaatttcaaatgtcctgaaagttgaaagaatcgtataatgaacaatcatgtattttccacctagatttaattaactattgttaactttatctctttctatgtatgcatacatttttatactgagccacttgaaaaacagttgcagactttattctgtgtcccccctaaatactttggcatgcattttcaaaaaacaaggacattccttacttaaggtattacgatgtatattcctttgtaggtgaagttccatttccaagaggcatgaaagggcaagactttgaaaaatcagatcatggttcttctcaaaataccagcatgtctagcatctatcagaattgtgcaatggaggtaaaagttctatattcagttcatgataaagtagctgtaagcatatttttatttcagaatggcatttaacaggattctaagatacccttgtggacagtataataaaataagtcattttgttgaatttgcttgatgtcttatgtaagtaagacattgaactggtagtttacctgtgaaataaaagaactgttattaataattccaaatttgatcagtagaataaaaaaaatcccattatctcaagagaattcctgttaagattaatttttattaaacgttctcagtgtctgcatttttctgtttttaggttttgatgtccagttgttcacagtgtagagcttgtggagctttagtttatgatgaagaaattatggctggatggacagcagatgactcaaatttgaatacagcttgtccattctgtaaaagcaacttcttg

SEQ ID NO: 46896 - DNA, 1605 bp, Homo sapiens
atttattcttaagttctactctatttcccaatcattgcacatgttggtttatgtaaccaaacctgattttagtatatgctattaggacatacacgtggagaagaatggaggaaactttttattaaatgtttttaattgttgaaacacttaagtaaatgtgatttttaaagactcatagttattaaaggtattgtattcattattttttatttattccttcattcagcaaagacagcaactactttggtgctaggtccttaacttatctttaaggaacttacagtattgcatggacttcataaacaacaccaaaatacaatgggataaacattataattagtcgttcacatagtatagtgggggatagagaaaactgtgtgcaaggtttgaggagattcagagaaggctttatggaggaattttcatctgaattgaagtttgaaagtgagtaggaattagttggtgaggttagaggataaggcattctgggcacaagaaagcagtgaggacaaatagataggttagaaacgggacatagacccttaatgtgttaagatagagaatagatcaactttaaaaagtaaacaagggtaaataatgaaagttctcttccacaccgtgttagccattttgagctttaatctggaggctatgttgatccatgagtaatagattttaagtggaagaaagttaacatcagtttcatgaggcaatgtgaggaatgaattgtagtggggtaaggcagacatttgcattacatgtgacagaactccgaaaatgcagtgctgctggagagaagaggatgaattccagatatattaaggtgattgagttagtggccagatggatgtaggggatgaaggagtgatggagtcaaggatacctcctaggtttatgacttgccgagataggaatcacatgagcaatatcagatgtatggggagaataagatcagtagtcttggacatgggtttaggtcacacaattggtgctgttcagtgggtatttggctgctttggcctggagttaaagagaggattctaggctggagatagagattaggatgctatcaatttataggtagttaaaacaatgtgagaatggatgatgcctaagagagtttgtagaataagaaagaataaagcagaagggaaacgctgggaaacactaccctgtaggaaagatgacccagtgaaaaagacagaaggaacagcctaatgacagtggatgtctagaagataaggagggagagaatccaacaagaagagactggtcagatgccatagggaataggagaaagagctaactacagtttttggaaggtttcccagataggcctggatcattaatttgtaataatactagttcatatgattctgtgacttttggcagcaaaattcagtagaaccagagatgataaatagttggattgatacagtatttggattttgttacgtgcgtatggtaagattgcaaaggagttgaaactattggtgaaagaatggtcagagtgatggaatgtgaagtttagactggatagggatgacgatagagccaggaggagctgaaagattgagataacataattggttcaaaggattaaaa

SEQ ID NO: 46897 - DNA, 1028 bp, Homo sapiens
tggaggatactattcacagttttatttttctgtgcctggagtctctttgttaacatagataatcaagaaatgcccatacgtgttactgttaaattaggtgaaaaaaatatatatatatatttatattgtttagtgtaggatggctatttgaattctgttatagaacacttaagtagcaatgtaggctgatttatccttgggttttgtattttaaaaaatcagtttaggctagtatctctgatttgttagaagatgaagtgaaaagtatattagataaattcaacctggtggggaatggggaattaagcttctcttcttttatttctttttctagatatgaactatagctttttctttgtccctattgtgtttcatattagttttattaggttcttgtgattgtgtcctgtcctttgcaaatatttcttattgttcttctgtaaccactgctcgatgttagcaccatatttctttgattcacacacgttttttttcagattttaacatctttgaaattggattgcctctagtaattgatggcagcagttgagatacagttggtattgcctgcacatttgtgaacttgggcatgattttctacacgagtctaaaagaactcttgtgtgactataaaaccaaaattccgacttataagaagcactgtatatcatagactaattggcagccttttttctttcttagtggcacacagtataatggtgcaacttgcaattcctggtcagttccattcaatgaaatatggtatgttttgtaaaacaggagctcaacctatccatgggtgctcagttcttattactattccttttactaggagataagagacagtaagttggactaaacttaatattcatgtaaatgagtgacttatatcacaaaactagaccacaagcaccacggtcttaaatcagttccaatgtgtgaaatacaaagagaaaaatgaggaaggagtgggtgctgtgtttttatttgagctgttctggagactttgcaggactgacagttattca

SEQ ID NO: 46898 - DNA, 1025 bp, Homo sapiens
tttttaatgaaattattaactgtgacatgataatccagtaagaattagttatttaattcagcaggatatgcacacagtgattgtgggtgttgacctctcaggaagttagcgtttcaaagactcagaggattgagatagagttgacaagatgagtatcaccaatgtgggtttcagggttgctaatttggaattgaaatcttttacctaaaactcagattattctgtttactctagaatatgtaaccatcttcacagtattatgaaaatggaagacttcattgaacaaagatatttaaagcagggggggatttaggttaggcaggatggtaatctgccttactataaaaagcaataggagactgctatttccaagtgacttaggccaaggtcagtagttaggagtgttgatttgccttttctttgtcatctgtagaatgtaataaggtagaattgttttaaaaaaataaaatacacacagtagcaataatactacaatgcattggattttctgggggagttgtggtcaagggagggaatcatacttccttgtgaaggtgaccttacctattgccttgaaggacccaggaagccatctcttaagagaggggctctgagttagcagaggacccagaagatgcatgtgatcagtgtatgttgccctaggaactctgttcagtgaggcattcagaatgtgtctgcttcaaaagaatgacagcatggaaccataaagaagggcattgattcatgtggggaagatggcttacatgggctatggtgatcaaacagggaaaggaaatcaggtacttttgctgtgagccaccactgaattgatcttacagcacctgtagtcttcagtatttgacaacacaggtatcagaagtgtgagagagtctctcttcaaaatacagaggggtgtctatcacttacctgtatttatagtgctttctttttgataataagtaaacagtatctcatatactgtaaatgggatggtctgtgtcgtggtatatctcatataccatgat

SEQ ID NO: 46899 - DNA, 1045 bp, Homo sapiens
atggtctgggcagtattttcaaggtacagtttctttcctctgtgaattagctggaagcccaaagccttataaccttatattcaaaattcaaaaggaagagagaagtaaagaatgctcagattggccttgcttaggtcatgtgtttacattggactaaccatcatgatgggataatggggcactttacttggccatcctgggtagaatagaagtaggtgaagtatcaggtctaaaattgtttctgccaccaggttcatgtggaatggggtgagatggtcccccaaaggaaggatagatagtgtactcatcatagaagtggaaatgtgcaaaataggcaaaaaatgtaaagcagaacttctcagtttgtcttttgggggacactgaaatgctgtatatgtggtaggtgtgccgagatattatcctgtctcagcattctggcagccagttagttgtcttagctcaggctgcctgaagtctctgtctggtagcctctggccacctggtatgtagaagccttataggatgcttaacagtatcttataaatatttgtagagggaatacctaacaaaagattttattgttttggaaatcaaggctacttgtttgtggttttaagacctgagaaaatgtgttttcctcctatgtttctatccataaggtttaagggtttatggtaagattaaatacttaggtatctgaactgaacatcaaccacaaagatgagtaattttgagataggttgagttggtctaaaataaaagtgtaaatagtttaatatctcaccttcaatggaataactctaaatactatgtgtaaggtgtatcaatttctttttgactgatttataaaatagaatatgccaaagagcaaaaactcataaatttgattttagagaaccacaagttccttcctcaaaacgtatccccattgatgagtttgacaaattgagttttgcaaaactcagtgcctctttcaaattcttgttacttgcttttctcttgtttggaagtggcagtagagtcatgcttatttgttttgcttttc

SEQ ID NO: 46900 - DNA, 1083 bp, Homo sapiens
gcaatgaaatagtatgtacagtattcatatattcccccaaaaaatgtatacacagaaatgtacacaaaagcattacgttgcacatgtttctttgtagttttttcacttatcaagatgttatggccattttaccacatttatgcagatctaactcatggtttttggaggctgccggtgttcacagcatatcaacaatttaatgtatgtaactgtttccctattgatagacatttaagttttccaaggttttgttgttgttgcatgcatctgaggccttctcagtcatctcagccttttagaacagctttgtccaaaagaactttctgctatcatgtgaatgatctataatttgtgcagttttatgtggtaaccactagtcacatgtaactattaagcccttgaaatttggctagtgtgactgaggaacagaagttttaatcgtatttaattttagttaatttaaattcaaatttaaattaatcaaattgattaatttaattcaattgatcaatcaaattaaaatagccaaatgtggctagtggctactgtattgggcaacctagctctagaatctctctcttcttctgaacaatgaaaatcaatcattatctatgctgtttattttgtatacctcaaagactatcttaaaatgtttccttgttcttttgtcttactttttgtctatagaaacgatttttatacttttaatctttaaagttgagttcaagttattcagttaatagtgcttgagattatagttgtgagtttcttaactaggctgtgaaccacttgagatgggggactgtcttttgtcagttgtgtcatcaaagcttaacacaatctcagtgtagatttggccctcacatatttttgatggctggatatgtaactcataagagagttttctgtttattattgatgctggaatactctagaagttattctttttagaaatcctaaaaaccattgttttcttaattgccactttcttttaaagcaaaatgtggaatgatcctggtttgggggtcccaaagatgactaacacgtttagttattctctaaaagaactcacaagactcagca

SEQ ID NO: 46901 - DNA, 1082 bp, Homo sapiens
attaatgaattaatgtttaattgtcaatgtcttggtggtaaagttaagaggatattttttcctttttgaaattgaattaaaatagatgtcttcgaaggttagaaggaacaggctttctaagaatagaacagatagagaaaatgaacaaatacagtgggcccttgatattagctggtttttcatctgtggattcaccagctgcagacagagcatatttggggaagaaaataaaaataagaatttagcaataaagataatatgaataaacaatatagtacaacaactatttacatagcatttacattgttttaggcattataagtagtgtagaaatgatttaaagtgtatgaaaggatgtgcataggttgtatacaaatacctatgccattttatataagatgcttgagcatttctggattttgctatccatggaatgaggtgtgcgtatctgtgtgtctgaccatcctggaaccagtccctgtagatactgaggaatgactgctggacaataaacttttgaaatatagcatatggcaaataaaattttttggcattacagtttgtgctatcaagtaagtgctttgcttatagtagatatttaccaaataattttgaattgaatttaaaaaaccattaaaatataatttacatctcatgtaattcatccatttgaagtgtacaattcaatggcttttattatatttacagagttttgtaaacattactacaacgaatttgagaacatttcattacccccgaaggaaaccccatgcccataagacgtcactgcctgtttcacccttcctgaccaccccctgcttcttacttgccctatcctagacaaccactaatctaccttctatctctacatacagccttttgtggctgttttttttctcttaccataatgttttcaaggttcatccatgttgtagcatgtatcagtacttcctttatttttatggctgaataatatcctgttgtgtggttatattgtattttgtttatttattcgtcagttgatgggcattgggttgttctgggcattctgctcatataaatgagatcatataacatgaggc

SEQ ID NO: 46902 - DNA, 1055 bp, Homo sapiens
ttactgttttgttgtatttccttttcattattttttcctaacaggcatcaactaatttctgaaattaacattttttcttataataaatagtaatttagccttattgcttttatgattccattgttttctctgcccatcccctcctgttactataaggctgtacagtttatcaatgctttttaattcataagaaataccctgagtttggcactgactttcctcattccatttctctaagacatcatcattaactgtggttagtactgaagataaatttttaggcactagtgtacataatatatatcagttgttctatgtgtcctttgactaatttagttagcttctctgaaactttgttccttcaaatgaggataaaataagattatacacaaaaaagacctagtgtaatatctgctcacataggtattaataataaagcactaccactaattagttaagttcattttattagaaaaagaatgcttattttcttacctcttgtttttcgtctgttcattcttgtctagaaagtaaattattttatcgatgcttactaaagcaaactattttattgatgcttactaagtgttatataccagttttctttatagatattaccaatgtccagaattgtggaatttgttgaaaatgactgcattactattaattttggtgataatttttttttaatgtttggtaatgaatagctgtgtgtttaaataagtagatgtaatctattttcctttgaggcttgatgatggtagtaatatatctttctgttttgtttaaggcttttcaagctttgcgtgtgtgtgtgtgtgtgtgtgtgtgtgtgtgtgtgtgttcattatttgtgaagctgctgctatgtcctgtgatgtgtgttacagtcataaagtatacttggtattcaccagctcttgccaggccacatttactaactgggggctcatcttttgttttgtgtccagagtgctattcacagaggtcagctcgcattctgtgaagccagttattttgttttctaattgatatcatgtgtgaagcgtgatgta

SEQ ID NO: 46903 - DNA, 1053 bp, Homo sapiens
agtcacaaaccgagggcattctttaaaagatcaaacaagctggacactgggagggttttaatgatgccagttaacatcagaggagctgggctcagtggttgcaaattgtgctcatctgaataaatgccactgagctggaaataatgacatgactaaaatgatggtaattgtgtgctgttctaccattccagtgaataaaatatactggtttaagcttatataatgggtagggtttttttttgggaggggggttggtaaatggggacagggagtgtagagacagagtcactgaagtagggcagtagacaaaatgacgttaatgttttgaaaaggttttggaatttgaaatctgattggaagcattatgtttgtacaagaattattatatctgtttttaaaagtattttattcagcatgtactctcaaatgatctagaattaaacttttataaacaatggtgttatttgttgggcttaaactcgtttctgtgctatgtaaacatgtccataagaacaagaccatcccaccttctccatgcgtaggataaaataactaagagactcatttctaaaaactctagtgataccaaattagacttaaccttgattatatgaataaaataacatatactgaaattgttaatgaaagaagttaacttgcttaaaggaaatttggaattaagacagcgagactggtaagtcttttcatagttatataatttatcagaaagcctcactagcatgcatataagcccagaaattgtatttaaacaatgcaatgtataccttttcttttaaaggtgtttatttttaagtttagaaacgttatagttgaaggaataggatttcttagagtttgtggtctgtactattagttggaggtcattctaaagcctttttcatgttttgagtatacattagttatcttttgtgatttagatgacattataccacataggtctttttttttttaattttgagctttattaaaagctgggcttatttcttttcacaatagcctggtggaatgtattatgccttaggttctaaattc

SEQ ID NO: 46904 - DNA, 1050 bp, Homo sapiens
agttgttcttacttcccttcacagaccctttcacttttttttgcaatattttgttttgaaacgaggattaaatttctcgatctctcttttgaaattgctagtaaatatccttttagctaggcaaagctttaataccattttcaaagcactgactgtagaactttgggattggtgagggaaggtttctttccccctccagatttgatgtttaatgcatgttgtgtttttttgtttgcttgctttttttttttttttttttttttttttttaccctatctaggacccaattgtagcaaatgctgcatatagatccctggccaactttactgcaggagaacacaccattcttcatctgcctgaaaaggtaggcatatctgctttctcactggtatttcttaatttgctagggtttacaactttttctctctcatcttaggagatacttacctgatgaatatatacataaccctagatctgttgtccatgcaagatacaaattcatacccattatttgtttatatgtaaaagactgtagaggtttgaagcagatggaagacacctatgatgcaaatgaaatcttcttaaggtgactgggtatatggcttgctccagatctgagtcactcatagggatcactttgcctaattagtatgccatcctggactttaatccaagcatggccttcatagactaagattttatagcacctgtgcagccaaagatctctatttgtgataaacaatgggatgccatatgaaaaaatctgcttttttttagtatctgtgaatggtatataggtagctccagaaaactggatggagaaagtatcactatcttttaagagttaacacatagtgtgatattcagttaggaaaagaggaagtcaaattgtccctgtttgcagatgacatgattgtatattatcttagtttttagactaaactaaaaacatataacctcttctagtatctgcctattataatcagctttaaattagtagatcctattaaggggttaaatatctgatttcttatttagtgccactatgaa

SEQ ID NO: 46905 - DNA, 1049 bp, Homo sapiens
acatgcagtggttttcttttttcattttccgctacatatgatttgtttagctttaatgttttttgtttttttgtttgtttctgtattgggcaacctctagtggtccttaggaaaatcacatttgaatatgaacctatagtcttatcaaatattttgtttatacatcctgttgtcttctgacatcatatttctgttattatatagtaagtaaaatgtcaaatgataaagatcttgggcttaattagaaagaacacaagcaaagatagtggacaaatatctcattttaaaataattgtcctaatattgctaagtatagatagttatgaaagaggtttttctgaaaacacttaaatgataagaaggagccattctcatgaaaatgtgggactgatatgttccaggtggaagggatagcaaatgcagtggcactgacttaaatatcaactttgtgtttttgaggaatggaaagaggccatatgtaagtgtgacttcaacatagcaaggaggtagggtattagacattaactctgagggggagtcagggctagattataaaaggtcttgatcatggtcagaagttgtgattttattttatgcacagtgaaaagcaactggaaggtgttagggacaggaatgacaaaattctggcctctgggcagaggaaggtttatagaggatggtcaagaggaaaagaattcagtaaactagtttttacattagtttgtatgaggaggacaaaagataataagtagataaatagcagtgaaaaatggagagaaactgatggatttgggatagattttgaaggtggaatcagaaggacttgctaatggattacatgtaataagtgagggaaagagaggaattaagcttgagcaacttggtgccatgttctaatttggaggaagactaagaaagggataggtatcaagaggtctctttttaccatgtaaggtttggccagaaatgtagcttagttgtttgtatatgagttaagaacgcatgtttctcttctagcttattgtatttactctacttttggtctcctt

SEQ ID NO: 46906 - DNA, 1867 bp, Homo sapiens
acatatttgatatgaagtacaaggaataatgttagcatctgtgcaatatgaaacaattaggtgaacattgtgaataataatggggagaagtggtatctgtgcttattacacatttcccctagaaaatactgtgaaaagtatggtttgctgtattttagatactccataattaccatgtggatgtgagttgttatggtaactgggtttctccccttctattaaataacagaataaatggttgcttgagatgtgactgaattgtcagcttaattgtcagctttcaagctaatgttaccctgattggaaacagtggagaggtaggagagaaggagggaaagagggaaggaaggagaaaaggttggggagagaatgttaaatttccagaaaacacctaggaagagatgagtgtcattttactttaaaaagtgtcctcccttctcttcttctcactatctgtcagaggacaggtctaacaaaaaattattttgccccaacaagattactgttgatggaatactgaagcccattatttcttgtatataaacaataggatattgagtggcttttggggtctctaataccagttgcaaatggtttttttttctgggaatgtggaaacaatgtgtgtgtgtgtgtgtgtgtgtgtgtgtgtgtgtgtgtgtctcataaagctaaatgtagtggttcagtatgcatatgtgtgtctgggtagcagttgaagttaaatacatttattttgataataacatttacatgtggcaaacatgaaaaatgcctttgtaagattggggttttaaaattaacagcaaatacttagtttacttgtcaatttttacatgctactcttccaatcccattctagttcgacaatcaaagaatgccatcaaagtttgttacctgatttatagtatttaatgaagggctgttataatgagtattttcttgtagatggaataagcatatttgttaagatcactcaagaggtggaatgcaataacaaatttttgaacaaagtattctgaactgtaaattaactaactagatggatatgtagtcccttgtagtaaaacatgtatgaggaaacatgattaccttttcattttctctcccatcattcccctacaattgcgaattatgtttctaagcagaacatttcctgttgtgatagtatttcaaatatacttaattaaagcttacatcatacagatttaaaagtttacagaatttcaatatataaaaattataatatctgctttaaaattttactgtgtcattcaatatgtttttatctggaattaaacctttcctggctagaacattttagacttgcttttgtaaaatctgcaaaactgtcttctcaacaactctgtgcctatttaaaaaaagttttaaattttgtgtttccagaatgatcacaacttgaacaccataattttctacaaatacttgcttatgatagtatgattttcacacgataggaatttgtcttaaagaggatgctacatatttagttctgttaaactccgcaggtccttaattgaacacttatgtgcaagacactgttatgggtaccatgggagggattccagcatgaatagaacatgacctctgctccttaggattgtatgagattaagatctaaagacagaatctgtggagtgttgtgggagaggcacatatatactggaagtatggagatgagaaaaattatttcagtaagtagaaatgagaggaaaatcggtcattcaaggaagaggaagcagtgagtgcaaaggtcctgtgaagtataagacaagcttgggaatcggttcgtaatttgatgcagccagaatgtaggttatataaaagagaggagcaagacatcagg

SEQ ID NO: 46907 - DNA, 1080 bp, Homo sapiens
tgtggagattttctttgtgaaagcttgaagatattatcttctccctgctaaattccagtaaaataatgttgtcaattttgtgcgtgtgacttttgttttaaggcatgggggaaggtgccagaaccacttggtgacaatggcattatgatctattttccatgaatctccatgaggatattcattgactcagtgagttagacaaatttccttattgataaaacactctcttggaactgctatacacatttaaataataagcataacattgaatattagctaaatcagattcattaatggtgtctatcatttccttatgctttgttctcttgaatgcaagtgaaagttgtgattccaaatagcttcagccaaagattagttcacaaactaagaaatttaagagtagatctcatctgacacagctgcatccagtgaatcaagtgatgccgtcaggctttgttcctctcagaatcattcctcatagctggcaagatgtctgccagtgacctcaaagggaaagaaaggtgtctgcccacagatacagcagaagcaacatgaggaggactctggttcagactggatgcctaggcccagggaggtcggtcacatgtgagtctctgagcaagtatctgggcccagggaggtggggaatgctaactgtccaggcctgggtcatatgtccactcctaagtctctggatagagaggtgtcaaggcagacccacccaaaccacctgaactgggtttcctccagaagaaagatgatggggtgctgggctggcaaaaaaatgacagatatctcccctgaagatcaattttttaaataagtacaaatctctttcttaatcggggtgactactggactaaagtaaatgcaggtttgtgacgatattctcaagggttgcattttattcaatggcttgagactcagccagcatttaaatttggtctatttgctaatgactctcctcacagccagtatctgggctctgtgtttagccaatcatataaacgtactgatgcatacgtatatgggatcactggaagaaaaattatgccactgaaataatgtacctttgtgtct

SEQ ID NO: 46908 - DNA, 1043 bp, Homo sapiens
gagatggtttctccctccaccatgtgaacatatagcaagaaggcattcatctgcaaaccatgaagaagaatcagctagcaccttggaacctcatcaggaacttaattgtctagcacctttatcttggacttccctgcctccagaactgtgagaaatatatttgttgtctaagccacccagtttatggtattttgttatagcagccaagctaagacagcaattagtaccaagaagtgtggtgatgctataaccaatatataaagatgtggaagcagctttgacgttaggtaacagatagaagctggaagagttttgaggtactagagtacctggaagagtactggaagagttttgaggtactagtttttttgctagaaaaagccagtattgccatgaagggattgatagaggtgattttggtgagggctcaaagagaagagggtgggagagaaagcctccatcttcatagagaacacgtaaatcaccatgaagataatgttggtagacatggacaataaaggccattctgatgaagtctcaaatgaaaatgaggaacctgttatgggaaactggaagaaaggtgatctttgttataatatgccaaagaacttggatgattgtgttcatgttctagtgttttgtggaaagtaaaattgtgagccatgaaattagatattgaactgaagagatctccaaccagtgttgaaggagtgcctcggtttatcttgactgcttaaagtaaaatgtgacaaaaaatgaagacagaattcttaacaaaaacggaaccagaacttaaaagatgtgggaaattatcagtctgtctgcattacaaaaagataagaaaacacgtttggtagagaacactaagagtgtagcagacaagtcatccaattagatttatgtgggtgtgaaccacagacctaatcagccaccccagcaggaacactgctagtttgtattgaaaggaatggagatgggacagaatgagggaagactgttggacttcttgaatttgggaccatagagctattcagctgtgaatg

SEQ ID NO: 46909 - DNA, 1013 bp, Homo sapiens
aatgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcaaggatctagaactagaaataccatttgacccagccatcccattactgggtatatacccaaaggactataaatcatgctgctataaagacacatgcacacgtatgtttattgcggcactattcacaatagcaaagacttggaaccaacccaaatgcccatcaatgatagactggattaagaaaatgtggcacatatacaccaccgaatactatgcagccataaaaaatgatgagttcatgtcctttgtagggacatggatgaagctggaaaccatcattctgagcaaactatcgcaaggacagaaaaacaaacaccacatgttctccctcacaggtgggaactgaacaatgagaacacttggacacaggaaggggaatatcacacacaggggcctgttgtggggtggggggaggggggaggaatagcattaggagatatacctaatataaatgacgagttaatgggtgcagcacaccaacatggcacatgtatacatatgtaacaaacctgcacactgtacacaggtaccctagaacttaaagtataatttaaaaaattaaaaaataaatgcacaagaaacagaaacacagcacaaaaacaaacctatcccctgtggacacaccaccactacttgatatgtgtaatgccaattgctcaactagctaatcagttcctactgttggttggaattatttctcttgatattgtggaggaccagttccccccaagaagaattcagttgtcacttaacaatcttttttttttttttttttgagacggagtcttgctccgtcacccaggctggagtgcagtggcctgatctctgctcactgtaatctctgcctccagggttca

SEQ ID NO: 46910 - DNA, 1019 bp, Homo sapiens
actaccatacttgcctacttttaggtttgattttctaccttgagttggttaaaatacctctctatgctgacttgtaattcagacagtcagaagtaaatgtgatgtagtccaaaaaggtgccctacgttttggttacttatagaatatagaaggccttcaaatgtttgttgatttttatggaaggctttgaaatatttgttgattgatgttcagtaattttcagatttcaaaaaaataactagggcttggcaggaatggagaagagcatatgaataaatgaatttgcttagaatcttatttctaataaaaattaccaaatacaataatcttctctgtctttttctctcttagattggaataattggtggaacaggcctggatgatccagaaattttagaaggaagaactgaaaaatatgtggatactccatttggcaaggttaatatccaacttgtggagacatgttttttagttttttcatttctccttgctggcttgatttttgaattaaaaaaaaaaaaaagaattgcttttgttttggcagcccagggctgtctgctcccagcagagagggccagaagttctgctgttgggttccatcagctgagaaggtgtctgatgggcgcctcacactttgatgttttgagaaaatggctacttagtatgtaaatcacttctcattctgttgctggaaatcagatactcatttcagaccacagactcatttcagactgtacttttcaaatctacattcaaatcttctaatttgtggccaataggtcacaccacactaattaggggacaggctgatgactaataggatgaattattgttacgaagcggcatttgagtggaaagaattgttttggggaattagaacatacctgatgttagttgaatgtgtaactgagctagaaataaaatgctcctccttttataggagaggttgcttgttctccaagcccatgtcactcagcctaggccggggtgagggtgtctgcattctcctaattccatat

SEQ ID NO: 46911 - DNA, 1041 bp, Homo sapiens
cttttgttgccattgcttttggtgttttagtcatgaagtccttccccatgcctatgtcctgaatggtattgcctaggttttcttctagggtttttatggttttaggtctaacatttaagtctttaatctatcttgaattaatttttgtataaggtgtaaagaaaggatccagtttcagctttctacacatggctagccagttttcccagcaccatttatgaaatagggaatcctttccccatttcttgtttttgtcaggtttgtcacagatcagatgcttgtagatgtgtggtattatttctgagggctctgttctgttccattggtctatatctgttttggtaccagtaccacgctgttttggtgactgtagccttgtagtgtagtttgaagtcaggtagtgagatgcctccagctttgttcttttggcttaggattgtcttggcaatgttcatggttccatatgaactttaaagtagtttttcccaattctgtgaagaaagccattggtagcttgatggggatggcactgaatctataaattacctatggccattttcatgatattgattctacctatccatgagcatggaatgttcttccatttgtttgtatcctcttttatttcattgagcagtggtttgtagttctccttgaagaggtccttcacaacccttgtaagttggattcctaggtattttattctctttgaagcaattgtgaatgtgagttcactcaagatttggctctctgtttgtctgttattggtgtataagaatgcttgtgatttttgcacattgattttgtgtcctgagactttgctgaagttgcttttcatcttaaggagattttgggctgagacgatggggttttctaaatatacagtcatgtcatctgcaaacaaggacaatttgattactcttttcctaattgaataccctttacatctttctcctgcctgattgccctggccagaacttccagcactgtgttgaataggagtggtgagagagggcatccctgtcttgtgccagttttcaa

SEQ ID NO: 46912 - DNA, 1028 bp, Homo sapiens
agttggaaaagcacagtattagggtggcagtgacccgattttccaggtgccgtctgtcaccccttccctttgctaggaaagggaattccttgaccccttacgcttcctaggtgaggcgatgcctcaccctgctttggctcacactcgatgggctgcacccgctctccggcacccactgtccgacaagccccagtgagatgaacccggtacctaagttggaaatacagaaatcacctgtcttctgcattgctcatgctgggagctgtagactggagctgttcctattaggccatcttggaaccgcctctcccacattttctttatctgttcatctgttgatggacgtttatgttgcttccatatcttggctattgtgaataatgctgcagggaccatggaagtgctgatgtctttcttgacgtaaaatttcatttccttatacactctgagatgggattcttggatcatgtggtagttgatattttcagttttttggggaattttagtaatggctgtattaatttatattcctaccagcagtatacaagggttctgtttttgtcacatcctcatcaacacttactttgttttgtcattttgataatggccattgtggcctggcacagtggttcacgcctgtaatcctagcactttgagaggttgaagcaagaggattgcttgagcccagaagtttgagaccagcttgggcaacatagtgagaccttgtctctgtaaaaaataaaacaaaaattagccatgtgtgttgatatacagccattgtcccagatacttaagagactgaggtgggagaatcgcttgagcctgggaggtcaaggctagaatgattcatgaatgcaccactacactccagcctgggtgacagcaaaaaagccattcaggtgtgaggtgatatcttattgtggtttttatttgcattttcttgatgattagtgatgttgagcatttttcatacagctgttgtccatttatgtgtcttcttttgaggaatgtctattcaagtcctttgc

SEQ ID NO: 46913 - DNA, 1055 bp, Homo sapiens
tcttcaactccatctggaattgctttggggttaacttagcatttcccctaaagcgcatatgacagtgggttgggaggagctcggatggggtttttgttcctccagagcgctgaggccttatttctgagtgaggtggccttggtgccagctaatgccactgtttagtgtgtgatgaactagaagtaacaggttaattttggccagtagacttgccagctgtgtaaacggaaccagtgaaactatttctcagtgctgcctcccacccctggaagaggacatcatgttatctacctgcccctgttggcttcccttgacccatctctcccatgctgtcccctcctccctgtgttactcatcagttcaaatttagaataattgaatgcacagagaaagtggcttgttctgaaaacttctgacaagaaatttccaggtgacttggtgctagattaattttagcctctcttatggattcaaaactgttttgtcagaagacttgaactaagacactttagaattaattacggctgggaaaaagaacaatctaaatgaggcagcgaacaaagattcctaaatatggagcaagacaagtggctctttatttcagtgggtcactggcatgaaaaaatatagttggggttacaggcaggaattactcttagagacatgggaattaaatgcaaggtaagtaccttgtttggaccctgaaactaacaaagcaactgtttaaaaacaaatttttttaagacattggggaaatttgcatctgctctgagtcaaagcctgggatttgtgtttgtgaaaaagctaatagaggaagcaagttggacacaatttaagaaattgttgaatctgggtgatgtgtatatggtgttaagtatatgattttccacgtctgtgatgatgaaacatttttgtattgacttcttaagtgtcttacctggcctttctgagcccacagttgagttgcacctgcaatccaaagtggttaccccgtcacggctgccagaccacagacactttaattcttgttgtgcggtgtgttgctgccagcccag

SEQ ID NO: 46914 - DNA, 1051 bp, Homo sapiens
tctttaggcaaaagctagcatgatgaatagaacagtacctcacatcccaatactgatgtcgaatgtaaatgacctaaatgccccacttaagaaaagatacgcaatggcagaatggataaaaatctaccaactaagtatctgcagtcttcaggagaatcacctagcacacatgaactcacaaaaacttaaggtaaaagggtggaaaaagatattccatgcaaatggaaaccaaaagcaattaggaggagctagttttatatcagaaaagaacagactttaaaacaacaacagttaaagcaaagagggacattatataatgataaaaggagtagtccaacaggaaagtatcacatttctaaatatatatgcacttaacacttgagctcccaaatatatcaaacaattactaataggcctaagaaatgacatagatggtaacacaataatagtggggcacttaagtactccactgacggcactagacaggtcctcaagacagaaagtcaacaaggaaacaatggacttaaactataacctagaacaaatggacttaacaaatatatatacccaacaactgcagaatatacattcttttcatcagcacatggaacattctccaaaatagaacatatgccacaaaacaagtctcaacaaatttgaaaatcaaaattatatcaagtactctctcagatcaaagtggaataaaattggaaattaactccaagaagaatcctcaaaactatacaaatacttggaaatgaaataatctgctcctgaatgatctttaggtcaacagtaaagtcaagatggaaattaaaatattctttgagctgaatgattatagtgacacaacttatcaaaacctctgggatacagaaaaagtggtgctaatgggaaagttcatagcattaaattcctacatcaaaaagtctgaaggaggacaaatcaacaatctaaggtcacacttcaaggaactagaaaaacaagaacaaagcaaacccaaacctagcagaagaaaagaaacagcagagatcagagcagaactaaatga

SEQ ID NO: 46915 - DNA, 1060 bp, Homo sapiens
tgaatatcactgcctcctttcttcctttcagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatttaatcaaatagtaaagttgttgtaaaaataaaagtggatttagaaagatccagttcttgaaaacactgtttctggtaatgaagcagaatttaagttggtaatatta

SEQ ID NO: 46916 - DNA, 1030 bp, Homo sapiens
ggtggtgggcacctgtagtcccagctactcaggaggctgaggcaggagaatggtgtgaacctgggaggtggagcttgcagtgagcagagcttgcagtgagacgagcttgtgccactgcactccagcctgggcaacagagtaagactcagtctcaaaaaaaaaaaaaagagtgaaatgctttttgtttgcttcagttttttatcatggggagatctttttcctcagaattgttttcttttcactgtaggctattacaggatacttcaggatcaagatacagaaccttttatttaaagagtttgtaaagtcaatgtgtttgtttgtgtctctgagattgacttcaagataataagctgctaattgtaaacaaaacagttaccctccagtattaatatgactcattagtgtgagccatttgggtcaagtatgattatgacccttggacttcctgatgtagtattaaatttcaactctggttatccattagcaatctgtagagaacttaatgaacctgaacccaggcttctctagctctggtaacgtgtgattgttttcactacaatatgatacatagatggtaccttacttttcctcattcttaataggtgtctaagaatgtcagggcaaaagtatgggcatttttcttgctatgttcagaaagtacagttctctccaacttgcagaggtacttttcttgattaaatagccttctctagcaacatcattttcagactaactaaatgaatgcagtatactcttttctttgttctcaatcattcactccttatgcaaagccaatataattttcctcataccttatgcttgaggatattgttgaagaacacttcctggaacacttctcacttgtgatgctgtactaattttttttttttaatttaagctagtatactaagtgaacaccatggtcagttgtgagcattttggtttccgcaaaggatggatggtgagcatcatgggaaagctgtagtttagtgacttagcccttagtgattaatagatttgcatgtac

SEQ ID NO: 46917 - DNA, 1052 bp, Homo sapiens
ttccatccttctagttcctcagactaaaaacttgaagtccttgactcttctcttcaaaacccacattaaaaccaggaaaaatttatttaccatccaaatatgtcaagatactgactattcctcattacagctactgcttccaacctagtctgagccactctcatctcacctggatactgtaataacccctaacaggtcctgtgtctacttttgttccctagagcaagcaacccaggaggcagaatgatctgtacaaaatgctatttcacttgtattaaaatcccacatttatgatagcctatgaatccccatgtgatttgcacttgccctcctatctctctgacttcctctcactactgtcctcttgctcactctgctccagcccttttccaagaacacaccaggccccctcctgcctttaacattagagtatttggtttgtgttccttctacctggaacactctcccagcagataaccacctggcctcactacagcagctccttcagatctttgctccaaaatcaccttagtgggtcaaccccaaacatcgtattttaacagatgataatgcccttcactccatgcccaaagtactcctaaggactcttacaagcacagcttttttgtttttcccatagctcttaacttctccctacttactctagtatttgtatatatttgtttattgttttgtaactcccaacacacacacttcctccaaaatgtacaacctctgtgacagcaggaaacttgtcatttactgatatcctaaatgaccagactagtgcttgggatttagtaggcttccagccaatactatcttgaatgtacagcttcccaatacatatggcttgcaaagccgtgtatgttctgacttactccagcctctttctcacctcccacacctcatggcactctaaatcagtgctgtctgatagaaatatgtgagccaatatgtaattttaaattttctaggagccacatttacaaagtaaaaaacagttgaaattatttataatatattttaatataatatatccaaaatgttat

SEQ ID NO: 46918 - DNA, 1118 bp, Homo sapiens
gaatgatggtttccagcttcatccatgtccctgcaaaggacatgaactcatccttttttatggctgcatggtattccatggtgtatatgtgccacattttctttatccagtctgtcattggatgggcatttgggctggttccaagtctttactcttgtgaatagtgccgcaataaacatagtgtgcatgtgtctttatagtagaatgatttataatcctttgggtatatgcccagtaatgggattgctgggtcaaatggtatttctagttctagatccttgaggaatcaccacactgtattgtttcctgactttttaatgatcgccattctaactggtgtgagatggtatctcatggtggttttgattagcatttctctaatgaccagtgatgttgagctttttttcatgtttgttgactgcataaatgtcttcttttgagaagtgtctgttcatatccttcgcccactttttgatggggtggtttgtttcttctaaatttgtttaagttccttgtagattctggatattagccctttgtcaggtgggtagattgcaaaaattggttattttctctgctcctcaccctcctcccacccttaaccctcaagttggccccagtgtcttctttgtgtctgtgagttcttatcatctagctcccacttataagtgaaaacgtgtggtatttggttttctgtttctgtgttactttactaaggataatggcatccagctccatctatgttccaacaaaagatatggtctccttcttttcagtggctgcatagtattccatggtacatatgtaccacattttctttgtccagtctgtcattggtgggcatttaggttgattccatgtctttgctgttgtgagtagtgctgtatgtgtctttatggtagattgatgtatgttcctctgggtatatacctagtaatgagattgctgggtcaaatggtagttctatttttagctctttgaggaatccccacaccgcttcccacaatggttaaactaatttccactcccaccagtatcagtgttcccttttctccacaacctcgtcagcatctgttatttttttactttttaataatagccattctgactgctgtgaa

SEQ ID NO: 46919 - DNA, 1094 bp, Homo sapiens
ggtgtttagtgccataaactgtcctgttaatgctgttttgtgtgttccagaaattttagcaagttgtatctctgttctcattagtttcaaggaacttcttgatttctgccttaatttcattatttacccaaaagtcattcaggagcaggttgtttaatttctatgtaattgcatggttttgagcaatttttaaaatcttgacttatatttttattgcgctatagtcctagagtatgtttcatattattttggttcttccgcatttgctgaggattgttttatgtccaattatgtggtcaattttagagtatttgccatgtggcagtgagaagaatgtatattctcttgggttagggtggagagttctgtagaggtctattagatccatttggtccaatgttgagttcaggtcctgaatatgtttgttaattttcttccttgatgttctaatactgtcagtggagtgctgaagtctctcgctagtattgtgtgggagtctaagtttatttgttggtctctaagaacttgctttatgaatctaggtgctcctgtgttgggtgcatatatatttagtatatttaggcttcttgttgaattgaaccctttaccattatataatgcccttctttatctttttctatctttattggtttaaagtctgttttgtctgaaattaggattgcaacccctgcttttttctgatttccatttgcttggtatattttccgccatccctttattttgagcttatgggtgtcattacatgtgagatggatctcttgaagacagcatgccactgaatcttgttttttttatccagcttgccactctgtgccttttaagtggggcatttagcttgtttacattcaaggttagtatcaatatgtgtggatttgatcctgtcattgtgttgttaactggttactatgctggcttgtgtgactgctttatagtgtcattggtacttaaatgtgtttttgtaatggtctttcttttctaaatatagtgctcctttcaagatctcttacaaggcagatctgttggtaacaaactccctcaacatttgcttatctgtaaagtatcttatttctcct

SEQ ID NO: 46920 - DNA, 1105 bp, Homo sapiens
tgctaaatgctgacattaaaattgccaatccaattacctccacctggtcctgcccttgacacatggggatcatggggattacaattcaaggtgaggtttgggtgggaacacagatccaaaccatatcagcactggtacaaaaacaaaaacacaaataatctcaaataaacaatctaacattataccaagaggatgtagaaaaacaagagcaaaccaacccaaaagatagaaggagaaaagaaataaccaaaatcagaacttaacaaagttaatgtgcaaaatacatacaattgttttcaaacatcaatgaaaccaaacgttggttttctgaaaaaataaataagattgaaagagtgcttgctagacttacaaaaaaagagagaagatctaaataaagacaatcggaaatgaccaaagggacattaccatcaaccccacagaaatataaaaaaccctcaaagactaaatgaacacttctgtgcacataaactagaaaacctagaaggaatggataaattctgggaaacgtacaacctctcaagattaaacctggaaaaaattgaaaccctgaacagaccattaatgagttccaaaattgaatcagtaacaaaaacctgtcaaacagaaaaagccttagattagatggattcacagctgaattctaccatatgtaaaaaacaaaaggtattaccaatcctactgaaactattcaaaaaaaaaaaaatcaaaggaggagggactcctctctaacttattctataaggctagcatcattctgatacacacacacacacacacacacacacagaaattctggccaacattcctggtgaacatgtatacaaaaatactcaacaaaatgctagcaaacgaaatccagcattgtatcaaaaagctaatccaccatgatcaagtagcctttattcttgttctgcaaggttggttcaatgtacacaaatcaataaatatgatttgtcacaaaagcaaagcaaaaaacaaataccacattatcatttcaataaatgcagaaaagacttttgataaaattcaacatcctttcatgttaaaaaaaaaaaaaaaaaaactaggtattgaagtagcatac

SEQ ID NO: 46921 - DNA, 1094 bp, Homo sapiens
gcatctacaagccaagaaatccctgatgtcactgacactagatgtaccagatctagaaaagaagaacctacatcgctcctggatccttcgtagagagcaaggcactgctaacacctttattttggacttctatcctccagaactgtgaaagaaaaaaaaatctgttgctaaaagtcccccaacttgcagtactttgttacggcagcccgaggaaatgaatacggaggatattgttgttatttaggtgagaaatagagttggcccagactagtgtgatagaagtcaaggtgaagaaaaaaggtcagaatctagaattattttgaaagtagagctataagatttaccaaaggattgaatgtaggttttgagggaataataaaggaaccaagaataatccaagacttttaatctaaactattggaaagatgttgccataaactgaatgaggaaggctttgggtggagcagcactcaggggaaatacaaagagtccagttgttaacttttagaagcctatttaatacccaagtggagatgtcaggtaggcagttgtacataaaagtcttgaattctggagagaggtctcagctaaagatataaatttctgagtggtccacataacagaggcattttcagccattagatggcacaaggttgaaagagatcactaaggaatgcagagcagagacgaaagcaaggcctaccctgggtactgcaatgttagtaggtcaaggaaaagagaagaaatcagcaaaggagactagaagggagcaactggtgaggaaaaaggaagactaagaaattgtgatgcttgtcactaatcatcagggaaatgcaaattaaaccacaaagagttaccagcttactcctgcaggaatggccataattaaaaagtcaaaaagcaatagatgttggcatggatgtggtgcaaagggaacatctttacattgctagtgggaatgtaaattagtaccaccactatagaaagtaatatgcagattccttaaagaactaaaagtagaactaccattcaatccagtaatcccactactgagtatctacccaaaggaaaagaagtcatataaaaaagacaca

SEQ ID NO: 46922 - DNA, 1102 bp, Homo sapiens
ctggaagacaaactgccgcagtgggacagatgggaaaaatccctacatggcttgccctttctgtcacaaactcaaccactggaaatggaactgccctgagggctgaagggcccctagaacagaatcccaattcctgatggccttaagctgaaaaggcccgccactccagcagctcctggactgaacattactattgaagggacagagctaagggctgctttggatgtggcaggtaggactataagttttctttgggaaatggccttcttggtgcttatgtcttcatgggcaattatcctccaaggtgatggggttaaattgggtgcccataacccaaaggttcactcctcatctttgctgcctgtgaggggagactgtcttttctcattcatttttaatgatagcagaatgtcctacactgcttttgggtagagatattttatttagactaggggcttagttaaccttttccaaatgcaatcttatgcctcaaggaagtcacacacaaggatgaacttcccagacttttccattaatccagaagtctggggctcaagaatatcaggaaaggtcataatgataatgcctatagtaactcagctcatggatccttctagctaaccttgtagaaggcagcttcctctttgacctctggccaaaagggacttcatcccctaattgaaaaatgtctaaaacatggattattaatatactataactcgctatgtaacacccctgtcttacctgttaaaaagagcaatggagcaatggacaatataggctagtccaggacctgcaaatcataaatgaggcagtagtcccaatacacccaatggtccccaacccatatattattctaggagaagtacccccagatgctcatttgttctcagtcttagagctcaaagatgctttcttttgtgtctccctagactcatcctcccaatttgtatttgcacttgaattggggaatgaaaaaggaaggagtctacagctaatctggatagtacttccgcaaggttccagagatggttccaatttgtttgggcaagtcttggctagagatttgcaggacctaactcttgagggttgagggtgtctc

SEQ ID NO: 46923 - DNA, 1115 bp, Homo sapiens
agacaatgtaactagttgttgcaataaagcatggtggggaaaggagaaaaggcacgtattaaacatcttttgaagtcgctatctatatcagtcagttctccagggaaacagaacccattgtgtgtgtgtgcgtgccagtaccacacatatgtatatgtatatacacaccgtcatggggttgcttaacaacagggatacattctcagacatgtatctttaggcgatttcattgttgtgcaaacatcatatacaaacctaggtggtatagtctattatacatctaggctgtatggtatgggctattgctcctaggctgcaaacctttacaacatgttactatactgaatactgtagataattgtaacaaaatgtagttttatatctaaacacatctaaacatagaaaaggtagtatgttgtgctacaactttaggacagctatgacatcactaggggataggaatttttcacatccattataatcttatgggacaccaccaatatgtgactgtggttgactgaagcatcgttatccagcacatgactctgtgtgtgtatacaattttatatatacgtacattatatgtctacacacacatatgtgggggagagaaagagagggagggagagagagagagagagagagagaaagagaaagagagaaaatacttattttaaggaattgtctcagaaaatggtgggggttgacaaattggagacccagggaagagttgttgttgcaagacttgaatccaaaggcaatctggaagcagaatttcttcttccttgagggacctcagtcatttctcttaagctcttcaactgcttggatgaggaccacccatattattgaggataatctgctttttcaagtctactgacttaaatgttaatcatatctaaaaaatacctccacagcaatatttagactggtgtttgactcaaacactgggtaccacagcctagccaagttgacataccaaattaactgtcacattatcccgtcatgcctgaggggttctctgaccctcagttttctgaggatcaaatttaaattgagggatctatctttgtttattggagccatatagctcaaagtataatcattttctctcc

SEQ ID NO: 46924 - DNA, 1083 bp, Homo sapiens
tttgaaagtttaccatgagcaagaattattaaataacaaccacaggaatattggggctcaaacctagagattctaattttgtagacctggagctgatcaacaagtctaaatgttaaaacatcctcacgggtgattctgacatggagccaggattgagaaacaattttctgaaatggaaggggttttaaacttgttgtcctcaaatgactactgaggcaaacaccattcttatagacataagacatacttgggagcaaatgtataataaagtggtatgcttccctagaaaggggacgaccttaaatctttctgtttatggtggtatttaaacatattaaaaactactaattttggaatagtcttactgtgataagtctaactatcaaaggcagtccagagattagcaaataatagaggatgatcaaatgtttttcagaaaatattataggtggcactttggcaggagattctgagaatggtgagagggtgcctctgtgccctaggaaaggtgatagagcttagaaactcagaactcagatggaatgaggagccatgccatatacatctttacaacagtcaccctctagaagaaaactctgtgttgacaataatctgctgacttgtctgtgggtttttgaacagaataaactgtttcttcttttatgtttgtgtattattgcttataaatatattctaaaatatataataacaaacaataacagtacttgcagcttaattaaagaaaaaatgcaagtatcttatttatactaagagaagagagaaacccgaagaacaatggattatccttacatatttggtttgggattacattgagagctacctaaataccagacactcattcttggtcctgactcctactctgttatccatagctcagtacctagtatctggcgcagaaagaagtggaatggaattatcagggagacccagtttttagccaagactaaaaggttttagccaaggggatggaagaatttgtgcatagatagacggcagatgggaattcgtttaaaatggaatggagacccagaggtcacataagacagggttcagaggaagtag

SEQ ID NO: 46925 - DNA, 1029 bp, Homo sapiens
aggggtaattatagaatcagcaaaaagaaaaaaaaaccctactgactattacatatcaatgcacacagtgtgttaatattttcaaaaaagggagggcaatctcagtgtaagtgtaaatgaaattagtttttgtatatatttgctgaagatcagttacctagcttcatatgataaattatttggtgctggtcacaatattgtgcttgccatattagggaaataaaatatcatgaaagtattcctaagtatacattttcccagaggcgtttggggttttatcagtctcgagctctcctcttgaaactgtttcattccttagttatgaaattactaattttaaccatttaaggcataggaaattttacatagattttgctttaacagcaaaacaccctttaaaaaattcatccacttaggtgaaaaataaaagataaaaatgaagccaaatgaatgttattaaatttataaatttatttaactttccagatcttcttggaataaatgtcaggtagtagaatttgtacaaaccttggtaatgtcttaggtttagatacgaacttaacaggtatatttaattttctgtattccacaatggagctagaagcaggactcatgaaaatagtaactatatgttttgcatgtatccttcaaagtgaaatccttaacaaatttaacagtatatattaggctgctgatgaaacagctaaacctgtctgccaggtggcttcgaaaatggaattaatttttacatggcattgataagttactatttcaatacaaccaggtggtaattgatacccaataatgtttgaggtttgctttaaataaaaaaaactaacaaaacaaacaaaaaaaacagtgtaatatagtactgtgggatccacaataacattttctttagtttcccttaatatcaggttgtcattaggaaagattccacaagttatttaaaccagaaatgaagtaacatgtttcatatctatttcaagggataatttttcatgacccagtataatgcaactagcaaat

SEQ ID NO: 46926 - DNA, 1057 bp, Homo sapiens
cctggattgcttctgggaaaaagcgcctagcgcggacgcagccgagctcaaagccgctctggccgcagggtgcggacgcgtcgcggagtcctcactgccccgcctcgctctggcagagtggggagccagccggcaaagaattccgttttcagctgggccaaggggccggcgtctccccacccccttaggctccgccccctgtccgctgtgatcgccgggaggccaggcccgggccgacgcgtcacgagggcggggaagcctgcccaaagatgctaggacgcatgcgccagagactgggccagggagccgccaggaatgctggctgcactgctcgctggatgtccagtaaagccaaggctaatattttgggaatgttcaccactgccctcagctcctaatccccagtaggcggagcagaggatttctgttccttcagccagccagttggtttcactgtggagacgttggtggctcccttgtgaccgagagaaagtcattcaaaataactccgtgtttcttaagatgtctgaaagcgacagctctgcacctgtcatacaagttaaattcatccccaggcagtacttgggcttcacaagtttcataacttgtatcaaacttagcaattttctcttggatgtgtctttctgtttgaattagtcaaccataaaaatagagaaaaatcccgagaatcatgttttgcgtgtgctttttaattctttccatttttgcattatggatacaacccttaaaagagaaaaaaactagttcgagattgagagtggcaacctggcacacataagacaaaaaaaaattatactttaagaatctgagatcccagtttcatcatatttgtacagtaaatctttgtttgcactcttacctatttaaacccactttgtcaggtatcttatttttatttatcatgagtaataaaggaaatttatgcagtaataatgaaacatcataagagaggggtgtggtgctgggcttgtcattaaacaggctgaacctgtcattaaattctcttctgaagatttaaatgccaagtgcttttttt

SEQ ID NO: 46927 - DNA, 1066 bp, Homo sapiens
tccacttctatattcccatgtatttttcaagattaattaaatggtggacttgttcatcattttagtatccgtattagtttgctagggctgccataacagaataccacagactgagtagcttaaacaacaaatatttattttctcagagttttaacttctcctgaggcttctcttcttgacttgcacatggccatcctactgctgcctcttcacatagtcatccctctgtgcacacgtgcccctggatctcttgtgtgtgtccaaatttcctcctcttttgaggacaccagtcagattggattagggcccaccccaatggccttattttaacttagtcacttctttaagggctctatttccaaatacggtcaaattgtgaggtattgggcttaggactttaatataaaaatttagaggtgacagaatttaacccataacaacagcatcttaatttttacacattttacttttcatttctttttaaactgttattaataatttattcatttgaataaggattaaaataaggctaggatattgaaattggttgaaattgctacagtctcttgtatctctctctctctcttttttttcttataagggacaggtttcattcaccttgtcgaccaggctggagtgcaatactgtgagcaagggtcactgctgcctcgaattcctgggcttaagggatgctcctgcctcatcctccagagtagatgggactacaggtgttggccaccatgactggctaatatttttacttttttgaagagatgaagtcttgccatctggcccaggctggtcccgaactcctgggctcacacaattctttcacctcggccccccaaagtgctggattgcaagtgtgaaccactgcacctggcgtcttgtttcctcttaatctacagtttcccccttttgccttctttttttttctttcaatttatctattgcagaaattggctttatctgtagttttctaaagcttggattttgctgaatgcttctttataatgacacttaacatttttctttgtcatttgtatttctcataacttattattta

SEQ ID NO: 46928 - DNA, 1099 bp, Homo sapiens
gggctcctgtaatcccagctactcgggaggctgagggaggagaatcgcttgaacctgggaggcagaggttgcctgtgcactcgggccactgccgtccagcctgggtgacagcgcaagacttcatctaaaaacaaacaaagaaaaacataatccatgtatgtgatgtaaagagcgccaacatgtttatatcctcctatttcaatctacttttacttcatctacatttttagcaataatgtgaacatgaaatcttgaataattagctatctgtaatatatttactcatccactcaaaatattgagcccccccaataaatatcatacactatattctaggtacaggtgataaacaattcagagagtattaatttcaaaacatggtaagtgcatagtgagagagctgatctggtctggtggttgagggaatcaagagatatttgagttgaggtctgcagtattatagaaaattaactaatcaaaagagaggcagtcattccaaggaaggggatgtgagtcagaagaaactgcatgtggcaagctctgaggtgggacaaagcaaggacatattgaaggaattgtgactggagcatagggatggaggaaaacattgtagctagctgagaaataagcatggaaaaatgttgtagagctgtataggccatgttaggacttttgtctttatcttaaggataagccattgatgtgtttataaagacacatgatgtgatcagattttcagttaaatttaaaaaatacttggaatgcattttggagaatggtttaggggagaggcaagagtggattctgtgggccagtagttcagaggataggttatggtagcttggactaaagtgcctgagccaagatggagagaagtagattgctttaagacatatttaaagaataacatcagcacttagcaatgaactggagatggaagatgagggaagggaaggtgttaggcaggtttttacaatgagagaggttggtgatcatggtcaccaaggtagggaatgctggatgaggatgcagtttaaggtgaagattatgagttcaggttcagcaaaactgaacttgagacatggtgaactatcaaggt

SEQ ID NO: 46929 - DNA, 1472 bp, Homo sapiens
ggaggttttgtttattcatttttattcttttttctctattcttgtctgcttgtctaattttggaaaggtagtcttcaagcttggaaattctctccttcacttagtctattctgttattaatacttgtgattgcattatgaaattttgggggttgggagtggtggctcacacctgtaattccagcactttgggaggctgaggtgggtggatcatttgaggtcaggagtttgagaccagcctggataatgtggtgaaaccccacctctactaaaaataccaaaaaaaaaaatcatagctgggcatgggggaacatgcttataatctcagctactggggagactgaggcaggagaattgcttgaacctgggagatgaaggttgcagtgagctgagatcgtgccactgcactccagcctgggtgagttgagagtccgtatcaaaagcaaacctacacatttttgtggcctgtttttagctctatcaagtcagttacattcttctgtattctagcttttttatctgtaagctcctgcaatgctttattagaatttttagttcctttgcattttgttacaacatactcctataactctgcgaacttcattcctatccatattctgaattctgcttctatcatttcagccatctcagcctcagcctggtactgaacgcttgccagagaggtgatgtggtcctttggaggaaagaaggtactcttgattattgagttttcagtgttcttgtgctgattatttcttatctttgtgggctcatctaccttcaatctttgaggttgctgacatttggattattttttcttttatcctatttgatgaccttgagggtttgattgtgttataaggtcaattcaaccaactagctttgtatctggaagactttagggggccatcgttcacctcccaactcctggactgcatgttctaactctggatgacttgtattgggccccaactttgttctctggttcctcgaggtttggagtctactttgttggaggaccaaggtgtggcagctccagctgggtgctagcggattcaggggtgcctgcctccctgcaggcattcaccatgctagtgaaggcaaggcatttttgtggggaacaggaggctcctgctatagactgtctgtgcttttgcactggtgatggtgttggtttggtgagaggcactgaccagtgcagatctgagtgccttcttggtcacctgcaagcaggagggattgctcagggtgtgggaggatcctctgttctccatgcagcattaccacaagagtgaggcactggcagctgcagggcttgctggctgtgtgctgctaaggttctgtctgcaatggtggttgacagaggtcaaggggcatacttccctcctgtatgctagtggggcaactaaagcaaattccacctgtgcagacatgtgcctgcaaagtgatgtggggagttgccatgggctcagg

SEQ ID NO: 46930 - DNA, 1052 bp, Homo sapiens
cgaatgcctcctttgtagctggatgtctaacatcatgatagccacactcacatgaatacagagatacacaatttacaaattaatgtaacataaaactcccatgcagtctgatttcatcttactgacatttctgtcagtcagtgttagcatcttaattatataaatgtggaaactgaaatactcaagaggttccctgacttcccaggccacacagtaagctttggtgccagaatgtatctctaggctttctcatctcaacccagcattcattatactattgctcactgcgtgtagaatcagatttgatttctctgacttttcttagtcacttctgtggttttgtaccactccctctctcactaaataactgcctgcaaaagtaaaaatttccatgaaaacagaaaacaaatgtaccagaaatgttgatggtgtaagagataaaactgggataaagagaaaatgtgttggaaagtggtgtcctttaatgcaacagaaaagtatattgggagaaaaagaaaagagagaaaaatagacaatctgaagtgatgagaagagcaaatgctacagatgtacctgaacctcttcagtaggtgtgatcctgaagagttgtgtataacaacaatgaacaaaaataaaatgtactgtggaaattgtctagctgttgagatcctcctgtgcgatatttttcaaagtgaaaactccaatcaaccctagcttatttatggagaagactttgccccacagtacccagaaagtttcttgacaatatcatatatgcataataaccctgagacaatttttgtttaccaggaaaacatataaaagggaacattaaactttgtctagttctactgcataaacatgtgataatgtgcatggtgaccttctgttgtaaatggaaagagttaagctctctgaatctactgctgaaaggtgaaaacactttcttagggctttgaacttcatttgaaatcttactgaaaaaacactacagactctattttctttatatttgaagatactttacataaaaatctaaagcattttgactt

SEQ ID NO: 46931 - DNA, 1069 bp, Homo sapiens
cttgtatgagcaactaaatctacacaccacaaagccccatgctgtcattttttctcatcctgcccctttattttgatgattccacattgtagttcatgaaaccaataccttctagagtgtggctgaactggcgccagcattaagaaaaggagtttccaaactttttagttttgtgagaaaatgttagaggaagagggaggttaggttgactatttatacttatgtaatcttctgtgaatttgcagtagttatcaccttgtactctcaaaagttttctagctctgagtatgtgaatctgaaagtgcaggaagtaggaatcttagcacaaaacaaccagtttggattatcacacaattaatatgggacggagctggaggatggacctgaacagaatgtatattctttatcactaggttatttatctatctacagatgtctagaaagacctgggcttttttagcaaacgtttgagaatctaggtttctaagtttccattgaccatgaaagagtgattagttttagaagacagttgggggcaacattgtgcaagtcagaagaggggatgaagaaaatcataaagctaaacatgtttgccataggcccaggctgtttttcagcatgtttcacctagcagcttggcagataattcccagtgatcattaggtctgtggaaattctgtttggtttataaagttttggccctgactatgtgtaccactgataacttgtttttctctctcttcccttttcctccaactcgtagccagagctaccttccagatgacttctttctaccactttctttcttcccagtgtaagagaatgcaagtatatgctgatgtttggagcaagaacattcaaaaattttcttattaacataacttctaatggaaatacagtatactactatggtgcatacaaagaagaaatagcaacatatatttgttttagacctgattgctgtattttattccttaggtcctccttgatgtcttgtagaccgtcactagctaattgttacagccatcgaaggaaaaaataaggatttttacttaggacatacgtaaca

SEQ ID NO: 46932 - DNA, 1049 bp, Homo sapiens
tttttattttataagcctttttatttttatttattttactttatttgttgttgctggtgtttttttcttgagacagagtctcactctgtctcagctcactgtaacttctgcctcccgggttcaagcaattctcctgcctctgcctcccaaggagctgggattacaggcacctgccaccatgcctggctcacttttgtatttttagtagagatggggtttcaccatgttggccaggctggtctcgaactcctgacctcaagtgatctgcctgccttggcctcccaaagtgctgggatttacaggcatgagccaccacgcccagcctgcctgatttttaaaattattaaattcatatttgttatttatcagatgcctctgccactttattttttaaaaatttatttttattaaggtatagttaacaaataaaaattctatatatttattgtgtacagtggaatgttttgatatatgtatacattgtgaaatggttaaatcaaactaagatatctgtcatctcatatgcatgccatatttttgtggtgagaacatttatgatctactctcttagcaatttttaatattctgctgtttgacttttaaaccaaggcttggattaggacagtctttgtagcttagttttaggttcagggataacaaaagttgttttatcctttgggcttttgcaacttgccattttcttaatgaagatctgggagaaaaattagtttaagtggtttttaaaatagccattagctcaggacatactcagccaaggcaggataagtagttttgccagcattcttctgtaggtaggttggttgttttttgtttttttgccacagtctttttaaaaaatataactttaaaaaaaccttggttttctgtgattgatctttttcactattttttatagagggccaggaatatgagtaaataattcttgggcttgggtgcagatgatccacgtgctggcagacagaaatctaaagggacaaaagaggctgtcctttgaagatacttttcctggcttgggttttatatttttg

SEQ ID NO: 46933 - DNA, 1111 bp, Homo sapiens
ccaccacagtaagtattttcaaaggaaaacaaagtaaaatttttctcttgtatgagtcacatctctgttggttgtaagtggctgaaactcatcttgaactaccaaggtaagagaagaaacatactggttaatggaattccagaaaggactgaacaatcaaaccattttgaaggacagcatagagctggactctagaacagccaaaacaaggggttaaaccactgcgagggatctctctccaactcttgctcaggcttttctccctggcttgactttcttctctttcactgtagattggcttctctcacatggcaagaaacattgctgctagcacttcccgagttctacgttctacaacatccaccactggtgagagattaacttatggtttttctgttgaaaagtcaaaaattacctgggaaaagtctgattgtctcagattggagatgttgcccatctctggaccaatacactattatgtgtggctgactatataaaaacatggatattttcttggaatcacttggtttgactgggagaagaccattctcaaaacaaaggaagtgcaatttatagaaggtagtagaataggcagataaaacaataattcttcactatattgctcaaataatccccatgacatttttagtatattataaagagagttctaaagtgtttccaaactattatagcaaaatttaatcttataataatttcttcttgaactatgtataatttacctgaaatattttccaaaaagcaatcaatgtgagaaaatgagagccctgtcttcttaaaaaaatgagtaaaagtccacaagttcagaacaaaagaaaatgaggtaaggcctaaaataaattgtgctaagaaagctaaaattctagacaaagtcacatcggcaaaactagaaggttggtactgtgcttcagtttactgcttgctgtttggttaagaggaggggtgatgtgataaaaatagtgacgaagtgagaaaactgacgtattagttttctattgcattataacaagtcaccacaaacttagaggtttgaaataacgcccatgtattatctcgcagttcctgtgtgtcagacctccaggcactgcgtggc

SEQ ID NO: 46934 - DNA, 1042 bp, Homo sapiens
atgtcagtttattactcttgaacaagcaaaaaagttaattcctacattgtgattttggcaaagaatatctctttaagaatttagtcactaagtgtagaaatttgcatttttttagccttaagagaaagtaatagaagatatatattaaattatcttgtttaatcttcacaaatatatactgaagaaaataccattttttccctattttaaagttgaggaagttgataactgaatagattaggcaacttgacagaagttccatcataaataatggagccaggaatgaaactcagttgtctcattacaatattgaaaaagaagggagtgtaaaacctcaaataacatcagtagctaagggacatggtgtagttacactgatgattaatatcaataatgccattactaagtattacactagtcaatggataaaatattactgctgcatgatagcggcaaaagtgataaaactgtcaagagataagatattcaaagcaaaaagtcactcacgactctgtacctatgtttagaggctttctcacctttcacagtggatactgtatttattatttttaatttctttcctaaatttcagtatggtattattaattttaagctaaactaacattatttttgtaaagtacattttaacaattgtattggaggctgcaataaatttgtcaggtcattctaattgttcattttgcctcggagatgtactctgaagtatgtggaagcaactggtatcacaaaataagagtcatatacataatgaaatacaaacataatgaagtatcatattgttccattacagaaaaaaggagaaacttttatcttttgtgactggtgtaaggaaaatggacatttttcataaacaaaccctagtggtttttattattattattattattatttttttttttaaaagcccaggcctccctcagcctcccaagcagctgggactacaggtacacgccaccacaccaggctaatttttgtatattttatagagacaaggttttgctatattggccaggctggtctc

SEQ ID NO: 46935 - DNA, 1053 bp, Homo sapiens
atggtctccttggttttagttgcatttgaagtcagtgaaatggtgaagagtacttacaataattaaaaatacattaagtaattatataaagaaatgaaaaccattatcgggagatattagtctctttataaatatgttaaatctggcatttgtcggtaactaaggttaaaaggattgatggaagggttaaagaacactgaagaacttgacagtcattatgcaataggtgtagcttgtatgccagtttgagctttcgtttttggtgggaaggaacactgtagggaaaactggagttttcgtgtgggcaagaacttgtgaaatcaggttttcttttattgaataattccatctgtattcatcgtctggggaaatctatgtaaaagttggtcaaagaaaggacatttctaatgtaattttggagacagtcttattctattaatattaataaattatagagagatgataaaagtagacttaaaatttagaaattaatacagaatttgggctgctgaataaatgatttataatgctagagaatgttgtatgagaaggtagagtaagaaatagcaaattgttttaattcaaattagcaaaagtattaaagatatttggttcattatgtaccaagagagttgatatatatgttaaaaaagaaataacacacaataaataatctacgacttcattagttttggccattattttttaatcttaggcacaagagagtattcacaatcatgttggaaggctgagactaagcacaacaaagagatttttttctctttaatattaccaaaattagaatgtaatctatcagttattaattgtagacaaagtgaattctgttttgaataataattatgtttccattcctggtactttagtattattcctaggagtttatttcttactttttttagacttttaaatttggactttctttttctgtgttttatttaacttttattcatgtctactgatctgatttaaggccatatggttttaaacagtcttccactttccaaatagttatttcttcaatttctatttctt

SEQ ID NO: 46936 - DNA, 1029 bp, Homo sapiens
ctctgcctcccgggttgacgccattctcctgcctcagcctcccaagtagctgggactacaggcgcccaccatcacgcccagctaatttttttgtatttttagtagagacggggtttcaccatgttagcaaggatggtctcgatctcctgacctcgtgatctgcccgcctcggcctcctaaagtgctgggattacaggcatgagccaccatgcccagcctgtttacttacttttatgacaccatcatcagtggttttactgccaagttataacaggagcaaagtactcaaagcatcaaaaagaccttacacctggacatcatatggcctttagaaagtcagttacttttcttatgctgtaatttctcctctgtaaaatggaatactttataacattagttctcatcttcctacattgaaagaagaaacactgttggtagtcagtaatcaaatttagaatgaattccttccaaaagattaattccactgggcttcagtatccttaatttatgaaaatagatactttcctttcaatttctttgagctcatatacctatacaaattgtagcagcaggaaacacatttgttttactgttgtaattgaagctccaagtgaagataccacttcttctccaacagtgaaacaaaaataaattgaaattccaggttgctttactatgttcatcttttatttggttattttgagattttttttggtagggaaatttctgagtttaggttgtttattctagtagtaggatatgaatgtgtagaaggtgtgtaggggatatgtggatccacaagcttagctggtgattgtgaaaactatagaagttggtatctatgagcgaaagagagtaaatagtgataggttaatcagattttgaaactcaaaatagaaattaatgatcttgggagtgaaaatgtgtgttcaatccagctttttataaaatgtaaatcttgaaagtatttagataagtggcatcttacctattcttttttcagagtttttctctaccctatcaataatt

SEQ ID NO: 46937 - DNA, 1030 bp, Homo sapiens
ccaatcatattgtttgttccacatattcaagttacatgcatatgtctacttgaaaagtctctataagtcattgtaaaagaatttcacctaatcgaacacgtcgaatagtcaatgactaatggcatagagagaaccaaagagagatttttaatttagagccctgtatgtgcaatttttgaaattcatgttgtattttatatctctcataggtgaaatgaaccagaaatacaaggagctaaagaaaagggaggaacatatggacagtaagtgatattcttgtagatataaaaatataatattttcagattgctgttcatttataccaaatcagagacctcattttgggcagatataatggctaataaatgcagaagtgtggacattcaaagcattttgccttgaagaatagtttctagcataatttagagatgggtagaaaattctaaaaagatatgtgatgagtgtctatacgttggggctagattctaaagctagtacttacattcgtagtctgtacagaggaaacctatagaccaggggtccccaatccccaggctgcagaccggtaggaaccaggccgcacaccaggaggtgagccactggcaagcgagcattaccgtctgagctctgcctcctgttagatcagcagcagcattagattctcatatgagtgtgaaccctatcgcgtatgagggatctaggttgtactcttgttatgagaatctaacccctgatgatctcaggtagaacagtttcatcccaaaaccatcacccgcatctgcccccagccctggtccatagaaaaattgtcttccatggtccctggtgccaaaatggttggggactgctgctatagatcatttattgattgaatgttctcttttacatgcttcactatattcacctttagtatctttcacttttatatttagctttccataatacttatctcattgtttattagccctcacatcagatattgtcacttttttctatcaccagctataattttagttgccttttgttagtt

SEQ ID NO: 46938 - DNA, 1032 bp, Homo sapiens
tctgaggtagtaagaagcacaagggaataagcctgcgatgcaataatttaatctgcctaaaattgtctcctagcttgccaacacttcgaagatcagggaactgggtaaatcaggacttgatttcatctgcagctgtatgtgaactggaatgtggaaaaaaaaaaaaaagctaattggagcaagcatgttgtgctgcagtggagtgtattttcattgatatgtttaacctttcatccccttcatctgtgaaaaaatgaaaattgctgacctttgaggttttatgtttttaattaagcaaaatttttttctttcaaataaaatcttatatgaagcccccccgccgcaaaaaaataaaataaaataaagttgagtagctcactgggagtgggtgagggtgtgggtctagagtccattctgttgatttcacctcttccactctcagaaacttctggagcacctttttagaacatgagaaattacagtttctttaaacacagtttaacatggctctgtctctaatttctaatgtaattaaattctataatatgggtgttgattcaggcccacaataatttccataactatttttaaataaaaatattcccatgtcttagttaatggctcattattcatagcaatattgaatacaagaaaatgtaaatataaaaactagagttaaacaacattttgagttcaccataataagatttagtgagaagacgctactaagaaagattagatactgttcaatatagaacacagaaaatacagtgagcaaaacattttagaggattgttatgcttcacttgtgatgcttggttgttaacttggtagacgtcatgccacaatgccaagtagttccttataaacaaggacacacttttatgcaaacattgaaaaagtgtttgaggctgggcgcatggctcacacatgtaatcccagcactttgggaggccgaggcgggtggatcacgacgtcaggagttcaagaccagcctggccaacatggtgaaaccccgcctctactaaaaat

SEQ ID NO: 46939 - DNA, 1136 bp, Homo sapiens
cagagaaggggcaaatcatcctgacctggggagtctgtgggtttttcaaggagcgtcacctgatctggatcctgagcctgtttaccaaggagagaagagctgaaaaagaccttccactcagagcaaatagagcatgcaaaggcacgaggaaagtgggggtgggaagagcatgctggctacagtgtagctgaagctgagagcttggactggaggctaggagagggcttataaaggatggctgaggtcaggttgaaggacttaggtttttaagacaaggaatttttactttataagaaaatgggaagccattggtagattcagactggtgcatgatgatttatattttagaaatgattgaggtgaccataccaaaggtagattgaatggcctcacagggcagctggttgggaggctatttctggaataaatatcttgatagctataggtactaagtggtgggaaaagagctcattagatatggacagacagggaagaggaacagatttaggaaagaaagcccagcatcagggtttgacccattgagttgatggtgcctgaagtattcttggtgcgcatgcccgaaacacactggaaacatagatctggacgtagagacaggtgggaactggagtgatggagccctcagcatactattaagaaggtcgagatgagtaccttgaggagcagctgtgtctcgtccagagggtccacagagtctgctgatgccggtgtcggtgcaggtgtcctgccttgttctgctatcccggggtccctcctttctctccctcttttgctcttctcgaacatgtacacacacaaatagacactcattcactcaggcagggatcagcagactttttctagaaagggccaatagcaaatactttaggctttgctggccacatgctgtctctgtcacatattcttccccccaacaccccagcctttaaaaatgtaaaaatcatccttcatttgagggccaagcatatatgggcattgggtcacatttggcccatgggctgggttgtagaccccagcccatgttaggcagtctcaggaattgatcctacctattaaagcaaccaacacttgtcttggagaatattcatatcaagagaaaaaaaatctgtgtggta

SEQ ID NO: 46940 - DNA, 1025 bp, Homo sapiens
acagagaattcctgttatctttctcccagcttcccataatgttaacatcttaaataaccatggcacatttatcgaaactaagaagttaacattggtgtggtactcttaactacagactttaccagttttttcagtaatgtcccagaattctgctccagaatccaatccaggataccatgttgcatttagttggcattgttttttaagttttgaaagtgatcacaaatgtgttgggctgatttactatttgggtttactgacaagactagtttataagaagtgcaagatggtagttctgcattttgaatgtgggccatcagatctcaaacttttctgttgtttctgctgcttagcacctccgccaggttggggtagtgggcaaatttgtcgagttcttcgggcctggagtagcccagttgtccattgctgaccgagctacgattgctaacatgtgtccagagtacggagcaactgctgcctttttcccagttgatgaagttagtatcacgtacctggtgcaaacaggtaagtgaagggccctgaaagcatcgggctttttgtaaaagttccatgaaacaccaagaatctgagcactgccttctgcctctacccaacagaaggcactgggttacagttacacaattatttttttctccatggagtcaaaatgggtttttgggatttaaggagttaatatgagatagagatggtatggccaatagaaagagctcagagattacagaagcctggatatttatactggtcctctactactagttttttgacattaaacaagtgatcttagtaatggttactgctgcctatggggtacttgctgtgtaccaggtacctagtatgtatttgctgtcaacctctttacagatctgtagggtagattgattgactagttaattaacattagagaaaactgaggagcagagaagtgttcatacccaaggctaataaacagcagagtcagaatccaaccctgcaactgcctggccccatacaggaacagcactctg

SEQ ID NO: 46941 - DNA, 1085 bp, Homo sapiens
aaaggattagagattgaggtaatacatttaaaatgtttaggacacagtgcccagaaagtgctcagtagccagtggtttcaggtggggttgggatgcgttttaattttaacggtaatcatgtggaatgctgaatctttgtggccagttgaaggcaaatgcataggtgtgctttcacaattagctcaggtgtaagattctcctaattaaaggctataccccaaaagaggcgggttatctatagatagaaccagaatctttttcagaaaacagtcactttgataggaacagcacattcattaatggcccctaataaaaagcagcatcagtgggagagtcaaaccattagcctggaagcctaaaaattgacagagctgttggtgtgtgtgtaagtgcagcgtatgttgcgtacttacataattgctaatggaagtatcagtttataaacttcaaccaggaaatactaacctatgttacttgttactccttaaaatgccttttaggtcgtgatgaagaaaaattaaagtatattaaaaaatatcttcaggctgtaggaatgtttcgagatttcaatgacccttctcaagacccagacttcacccaggtatgagagtgccttccactgtgcatgtatttcctcttcctcaaggctgcgattttagtggtggtttttcttgggggaatgcgctagtaggaaattagtcactgccaaggcattacaagagaacggagttttagaaggttgaaaaaccaaaaggataaggcaattgtaaacataacagaataatataacttcttacattcctactggcttaataattgtaggttaagtgtgcttccctatttgaactactgattcacacctcttaatgtggaagaccactgaaagactttgctaaaggaataagaatgatacaatggactttggggactcagggcaaagggtgggagggaggtgaaggataaaagattacaaatttgggtacagtgtacactgctcaggtgatggatgcaccaaaacctcagaaatcaccgctaaagaacttattcatgtaaccaaacaccacctgttccccaaaaatctattg

SEQ ID NO: 46942 - DNA, 1085 bp, Homo sapiens
ttgaaagacaattaacccaggagaatactgacttatgcctctcaccaccccttctcacctctctctcttctccgttgaagctttggggacagcttttctgccatggagaacaatgcttaggagacttagagaaatagccaggtctatgttttgttttgttttgtttttttcttttcttggtgtaagctaaggttaatctttgcttgcttcactaagccagctcctttcttgcttgccttcttagcctaactccacgagaattcaactcctatggctcccgccgaggtaatgacgccgtcatggcacggggaacatttgccaacattcgcttgttaaacagatttttgaacaagcaggcaccacagactatccatctgccttctggggaaatcgtgagtattgtcttctgcttcctgcagacactagcatttgtcagccttggtggaggttggatatttacagttactcgccttttggttttagtttttcttcacagctccatcctaccctaactacagtcctccttgccaggtgtccatatgcatagaatgtatcattgacaaattcaaaccttttcttcttgcttagagattctagaccgtggtttcactgagtctcttttcttaggaattgagctttgagtgacatttcatttaaagtattcgaaggggaaataccaggttaaattaaaggatatttatcaagaagtgctattgtatgactttattggcatgtaatttaattcatctaatccacatgaaaagaaggagtagagaggtgcttggaggcatgttttggttctaatgggagcactgtggtcagtatgttgcagcagggactgtttgttcccagctccacgttatactagctgtggagccttaaagttatttccatctctgagccttgcttttctcacctgtgaagtaaaaatactacttaccttggaagaacgctctgaggcttaaaatgaaatggaatgaaatataaaacctagcatagagtctggtacatgtcataggtccttagtgtcacttcccttcccagtgagtgctgtgaaattgcctgtaaactgtttaacttacttg

SEQ ID NO: 46943 - DNA, 1101 bp, Homo sapiens
tctctaagaacttgctttatgtattgggtgcatatatatttaggatagttagctcttcttgttgcattgatccctttaccattatgtaatggccttgtctcttttgatctttgttggtttaaagtctgttttatcagagactaggattgcaacccctgctttttttttgctttccatttagttggtaaatcttcctccatccctttattttgagcctatgtgtgtctttgcacctgagatgggtcttctgaatgcagcacactgatgggtcttgactctatccaatttgccagtctgtgtcttttaattggggcatttagcccatttacatttaaggttaatactgttatgtgtgaattggatcctgtcattatgctgttagctggttattttgcccattagttgatgcagtttttcatagcatcgatggtctttacaatttggtatgtttctgcagtgactggtatcggtttttcctttccatgttcattgctttcctcaggagctcttgtaaggcagacctggtggtgacagaatctctcagcatttgcttgtctgtaaaggattttatgtctccttaacatatgaagcttagttcggctggatatgaaattttcggttgaaaattctttaagaatgttgaatattggcccccattctcctctggcttgtagggtgtctgtagagagatccattgttagtctgatgggcttccctttgtgggtaacccgacctttctctctggctgcccttaacatttttttcttttgtttcagccttggtgaatctgacaattatgggtcttgttgagtatctttgtggtgttccatgtatttcctgaatttgaatgttggcctgccttgctaggttggggaagttctcctggataatatcctgaagaatgttttccaacttggtttcattctccctgtcactttcaagtacaccattcaaacgtaatttggtcttttcacatagtctcatgtttcttggaggctttctctgtttcttttcactcttttttctctaatcttttcttattgctttatttcattgagttgatcttcaatctctgatatcttttcttccacttgatcaatt

SEQ ID NO: 46944 - DNA, 1056 bp, Homo sapiens
tagaaccagtacataattgtgatttaaaaaaaaaaaaaagaaaaccccacaataatctgaggcaaagaacaggtgggtctcacttattttacaattggaggaaaaaaaaaaatagattcacccaaagtccagaggatccatgcacctgactcccctctacaggcagggtggggttgcaagtgaggacactgggcacctcataaagaagaagattaagaaggttccaggtaacccagcttctgaaggtagatactcattattcaaaaacagaagcgatgtttgctgaaaatttgtgaagctgaagttcaccagtggccctggcaggcacaatccaaaggatacagggaaaacgaccaaggtcaagatgcaattgaagaaggtcagggactaatgtgtccacaggccccacctagagtcaactttagagtaaacagctcagaaacaaatgcagatccaacatactagtccctcaggaaaacatagggtctaaaagggccatttttagtagaacaatcacccaaattggagctgaaaggaccttttacagctaaagaagcagacttagaaaggtaagggaacttagcaatatgactcctaataggctttttgcccaaacagctgagctgatgagagatttctgctttctgaagacgaacggaacatcctgaagtaataactcctcatctgagccagcccagcccctccactgtgccccccatgcaagagttataccccatatttctctttggagatttttctaaccctttctctgaaagttttaagaaagaaatataaggctgcaatagaaggctaatctgcagatgtcacattttacaaataaggagatattttgttttcattataaaagtgatccatagcccaaaaggaatgtttggaaaacataaggtagtaggaaaagagaaaaaaagtcatggaatctcaccaccaaaatattaatacattttggtatagttcccctagcctttgtttttctgtagcaaggtaggttttttgactttttctcttgacaatgacaatgaatgtatttgctgctgt

SEQ ID NO: 46945 - DNA, 1031 bp, Homo sapiens
ttgcgtaacatcgtaaataatgccactgaattgcacaattgtttaggaaaatttgttacatgttttacaattaaaaatcctaagaacactaaaagaaagtcatattaggtcggttggtgcaaaagtaatgtgccattacttttaatggcaaaaaccgcaattacttttgcactaacctaatagttatatcctgaagaggcagaaactgataggtttgtctgtgtagtttttcagcttgtattattactaccactaacagcctctgttgaacccttcattactatgtaagcagccatatttaattctcagaacaatgtaatgagggagagcctatgaaaaaacaaagcctatgaaacagagcctatgaaaaaacattaaccaaggtcatcatccacaaaaatacaagttccagcactaactctgctttctctgtgatgcttctcctgcccattcatacttgtagggaataggagtagaggccaattatgtcgcttgagagtgctcttggaacagtggcaaattttctgtacgtgaaattagcttctcaacttttttgtacgtacggtactggttcttaaccttggctaccattggaattacccgggaaacattaaaacactcatcaggtcccaccctccagggattctgtataactcggctgggtgtagcctaagcatcaaaatgattatgcgcagccaaggttgaaagccaccaacactgacacatggatttaatattaaccacttggaacagaataccactgttaaaattgccgtggaaggttaaataatgggcagcccttgctattccaagtttggtttttttgttttttgtttttgagaccaagtcttgctctgtcacccaggctggagtgcagtggcacagtctcagctcactgcaacctctgcctcccgggttccagctattctcctgcctcagcctcctaggtagctgggactacaggcgtgtgccaccatgcccggctaattttgtatccttagtagagacagggtgtcaccatgttggccagg

SEQ ID NO: 46946 - DNA, 1035 bp, Homo sapiens
gtgagcatttttactcgacaacacttagctgtcattggctattggtgtttggtttttggacatggaataatgattgattagtcctccacaagcaccttgaacccatcaccttcactggaaacatagttcttacttaacagcatgttttatacaaagttctaaggaaagtaatttttagatttggcttggagtctatgagtttcatggatgaagtttaatctctttactggcatgtctattttttatgtcctaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacat

SEQ ID NO: 46947 - DNA, 1070 bp, Homo sapiens
cttttggaagaaaatttatttggcctactcccatttttcctgacagatggccagagtggttggaggtgccctgcctgtcagaatgtttctgcacatgttcctaatacctacacttgtttctgtggtaagtttgtttatatacactggagtctcttttactacatacattgtacctcagttcaggaaaggtggtctgcggggcatgttttagaagttactaatgagacttcaaagctctaggagtctataagactgtaattatgtggtccatcacacagctagagccacagcctttgtgctcctggcaagctgttctggagatggccaaccaggctcatgctgcttctgggctgtagtgcttgtctccttggtcttgagaccaggcctgaccatgtagcagagataggtgtggacgtgggcttcatctcacccccagcagttacagctttgatagtccagatttgagcagtatgagtaaataatagtgtttattttaatcctggaaataagtcattggtatttataatcagattttttataaaccagcattataaactctatcctggcatcttccctctttatggaatacttctttctgtttttgaatatctcagttcccccaagtattaggggaaaacttcttgtaacccagatgctcattcttgctgctagcccatttctgcatgttttttttcctttcctgccttttaatgactaacttccctctagttgttgatttttcagattttgtttctttactgtctgtctccctccctgaagcattgcatttttgcttctgtcttgttgcctcactgaaaccgtattcagaaattaccaatgggccgggcttagtggctcacgcctgtaatcccagcactttgggaggccaaggtaggtggatcacctgagatcaggagttcgacaccagcctggccaacatggtgaaaccccgtctctactaaaataagttagctgggcatagtgttgcatgtctgtaatcccagctacttgggaggctgaggcaggagaatcgcttgaacctgggaggcagaggttgcaatgatccaaga

SEQ ID NO: 46948 - DNA, 1034 bp, Homo sapiens
ggtgttcagccacggccttatggaccagatagtgttctcttaatttagaggttgcttcactctgatgctgttcttggaatgtgctgcagaggcactatgagatattaatagtttaacaaggcttttttaatttcttcctatggtaaagctcttaggcgggtcttagagctgctgtatgaactatactcatttctgcataggtctgatcagtactctatttggcctcccagattacaggcatgagcgactgtgccaggcccgcattttgtattttcttatagattatttgtgacattttaagaacccatacatgttactaacgttttgtttttgaaattttctcttcaagtatgctattgcggcagcacctcccgagatgtgttatgtggaaccgatgtaggaaagtctgatggatttggggatttcagctgtttaaagatatgtggcaagtaaggttttacgttttcttcagttgaactaaagctgcactttatgcaacaattatgtaatagtgtgttttcttaacagggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttaggtaactagtaagcgtaaagttggctttaaaaatattattgtaaatggttggcagcagtgagtgtttaagcaatgtagaagtaagtgctagttacaatatcagaggtttctaaatattatgatcatatttatgtaggtacgttttctttcctcctcaacatatacttgtgaaaacccatacatttgcccaaatgatctctctgattcaggtattttattgttaactctggacaactgtggtgagttactgttccataggggttatgatttctcttaggagcctgtactg

SEQ ID NO: 46949 - DNA, 1021 bp, Homo sapiens
atgctgtgtctatgtcttcataaagcatgctatatttaagtctttatggtaattcatgtgcaggaatttatgggagttctgcctttcctgacaattgtagataaccactcctgcatatcatttcttccatataatccagtgttcactgatgggagcattaactcagtttcatgagtcacttttgctttatatctgtagagagcatatagggaactttttcatatcatcaatcccagacacctcattttttatctgaaatgtatattttccagccaagaaccttttattgcttagacttcttcacatctgttatcaacttcagtagctgctttttttttttttttcaggataatttttacgaagaggggacttttaaagtcatttttctcatttctgagtacatggcaacctgtaaatgacatcaaagccaaaatcagatgtagaagccgggcagctagccagactcattctaccccaagtgactgacttccttcccacacaccatcatcactacacacgatttttaggatcatgccttagcaaaattacgtgatagaccttttagaccactcacatgtagtggaaaccaaactttagaggccaaaccaaagatcctgctttatttcactttgctgtagttttgtgatattatcaggtgtgctctgaagtgtgtagagccgtttgtccctgcattaaatggtacagattgtcatctgttttcaattcttatatctgctttttatggctttttctgtctgtacccttgtttggtgatgacttctctttcctttgcatgcctttagcagccctctttctatttagattttgtaattattagtctactgtgaatttggagaccagaccacaaaaattgttagaattgtattttcatgaaaagtctgtaagcctggagtcctcttgtgagtaaagctcattcatatagggattaggctcgctccagacatggcaagtgaagttggtgaataagtgactatcagagaagtatgggatatttgggata

SEQ ID NO: 46950 - DNA, 1088 bp, Homo sapiens
catgcttgtccttcaacactttaacataaagcaaggtactttttactttcctgtgaccgtttttcaaaagtactcccagtttctgaatttaaaagtttcatgccgtatgccacttatatgatgtataatggtttacatggctttatttagaaagtattcctaaagttacctttctctttctgcagtatatcattcttgtcatagtgaggagaagtgtcccccttgcactttcctaactcagaagtggtgcatgggcaagcatgaggtaagttttctctctcaagtgctcattgttccaggcagaggttcatgattttattacttaagaattgttagtctcatcgtctgtcaaagtaaatacactcagaagtagaagctttccattgcttaaaaattttttcttaagatataatttgcatacaacagaatttaccctttttattgtacagatccatgagttttagcaaaagcatacataccatcaaaccactaccacaatcaagatatagaacagttcagtcacccccaaatatccttcatgcccctgtatactcaatgtcccctacttccaacttctgaaaaccaatgttgtctgttccaatcattttactttaaaataccaaatttttttttaataacctccttattcctgcaagaatggcaataatcaaaaaataatagatgttggcgtggatgtggtgaaaagggaacacttttacactgctggtgggaatgtaaactagtacaaccactgtggaaaactgtggagattccttaaagaactaaaagtagatttaccgtttgatccagcagtcccactactgggcgtctacccagaagaaaagaagtcattatatgaaaaagatacctgcacacgcatgtttatagcagcacaattcacaattgcaaaaatgtggaaccagcccaactgcccatcagtcaacaagtggataaagaaattgtggtgtatctatacgtaccatggaatactactcagccaggaacgaaataatggcattcacagcaacctggatggatttggagaccattattctaagtgaagtaactcaggaatggaaaaccaaaca

SEQ ID NO: 46951 - DNA, 1033 bp, Homo sapiens
gtaacaaagggaacctgatagggtgggcctttgtaggccatgggaaggtttaaggcaaaggagtgaatgatgaagctagcttttgttgttactgttgctgttgtttttgagactagtctcgctctgtcccccagactggagtgcaatggtatgatctcagctcactgcaacctccgcctcctgggttccagcgattctcctgtgtcagcctcccgagtagctcagattacaggcctgcaccaccacgcccggctagttttgtatttttagtagaggcgaggtttcaccatgttggccattctggtctcaacctcatgacctcaggtaatccgcctgccttgtcttcccaaagtgctgggattacaggtttgagccaccgcacccagccccctagctcattttttaaagggtaatgccagctgctgtactgagactagaccacagggctgagtgggaacaagggaagaggctggaagaccagaaggcccctgctatagtctgaaagaggcagcactggctggaaccaaggtaacagtgctgtagcggtgaggagtggctggattctggatacatgttgcagattaacacctacagcttttgccgacagctgggacgtggggtgtgagagtgagcggagagtcagggatgactttaaagtttttggcctgagcaattggaagactgagtgcgctgtttactgagataggaaagcctgtgggaggagcaggcttggggatgaaaatctgtccagtaggcagttgtgcgtgggagtctgaagtctggaggcaggactgggctggaaatctaatttgtggagctgttaatggcgcctataatggtatttaaaggctggtgaaaccatgtagggaaggagggtgaaagagaagatatccaaagacaactgtgccccgggcacaccctcatcctgaaggcaggaagctgagaacagggaaagttagagatgtccaaagccagagacaggggctgaagctgcaggactcagtgctacaggaagtcctgtagggtgaggggc

SEQ ID NO: 46952 - DNA, 1075 bp, Homo sapiens
acagagtttcaccatgttggtcaggctggtcttgaactcctgacctagagatccacccgccttggcctcccaaaatgctgggattacaggcgtgagccaccgcgcccggccagctgcatgtttttaaaaatcaaagtaagaagtaatttgtttaaaaaatatgttgttatttcagtgctctttccccatggtacttttaggaattaaaatgtatttaagtgtcagttagatgcctagaacggccctagacctgctgtgtatacagtattctacttaatgtaaggcctcatggattgtgtgatatcctactattttctacattaatgagatgatttttaaatgctaccaattatagttataaaaaattatgaattgtaaataccgctccaatatgagatatgctaaaatgtgacctaatctttaaatcatcctgcaaaatagcaataattgtatcattttacttaattaaaatgtttttgttaaatagtagtaatataattataacgtctggctgggtgcgtggctcacacctgtcattctagaactttggaaggctgaggtgggaagttcccatgatgctaggagtttgagaccagcctgggcaacaaggtgacattcctactctacaaaaaaaatttaaaaattagctgatcatgctggtgcactcctgtggtcccagctattcaggaggctggggcaggaggtttgtttgagcctacaagtgccaggctgcagtgaggcataaatacaccattgcactccagcctgggcaagagagcaagaccctgtctcaacaaacaaaagtctaacagttattgagttgttgcttgttctggaaacagttctaaatgctttatgaagattttcatttaagcatcacagtggtgtcctgtgagctagctgctgttgtcatctttattaatgaggaaattcaggcacagaaaggctaagcaatagctggtaggtgaccgagttcaaagtagaactcaagccctagttaagctgaatccaaacaccaagctcattctatccaaataggctgctgtttcattaaggtagggagcagtaagagcta

SEQ ID NO: 46953 - DNA, 1093 bp, Homo sapiens
ctttaatctttttacatttgagttactgctggaatgagttaagacttttggaaacttctgaaaaggcttgtttgtattttactctgtgagaaggacatgagattcaggggtgtcagggtcagagtaatatggtttggtggtgttttcctacaaaagatcatgggaaattgtattcctgaatgttggaggtggggcctggtgggagctgattgaatcatggatgggagggggttgcgggtagaaggaaaaagaagtgggtagggtggggaggagtaggttggcagtaaactgtgagagggtggtgggtagtaggatgtgggagtagcctcctgcagaggcagagcctcatggaaaacctctactagggcggtgcacctgtggctttgcagggtttagtcccttggtggctctcatgggctgggctggtgttgagtgcctgtagctttttcatactgagggtgcaagctgttggtgggtctataaatctggggtctggaggatggtaacctcctgtgtgggggctccaagcccatattttccttctgcactgccctagtagaggttttccaagaggctctggctctgcaacaggcttctacctggaaacagtggtggggtgggggagttgggggggacagatctttcaccaatgattaagcatcatcttcttgatgctgattttgtcatagtgagttgtcatgagatctggttgtataacagggtgtgatacctctttcctccttctgtcttgctcctacttctaccatatgaaacatcccattgccacttgttcttctggtatgattgggaggcttcctgattcctcccagaagcagaggcctctatgattcctttaaagcctgcagaaccatgagccagttcaacctcttttctttatgatcttacagaaaattggtgcttggaagtggagctatgaaatgccttcaaagcctttttcttattgtcttggcaatcagcactcagcttctcttcatgcagatatcggatccctttgtgaatttttcccctgaaaatggacatttcttctttttaccgcattgataggctgcaataaggatggatgaaaatgtaa

SEQ ID NO: 46954 - DNA, 1049 bp, Homo sapiens
ttctgagtttgcctggccacagcccaggttccttcacggacacttcagcatcaggctctctcctcagctttctttctatcttctgtgccctctgctcataaaccccagctcatagaagctgaagtcacctagactccaagacacctgattgtagagacaggaaaggagttctcaggatatgtgccataatttcatactggtttctacaagaatcagggttggaattagagctgattcattattcagttaacattgacattgttgattagagacatatccctgttgaaaatatttcccggcaaaaaacagaagttccctttggctctgaaatctgcaaagccctttcagatgtccctgtgtccttgtgccgtcactccacagcactgcacaggcatgtgctcacctcacaaaatggcagtctcaaagggaggagtgtccaaccacaagaggcgccaccctatgctgagaaagaacctttcacaggaggagagaaaagacctttccagaatctttaacataagattttttgtgtgtgtgaagtctgacctgagcagcaaccttgcatcagacttcaaaaggcaatatttcctgtacctccttgtgctgtacaagtgagtacagaagtcgagaaaatgttcctaagtctatggccagttcaaattccatcattttctatttctgagattaaattatatgtattaagatccttactctgccctttcatgtttattgctcctcggacaagatatcccctcttcaggtcccaaacacattcattgcaatgcctttcctcatccttgtcccagtcctggctctctagcttcttgagacaataacccatcctaaggtatgtggtgacatgcatcttctgcctcactgggatccctaagtggtataagcattcactcaattgctttagctagagtccccagaatatcttcaccctctgctgtcacactcttcttccacattggtccataaccacatctttaacatttctgtttattaaaacctctcaaattcaaccactattttctatcccaaccaat

SEQ ID NO: 46955 - DNA, 2082 bp, Homo sapiens
ctgtccaaaagcaaagcttttaaagctttaaggctagttagaccatttttcaacataatgataaaatgttctgttccatctttccaacttaatggtcagttggagacacgtgagagaaaggagaccatccagcaaattaggctacctctgataatctagttatggaaaaataacagtgaggaaaaggtataaattcagagtttaggactacagatttccatcttgcttaaagattatattgaaaaggtttaattcttttatgtttctgaacttcttttgaactgcttcacatacgactacagagatatctgagttggttggatgcagtggctcatgcctgctcacacctgtaatcccagcacttttgggaggcggaggtgggcagatcacttgaggtcaggagttcaagaccagcatagccaatatggtgaaaccccatctctactaaaaatacaaaaagtagccgggtgtggtggcatgcgcctgtagtcccagctacttgggaggctgaggcaggagaatcgcttgaacccaggaggtgcaggtttgcggtgagccaaaatcttgtgccactgcactccagcctgagcaacagaatgggactctgtctcaaaaaaaaaaaaaaaaatcctacagagattcctgagtaaaatttaacctctttgattgtgttaatatcaactttattcagcaagaaattgttattcagagattatgcttatgtacctcaaaattagttgactctgaagtgaatggaatgatagatactaagttgaagaggtaaatttagttcacatcaccaaggtttgatgttacttaaatgatcttccacatgataattggaaaattcaggtgttggaatatgtatttaagatgcaaagtggctaggagtggtggctcacgcctgtaaccccagcactttgggaggccgaggcaggcggatcacgaggccaggagattgagaccattctggctaacacggtcaaaccccgtctctactaaaactacaaaaaattagcagggcatggtggcacgtgcctgtagttccagctacccgggaggctgaggcaggagaatggcttgaatccagaggcggagaggttgcagtgagctgagatcacgccattgcactccagtctgggcaacagagtgagactctgtcccctgccgccccctccaaaaaaaaagaaaagtgaatagtccactttaaacacctttatttgatttagtaacaaatacatataaaaatgttttggttattgggtgggtgcagtggctcacgattataatttttacccagcactttgggaggcagaggtgggcagatcacctgagctcggaagttcgagaccagcctggacagcgtggtgaaaccccacatctactgaaaatccaaaaattagccaggcatgatgtcgtgaacctgtagtcccagctatccgagaggctgaagcaggagaatctcttgaacccaggccaatcgcttgaacccaggaagcggaggctgcagtgagccgagatcgcgccactgcgctccagcctgggcgacagtgagactctgcctcaaaaaaaaataaaaaggttttggttattgtcttattattattattattttttgacgctgttcgaataaaaaaaaattagtcaagcatggcagtttgtgtctttggtcccagctacttagaaggttgagttgaggtgggaggatcacttgagcctgggaggtcgaggcttcagtgagccatgagcatgccattgtactctagctgggtaacagagcaagactcagtctcaaaaataaataagttaaattaaaaataaataggctgggcaccgtggctcacgcctgtaatcccagcactttgggatgccaaagcgggcgaatcacttgagattaggagttcggcaccagcctggtcaacatggcgaaacgctgtctcaactaaaaatacaaaaattagcctggtgtggtggcgcacgcctgaaatcccagctacttgggaggctcaggcaggagaattgtttgaatgcgggaggtggaatttgcagtaagctgagattgcgccattgcactccagcctg

SEQ ID NO: 46956 - DNA, 1028 bp, Homo sapiens
caaaaaaattagctgcgcttcgcggccagcacctgtagttccagctacttgggaggctgaggcaggagaatgacgtcaacctgggaggcggaggttgcggtgagagccgagattgtgccactgcactccagcctgggcaacaagagtgagactccgtctaaaaaaaaaaaaaagaaagaaagaaagaaattatttaatactctttggttgaactttaattaaattttttcaaggttttttttaatgctctcagaatcaaaactttaattaaattctattatagttttaagtagtcaggtttatggaggtataatttatacattaaaattaatctttttagttacatagttctatgaattttgataaatgtatagtcacattcagttttttaaagaaaaagatgaccacagcagggcagtttttataccaaatttgtctatgtgagaagaaaatgaagttactcttttttcttaaaatatgaggaaaatggctctgaggactcagagttattatttgtgtggtacaatgagtcctcactaatttggattctactaatttgaaaattatgaggtttttcttttttgagaaaggattttgctgtattgcccaggctggagtgcagtggcacgatctcagctcagtgaaacctccgcctcctgggttcaagtgattctcctgcctcagcctcccgagtagctgggattacaaacacatgccaccgtgcctggctaatttttttttatttttagtacagacggggtttcaccgtgttagccaggatggtcttgatctcctgacctcgtgatccgcctgccttggcctcccaaagtgctggcattacaggcgtgagccaccgcgcccgactaatttttgtgtttttagcagagacgtggtttcaccatgttggccaggttggtcccctgacctcaggtgatccacctgcctcggcctcccaaagtgctgggattacagacatgaaccactgtgcccggctgatatggtcgtttcttgtaagagcttcagcatta

SEQ ID NO: 46957 - DNA, 1043 bp, Homo sapiens
ctcaagtgatctcctgcttcagcctcccaaagtgctgggattagaggcgtgtgccactgcgcccggccctggcttgcttaatttcttttagtaatgctattattgctgcatttaaagtaatgtcttttttcttttggctgcttttaatatttactctttgtgtttgttttcaacagttaaactttgatgtgcatgggtgtggttttctttcctgcctttggttcactgagcttctttatctttcattagttttagaaaattcatagccattatcttttcaaatattgctgcttcattctctctctcttcttcattaacctacgtatagtagaatttttgactatgttctgtgtgtctccaacactgtgttctgtcctttttgcccttgttttctgtgcttcagtttggatttgacctgaaattttttttttttttttttttttgagacggagttttgctcttgttgcccaggctggagtgcaatgacgtgatcttggctcactgcaactctgcctcctgtgtttaatccattctgctactgcagcctcccaagtagctgggattacaggcatgtgccaccacactcggctagttttttttgtatttttagtagagacagggtttcaccatgttggtcaggctgttctcaaactcctgacctcaggtgatccacccgcctctgactcccaaagtgctgggattacatgcaggagccactgcgcctggcctgttgacctgaatttaagttaactaattctgttttatactgtctatccaatgagttacagattctaggtactgtatttcaggtttaaatttttaaaatagtttccagtattctgttaaaattcattccaaaaagtcatttcataaattcattttgtgcaattttttcttctattttcttttaatatactaatcatagtcattttaaagtccacgtttgccagctccaatatctgaatcatctgtggatttgtttctgtacttttttctcctcttatcagtcattctccctctttccatacttcttaattttttaa

SEQ ID NO: 46958 - DNA, 1030 bp, Homo sapiens
atatatgctatgaattgtggtttctgagcagtaatgcatatactttgaaatcattaaacctttataaaatttttgttttcaaaatgtaattgttactatactctgtgtattttatctttgatagattaaaaatactctgatatctgctcaaagctgacatattcagaaatttatgaaaactaagctaagctgggaagcatagtttatattgaaatttgcttaggctcattgcccaagtttagtttggaatccctaacctgcctgatagttttagatccttgagaatatccctgttttaacatagtaggtcatattttcaaaatgcctacaagaatggtttatgtagagtattaaaatcttaagactgggatggactctgagatactatttttcattacatctttattttggaaaacttactagaactagtatttcccccctaaatagctgaaaatttttacagaagcattgttgtgacgttaggagccttgagactttaaatttctttgttttgtttttcagaataattttggattcaagaaaatatgatttggttatttaaatgtaggtttaatgtttaacatacagtccttgtggttatctaagccttttgtgtgtgtgtgtgtgtgtgtgtgtgtgtgtgtgtgtgtgagagagagagagagagagagagacaggatctctctctatgaccaggctggagtgcagtggcagtggtgcaatcagggctcactacagcttcaacctcctgggctcaagcaatctttctacctcaccttcccaagtagctgagaccacaggcatgaaccaccatgtccagctaatttttaaaatttttataaagacaaggtctccctgtgttgcccggattggtcttgaactcctggcctcaagcagttctcctgccttggcctcccaatgtgctgagattacaggtgtgagccaccttgcctgccctttttttttttttaaaaaaatagcattttaggagggcacgtttctcaagtaattatgtaaaaggaagttcttt

SEQ ID NO: 46959 - DNA, 1287 bp, Homo sapiens
gatctgcctgccttggcctcccaaagtgctgggattacaggcgtgagccaccacgcctggccttctaaatattttaaatgccgtttttcatttttaaaatttctagtttgttgttaactatcatacttctactgtggaagatgaggatttctctcattactgtaacaccccatcccataaacgtattcattagctctccatatttccagtagttatagttttaatttagactaattttcagtgtttacattaatataactatgtaaataatagttccggttgaaccatgtcatacaccattattaccttttctttcacatgtagtgtagtgttttgttttttgtttttgctggaattcctcttcatccctccacatttagtttttttgtgtgtttttttttgtttttttttttttgagatggagtctcactcttgttgcccaggctagagtgcagtggagtgatgtcggctcactgtaacttccacgtcccaggttctagtgattgtcctgcctcagcctcctgagtagctaggattacgggtgcccaccaccacactcggctaatttttgaatttttagtacagatggggcttcaccatgttggccaggctagtctcgaactcctgacctcaggtgatccacccacctcagcctcccaaagtgctgagattacaggcgtgagtcactggtgcccggctcacatttagttttctaatgtgcttatcagtaattcatccctgaactctgacagagtataaaatctctttaaatacacatggttatcatacttaactgaaatgtaattaacttttttttttttttgagacagagtcttgctccctcacccaggctggagtgcagtggcatgatctcagctcactgcaacctccacctcccaggttcaagcagttctcctgtctcagcctcccgagtagctgggactacaggtgcctgccaccacgcctggctaatttttgtatttttagtagagacggagtttcaccttgttggtcaggctgatctcgaactcctgacttcaggcgatccacccgcctaggcttcccaaagtactgggattacaggcgtgagtcaccgcacccagccaacatttttaatttgatcaaaacatgtgaaggtagaaagttgtatgtgtcataaatatagcagttggtggattttcacacactggggcatctgtatatctagtcttcagatcatgaaaaaagaaaattgccagtactacaagaagccctttcttgtgttctcttacagaaccatcttcccat

SEQ ID NO: 46960 - DNA, 1050 bp, Homo sapiens
gtgtgcttttttgtttgtttgtttgtttgtttgtttgtttgtttgtttgtttttgagacagtctcgctctgtagcccaggctggagtgcagtggcgcaatctcgctcactgctacctctgctttccggctcccagttcaagcagttctcctgcttcagccttccgagtagctgggattacaggcatgcgccaccatgcccagctaatttttgtatttttagtagagatggggtttcaccatgttggccaggctgttcttgaattcctgacctcgtgatccacccacctcggcctcccaaagtgccgggattacaggcgtgagccaccgcgcctggcctactattctaaaagtgtgtttttaaatctccaaatgttttggggattttgcaggtatctttctgttaggaacttccagttaaattccgttgtgatctgaaagcagacattgtatgatttctatttttaaaaatttgtcagtatgtgccttatggcccagaatgtggtatatcttcatgaaagttccatgtgaactcaagaacaatgtgtaatctgcagttacgagtgtagtagtctataatgctcattatatacacttgaagaatggtgttgctgagtccagctatgtctttacttattttctgcctgccagctctgtccatttcaaaaaacaaaaaaacaaacaaaaaaaaattctgtaatcttttatttgcaatatggttttgcagtggtctcattttttcgtagcagcatcccaagcattgaaattgctttagagtcttgccatcttagtcatgcatcagttcttttttttggccctgtggatgttggaagtacctttgctccagaaactgagctaacatcacctttaaattacttttattttatttatttatttgttatttgagatggaatctctgtcacccaggctggagtgcagtggtgcgatttcagctaactgaacctccacctcctgggttcaagcgattctcctgtctcagcttcttgggtagctgggactacaggtgtgcacgaccacacctggctaatttt

SEQ ID NO: 46961 - DNA, 1060 bp, Homo sapiens
ggttgccttttcactttcttgataatgtcctttagatgcataaaagttttccattttaatgaagtgcagttatttccaagtctttgatctattttcagttaatttttgtatatgacatgaggtaggagttcagttgcatttttttgtttgtagaaatccagttgtcccactaccatttattgaagagtctgttttttccccattgaatggacttggcatccttgtcaaaatcaattggccatcaatgtattggattatttctggactctcaattgtaaattatattccattggtttatatgtctgtcattatgccagtactgaacaacatggttgtctttgtagtaatttttaaaattaggaagtgtgaatcctccaacttttgctttttccacattgttttggctctttgggtcccttaaattgctatataaattttaggattaccttgtcaataactgtaaaatgggaaggtaggatttgataaggattgtgttgaatgaacctgtagatcaaactggggaatagaaccatcttaacatcgtaactctacattttttaagatcttttaaaatttctttgagcaccgttttgtagttttcaacgtacaagtcttttcccttccatgactagatttattctctctctctctcttttttttttttttttttttttgagatggagtctcgctctgttgcctaggctggagtgcagtggctcgtactcagctcactgtaacctctgcctcccgggttcaagcgattctcctgcctcaacctgctgagcagctgggattacaggcatgagccaccatgtctggcaaattttttgtatttttgtagagacggggtttcaccatgttggccaggatggtctcgaactcctggcctcaagtgatctgccagccccggccccccaaagtgctgggattacaggtgtgagccaccccgcctggccagatctattcttttaaatgacaattatcaatggaattgttttcataatatcctattaggttatttttgctagtttataaaaataaaagtgactgagttttgatt

SEQ ID NO: 46962 - DNA, 1779 bp, Homo sapiens
tgcgtcattttgaagagctgtatttactaaacaataatgtatatgattctcatttccctatgttcacttaggaatagattttcaagcctgaatccctactcttaacttatcctagttctactctggttctttattaccacctaacattagtgtcattcattggttgcagttaataaacaatgttaattcattataagtaactgaagtccatacgctttcacatttcctttgtttttacctgtcgttgttttgctccaaaatatttcatacatataaatatatatctatatatgtacgtgtatacatatatgtatttaaattttttgtagagatggggtctcactaagttgcccagctggtctcaaactcctggcctcaagcagtcctccccacttggcctcccaaagcgctgggattataggcatgagccactgtgccctgctcatcacattatatttaatagtcatgtcttcatgggcaactcctctctctctctgtctctgtctctctctctctctctgtttctgtctgtgtctctgtctcttgtctttgagacagtgtcttcccgtcacccagactggtgtgcagcggtgtgatcacaggtcactgcagcctcgacctcctgggctcaagtgagcctttcacctcagcctcccaagtagctgtgactataggtgtatgccaccatacctagctattaagcaactcttgattataaattttcttgtttttgatgacaattttggggggtactgatcaggtattttgtgcaatgtcccccagttgagatttttcttatgtgttttctcatgattagtctagggttataggtttgggagagaaagaccagagaagtaatgtgccattttcattatgtcatatctgaagtatttactatcagtgtggcttatccctgttgatgggatacctttcatcacctgcctgaaataatatttttagcttttctccactgtaaagttgctctttcctgaacttttcattctgtactccttggaaggaatatgcatagcccacaactaaggagagggtggctatacctccttgaagccagggtatctatataaattattttgaattcttctgcatggattgatctattcttcccctttatttgtttattcaatcatttgttaaacatttttactgatacaaaaactaataacttgattagaatctccaggtttatcaaaagtgaagaattggaagcttcctgacttgtaatagaagctcttcaagatgtgtcaaatgactgttgattatgtttgttactcattcctttgggtaccttgttccatccaatttatttagaaagagttgagaaaatagatatattaaagatttcagcatatcttaccaatatattttttaagacaaaaaatgttactttctttctaaattcaaataaatgtgtttttacacctcaccttgacaaccatcatccctctgaatgtttttttctcatatttctttttttttttttttttttaagacaggatcttgctctgtcgcccaggctggaatgaagcggcgcggtcacggctcagcacagcctcaacctcccgggcttgagcaatccttccactttagtctcttgggtagctgggaccacaggcatgcatcacggtgtctgctcaagattttgtattttttttgtagagagatggggttttgctttgtttcccaggccagtctcaaactactgggctcaagcaatccacttggcctcccagaatgctcagattataggtgtgccccaaa

SEQ ID NO: 46963 - DNA, 1001 bp, Homo sapiens
gctcaccgcaatctccgcctcccgggttcaagtgattctcctgcctcagcctcccgagtgagtagctgggattacaggcatgcgccaccatgcctgcctaattttttgtagttttagtggagacgtggtttctccatgttggtcaggctggtctggaactcctgacctcaggtgatccaccagccttggcctcccaaagtgctgggattacaggtgtgagccatggcacccagccttgttttagttctttattttagaaagttccaaactcataaaagtagatttggctgggcatgactcatgcctgtaatcctagcactttgggagggtgaggtggccagatcacctgaagtcaggaagttcgagaccagtctggccaacatggtgaaaccccaactctactaaaaatacaaaaattaacgagtgtggtggtgtgtgcctataatcccagctacttgggatactgaggcaggagaatcacttgaaccccagaggcagaggttgcagtgagctgagatcgtgccactgcagtccagcctgggtggcagactgagactgtcacaacagcaacaacaacaacagcaacaacaaaaatgtagattaatcctgctttgtaaaaactcttatttttttctactcacacaccaccacagcaattatcaacacagaaaaagaattctgtggccaaatgtgtgggcagttttccccacacaccaagcagctgccaccagttgggtgttctccagttcaatgccgacactgtctacctggagatagtgtcagatcccactggttgaatgcgcagtctccaagattgccccctagcactcatcagtcacaagtctgggcctcaagtgcttctgaccaccagcttcactcatgtcagggttccctcggtcctctctttaggtttaatttgccagagtgtttcacagaactcagagaaactcttttatgtttactggtttattctaaaggcgattgcaaagtatacagatgaa

SEQ ID NO: 46964 - DNA, 1050 bp, Homo sapiens
ttctcaatttttttattgtgttttcctcatgtgtttggattgggactcaaataaggtctgtaagttagtgattgcttgagatgtattccttaagatctttttcagtctgtaggttctcttttcatcttgctttttttgtgttgaaggaaactgaatcactttttctaaaagtttgctacagtcaggattttgcagtttaattcactactattttaattaggatttgggtatgtatggataaaacataaataatcagctaggtgtggtggtacattcctatagtcccagatacttgggaggctgaggcaggaagatcttttgggctcaggagtttgaggctgcagtgagcaatgttcatgccacttcactccaacctgggctgttcagagcaagaccctgtctctaaaaacaaggatcaacaaaaattaaatatgctttcatttctggttcttttttctcttttctctgtcagtttttggtatcagtgttatgctgatctcatacgagaacttggaattcagcaacattcattcagcaggagttactgagcactactgtggccgggcactatgcttggtgtaatggtgaatgagacagaagtggtatttgtcctcgtagtgcataaaggcaagtggggaagacagacaataaacaaatcctgaataaattgataagctacaaatatatatttgtttccattttatgtgttggaatagattaaataaaataggaataatctgtttcttaaatatttaatagaactttaaagacatctgttctgacatttattttagcatacacatatttcataagcatgtgaaattacttaagaaccccttttctctccccataaatctttgacaccgtgtgaagttgttccatccttatattgtttttcctttaggcctacagtgttcccctggggatttgagttttcaagttttgtgaacaaggctgtattatttctgtgggaaaaatcattcaggtttcacatgatggaaacagaatgatacaatccactgagtttgaagactccaggaagaacaaaaa

SEQ ID NO: 46965 - DNA, 1048 bp, Homo sapiens
aaaattaaaaattagccaggtgtggtggagcttctctatagtcctagctgctcaggagcctgggacaggaggattgcttaagcctgggagttcaaggttatagtgagctatgatcacatatgcattaggttgtttggtattgttccagatatctcttaacactgttcaattttttttttccctttttctctctttgtatttcagtttggctaatttcttttgacctaacttcaagtcccaagtctttcttatgctgattattgtcttcggattagcatagcctggtttatgaaccatcaaaatttttcttttctgataatgcatttttcacttgtggcatttccatttgtctctttatatttccatctctctgctgaagttcccatctgctcacacatgtttagtttttccattagaccctttaacatatttattattgttattttaaagctccctgtctgatgtttacaatatcttggctctccctgaatttgggtctgatgactggttcctctcttaattctggatcacattttcttgcttctttctgtgtcttataatttttaattgaatgccagacaatgtatattaaaaagctgattttgtagattatatggcttgttttgttgttaggatatgagtaacattttcttgtgatttcacatcttacaacagatatctatgttattttgtatatttatgattttgccagtgttacctggcttgtggctttaagatagttttttttgttttatttatttatttatttatttttaagtcctttgctgcaggaggcgctgatggctttaagatggtgataaccagtcatggaattacagattttcacttaattttaagtttgatcttctttttaaaaaaacctcaatttgaatctcctcacaataatacctgaattaaatattatgcatttgctatcctctattggggatttctccccccacctggaattgtactttttttagaaaaaacgggcagattgcagaatcataggcatatcagcaatttagaaagaaacaaagcaaatgaa

SEQ ID NO: 46966 - DNA, 1031 bp, Homo sapiens
aaacacagagagtatgagttctacagtgtttctgaacatagttgtattttgagttggagcatagagaagttgggctccctgatcatagattcatctgcagattgtggcaggagtggaggagtgaggagatgggcagggccttcttagaccaggaggggatgggcagggccttcttagactgtaaagattatggagaccttgagattgcagcttgaccagctagctacctgtgccttgagtctatcactcagcactgagggtggagtcgggcaagtctccagtgggaagaacagtgaagactactggcctgaggccttaggccaggccaagatctgtttgtaagctggccagttttcatccaccagcactcctgacctcacctctaagagtaagaaagctgcagtcatttggtcctgaaagagaagccaggctgtgtggggagaaatgggaaaaaggagcccttcttggctgaggccattgggatggtttgagttgggagggacagactgtggctcaggtgcctgctggaatgaggaatagccctcagacagaaggaagcagggactttattttttaaattattttgttattattattactattttatagagacagggtcttactatattgcccaggctggtcttgaactcctgggctcaagtgatctgcccacttggtctcccaaagtgctgggattataggcatgagccaccacgcctggccagaagcggggactttaaaagggagtggggttagaagggatggacaaagatccaggattgaaggaaaacaaggaaatgggaacaggaaataaattttgcatgtttgagttgtactggggagaaacaaggtgaaaaaagaggcagaagcttcacaaatactatgaataggaatattcacacttgtctccggatcacatgagtcacactgccttgttcctctcactacctgatgtcagtggacctctcctaatcctttcctgcttcggcagaagctaccctgttaattaacactgatggacagaatactga

SEQ ID NO: 46967 - DNA, 1035 bp, Homo sapiens
agagcagagtccaacaaagaaatagcaccacccaggtgcacacacgggcatacacacagccagccagttggttgcccaactgctccagctcgggggaagaagagaaggagactagcaaacagtaattagcctcctcccagatgccagtgtctgtctctaagtccccagggacttccaaggagatgccggaaatactcaggtttttcacctcccccatgcaagaatgcaaggtgtggagcagaatttgatcctaaatgtcaatacacagctcctcccataggcacttcccacacggtgctagctcagggcctcattctcagtgccctctgcccccagctgcctaagcttgtcagccctagctggtctggaacagactcttattccctttctctcagtctacaatgacttagctttcctccccattcctatatagatacagcttagaaaacacctcctggaaaatgcagccagtggcctttaggtgatgccctcaagctgagcagaacccaaagaaggctttaggtggctcagatcacacctgtgagtttatattcattcattcaagataaccaaagccctattctgggcaccaaggaaataaggagagagagggtcagtatctgaagaggagagagacttcctcatcctcaaaactttcatatgaagtcagcctatctcatgagccctggaggcaggaagaggccaccaaggtggattcaaaagccctttccgacagttatgttttgagaatcttaattttctgggatctgaagttctttgatgaaagacagaagcccacaggcctgggcacccacccaccccaggcaccatgatagtgtcccaaatgtcaccacagcatccagttctatcaacaatgtggaacagcagacatagctgcagtgtccattttacaggtgaggaaacgtggcccaaacagaaaaaggaacttgtctgaagttagccaggtatcaaggctgcctggatctaaaatcccagcccagctctccacagtgtaagttttaggagatgggagat

SEQ ID NO: 46968 - DNA, 1032 bp, Homo sapiens
ctgatagatctttgaaaacaaaggtgccatgatgggctgttctaacccccacccccactgccaggtaagggtgtcaggggctccagtgggtttcttggctgagtctgagccagcactgtggacatgggaacaggattaatggatgggacagaggaaatatgccaatgatgtggaggcttggaggtaaaggacctgcctgttcttctctgcttttgccccttgacaggtatgggccagcagtttcctgccagatattgcccagcgtgaggagcgatctcagcaggcctataagagtcagcatggagagcccctgctaatggagtacagccgccaggagctactcaggaaggtgggagagagccaagccctgtgtccccaaggagtccctaactttcttatcccatgagagaggtgtgtaaaggagaaagctagaggtgaactagtagagagagacttgctaggaggccttagcaataatccagtaatctaaaggaaagatgatggtgacttagactcgggtggttagtggtagaggtggtgagaagacatcagatcctgggcacattcttttcttctgcttcccttgcctatttgctgaccacactccggctcctatgtcaccttgatgacttcctatccattctgtcttcctaggaacgtctggtcctaaccagtgagcactggttagtactggtccccttctgggcaacatggccctaccagacactgctgctgccccgtcggcatgtgcggcggctacctgagctgacccctgctgagcgtgatggtcagtctcccaagtaggatcctggggctaggcactggatggaggttgctcccagtagggtcagcatctggaccccaggctgagagtcaggctctgattccagatctagcctccatcatgaagaagctcttgaccaagtatgacaacctctttgagacgtcctttccctactccatgggctggcatggtgaggcttttcaagtacctatatttagccccaacaccatttctgggctcctggggct

SEQ ID NO: 46969 - DNA, 1032 bp, Homo sapiens
tgaatttcaccctggcaatgtaaactgatagcttatcttcacaggtgcaggacaatagacagaactcaaagtcatccctctgctcacctgagacaaatgtgtatctgattgctgcttctgccctattgtttatgcaaaaatgcagatccactgagccagactaaggcatcagtgtgactattcctttactccccactccatgtaaattgtgtattcagtgaaaggctgatcaaagaccccaaaaaatgcagccttttgtctcttatctacctatgacctggaagcccccacttcgagttgtcccgcctttccagactgaaccagtgtacaccttacacgtattgattgatgtctcatgtctccccaaaatgtataaaaccaagctgtgcaccgaccacctttagcatgtgttgtcagaacctcctgaggctgtatcatgtcatgagtgtgtgctcaaccttggcaaaataaactttctaaattgattgagacccatctcagatacttttggattcacaacatgaactcagcttcctttacagacccctgagacctgcacattgatccctgccatgcccctccgtaccgtttaacccctgccccattttactcactcatggcaagaaaaccaatatgctgagaagaggagtgttgccacacacacaagaggccatggaggatgagcagagatggacaaatgaggagagtccctgggagcagcaggtgtgcatgggtgtgcaggagtccttctgcttgtgtggagtctgtgagactgtgtgtgaggttggatggggagagcaagcaggagagggatcatgatcatgagggcgagggagtccttggaagactgagggtccatgagtgtgtgtggatctgtaggaggctgtggctgtctcctatttatggccccctaaaactttcattttctacgttcagaaacttccttccctaatggtgtgtaataaagaatttgactgccttttgtccctggctcctgagagggagactaaacctttggaatttcccaagtaa

SEQ ID NO: 46970 - DNA, 1102 bp, Homo sapiens
accgcctgggaacataggggagctgcaggagcctcgtgatggtggagcccccagagggccccctagaaaaggaggacctgagactgtgccctagaactgtgggaagcaacctctgactggggagggggatcctcccatgggatccatgagtgacttcccacggctccaaggactttggcctttatctccctataggcctacatgtgtcctcacttctgaccaccgtggcccagaggtggaggccttgtaggatctctttccattcccctctttccctattcggatttttcttctccatggtagcccagttgctccaggctgcattttagtggaggtagaaactgctgcgagagcacagggccccaagcgggggacgaggacaagtgaggcctctaaaggaaagataggagatttgagcccctgggtttgaccgtccagaaggaagcagtaagatcaagtggaataactgactttggcaggtcctggaacaaaagacctttgaacgaaagaataaaggatgtatagggttgttgagcaccagtgtgctaggcactatactaggtatgtttaaacatctcatgtaactcttaacaacagctttgtgaaattatccccttctaaaatgagatttagaaagattaagcaatttgaccaaggttacaaagattaaactcatgaaatctgtttttcacagattttatttggaaagaaatgtcaaggagaggaagaagcaagaatgtactcttgcttaagtttaagagctactatggtttgaatgtgtctcccaaagttcatgtgttggaaacttaattctcaatgcaaccgtgttgagaggtggggcctaataggtgattaggtcttgagagctctgccctcataaattaattgacattatctctggaatgggtaagtcatggcagggggtttgttataagagcgagtttggctgtcttgttctcctgctttctcacgtgctctcttgcccttccaccttctgccatgaaatgatgccacatgaaggccttcactgaaagtggaccctcaatcttgggcttcccagcctccagagatgtaagatataaatttcttgttctgttatagc

SEQ ID NO: 46971 - DNA, 1046 bp, Homo sapiens
ctcctacctagttattacacaccaaagctctctcataatgtgaagtaatttgatatccccaaaactcaaaactatcagataacacaatgcaaaacagaactgagcctttgattttgagagggaatgatctgcttttaattcctggggtttcatgaggaaaacagtttttttttcttccccccctcccccaaaacagggtctgtagtgcctcctctgtttttcccaaggagtccccggctaccggaagttatcttagggcctgtcatatgtgcattaagagtggcaagacaaaaaatggagaaaaataattcagtcgactaaaaagaaaaaagactttttccagaaaaacatgatccaagaagagaaaaacataatagccttttaagtatatctataactgggatatccacttttaattaagctgagcactctttcagaaaatccttttaaatcccttgttactaaactttagccacaccaagcagttaagattttcagcttttgaatgtcacaaaaagtaacctcacaggtgagaccaacaagccttaattagtttatgacttaacctccagtgtacaaggtattttcttttttctttttttttgagacagagtctcgctctgtcgcccaggctggagtgcagtggcgccatctcagctcaccgcaactcccatctcccgggttccaatgattctcctgcctcagcctcccaaatacctgggattacaggtgccagccaccacacccagctaatttttgtagttttagtacagatggggtttcaccatgttggtcaggctggtctcaaactcctgacctcaggtgatctctgcctcccaaagtgcagggattacaagcgtgagccaccgtgccctgccaggtatcaggtattttcaaaggggtgataagtaacttttgaaactctcattgcaaaattgtgactgagacagtgaaagagatcagacccaaccaactccattttgtttttagcccctaagctgtccttgctcatcactgggcataggctgaaccaactttgggaggtg

SEQ ID NO: 46972 - DNA, 1028 bp, Homo sapiens
tgaactcttagcctcaggtgatcgtcctgtctgggcctcctgcaatgccatgattactggtatgagccatcacactcggcttcaggggtatatatatattttaagacttctgtcaaacttcttaatttattttcagaaaagcttttccggtttgtactttcagtatttgagtgtgctgtaccaacattaagtattcttattttagaaaatttttgccaatttgacagaagaatggtataccattgtttaatttgcatttctttgattatctgtgatttgaatatatctcataagtttataggtcacttatacttcttcagctaatattacatcaaagagactttgagaatcatagaaacctagttacacttatgctattcctataagattgtcagtcacttgagggaagaggttatatagagtcatctctgtgtcttctgggctggctgagtacatggccatatgtacttaataagtgtttgatgacattgctattgctgatgaggcagtaatgttggtagtgtgggtgggagtggatatgaatctgtaccttatttggcttagctgcagaaaaatctgggggaggaggtgagactttagctctagaaacggagattgcggtggcagcgggtgggtgggtgttccaggtggaagggacagttcaggagaaggcatggagataggccaggaagaaggcttgacaggagctcttgggttgttgaagaaagctgaggaaggagagccttggtaagcagagacagaacagcaaatagatgagaaggcctgggtttaaatggagcagtctcaggagaggtaggattacagctgccagcctgagaggtagatcagcattttcttaggggcgatcattaagacagagaacgaatcgaaactcttctgcaaagttccgttctcacttgttactccctcccaagaaaagtgacttccttcttgttctataattgaagcctcaaaaatgggtccctaggggaaaaataatgaggcttaaggagagggcttttgagaac

SEQ ID NO: 46973 - DNA, 1040 bp, Homo sapiens
cttgcttgggtgggcatcagagaaggcttcccagaactatgccttggaggaagagttggattttcctctatggaaaggaggtgtgagatgctatttcaggctaatggaacagaatgagtaaataaaaatttggggttttgagtatgtgacgtctttgtgaaacaagacaattagattgtaggaatgtatatggggtcaagaaagagggcagaggagaggaatttggggatttgggccagatcatggagagccgtgacggctctgtcaatggattgatttgattttaatctttaggcattatggggaaacctgtggagaacagaaggacacaatcaactttgacatggttgtagaatatatttaagatagtgaagggggagaggtacatttccagtttgagtcatggggtcagttaaaggattgtttgcctaattttcttactcaaaaggaacacattatcctgggggggttgagatgtagatatggaagagatatgtccccattccagggagtgtctttctcatctttcccaccttcctggagctgcactgttttggaggattccttgtcacctagtccaggacaggtgacccattaagtaagcagaaatagcttgaaaaattgggaacctgtgaattcgattcttgaattctcccctctacttgtgatgtgacatcaatgggcctttaaaagagaaaagaaaatggaggggcactaatggaccaaggtgggtggactttccttacagaaggaagcctgtgggcctatccatgtatggcctagaaggcaatgtagtctctgatgaataggaaaggagtaatctctgggctttatttttatcctgttatggcttgatcgggcccttctggaagtgtcagtttcctttagagtattgtcctgggtttgataaataatcagatttgggattgcagtcatggttttatcatctagatcactgtgatttctattaggaaagcagccagtcgatgcccccaggcctgtagccattcagcatcctggtcctggacttaactccaggc

SEQ ID NO: 46974 - DNA, 1045 bp, Homo sapiens
aaaaattaccgggcatggtggtgtgcacatgtagtcccagcaactcaggaggctgaagtcccagcaactcaggaggctgaggcaggagaaccccttgaacctgggaggcagatgttgcagtgagctgagatcatgccactgcactccagcctgggtgacagagcaatgctctgtctcaaaataaagccttggatcatagaaacccagtgtggggaggggctcctgatctggatggattaagcaatacaatttttttttaacagtatctttttaatggccttttctactttttcctgtctaggcttcctgttaagacctcagttaccccagaacaccctgggttatttttctcctcacctccaatacttcagtgttgccagataaaacgcagagtgcccagttaaatttgaatttcaaataaacaacagggagtcctgtatttttacttgctaaatctggcaagttcatgggagggcttatgtgttctatttttctctctgggcttatctgcaaatttaggataataactcacccttttcttcctgttactcatacacaatgactatgcaccctgctaaaagtcacttgactgaagagatggttcacttcatgttagggtaagggcaggctatctagaaatggtcttgattgatcagtgttgaagttacccaggaaaaaaaaaaaacacccattcagacattggcatttaatataatttttgtcaaatgagtccgtcatacgaaacgagagcatcattttgagtagccagatgtcaacattgctctgatagagctaggtgatggggtagaagggaatcctaacaacaacaaaataactcagcagaacctgtgctgtaccatatttactctttatggtggtaatatatatatatataacatagaatttaccattgtaataattcttaagtggcattaaatatattcacattattgtacaaccattactgataacaatctccagaactttttttcatcttcccagactgaaactctgtaccagtaagatgctaactccccatttctcc

SEQ ID NO: 46975 - DNA, 1015 bp, Homo sapiens
cagccaagatcttagttttaagtgaaataagaaagtcacaggacaaatatggcatgattccacttgtattagttatcaaaaatagttaaaatcatagaagcaaaaatagaaggaatggtggtggccaaggcctggggtggggtttgggggcgaatggggatttgctccttcatgggtataaagtttcagttatacaagctgaataagttctagagatctgctgtacaatgctatgcttatagttagttaacaatatgtgctgtacacttaaacagttgttatgaagttagatcttatgtgttttcaccacaattttttttaaatcttagtctttagttattcacacaagttctttacacattaaagatatatgcctatatgccttttgttataacaaatatttgcttgccttttaattttgtttgtgatttttgacatacagaatttcataatatctatatggttaagtctttagttttcttttgtaatttcattactcctttcagcaaatgcactgggagtctatgtcttgagtctgggactgtggagctcagatctttctgaggaactctttgtatgcacatggttttctctaactgagatcccttccttagtccccgaccccaccacatatttctactcctcctctaacagttcagtcatttgaccctcctgaaacttttcttgattacctcatgcaaacttgggtatgatttccactatgccttcatttgaccttgtctggagctccattataacaattaacaaattattttatataaccataaactccatgaggacaagaatagagtctttgaatccagggtctctcagagatctagagagaaattgacctctttcatttaatatatgaaattcttcatatattgaaaatgattgaaatccaaaccactattataataattttagtatattttaaatatttgccttaacaaattaattttaatactgtaatgattgtacttaggacagaaacaacataatcatctcagtg

SEQ ID NO: 46976 - DNA, 1049 bp, Homo sapiens
ttcgagaccagcctgggcaacatggcgaaaccccatctctactaaaaaatacaaaaattagccaagcatagtggcgcatgcctgtaatcccagctactcgagaggctgaggcacgagaatcgcttgaacccaggaggcggaggttgcagtgagccgagatcgtgccactgcactccagcctgggtgacagagcgagactctgtctcaaaaaaaaaaaaaagaagaatttggtgttgaaaaaagaaagagaggactatctgacgtccttggattgacatgcagtgatagcctctgctttctggtaccctgatattccacctctcacccatacccccagttatggggttctcaaagacttcagtctctgtggagctgagcaacaccactcaagctcctacagcaactgccactgtttttaacagctttattgaaatataattgacataccatacattttgccatttaaagtatacaattcaattgttttagtatattcacagttgtgcaactatgactgtagtctaattttggaacatttcatcattcccaaaagaaaccccacacccattagcaggcactccccatctctctgcctctccagcctctggcagccactgatctactttttgtctctatagatttgccttgtctggacatatcatgtaaatggaatgaaacaatatgtgaccttctgtgtttcttctttcacctagcatgttttcaaggttcatccatgttggagcatttatcaggacttcattcccttttattgctcaataataattcattgtgtgtaccaccttttatttatcccttcttctgttgatgaacattttggttgctcctagtttttgactatcatgaataatgctactaggaatactcatatacaagcttctgtgtggatgttttttgtttctcgtaggtatatacctagaagcagaattgctggggtcaaatagtaactctttaactttttgagaaactgccagaactcttttccaaagtggttgcaccattttacagtgccctcagcaatgtgtgagggt

SEQ ID NO: 46977 - DNA, 1108 bp, Homo sapiens
cagatgaatccccaaggaaccctggatgctccggctcaggggaccagcactgccgctgcagtagcacatccagtcagtccgaggcagctgaccagtccatgggctatgtgagcgactcctcctgcaacagttcagatggtgtgctggtcaccttcagcaccctctacaacaagatgcatggcaccccccgtgccaatctcaactctgccccacagtcctgcagcgactcttccttctgcagccactcagaccctggcgccttctatctggatctgcagccctccccatttgagtctaagatgtcttatgagtcccatcaccctgaaagtggaggaagggaagggggctatggttgccctcatgcctcttctcctgagcttgatgccaactgcaactcctaccgcccacactgtgagccgtgcccagcagtggctgacctcacagcctgcttccaaagccaggcccgtcttgttgtggccacacaaaattactataaacttgtcacctgtgacctatcttcccaatcatccccaagccctgctggctcttccatcactagctgctctgaggaacacaccaagataagtcccccaccaggccctggcccagacccaggccccagccagccctctgagtattacctattccagaagccagaagtccagccagaggaacaagaagcagtgagttcctccacccaagcagcagctgctgtgggccccactgtgcttgagggacaagtatacacgaatacttcaccccccaacctcagcactggacgtcagcgctcccgcagctatgatcgcagcctgcagcgcagccctcctgtccgcctgggctcgctggaacgtatgttgagttgcccagtgcgcttgagtgagggccctgcagccatggccgggcctggctccccacccaggagggtcacctcctttgccgagctggccaagggccggaagaaaactggaggctctggctcgcccccacttcgtgtgagtgttggggactcctcccaggagttctcacccatccaagaagcccagcaagatcggggggccccactggatgagggcacttgctgtagccatagcctgccacccatgccttt

SEQ ID NO: 46978 - DNA, 1087 bp, Homo sapiens
tctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggctgaagagaagatggagtgcgagggcagcagccctgagccggaacctccagggccagcgccccagctgcctctggctgtggccacagacaacttcatcagcacctgttcctcggcctcccaaccctggtcccctagatcaggacccgtcctcaataacaatcccccagctgtggtggtgaactccccacaaggctgggctggggagccctggaaccgggcccagcatagcctgccccgggcggcagccctggagcggacagaaccctcgccacccccttcagctccccgggagcccgatgaggggctgccctgtcctggctgctgcctcggccccttcagctttggcttcctgtccatgtgcccccgccccacaccagctgttgcccgctaccgcaacctgaactgtgaggcgggcagtctcctctgccaccgagggcaccacgccaagccacccacacccagcctgcagctgcctggggcacgctcttagcagtggagcccgtggtctcaggcctccaactttggccttcaggacaccctgtaagaacagagcacacttgctggacagtgccagttccagatgggctgaccggctcttctccccgtgtaggggagccccagcatggactcaagggacagagcacttccagtcgaccccccggctcgcgttcccgtggggatcactgaaccagacacagcattgctgacacatgagactaacacgtgcaattatttaaaaagatttcaataaaactgcctggctggctccgggccgcccctatccgctcagcccgtgcgccctcctcccccaccccattctaccatgggaagttcttg

SEQ ID NO: 46979 - DNA, 1027 bp, Homo sapiens
gtgtcacatgtgactcacgcccggcaccaggaatcctgcctacatacaactagaaccagcttctccctcccaatccctctcagctccaccccaggcttctgtacagccattggtgagaccctcactgttactggagaagggagagggggacagtaaaatgctgtgctaagggagggtgtaatggatcctgattccttatacacactcccagacatacccacgtctagcctctgacccggaacagtttctcagaccttcaacctcttcctgtttcttagatgcactgacccctaaactcctaacagcttgatagaactccttccccacacctacctactaggaccctgtgatacactgatttttgattacttcatgctacctagacttgactgcctcactcttaggttattaggtacttaatactgctatcttcagctcacatctgtggtagtacccattgcttcagaaaaacccttaatcacagctccctgccctgtgacttttccctgtcttcctgaacacagattgttttcttctcattcactaactatatcctgtcattggcttttactcctgctagcttctgatgcttctaccttaatctttttcttccatagtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggca

SEQ ID NO: 46980 - DNA, 1031 bp, Homo sapiens
tctttgccaacatacaccactactgcttcactgattttttttttttaagcccacagtcctttctggctcttttccacctttaacactcttatgttgaaatcttccgtttttcctcctttctctttagtaagacctcaggtttttaaaaaagctaggcttgattgtttattctgcatggtccacttctgccttccttcctcttctattacccttttcttattctagactgtttttaaactcagttatgcttgctttcaccaaagccttaacctttcctgtgattagaaaaagatgcttatgtttccattacttttcctacaagaaaacgcattctcaaattcatatccacttcaaactctcccaacgttttgcatccagaagcataaagtggccattattgtgaagtccactgagtgaccatttaagcttggtgttatgccacacactgtatagtgaatttcataatcctggtgccagatttctaaattattacagacaatagatgatggactgggcacagtggctcacacctgtaatcccaacatttggggaggccgaggcaggcagattgcttgagaccaggagtttgagaccagcctggccaacatggtgaaaccctgtctctaaaaatacaaaaattagctgggtgtggtggcgcgttcctgtaatcccagctactctggaggctgggatgggagaatcactggaacctgggaggctgaggctccagtgagccgagattgcatcactgcactgcactccagcctgggtgacagagggagaccctgtctccaaaaaaaaaaaaaaaaaaaaaaaaaaaaaaaaagaattctttgctatgaaactgaaattgcttctccactttcccttccctctcatgatctctcctcagtaaaaccaaggtgcatttttctggacccacctatcttgggggtgattaggagtagagggttgtaaatacttaaaatttttttcctttctgatataattattgatctccttctagaagtcctgtcgtctttgctggagaa

SEQ ID NO: 46981 - DNA, 1034 bp, Homo sapiens
cgataaaattccttctcatggaatacacaatctaatggggcagaaagtacctactttaaaacaaatgtattaaattaaattgaaaagtggcctgagtaagcctcaaaaaagactaattagaactcaagggaagagaaaacatttcaggctgacagaaaacccatgggcatagaataacatgacccacttagaggactatagatagctctatatgtttagaaggcatatgtggctgcagaggaggctggagaggaagatggagccaggaccacctggtggactgagattcttgttctccatcctgcaggctagtggctctgaacagcagtagtacttttcctggaggggcattttggtccgtggtgggtgcgcaggagatagtgggggtggggggagggggtgggggggcaggcaggagggggtggaggggaaggggcattttcttggttgctatagtgatgagagtgggtgctactggcattgtagtagttggaggccgcagatgttagactctgcaatgtgaggacagttccacataattaagaatgtattccatgagagaaggaatttcaccttgttttggttgttaatccttgtaccttgacactggcaataccttttaggtgtcaaataaatgtcctgaattcggcatgatttagatatcctgagttctgcacagtcttcaaatattccaccaaacagttgtgtagggtgttatatataaatatatatataaatacatctgttctgttattgcttatcctaacactggtgtttaatccagtatctttctttatggagtggcttcagatctcttaaatcaaaatttattcattccctgtaattagatggaagcatctaattacaattagctgagtgcctcctttggtgttctatcacagttatatccaaccatttacatattgaaatacctgtttttaaaataagttattgtcttttatttctctcgtttttttttttttttttttttgagatagagtctcactctgttgcccaggctggagtgcagtggt

SEQ ID NO: 46982 - DNA, 1292 bp, Homo sapiens
tcctgatacttttagagcagggctgaaactcggaggctattttacagatggggaaactgaggctcagggagggagcaatttgtccaaagtcagagagcttgtgaatggcagtgtgctggggctagaaaaaaggtttcctaattcctatttcatactagtgtgtttttttttatccactgcaatgtatacttaatagaaaaatagacccaagtggggaaaggctcaaagcataacctcccttctccccggtctgcccacaagggtgctttatccacaaactgttccttatttgccaggcgtcagccaagggccaccctccggtggggaagtgacttggacagaagagagagaggtccaattttttaatggttggaatgtgggaggaggagggggtgtcctggtctaggggatgtgccatgaagatggctccatcatggagtgactgtagtcttcatggcccaagtctgtagccacctctggtgggtgtcactctagataggatggagatgtgcctgatggagtctttggaaataacagccaacagaacagctggggggtggagaatgggtatcagtgagctctgggggcctggttcagtgtacaaacttaaggagacgaatgcacgtgaaaggtcacaacccctgcagagatgtctggtcacttatgtgtatgtgtgtaactgagggattgtggggaggctggcagcatgtgtacatgcttgtgtgttgttaagtgtagacacgtgcatgtgtgtggggtgcatgtgagccagtgtatcttctgagcgcctgtgttatggtatgaaggggaggggacatgttgtggcccatgtacattcctcttcagctctgcctcctcctcatatggacagatcactgaagctgtgaatggggctggagaccctttctcagcagttccaagggtgagggcagtgttgcatgcctcccataacgaatataagttatccatccatccccagccagtgcctttgaaggaaggagctgtggaggcactctgtgttgattactgctgctggcaaattggacactgggcagaggcagtagccagtcaggttttcagttttggtaaggggaagtttatgctgttgggccaagttcctagcttccatcctctgccatcatggcttcttcatgtgcccattgagcaagcattgggctggtgaggggagcagggtgaccgacagccacagagcatatacagctgaaagttgtggataaaaacactgttgcccagaagcaggttcaggtgctttggggagaattgtaatgaag

SEQ ID NO: 46983 - DNA, 1026 bp, Homo sapiens
caccgcatattctcactcataggtgggaattgaacaatgagaacacatggacacaggaaggggaacatcacactctggggactgttgtggggtggggggaggggggagggatagcactgggagatatacctaatgctagatgacgagttagtgggtgcagcgcaccagcatggcacatgtatacatatgtaactaacctgcacattgtgcacatgtaccctaaaacttaaagtataataataattaataaataaataaataaataaataaaaatttaaaaataaataaataaaataaaaaggaagttggaaaatattctagacaactgataaatctagaggataataagttttacctcttcttatttcttatagaaaaatgccacaaaaacttttttttttttgtcaaatagattttctcctcaaaaagtgaatcccgactaaaacatctgttgcagcgagccccagattattgcccagagacaatggtaagtcttattgtaacttaactgtagaagcttctgtctaaatgaaactatccaatgaattactttcagagttagcaaatttttaaatgtgattggaatttgtggtcaaaataaaatgttaagtttaacttaaatacttaaaaaaaatcttcatataaattgctagatagaatattgtttttcttcttttattatcctatgatataaatctaaaaacaatcttaaatataaatgtgttcctatctttaaatttcattatagtattttatctggggtcgggcgtggtggctgatgcctgtaatcccagcactttgggagtctgaggcgggtggattacctgaggtcaggatttcgagaccagcctggccagcatagtgaaacccgtctctactaaaaatacaaaaattagccagacatggtggcacacgcctgtagtcccagctactccagaggctgaggcaggagaattgcttgaacccaggaggcggaggttgcagtgagctgagatagcatcactgcactccagtctgggcagcaga

SEQ ID NO: 46984 - DNA, 1048 bp, Homo sapiens
tatctggaacttagaattttatttattattatagtttgactaattttatgaaaactataataactaaatctgtttattttgattttggaaaattgaatttgggataagggaaaatatatgacttattatcttccaattttctgacatactgtagatatattgcttacctatctgaatcatgtaactttaagaccttttaaaggtctctaatacttgggctgtcctcagtgtttgggatgctcatgtgccagaccaagaaagtgtgagtttgtttgcaagagcctctttagatatggtggcttatattatgtgaaggggaaaataagttgatgattaaatagttctgactgacacattccctttagtcttcagttttgtctataggcttggaaacagtgattccagtaagtatcctgagtaactagactcatcgttaatgctctcagatgggaaaagaacaaggaatatttctgtatctcagctttgttccccccgaatagctgattgatgtgcctgtagttctagaacattgactgtgtagacatagccataatcaaattagctgttcataatttctgtagaaattaattgtcatatttaggaactggttatctacataaaagccttttgttgggtacacttttaggttgaaatttggaattgtatgaattcatctttgccaggtaagcaataaaagtgtaacatttagcacttaattttaaaaacttactgtgtgaatgtaaaattggtgtcattgtcctggaacctaatttatactctggagtttctatcctctccttcccttcaacacctaaattttttttttctaagacacagtcttactgtgttgcccaggctggtcttgaactcctggcctcaagtgatcatcctgccttggcctcccaaaatgctgagattacaggcatgacccaccatgtccagcccaaattttcaaatacataatttattctcattcactcagtccttaactttgttctcttgtctccacttctgccattctactgaaactagtctttgaaagattacc

SEQ ID NO: 46985 - DNA, 1065 bp, Homo sapiens
ttgaaatgacacattatttggaaggctgaagaaatttaataatcacttgtttagtgatatttccaagtcatgacattaaactccttacatattctagtcatctatactttttgacattcatggtatccacaaggaaaaaacaccttgtagaggtttaaaaacatttatgtttttaaagaacagttatatttaacctctcctacttagcatttcataagctggatttcttctatgaaatgtgaaactttaaactggaagaaatttcaacccatctgtgaaaaggaaacagatttttatttattgaggccttagaaacaaagtagcccctttacttttaagtaatagcatagttaagtagaaagtactgggcatataaaacattaacataacagttaataaaatgtgctcttttgggtctttgtccaaaagtaactaaatcatccaaaattcaaacctgtaatttttttttacaagattcatatgatcagtgttttgttgtcatcatctttatcattgatgaaaatgagagagagctggagtagtcagtagtaaaagggcagtggacagagaaaggattgaaacaagtggacaaatggaggaatgaaccatttttttcaaatccaaaagccaaatcaaattggacagccagatatacgtagcaagcaaagggcagagccagggctagaacccggactgccctaccagtgctcttccatgacactgcgttgtgagaatagtctggtctcactgtattgcaatggactatttggatttctctcttctgaatgcacccaaagcaaggttgaatgtttgttcatagattaatctatttaaccagtttcctattttaaaaatcaatagaaaagggtcactgaagtggcagaaaataaattgcagagcgaacttctgggctagaggttggaccagcagagtctacttcccaggtgcacccaaagggtcttccccaccaaaaggaaaaccagtgtggcatgaaggatcacatagggttccctcaactttgatttactctgtttttgtgccaggtttgcccacagttcatatgct

SEQ ID NO: 46986 - DNA, 1050 bp, Homo sapiens
tggaatcttttgtggagctttaaaaaaataccaggctgggcacagtagctcacgcctgcaatcccagcactttgggaggccgaggtgggtggatcacctgaggtcaggagtttgagaccagaatgaccaacatggagaaaccccatctgtactaaaaatagaaaaattagccaggcgtggtggcacatgcctgtgatcccagctactcgggaggctgaggcaggagaatcgcttgaacctgggaggtggaggttgccgtgagctgagatcgcgccattgcactgcagcttgggcaacaagagcgaaactccgtctcagaaaacaaaacaaaccaaacaaacaaacaaaaaatgcctgagtctctcctccagagacagacacagttggtctgaggaaggacccaggcattagtatttgttaaatgctctccaggtgaggctgatgtgtggaacatggatcagcagtagcatctggaagcagaaatgcagaatcctaggtccctctgtagacctactgaatcagaatctgcccattaacaagattcttgcacacatttgagactgactgctctgaggtccccgctcctggctctggcccggagagcagcagctcccagggaaacgcctgcccatatcaacacgtgtggggacagtggatgccccaggtgaggtccctcctgcccacagtggagatccgtggcttaccagcctgattgtctttccaaatatggatgtttcaagagctgcaaatggggtgagatgacagtatagtctcctagaaactcggagcatcatcagaaggcccttgcagtacattgcattcaaccttttcattgtacagaggcccagagagggaaggctttgcccaggattacacagcaagtcagtgtgtatgggttgtgggggataggtgcagattccctgaccccaggccagtgctcttcccagccccccagaaggcccactcttcagcctggccatgctcatgggcaggagtccctgagtctgcaaagcagcgtccaggatgtgtcagctgactggggctttctca

SEQ ID NO: 46987 - DNA, 1060 bp, Homo sapiens
ttttgagacagtcgctctgtcacccaggctggagtgcagtggtgcgatctcggttcactgcaacctccgcctcctgggttcaagcagttatcctgcctcagcctcccgagtagctgggattacaggcgcccaccaccgtgcccagctaactttttgtatttttagtagagacggggtttcaccatgttggccagactggtctgaaactcctgacctcaggtgagccacccgccttggcctcccaaagtgctggaattacaggtgtgaaccaccgcacccggtgacaagttatttcttgtaggagaagaaagagacatgggtgaattaaagggaagctttctggagaagtaattttattggtagcagtggtggagggaagtttagggaaatctcatgcatgatagttaattgtactgcacatttgctgtataccaggtacactttcagatcccagcagtagctccacaggttaagtggtagtgtcatatttcagatgagaatggatcggtgtggaagttgagcagtgtcactaaggtagcaaggtaataaatggctcaagtgcagcttcaaacgtaggtctgcttgacttcaaatgtttctggaatgtggaaagttgaaagtgggtttgggacagtctttcacttttgaaaactggccctttttctgtctggagttcctgaaaggccctagaaagtttccttctgaagcatcgtgttgcttagtttagttgttgtagtaagtcaaggccctacatgtcctttctgcatgtttccacagcaacagacgatcccttggcttgagccagttgattcttgtaagaatgttagtgcagtaatacagtaactaataaagaggaaagcagatgccagtgggtctggaggagccttcagacagcatgtgatttttaaggagatgtgggatgaggattgcttcttgttttgtatatggagtagtgatcaaagtctctcatattccagcccagggctggactatattagtggatagttggtatgtcaattgtactatattaaccataatgtaggcctggccagactagcca

SEQ ID NO: 46988 - DNA, 1035 bp, Homo sapiens
aagcgattctcctgcctcagcctccccagtaatccccagtagctgggattataggcatgcaccaccacatccagctaattttttgtatttttagtagagacgggattttaccatgttggccaggctggtctcgaactcctaacctcagatgatccacctgcctcggcctcccaaagtgttgggattacaggcgtgagccaccacaagcagccggcatgtatttctttatctctcactatctactgatgtatgtctcttcagcttagtgtcttagagaaaaccatatttagtcctcagaaacttcatgtttcatgtttgagaatccaatctagcaaacctgctaggtatgcattttcttgctgtcatttctagaacctttaggttaactgttagcaatgatcccatacctctaccccctgcacttctctccagtggagtttcttttgtagctctgccctggctctgccacaaacacactgcagaccaagtaggagtagatgctttgtggtcctctctagtgctaatattctgtgttctatcattctctggttcctgaatcatctctacctttggtaattgtcctaatagcaccctgcctcacagaagtgcttctaccatatttagttatgagagtgccaccttgtgttccacaaaaccattgtcaaacctggaatatggactagtttgggagaagaggtaaaagattaagatgaataccctactatgaactaatattggcagcattggtaaagaatcatctataattgtttctcccccaattggtgcccagaaggcttttttcctattaataatagaagtcagtatttccacatacacccttctcttttgctctgcccaaaacaagacaaaacaaaactaatgacccactaagatgtcagtggactgggataagaccaggaataggactgtgggaaagaccaggcaggaatagaagcactgaaatcagagttggttgtgcaaacagagaaaacagaagtttatcttcccctctctactcttctcccccaacaggca

SEQ ID NO: 46989 - DNA, 1029 bp, Homo sapiens
ctattgtttagccatcccaattgtagtgagcttagctctctgagagtttggttaatatgcataacctgtaatggtgtgattcagccaagggaaaagttactttccatggaaccctgaaacgaaagctgggtgtcatgaatacacccagatctagttactttggatatgattatagacttggtcatgttgagtctcctcaatatagccctgccccctgaaagccacttcatgaaggggtccgttggcaggaatatgtgctttgtaattaggcagccaaggatgttccaacatgattattttagaattgagggttctgtgggtacttatttgtgccttaaaaagtcttgaattgacttcttaaaaatgttctgtttgaaatagattttatttagttactgatggttaaggagttgtgaggagaaaaacgctttcattctcatatcactactcaccagcagctgggctttaatgccctacacttagagcccttcttggaagcagcaaagagaggatatgtggtgttgcttccctcagggcaggcaggttcagagcccaactttcactgaatagtcaatccattcacttcagtgtataaacgggccagaccgagcctggggatatttttaattttcagggtagagccttgggttctcgtatgcagaggcaggaagcaggttgggttaagtgcccttgtctctggcagctctgttagacagagatgtggcaggagagagagctaacggctttgccagccagccagtgctattgtgggtccagtatgacagagcagttggactctcttttatatgctagcagcccttcagctcattggattccggcttgagcctgtgtcctggtcactttcctctgggggcggtgtgctcaaggagtgcctgtcaggttccatgtggagtccacaggactccacagtcccagtcccacaggactgctctctggtgtgcaggctgggttgccagtggtgatggcttccatcagctacgtggggctgttgttgagcctgtggtcagt

SEQ ID NO: 46990 - DNA, 1074 bp, Homo sapiens
gctacagcctagaacagttaagtaaacctttctcactgcccctaactgtgtgtgccatgaagtcgcagtgttgtagtggctctgggcttcagcggtgtttgccacggccatccctgtgatagtgccacccctccgtccccacagaccagtcatctccattgcttttgctttgcccgtgatgcttgttggagtagatgaatatagtgtgtcttagcgctgtcctttccggctgtagctcccaccagttaattccgaactgggggtgggctgaccttgatgtgaaagaatgttggagcagcatcctgccaaaaagcaactcacgttggctctcctgccagtgtgccctgagtggccccaaggcacctggctggagggaaaatggcaaacttttggctgaactggagaatgtcctaacaaacccccttccagaatggctttagtctctagtgcttgctagcatgggagctttgtcttgaattccttttgatctgccccgtttctctccagccttaggaataaatctagaggctattgtgcaatgatctgtgggctttttagaagtctctaaatttccttgaaattcagtacagcccagcataaactactcaagttcttgatcagcctgctgctttgttcttattaataaaagcagtgtgtagctggctaaggacttgttttattaatgctccacaggagcagagacagacagagagacatagtgagccttgaaccaaacacctgtattccaacattttacacagcggtctgggcaccctgtgcctaggagagccagctacgtgtctacctgagtctgacctgggccaggggctgttatcttgggaaagccagaatgtcattaagaaagggacaaataggcagttgcttgtgtagcaaggcagccaccaggttgctcaaagggggttctgcataaaccaacatattttgttgttgcttccagggcagcagaagaagcctttgtaaatgacattgacgagtcgtccccaggcactgagtgggaacgggtggcccggctgtgtgactttaaccccaagtctagcaagcaggccaaagatg

SEQ ID NO: 46991 - DNA, 1062 bp, Homo sapiens
cagtagtgcctcccctggcagggttatttgaggaacggaatgagatcatggacataaagtatttagttaagtgctggccacagtaaatgctcagtaagcagcaggtatttctgtggttatctgtagtccttgtcttctgcccgtcaccaactcagatcaatctgcctcctactaatctgctagaatatctggaccctgaaggagaaaaatccccagctgtgcaaactgcaacctagacatcaactggtggtctcctgtctcccctgggccctcacagctctcacccattctctctgactgcgcttttctataccttcaccaccttcccagtccttctacccccactgccaacagacgagcatacttcttacctctctcatagggggcaccaccaggcagtgatcccctacctttttgcttcctgtcccatacacccatcatctcggctcgccatgccctctcgtggaccctctgcctggctttgcagctcatctcttcccacctcttcagaaccctactgtagggctctatacacttctctcctgcactctcggcctccactccccatctcttttccttcagcatatgctcacaaattggttttgggggccaaaaatctacactgtttttatgtatgaagcacagatatactacacatacagtgcatgtatgtgtgatatatacataacatgttttgtccatttatttcttcattaaaatgtgtattaagtaccctccctgtgatactggctgagaaaacaaaactgaaggaaatcttccctgctgtcttggaactctagacctctgtccaccaccacccctggggaggaagagtggcaatatgggtcagccaagaagactgtgcagttttagtgcgagggagccctgctctttccctaagaagtgaaaagggggaaacttctggcttcagtgttcagctgtctttggaatttccactttgaagtacttgtctactatttggttacttaattcctcgagagagggacaccaaccatcatggagcttttttgcctccctctgcaaggccattccagaggcgta

SEQ ID NO: 46992 - DNA, 1030 bp, Homo sapiens
gtatgctgtactcaataaagagcagaactgtaaaaatgcaaaatggaaaatccacacaactgatcacattctagagaagaggcagctcccttcaccatttgctgatacccctcacctgggcagtgatagtaatcagcatactccacactccaagctgttaccaagtatagaatttcaggtcttttgggtggcaaaagcccgatctgatgcctaaaggggtcttcccactgtcaagtctaccgtcttggattcccaaagaatttacttctttgaaatgttaatgatcagtaaaatagtgagacaaacattgtaaaggatccacaagtcaatactatcagcaaatgattacaagctcttgtgtatgtttctagtcttaccttccaactatatatacttaaaaaaaaaatcaatcgctcatatgggatataaagttaggagtttaggagttattttaccttcatgctgactattgcaactcggaggttcgtcccgccaagatcaacggccaaggcacttagagtttcaagaatatggtcaatatcttgagagatattctccttcacaggaggaaagcagaatttcttttgcagtggctcttgaagatcgatagatttgagaaacttcaaaatccttggaacagcatttccatccccatatatctttgaactgcaatatacaaaaagtcaattaaattatatgcttctgccatacatgttaagtggtagtgagggtataatgtaatggaaactgagacttcaggtaaaaataattcatgcttcttcctaaagtgacatcttcctgccgtgcacagtggctcacacctgtaatcccagcactttggggggctgaggcaggaagattgcttgagcccaagagtttgagaccagcctgggcaacacagacatagcaactctatctctacaaaaagtaattttaaaaatcatgtttaaagaaataaataggctgggtgcagtggctcatacctgtaatcctagcactttgggaggtcgaggctggcggatcacctgaa

SEQ ID NO: 46993 - DNA, 1057 bp, Homo sapiens
tcacctcggcctcccaaagtgctgggaatacaggtgtgagccaccatgctaaaataactcatttttttcttatatttttctttatttttttttcttcttgagacagtgtcttgctcttgtcgcccaggctggagtgcagtggcacaatctcagctcactacaacctttgcctccagggttcaagcaattctccagcctcagcctcccgagtagctgggattacaggtgtgtgccaccacgcccagctagtttttgtattttttagtagagacagggttttgccatgttggccaggctggtcttgaactgttgacctcaggtgatccacccgccttggcctcccagagtgctgggattacaggcatgagccaccactcctggcccttatatttttcaaatatgttaaaggtatacataaccctcaacaacattttttgttaaatctctgctctttgctctttcttcccatctgtttcctcacatccagtctgctcttttttctctcttaactaaaaactctgttaaaaaaaaaaaaaaaagttgtcttctccgcttcctccgtctttatagagaggcaggagagaacacttctaagtgtgccagggcaggaccttcttttttcaggcagataaaggagtggatccatggatagtattttttagaggtggggtcttgctgtattgtccaggctagacctggactcaagtgatcctcctgcctcagcctcccaagtagctggaactaaaagtgtgcaccacttggccagttttcatggatgattgttatgctttttcacttcctcttggttaatcttgacagacatcccctcctcccaataaaaatatccaggcatggtggctcacacctatagtcccagcactttggaaggccaaggcaggtggatcacttgaggccaggaattcaagaccagcctgggcaacatatttagatacccatctctacaaaaagaatttttttttaattagctggtcttggtggcacatgcttatagtcccagctgctcaggaggctgaactgggaggactgctttgagtcc

SEQ ID NO: 46994 - DNA, 1038 bp, Homo sapiens
cttactctgtcgcccaggctggagggcagtgacgcgttatcttggttcatcgcaacctccacctcctgggttcaagtgattctcctgcctcagcctcctgagtagctgggactacaggcacatgccaccgtgcccagctaatttttgtatttttagtagagatggagtttcaccatgttggccaggctggtcttaaactcctgacctcaagtgatgcgcctgcctcaacctcccaaagtgctgggattagaggcgtgagccaccatgcccagagacatttttatttttatttaattaattagcttattttaaaatacaaagatgaagtctcactgtgttgcccaggttggtctcaaactcctgggctcaagtgatcctcctgccctgacctcccaaagagctgggattacaggcgtgagctgccatgcccagcctgagctgttatttttattctgtccatttgataatctatttgaaagctatactccttgtgatccaatccctacattgagttgaagttaaataaacactggtcttgctctgagtcttaaagaaccatgttgatgtttactgtagatgtttactttaattgggctgcacaggagttttattcagagcatcatccagaaagcttctaaacatcttcacacagttctccttgtccctgtagtttcccaggtgttaaaaatctccttttctgtccctttgcacagggttctcaccccatcctgatgctcttctgaatcacctcctccttcatgcttctcctaaacagagactcattctgcagggattctggtgaatacaattctccattgagctacacatccttagaacaaatgtttaatgagcacctactgtaggctctgccatgaataatctttcacatttggttaggcttttttctgtctacagaattactttcatgtccattatttagaataggggtcatcaaatcttttctatagagggccagatatttttgcaggccatgtctctgtcacaacttctctgctctgcccttgtggtacaaaagca

SEQ ID NO: 46995 - DNA, 1053 bp, Homo sapiens
cgtgcgactcttcctttcacttgaacacttagaggctattgtaggattattagttggcttaacttcaatgttattgtgtctcagggagtagggaggcccacggaagaggggagagagatggggaaatagccggttggtcagttgagcaatcggaacatgcacacttattgattaagtttgctgtcttatatgggtgcgatttgtggcacctcaaaacaattacaatagtaacatcaaaggtcactgatcatgcctgtaaacctagcacttcgggaggctgaggttggaggatcacttgagtccaggaactcaagaccagcctggacaacataatgagaccctgtctctacaaaaaaattaaaaaaactagtggcatgcgtctgtagtcccagctactcaaggggctgaggtgggcggattgtttgagcccaggaggttgaggctacagtggtcgcaccacggcactccagcctgggcaacagagtgagaccctgtctcgaaataataatcacagtcataattataataatgaaaaagtttgaaatgctgtaagaatgatgaaaatgtgacacagacgtgaagtgagcacatgctgttggaaaaatggcaccgatagccttgctccaggcagggttgccataaaccttccatttgtaaaacgtgcagtatctgcaaggtgtgataaagcaaagcacaatagaatgagttattcttggactcacagagcataacacggggataaatacgcacaaatctatactgattaaacatcttgattattgaagtagattttacagtatgacttttttaagatgcaagatatggaatcagacctatcctcacattttctagtactgggttaacatttgtgtaaacttttagctactctagattagaaaatgtaacatcattgttccttatcttttcttatacaaataagactaggccttaggtctgtggctttaatgaaataataatttgtcattatttatgtcaaattcagcccctgctttactttcttttcttttcttttttttttttttttttctgaga

SEQ ID NO: 46996 - DNA, 1016 bp, Homo sapiens
gagcaaattcaagagttttctagaactgcattagcagtttttccagacacactgctgatctctaaaagtcaaccacgaggttattttccacaagtaagatggagatggtatgagtgtgactttgtatattaatgtgcataacagggccctacttagctctatggtttttaaaaaataaactacttaattttaaaactcagggagacaaaatcaataagatctacctaattttttttacaactaatttttatttattatttgatgtataattaacagtatatgtaacccacataagttgtgaagcataataataaaatacatatcatatacataataaaattgtgtatgactggggtcttagtttgggttttcctgatgactactgataattttttcatgtcttcttttttttttttttttttttttattttgagacagaatctcgctccgttgcccaggctggagtgcagtggcgtgatctcggctcactgcaacctctgcctcctgcctcagcctcccaagtaggtggaactacaggcgcgtgccaccacccctggctaattttttatagctttagcagagacagggttttatgatgttagccacaatggtctccatttcctgaccttgtgatccacccgcctcggcctcccaaagtgtgggggttacaggcgtgagccaccgcacccggcctttttttttgagacggagtttcactcttgttgcccgggctggagtgcaatggcacaatctcagcttactgcaacctccgcctcccaggttcaagtgattctcctgtctcaccctcccaagtagctgggattacaggctcctgccaccatgcctggctaatttgtgtatttttagtagagacgggtttcgtcatgttggtcaggctggtctcgaaccctgacctcaggtgatctaccctcctcagcctcccaaagtgctgggattacaggtgtgagccaccttgcccagcttcgtgtcttttttttttaaattattttttcttc

SEQ ID NO: 46997 - DNA, 1052 bp, Homo sapiens
agttgggattacaggtgcctgccaccatgcctggctaatttttgtatttttagtagagacgggattttaccattttggccaggcttgtcttgaactcctgacctcgtgatccgcctgcctcggcctcccaaagtgctgggattacaggcatgagccactgtagagcccccccgcctttttttttctgatacggagtttcgctcttgttgcccaggctggagtgcaatggcaacctccgcctcctgggttcaagcgattctcctgcctcagcctcctgagtagctgggattacaggcatgtgccaccacgcccagctaattttgtattttttttttttttaattttttcgatacagagtctcgctgtgtccccaggctggagtgcagtggcacgatctcggccactcccaggttcaagtgattctccttgcttcagcctttcaagtagctgggattacaggcacccgccaccatgcctggctaattttttcgtgtgtgtttttattagagatgggttttcaccatgttggccaggctgatcttgaactcctgacctcgcgatctgcccgcctcagcctctcaaaagtgctgcaattacaggtgtgagccaccacacccaatcagagtccttttttttttgagatggagttttgctcttgtttcccaggctggatcgatctcggctcaccgcaacttccacctccagggttcaagcaattctcctgcctcagcctccagagtagctgggattacagacatgcgccaccatgcccggctaattttgtatttttaattttgtgtttttagtagagacgggctttctccatgttggccaggatggtcctgaactcctgacctcagttgatctgcccaccttggcctcccaaagtgctgggattacaggcatgagccaccgcgcctggcccagagtccctcccttttttttttttttgagacggagtttcgctcttgttgcccaggctggagtgcagtggcatgatctcggctcaccgcaacctccacctcctgggttcaagcaattctcctgcctca

SEQ ID NO: 46998 - DNA, 1076 bp, Homo sapiens
gctgttagtattggagcttggaacaccacctgaataagtttattgctcattccatatgatgttttgtcacagagtgatttgccccggatcaaaacggagattgaggccttgaagaacctgagacatcagcatatatgtcaactctaccatgtgctagagacagccaacaaaatattcatggttcttgaggttagtagtatgttccagatacctgaaaacatttgatcactttatcaatagtaaaagagaaaagtacatttcacctgaaagattagaagagatgttaagcgacttacctgttttgttccatttgtaacaatttagattaaatagatgtatataataagttggagattcaatgtaaatgtcatttttctaatacacccctaatggggtagtatggtttactagatagaatatgttagaattttctcctagagggaaggactcattctagtttttttttttttttttttgagacggaatttcgctctgtcgctcaggctgaagtgcagtgatgccatctctgctcactgcaccctccacctcccgagttcacgccattctcctgcctcagcctcctgagtagctgggactacaggcgcccaccaccatgcccggctaattttttatatttttagtagagacggggtttcacgtgttagccaggatggtctcaatctcctgaccttgtgatctgccctcctcggcctcccagagtgctgggattacagacgtgagccaccgtgcccagcctcattctagttttatatggtatattaatttcctagggctgttggaacaaattactacagacttggtggcttaaagcaacagaaactcattgtctgacagttctggaggtttgaagtctgaaatcaaaatgttggcaaggctggttccttctggaggttctgagagggaatctgtttcctgcctctttgctagttgttggtagttgctggcagtccttggcactccttggtttatagatgcaccactcccatcttggcctccgtcttcaaatggtgttttcctctctgtgtagctgtgtctctgtccaaatgtctctcttc

SEQ ID NO: 46999 - DNA, 1031 bp, Homo sapiens
tttttttttggagatggagttttgctcttgttgcccaggctagagtgcaatggtgcgatcttggctcaccgcaacctctgcttcccaggttcaagcgattctcctgtctcagcctccctagtagctgggattacaggcatgtgccaccacgcccggctaattttttgtatttttagtagagtcggggtttctccatgttggtcaggctggtctcgaactcccgacctcaggtgatttgcctgcctcggcctcccaaagtgctgggattacaggcatgagccaccgcacccggcccaatatataaacttctatacatatacttcttcaatgaaaagcttaacaaaataaaaacagaatgctgtgtcaaatcacattttccttttgacttataaaataagaacctcctcttttctttttttggaagataaaattttggcttcaggttataataaaaccacaattgagatcacctactgtaagctttgttaaaatcctatatatcagagacagagagtagataagttgttgcttggggttaggggtggagagtgactgcctgtgagtatgggttttctttttgggatgatgaaaacattctggaattagaaagaggtgatgattacacaactttgtgaatatactaaaatctacactttaaaagggtaaatattatggtatgtgaattatgttcagttaaaaaatcaaaaaaatcacaggaaggaaaataggaaaattatttcaaagcaaactaacaaaagaagacatgtaaagaggaagaaagaacatcttgtgttccatagcaaactgaggtcagactagcagagcagcatctctgaatgcttcactctctttcttcttcttttttttttttttttttgagataaggtcttgctgtgtcacccaggctgaagtgcaggagtgcgatcatggctcactgtagccttgaccctctgggctcaagtggtcctcccacctcaacctccccactagctgggaccacaggcactgcaccactacatccggctaattaa

SEQ ID NO: 47000 - DNA, 1032 bp, Homo sapiens
ctcttccgcatcctggcagaagactggaggtcacaaggcattcttgtaccaaatacagctcagatgcggatgatgaacaattctgaaatggatgcgcaaagtcttcatattgaacagtgcaccaccatctcaaattcccttccctattcaactttgagaacgctgaaaccaggatttgtatcctatttgcagtgatggtggggaaaatattggaagatttatctccagggaaaagctaagataaatatcctactatattagtggttgggagttcaagttcctgtccgttcatcttagagaggagccttcaaggtattgagcagccccatcatacacatagaacctctcatcagctgtgtaacgtaattcttcacttttaagtagaaacagacaaccaaaaatcactagaaatttgaggaaaacttctaacatgaaagtcggagatcaaaacaaatggagtaaggtggggagaggaaagaagaaaaagtagatactgagaaaaaaaaaccccagatatgcagggagcgggagaaaatggctaaaaactgctaattaatattctcagataagagaagtgattttcattcttgacataggaataagatgaataaaaatgaacattccaagagatagctcttgaaaatctaaaatgtgaccacagaaattaaaagctcagtaaaagtgtttgaaaatgaaattcatttgaaatcttttaaaagtagaacctggtgggctaggtgcggcggctcacacctgtaatcccagcactttgggaggccagcgcgggcagatcatgaggtcaggagatcgagaccatcctggctagcacggtgaaaccctgtctctactaaaaatacaaaaaaaatagccgggtgtggtggcgggcgcctgtagtcccagctactcgggagtctgaggcaggagaagggcgtgaacctgggaggcagagcttgcagtgacccaagatcgcgccactgcactccagcctgggcgacagagcaaagtagaacagctaggcacggtggcttacgc

SEQ ID NO: 47001 - DNA, 1032 bp, Homo sapiens
gtaagatagaggtgaaaggaatccctagactgacaattgagtagctggctgagaagccggtccagagtggagcagaggatgcagacatcaggtggaatctctctaagtggggaagcagttagcagatgtgtgtgaacatgttgagaggaggtaaagtgttggaaagggtggagttcaatttgtaaggaataactgacttttatttttatcttcaggaaaaacaaaggtataaaaaaatggaaatgcaagaatagcaccctgtgtggtttagctgcagagctgatattcggccagcatgaccacattggttgttaaaatattagtgtatttatatactgactggtaaataaccactatcttcagtgccctccatgttgccctgttacttccctggacactactccctcccctcttctcacaattaaaagattaataattggaaaggcaggcgtctcccaggaccctactgacctcttggcctctattttgatggttgatgtcagggtaacaattaactattttgaacattatccctacttagttgtgaatgctatttacataatcataataatgcaaatattaacttagctaaacattgtgataaaattatagtaggaggatacagggaggagatgtgtgggaaagggagggagttgcagtagagttaaattcatatttctcatactaggaaatttatacatattatctgaagctgaaaaaaattttaagctatgtaagcatttagtttggaaatacagaattaatagcagaagaaatagctaaaagtgtttgaaagttgttccttagggggagtggaaattgtatgtgtgtggaggtgtggtgcactggttgctgtttttcatcatatgctgtgtaaacctattggcttttaaagttctgaatgttacactgaagaaaaaaattaattaaagatagaacatcatttccacaaacaagtaatcttctaaccaacttgattttcttttcctttagtggcagtatgatcacctcacggctacctatcttctgctt

SEQ ID NO: 47002 - DNA, 1025 bp, Homo sapiens
acaactctgcattagatttcatttcctatttgtataaaacctcaaggtcagcttgaggtgagatcttagatccttctaaagtgttttttgttttttatttttatttttttgagatggagttttgctcttgttgcccaggctggagtgcaatggcacgatctcagttcactgcgattttcgcctcctgggttcaagcaattctcctgcctcagcctcccatggagctgggattacaggcatgcgccaccacacctggctaattttgtatttttagtagagacgaggtttcaccatgttggtcaggctggtctcgaactgctgacctcaagtgatccacctgcctcagcctcccaaagtgctgggattacaggcgtgagccaccatgcccagccccttctaaagtctttcctgagcaaatgcacagccctgggtatgagcacatcctatacatgtacattgggcttgtagataccctggtatattttggagcttttccaattcactgtggacatcttattctctaacttttttttcagcatttttgttagtttattgtggtcaccagctattacttactgcttcggcagccacaatgtgcaacaattgcctgtaaatttttttttgtttttgagataggatctcattccgtcaaccaggctggagtccagtggtgtgatcatggctcactgcagcctcgacctcctgggcttaagcaattttcttgcctcagcctcccgagtatcggggactataggcatgcaccaccatgcccagctaatttttacaaaattattttgtagagacagggtctcaatattttgcccaggctggtctcaaactcctggactcaagagatccacccgcgttggcctcccaaagtgctgggattacaggcgtgagccactgcgcctggcacctctaaatctttttaacagatgctgctggggaaaaggctgttcatactgggcaggctctgagtaaggtcaaataaagacagctttcaggctgggtgcagtggctcacgc

SEQ ID NO: 47003 - DNA, 1054 bp, Homo sapiens
ttttttgttgttgttgttaattatgttttcgaaatcagttgggaacaaatacatatttaaaaatatttatccatgtgccacccagaattaccttgtctatcttgtatcacactatgagaagcactaccttaagaaatttgtatctcttctttgggccataggttcttattttgaaaagtaagatagttggatacttttcttcctaggcattttgttatttatacaatgaactcaaacctgaaagatatagaaactatggttttgtttgacagtgaaggtacttaccaggaagggagggatttttgtgtgtccaggacccactaaaacagtgcctaccacatagtaaacattcaaaagtagttgttgaatgaatgaaggataaatatcaattaggaatgaaattatctctgagaattaggctctcagtcaatgagaaaaaataatatgacatcacttttttaaaggaatacctgttacatttatttcctcatagaactgtcataaaatcagctcctggaactctataatattctttaaataatccagaaagagttaaggaaacatatccaactaggtacaaagcaaactttgtatggtgtttgtttatctttccgtggtatacatttcaggactgttaatgtctcttaaaatagtgtgggaaggggaaaataggcaaagctcaaacagttagatgggtgctctttaatatttatttctttaaaaggattggtaggagaggaagatgaaagtatgaaaaggaagctatgggtgtgtttactaataaccataacttctccaagctctcccagtgggccattaactcactaagagttgactgtaaattcctttgatattttttaggaaatagttccatttgaaacagtactatattgaggagttttggaactcttgatctggtgtgatggtctttgtgttgatgtaaaaatttacttctcatctcttctttttcttttcttagcttcactataacgtgactacaactagattagtgaatccagatcaactgttgaatgaaataatgtctattcttcca

SEQ ID NO: 47004 - DNA, 1003 bp, Homo sapiens
gagttgtagttttccttgcgggcgtagagggcacgaactcccggcttttgcccgataaatagcatctcttttgtacgagtcattcaaataatagacgcaatctaggtaacttcaagagaagatgggaaggggaaggggcaaagcatggaaggcaaatctaaagattatgggcggggcagagaaaggttcgcacttagtacgcatgcgcataccaggcgcgacaggtgggcggacacagaaggcgacgcctagggctgtgttgtcccggaagtgccttctctcctcccgggtctgcgcggacgcggcctccttacctcatttgtcctcgcccctccccgtccctctacgcgttttggtccctgtttggtgctttctgtttgcagctacggcagtgagtatgtatgtgacggaccccgagtcacccgcggcctgggacccctgcctaccctccgtctcgccagccgagctgtggaactagcgcgtgccccctcgccgacctcggcgtctccggtccgcccctcacttgtggtggggcgcagctcctggtccctcagctgcgcgccgccccacgcggccgggctgcgggtctagggggtccgcatctccctggctttccaagggctaaggtcgtgattctagggcggctgggcgtccagggcctcggtgggggtggcgtgtctgccctttttatctccccgcaaggcccccagtcttctagggaagccagtcagtgaagcgcggaggtccgggcgcgccgagagagagtccagtctttgaggaccgagtagtcctgggccacctcccgcctctgctgtcagaagcagcagctgccgccgtggaatccaaaatttcgggagctgtgaccctttcctcatgtaaaacgagtagtcttggacggtgagcggacagttgccttcaacttttgggaagagctgccggttcggtggaaaagctgtggctgggaatcaggaggcctgggttctagccgtggctcccccacgga

SEQ ID NO: 47005 - DNA, 1029 bp, Homo sapiens
gttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggttagtatcatattggccattttgaaagtagtatcatctttcataaggaggactgcttttcctagagaaaagaccaatagggtctactccgtttaattcctcactttttggtcttgttttttggtttgtttctcatgcgactctcttaccagtggctactctaatggtggtttgtctgaacgtcagaaagagtatgtcagaataccaaagacactctgcttctgctgtaagcagattcatagctgcttcttcctgtttggctagagccagttctggacctgaaatcttacttcccccctctctctctgcttggtaccacaggtgagtactccatccacctctggcattagccctgtgcactcattcagccaactctgttgggactgtctcttcctatgggatttg

SEQ ID NO: 47006 - DNA, 1034 bp, Homo sapiens
aaatctcaattttttttttttttttttgagacagagtctcgctctgtcgcccaggctggagtgcaatggcatgatctcggctcactgcaagctgcgcctcccgggttcacgccattctcctgcctcagcctcccaagtagctgggactacaggcacctgccaccacgcctggctaattttttgtatttttttttagtagagacggggtttcgcagtgttagccaggatggtcgcgatctcctgacctcgtgatccgcctgcctcggcctcccaaagtgctgggattacaggcgtgagccactgcgtctggccagaaatctcttaaccatgggagttaagtctcaaaattctggtgatacaagtggttgaaacttaaaactttgtttaaaaaataggattagtgaatttgagataattcataagtctgtgaaagacaataaatacatacatattttacatttactattactaaatttgtagtaaatttgagtacagcactacctctttatctgtgaaaacttcagactctcccctattactttaatttcagtgagacattattatattaaaaaaatggccaggcctggtggctcacgcctgtaatcccagcactttgggaggccgaggcaggtggatcacgaggtcgggagatcgagaccagcctggctaacacggtgaaaccccgtctctactaaaaatacaaaaaattagccgggtgtggtggcggacgcctgtagtcccagctactcaggaggctgaggcaggagaatggtgtgaacctgggaggcagagtttgcagtgagccgagatagcgccactgcactccagcctgggtgatagagcgagactctgtcaaaaaaaaaaagaaaaaaaaaatacaggccgggcatggtggctcacacctgtaatcccagcactttgggaggctgaggtgggtggatcacttgaggtcaggagttcgagaccagcctggccaacatggtgaaaccccgtctctactaaaaatgcaaaattagccgggcattctggcaagc

SEQ ID NO: 47007 - DNA, 1049 bp, Homo sapiens
cagcttcctgaatagctgcgaatgcaggtacctgccaccatgcttggctaatttttgtatttttattttttatttttttaaaatttaaaaattttaaaatttttatttattttctgagacggagtctcgctgtgtcacccagcctggagtgcggtggcgttatcttggctcactgcaacctccgcctcccaggttcaagtgattcttccacctcagccttccgagtagctgggattacaggcacgagccaccacgcccagctaatttttgtatttttagtagaaacggggtttcaccatgttggccaggctggtcttgaactcctgacctcaggtgatctgcccaccttggcctcccaaagtgccagaattataggcgtgagccaccgtgcctggccagttattgtatttttagtagagttggggtttcagcatgttggctagactggtcttgaactcctggcctcaagtgatccaccggccttggcctcccaaagtggtaggattacaggtgtgagccaccgtgcccgactgaaacgtactatatatatatatgtatatatttaatcatattaccataggtaaacaaattcccggtaattctttcatcatcacatacccagctagtgttcagatttcctacactggctcctaatttttttttcttacagattatttgaattcgatccaatccaggtattgtaattggctgttaaacttaagtatcctttaatgtataggttccccttaatctcttcctttttttaatttcttgtaatttgttgtaatacctagattctttgtcttctagaatttccaatggtctgaattttatagtattgcttaacatgttctactgtcctctgtctttcctgtgaattggtagttagatctagaagcttgattaaattcagattttctctctgttgttacatcatcagtttgacacacaggttcatttgtttcactttgcttttgatatgttattttttggaattatcttttaaaaatttggttttcttttataatcatgtaaaatgtgtataaggt

SEQ ID NO: 47008 - DNA, 1027 bp, Homo sapiens
ttacaggcatgagccaccacacccggccctctttcttaataaatagtggcatactatctactcttttctctaaccttatttttttctcttagccgtatatcctggcgatcaatccatagtcctatgtaaagatatttaatatttcttatttctaggactatgaactatttttgtatcttctacactaatctgagctgggcacattaggcatgtaataaatactttttgaaagtgaatgaatagtaatttaaaatagttgatgactaatgcacttgttacagtcttaaaatatattttaaacaaataaataattgtctaattccactttcagaagaaataagaagttcttattcctgtttgtaattttttttatcatttggtaattttgaaatatttaggtttagcaaaaaattaataggctcaggttttaaaaagaaaaatgccttctgcaaaaggaacaatatggtatttttaagagttgaagaaaccatattagttcctggtttatgactgttatggtatagaattttgtgtcaatgtagagctccttcagtatgtgtaatttggcacacaacccctttagttcgtcagcatttggcacatcggggatacctaacaaattgtaggtaaatttgtttatttatttattttttcccttaggtaaatttatttgcagttctgcctttgtgtatagagtagagctctttacatagtattatttaaagtgaaataattgcttgactaaggtaaatggcttttgaaactgaagtaaaattatggcttcaacacttatggcagaaagtgttttaactattttgtgttaaatccctttttctcccaaaactatacacacagaagttttggatataatttcaaaggatgaagaactcatctagaggccattgttgaattcctggcattcattaggcactcaaccaagactggatatctaattaaaatttgaatagagtgggttacctatttgaattttaggttttctagtaaatcattttgtttgatctaggtc

SEQ ID NO: 47009 - DNA, 1030 bp, Homo sapiens
aagaatggatgttaagtagcttaagaggtatttattaagggaaaatatttttattggcagttcccttaagtcatatttgttttgtaactaaatagtgcttgcaacagaattatctatcatagggagggaaagctccaactcttgaaaacttttcaatactttttctatattggtagttaatgagaattcttaagataggaaatagactggttatgactggtaatatgatattgctaatgtaatacaaattatgctttaaaaaagccaggtgaggaattcaggatttggaagaatatgacatacatatacatttaactaaagaaaggagattttctttaaagagaagatgtgcaaccacaatcaatcctgtaagttagtccttaatcctgtactagccagtttttagtattaaatggtctgatttaacacaaatgaacttttgtcaatggttttatttagaaatagcattacttcctacttttaaggaggattttaatagctaataaaaattcgttgttctgataagaacttgaaagacatccttactcccatataattgagtattttgctcttcattcaacacctcagcccttttggtttgcttaaaaaatgatacaaattttgtgggagaataaatataacttaaatattgctgtaaatgtgttgtataatcatattttagcctggtattattggttcttctgtgtatgaaatacttttaaacattcaaaatattcaatttaaaagtttctggataggtgagtggtagagatccatcaggtacttacttggttgtggaatatttgtgttcttgatgccatgacattttaaagttgtattaatccctttatttttctgtttgagatgattcagtttgggaggttttattatcagatctaacagaagaaacgtaagtgttgtaccacaggtcatctaattttcaaaccatgttggttagttaaactgactttggtgtataattatgtacccggtagtcagaggagttcaagtcgattgcaattcaactctg

SEQ ID NO: 47010 - DNA, 2944 bp, Homo sapiens
ctatggcaatttagttattgttagaagtcaaaagtagaggtctctgttcccaacatctccccaaaatattttttcattaatattcacaggctttaaaatatcaaattattgtgatcaaagctacttctgttttacagttgttttgtgaggctggtgtcatacagtaacatttaactgaattttgtatttgctaaattaacataaaataataaagagatcctttttaccatttaaaaaattctaataatttcctaatcaggaaaaatgatgttatgatatactgtaaataggctaaaaaaaaccttgtaatgttgatacatagggaaaagagtaattttgataattaataattttagatttttttcctttgattgtacctcatggttgtgaggtgtctaaaatgctctttctgcatatctgttaaggactttgggaattggggtaagggcaagccttctttctgtgtctgttaattacaggttttttcttgtggatgtagtgctcttagaatatgaaactgatttatagaatttgtaattaccaagaaataaatagcatcattgaattttgttttctttatttttgctattattttctagttactgtgcttcacattttgatttctatcaaatgacttctcaaaaagcaatttcttttaaatcagtgagtttcaaactaagaagaaaatgtatcctgatagtctaattagctgttgtttgtccatgccaattaaaataatcttttgaatttctagtctttgattatagttatataggcttcatgagtttgtaaaactattcctccttttaaagtattttaaaaggtgtattgtaattttataattgatattcatatgtaattattgagaaacttgaataacctaaaatatatttctagtattcagcacatcaaatcaaggtataacctgtgatataaaagtggtccaacagaagtatacagctttaaaaataacaaggaattaattctgttagcatgttttactagcaaatgttcgtggaaaatgttattaattcttaaagctcagtgcctgggttttattgtgtgtggccttactaggagaacactgtagagccgaacttgaaatttattaaggaaagaagaaactggtgaagtgcttttatgctgttaaaaaaacttcacagacaattgtcagacaattttttttttaaaggtcatgattgcttgatgccttttccagtctttatttgaaactctcgttttgtaggatttcttttttgttcttcctcttccttttttcttttggcagtgggtggaagattcttttaaaactgaatggctaaacctgtatggtaactattgaagtatgatcgaaatacttttattcatgatttttttaggccaaaaaatgctatgaaggtaagccaatgatggtaaaattacattgtgttgcgtggaaactgttttagctttagcgttttctgttcagaaaagtaggctctgcattagagttttaaattgggatttgtttgtgaaatattttgtaattctcatattgctgattgcctttatgtctcggtgttctagtagatagttcgtagttcctgaaaaataatattctgtgtatgaaagaaaataggaggtgagaacagaatgagaattgggaaagaaaaccccctacccaaaatgccgccacctaacaggtggaaatatctatgccattacagattttcaaaacgtagagtgcttgaactctttttttctaagagattacttcaaatttgacagatttcacaaaattttgttatgataaatattaaaattttaactcttatttttatcctaaatttaagcccttacaaattaagaaaagagtgcctcgaggctgattgctaatgttcaattaagttatgtgttcagtgaagtaattttttgattatgatattttgattttattaatatgtaaactaaaaattataaaaggattatgagtacagaaattaaattatgtgaaattaattttgatattttgcggcagacagtttagaattaaaatatccttggtgtgtaataattttatttcttgtaaggacatctgttggctttcagtattcagaaaatttagactttttaattttaaatgttgacgtaaattaacgggagccatactttaaattgaaagaacttaagggaaatacataaaatatgctagtgattggcttacttacattttcagtgattagactttgtgaaataagagtaaggcctagcattttattttatttaagaaaatatacttaatttaaaagtactaatacaagaatgagagaaatctggtcaagtatagtaaatccatatccataattattttcaatcactagttacagaggaaggtgtgaatgctaatatcttctttgttgaaaatcataagttgtattttgaaaagggatgaaagggaacaagtaactgctttcaggcagatttatatcatcctaacatcatatgttatttgtgggttcatgtcacaaaagcttgcaaaacttcacaaaataatttaatgtattttaatttagtaagcttgctgaaaactcttttgtgataaatctagaaaaatttatacatgatatttttcttttttaaagtttagtgatccatcttggtactttgtctcaatttcagtcttgttgatttagataatattcttattgttttataaatttcctttcaggaatgtgttactgccttgatacgttctcacctttccagttatatatgatccatctatgacattctatcatccaggtgttactattttattgttctttcttgtacttttgttgtaaggtacagacttcaagtctaaagtaagagctagtgtatattacagtgtatatgaccatttctaatttgacctgttactgtaaagaaggctaacaagtgtgtatgcctagcccaccccttctgg

SEQ ID NO: 47011 - DNA, 1044 bp, Homo sapiens
gtttctaggatagaaacatagattgagctattaaaagcagaacattagagttctgggataaagatagttgtcaggtgtaaacaagccttaattgaaaaggaggcagcctaaaagttgattctttatgctattataaataagtaaaaatgcaaacttgcttgagttcagaaaataggagcatacccaacttttaaaactacttattagattggtagttgctttagatccttaacttaaaaaaattcttattaaaatcagtgttcaattgagtaatattcctcgtttaatagattgagatgcctcagttaaattttgaacaaaaattgttcctataaattgaattggagatgctgatctgttaaaagcaaggaatataacccaaaattaaaataggaattattttgctagtggataattatcttggacagtaggtcttatatcttgttgaagtgtgtagaacacacattttcacattcattcatctttaagtgaatatacctgtaggctgattcagacttggtattttatttattttaaacattagaaatgataaatactaatttaagcaagtgcgattactattttaactcattcttcgagagttgcttcatttatctcagagtttttggtgtaccttatttaccttatttagattatatcattgtattaagtcctttgcttactgctgtagttttttggtacctagaataatttattatggaattgaatattaaaaatttgacgatcccaatagttatgaagcttacagattctgtatgtaggcttttttcctcctttggtttcaggcataatgaatggatggcccttgctttctgatatttgtgtatccaattttctgaggaaacacttttctacaaagtctgcatgtttgattgttctacatttttctttcattataatttgaaaaggacttagatcctccaaatgaaaaatggctgtcttggccatatggtaaattaggcctgctttattattgtctaataattaagcctccctttacttatcccaccctcgttttaaaaa

SEQ ID NO: 47012 - DNA, 1159 bp, Homo sapiens
aagatatttttccaggttagaaagttacagtttttctgagcaggtgttttctgtgaatctctgtagcattggaatttatagagatataacttttctatttctgtggggtttttttgttttttttttttttttgagacggagtcttgctctgttgctctggctggagtgcagtggagccatctcagctcactgcaagctccgcctcccgggtttacgccattctcctgcctaagcctcccgagtagctgggactacaggcgcctgccaccacgcccggctaattttttttgtatttttagcagagacggggtttcaccgtgttagccaggatagtctcgatctcctgacctcgtgatccacccgcctcggcctcccaaagtgctgggattacaggcgtgagccaccgtgcccgaccgatttatctatttcttttttccatttgaagtcagaaagaaattgctagaatccttcaagtctttctcagtgagagtaaaccttttctgtatataaaacgatcattctgtatacttcattttactttgagttttttagacattaaagctgacactggaaagggtagcttttattttactttttgacttagctacttaggttgtatgaacaattataaaatcatcttcatatgttaaatctgtaacaaattctttttctggctgggtgtggtggctcacgcctgtaattccagcactttgggagcctgaggcaggtggatcacctgaggtcaggagcttgagaccagcctggcaaacatggtgaaaccctgtttctactaaaaatacaaaaattagcctgacgtggtggtgcacacctgtaatctcagctacttgggagcctggggcaggagaatcacttgaacctgggaggcggaggttgcagtgagccgagattgtgccactgcactccagcctggacaacagggtgagactccatctcaaagaaaaaaaaaatcttttttcttcgactctaagatgatgttgaggcttttttgagctctgaatgtaaacttagatcctgtgggttgtttcttagtatactttctggtagctcagtgctacattagcagttctttattttggcattgtatttcctcacacaaagtaaaaagtctcataaatcttcctccttttaaaaaaatgaa

SEQ ID NO: 47013 - DNA, 2267 bp, Homo sapiens
cattcttatcacatcaagtataaaatgctatcagcatgatttgtcattgatgttagccttgattaccttgctgaggtcgtgtttgtctggtttctctactgtgaaggtattcttttttccccccttcttcccaaacagtattctttggaaggaagtcactatacacagcccatacttaaggaagagagtgttatgctctaccttcttgagggtgaaatatctataaaaattatttggaattcttcctatgggtgatttgtctgttcttgcccattcattcattcttatttgtatcaacttgtggatatttactttacattttgggttataatttaatagtactttattgtgttgcttaaattgttctagctttgacctttgggagtgctttcagttggctcctatgtttctttaatatactcctatcttttttccttaattttattttttaaaattttatttttatttactattattattgattgattgattgattgattgatttagagatggagtcttgctcttttgcccaggctggagtgcactggtgtgatctcggttcactgcaacctccgcctcccaggttcaagcaattctcctgcctcagcctcccaagtagctgggatcataggtgcccgccaccatgcctggctaattttggtatttttagtagacacagggtttcaccatgttggccaggctggtctcgaactcccaacctcaggtgatccgccagtctcagcctaccaaagtgctgggattacaggtgtgagccaccacaccctgcctgttgttattatttgtggttattttttagggtcagggttcactctgtttcccaggctggtctcgaactcctaagctcaagtgattctcctgcctcggcctcccaaaatgttgggattaaggtatgagccactgcacctggcctttctttctttctttcttttttttttaaacatcagatagtggagcaataatattggtcatcagtgtttcttttcttttttaaagcacttcgttacttcctggcactgcaagatgctaccgctcatcttgtttctttctttccccagacctagaatcagctatttctgaaaggagtcctggtttctttaattggagaatgatattagaaaccaaaatctgggtgctcagtgtttgtcttaatatagtttgactcaatggattgagtcaaatcataggtaatttttgtttgcttttggagacaaggtcttgctctgtcatccaggctagagtgcagtggtacaatcacggttcattgcagcctcaatcttcaagttctaagtgatcctcacacctcagcctcccaagtagatgagaccacaggcatgcaccatcatgcccaactaattttttgattttttgtagagatgaggtctcactctgttgcccaggctggtctagaactcctggcctcaagtgtcctcccgcctcagcctcccaaagtagctggaattacaggatgagccactccgcctggctctttggggatcttgattactcttgagagtggaggggtgtcaactcttctttccttctttattacctgtaatgaaaataacagtgcttaccttggggtttgtgagtatgaaatgaaataatgcatgtgatgaacttaaccaccatcttgcattgactgtattattgctaacccattttgagagatgaactgtttgaatatcaaggtgtcatgtaggcaagaatattgtataaatataagcttgtttagaattctgtgtcattaattgcatttactctatcagttaattagagattcttttttgttggctttttttgagacagtgtcacttcgtcacctaggttggagtgcaggggtgccatcacagctcactatagccccgacctcctgggcttaagaaatcctctcaccttatcccccaagaggctgggactaagggtgcacaccaccatgcctgggtgatttttctgttttttgttttttttttaaatagggacgaggttttgccatgttgcccaggcttgtcttgaactcctaggctcaagccatctatctgcctctgcctccccaatgctgggattacaggtgtgagccactgcacccggtcgttaattagagagtcctgatctcagttggattgtttaaaagtgaaagtgaatgatgataatatttagtaaaatcatcttaatgcattttgacttttaacttcttcagatttttattaaagtatagagaatttagatgttttagaaaatcagtgcaa

SEQ ID NO: 47014 - DNA, 1026 bp, Homo sapiens
gttatttttgaactcaaagtggtagaagcagagaggaggtgacaaactgagaaccttttgattttgttggggtggaacttggtctgctgttatagctgacattattactgtatctcaatgatttttgagattttgggaaaattgttttaatgtttcactcccaagcgctgaagatactccagaaatctttgccgttctgttcctataacatttgctcttccattttgaagctacaacagtgtaggatattttcagctttctagaattcctgtagaacctctgtattctaaaatctcccaggattaaggaggagaaaaataagcagaaagacatcagaaaaactaatcagtcattaggttctctggcaagtgaaaaatggaataaagataaagaatgtagtggttaatcaagagtaacctgtttataacatagactaggctcaaaacttaaacttgaaacttaacacaataaattaaaccatctttgtaaacagtagaatttaaagagattcccttaaacattaaacattaggaccttctgtggtgtcaccttattcaaactaccactgtgttacctctttttgactcttaaggctgccagacaccctacttgaaggatcctgttggaacctgtggaaataatacttacaagaacgttgcagctaagctggtccgggtgcagtggtgttacaactaatggatcacaaccagtcacggatttctttgttccatctccattcccacttcttcacttgactagccttaaaaaggctcatgcctgtaatcccagcactaagggaggctcagacagaaggatcatttgagcccaggagtttgagatcagcccaggcaacatagcgagacttcatctctactaaaaataaaataaaaaaattagccaggcgtggtggggtgtgcctgtattcccagctacttgggaggctgaggcaggagagtcacttgagtaataatggggtttgaggctgcattaagctaggattgcaccatggcactcaagcctgggcaa

SEQ ID NO: 47015 - DNA, 2052 bp, Homo sapiens
tttaaaactgcttattgggaagataagaattcactttacatttacgatctcatattttggcatattcggtatttcctccataacgcctactaaaattaaattatgtaaacaaagtacccaggccaggcgtgctggctcatgcctgtaatcccagtgcttttgagagccgaggcaggaggattgcttgagcccaggagttcaagactagccctagcaacataacaagaccccatctctacaaaaacaaagtacccagtacatatttgaggagtagaaaattagcatctactgaggtttatcaaatacccagccttgggccagatgctggagggacacagccaaatctgacagggacccgccctcaggagcccacattctagtaggggagacagagtcacagccgtaatgacagaaaccagtgcattagataagcaatactttatcttaagtctaattaataatttaattttaaaagttccaggacccttcctacatcccgagacattctaattctctgccgtttgtgtagcaattctttgaactgttgaaagatctcctgacaaattgttactgatattgtgttaagcaataatcttaaccttcccagtaaatgaactggaatgcccaattttaagtttctctatttatgaagaaacaaaatacaggggtcatagtcaggatactgcctatggtacattttaaaatttctgggtctactaggatataatctttcttaacctcttttgagatttgatgtcagttcaagggaagcattccattgatgtcaggaaggcagctatttgttgactgaaattctggtactctggcataagctcgttctaaaaatccacaaatatgttgttaatagaatgggaccatacttttcacttgggggcctacccgctagaggtgagatgtcatccttgagatgtttggaagactttgtgagatttttttttcttttgcaaactagacgtgcgccagcttctctgacctaaatgtagctccagtgggaatttcactatggatactttatcttaagtctaattcccctggtaacccaacattgctggttttagaatttaatagtcttcagaaattttttaagataaatttgctattttctttattatcttttaattacttttataacatggggtttttgttgtgtgtatatactagcattcctttggacacaaagtagactataaagaaaatttctaaattctgaatgcagtttctcattgattttaattattgctatgttccttttgaaaattttttggctggctctggcaacttatgcctgcagtcccacccagcacattttgaggccaaggcaagtggtttgcttgagcccagcagttcaagaccagcctgggtaacatggcgaaaccatgtctctacaaaaaatacaaaagatagggcttggtggcatgcatttgtagtcccagctactcaagaggctgaggctggagggatcgcttgagcccaggaagttgagactgtaatgagctatgattgtgccactgcaatccttggctgcaaagtgagatcctatctcttaaaaaaaaaaaaaattagaaaaagaataaaaaagtctaccctaaccattttatatttaaaacaagtttgttcttttcagtgtccttacttttaaaatagttgaactgatttttctgggaatctttctcaaatacaaccttaaacagaatatatggatgtgtttctgatgtcttagaattattctaatattaattatttggtgccatagacatattgtagttctcagaggctattcatatgtatgagaaatttttcttaattgaaattttccaaagattgctacactcaagagttttttgaattctgtttgtaagctacctaagagtagcaaataggtttcattctcacataccaattccaatcttttgaaacagagtgttgaggagagttctgagagcttttggacttaggaaggataactaagacaggatcagccaaaattgtctgtttgtttgggaaaaggggatagagtgatgggactggtac

SEQ ID NO: 47016 - DNA, 1033 bp, Homo sapiens
tcattttaaaaacaaagtgaagatcagaggcaaaattcataagggattatttgcaaattacatgttatttcgtttagattctttatgcacaccttgactaagttttaaaatttgctgggcaggttcaacagctaggaaaatctgttaaaattgtaaatttgttgcttttgttactctaaaattatcatttgtactgttttcttaaaatggtctttagcatcttttataccttcacttttgataattttctgaactttgccggatattttgacattacagactgacttttaaacattcactttccccccattgtcttacgcattaatagaagggaatgtcatctggtgttttgagtgtgcaaaataatatttatggaccattcatagataagttatttttaaaggcatttcttcttaaaaatttgaatatacacggtgtcttgcagtggttcataaagtacttccagcattggtattttaatttgagcaacagtttttgtgtgagcaacgacatgagtgagcaatatgggcattgcattatggacttgattgagcaatgtgggcattccaatagggacttgagtgaacaatgtgggcattccaatagagagacttcagtgagcatcgtgggcattccagttgttacttgagtgagcaatgtgggcattgcaatagggacttgagtgagcagtgtgggcattccagttgtgacttgagtgagcaatgtgggcattgcagtagggacttgagcgagcaacatgggcattgcaatagggacttgagtgagccatgtgggcattccaatagggacttgagtgagcaacgtgggcattccaatagggactttagtgagcaacgtgggcattccaattgtgacttgagtgagcaacgtgggcattccagtagggacttgagtgagcaacgtggccattccaatagggactcgagtgagcaacgtgggcattccaatagggacttgagtgagcaacgtggccattccaatagggactcgagtgaacaacgtgggcattcca

SEQ ID NO: 47017 - DNA, 1061 bp, Homo sapiens
aggccaggcgtggtggctcatgcctgtaatcccagcactttgggaggccgagataggcgggtcacttgagtccaggagtttgaggccagtctgaccaacatggtgatacccttcctccaaacccctccccgcacaccgcagcccatctctactaaaaatacaaaatattagctgggtgtggtggtgctcgcctgtaatcccatctactcaaggaggctgaggcacgagaatcgattaaacccccgaggaggctgacgctgcagtgagccaaaatcatgctactgtactccagcctggacaacagagtgagactctgtttcagtaaaattttttctcccattttatagtccattgcctcattccccacaaaatgattttgtctcttttattatggtagaattgtctgtcttgcagaccatatgatctgaccagcctttctctcacatactagtatttaagattaaataaattaaaataatttcttagttttgttttgtttaaatactgttgtggtaaaggctgttttttgtcttttatcaaaaatgtaagaggttgaacaacaagaaattagtgtaatggttgaatatggcaatttcatatgcttctgacaaatatttcttaagcctcatttgtttttgtttgtttgtttgtttgtttgttttgttttgtttttgagatggagtcttgctgtcacccaggctggagtccagtggctcgatcttggctcactgcaagtgccgcctcctgggttcatgccattctcctgcctcagcctcaaggagtagctgggactacaggcgcctgccaccatgcctggctaatttttgtatttttagtagagacggggtttcaccgtgttagccaggatggtctcgatctcctgacctcgtgatccgcctgcctcggcctcccaaagtgctgggattacaggcgtgagccaccgcgcccagtctagcctcatttgttaaatacgctttcattaaggtagcctaggaactcagccaccctatagattgttgcttcagtacagaaatgagtcccacatttaaaagaacatttta

SEQ ID NO: 47018 - DNA, 1042 bp, Homo sapiens
atatattaaaatatatgcataactgaattaaatatatacatttaatgtatatattttaaaaattagtaatgcttctaaatgtcagtgagtgccctcagcttctgacaatgcttaatctaccggtgtctaaacagcattgcagtgttcctgctgcttaaatcatataggattcattttagctaaggctaaattaggggaataactgaagatatatcggaaatggaaaccccaaagagtaatagctatgaattctgtaaatgggaagacagaccagcctttactgtagcagtcaatatatagagataaggtcttacactggtgtttttgtttgtttgtttgtttttttaaactactgatgcctcagtcctacccctggaaatatgagtaaaatggggccaggacaacagaaagttgagagcttctttttgtactggctttaaaagcaaggatctaggccgggtgtggtggcttacgcctgtaatcccagcactttgggaggccagggtgggcagatcacgaggtcaggagtttgagacgagcctggccaacgcagtgaaaccccgtctctactgaaaatacttagctgggtgtggtggcacacacctgtagtcccagctacttgagaggctgagacaggagaattgcttgaacctgggaggtggagtttgcagtgagctgagaccacgccagtgcattccagcctgggtgacagagtgagactcagtctcaataaataaataaataaataaaattaaaaaataaaagcatggagctaggtcagaaatagctacagactgagagtaatcactgtaagtagtgacacaaagactaatctttgtgcagtgtggaaagtacagctgggttgtttctttgattcctcctgccccattgagccatacctacagagagcagctgtgaaaaactatcactttcaacaatgaagaatagtaatatgtcataatggagattatgaagttcagaaaggggtaaatgcagttttggggagggctgagactaagagagaacacaataagacaggcaa

SEQ ID NO: 47019 - DNA, 1974 bp, Homo sapiens
ccacacaagagaatagtactaagccagaaaattgatgaaaccaatcttcagctttctttcccctccctctcttcccctcccggctttctccctcccttcccccttccccctctccctctccctcctcctccccacttctctctcattcctcttccctcccgccttcacctttcccgcttcgttttggcagggtctccctctgttgcccaggctggagtgtggtggcgcgatcttggctcagcgcaacctgctggactcaagcaatcctcccacctcagccccccgagtagctgggactacaagtatgtaccaccacatccagctaatttttgcattttttgtagagatgggttttgcccatgttgcccaggctggtctcaaactcccgggctcaagcgatccacttgcctcagcttcctaaagtgttgaggttacaggtgtgagccacgatgctgggcctagctttctatgtggccagtttctctggtatttttctctggaaattgcagcgactttgacctgtgtacattctgtgatctgtccttgacactcaattacgtagatggggtctggtttgactacctcctcccttacaaggtggccaggaaaccttctcaatgtaagattcaacttacctatttcctttctctccaggatcactattctgccatgtctgtgtgtctaaaagtgtttcaggcagaggcagggggatctcttgaggctaggagtttgatatcagcctggataacttagtgaaactgtagtctctccaaaaaaaaaaaaaatcgttggtcatggtggtgtgcaaccgtagtcccagctactggagaggctgagaagggaggatcgcttgaacccaggagtttgaggctacagtgagctatgatcttaccactgtactccagcctggatgacaaagccagactctgtctctaaatgaatgaatgaatacagttgtgtcttcttattgtttagagttgaagtatatgtagtccttgttactccatcataactgaaagtgtaattttgctttcattcttaaatgatatatttggagcatataatctcatttgaaagctttttttagcacttgcaatgtgtatttctactgtgttctggcatttattattttttatgatgtcagtagtcattttttttctatacgttaatgtgtcatttttctctgccttctttcaagattatttctgtatttaaactttctagtagtttgtgatgtgcctggttgtacattttttgtatttttcctggttggagatcaaacttttatttattatttctccagagtttttttttttttttttttgccttgtgttcaagactaaaacttttttcttgcttcattttttccttctggtcattcttgtattcctgtaatacatgtggtaatccgttgctgtgtcctacagtttatgatgctctgtttaaaacaaaaaaaaaatcgattttctgtttgtcggatcggataatttttactgatctatgttcatgcctactaacttttccttctgtcatatccaatctgctatttagcccattcagtgatttttaaaaatatttcagatactatattttctacttctaaattttccattgctttaaaaaaataatttctatttctctggtgtgatttcctatctgtttaatcattgccagcattttttttcaaattaataagttttatttttgatatttatgttcatcgttttatcactttttatgaccgaggtttagtgaatagttttaagtttttgttaagtaaattagtaggccctcctgtactctggccctcctttctgtgttagtggtgttcacatcagttttttaaatgaatgatttggtgctcctggtttctccagtgtattttttgttacggcttctgcttttgtttgtttgttttcagacaaggtcttactctgtcacccaggctggagtgcagtggcatgatcacacatc

SEQ ID NO: 47020 - DNA, 1027 bp, Homo sapiens
tttgtttcttgtgtgcattacatcattcatttccctcccattttgacatctgcaatggctccctgatatctactaaatataactatttaaccagcatctaaggcaattcataatatgccccaacctactttttaaaatcttatttcttagtcccctcacagattttctctaccctattccactggtttctaaacaggttttttttgaagcctcttaggcattcccttggaaaggtaggggtcaagtcaccagatttctatcctcaacctttaggctttaatctcttttgcatattttggtttctttaaaatagggctctataactaaaagaggtttgaaagtcactccatttgtctggtcagatgattagtctctatgtctttcagtctgtctctgcctctttctcctgtacacatactccctagggccttatacttaaacattttcttgtggctttacttttctgtgtagttccttctgccaggaatgctaatgtctccagttgatcattcatatagtgagttttgctggttagctggaacagtgtgacagttttaaacattttatttttatttctaaagaatttccagtaagctgggaattaagtgtttcgcatgatcaaaacgtttagggattaatatatgttttgttaccttatgacattgtatgaacgatggagaaagacagatttttacaaatgttagaaatgtaaagtcttgaattgggtcataattttttcaatgaaggtgtgaagtttaagtttagtgggagagagtgattcagcatacatatggttttacttgtagggttttttggtttgtttgttttggggttttggttttggttttggttttttaataacataagctgtatatgcagccaagatagattacattatacatattatttttcttccatctttatcatcaaatactgagttctctcacagtgctttgattcacactagagatttttttttatttataatgcagataagtagtatgttttgtaatgatagttctcattt

SEQ ID NO: 47021 - DNA, 1037 bp, Homo sapiens
aatcatatacttatttaatattgcatatttccatttccctggctcagtgcagagtaaatcaacaacattgaaaagctagttgggaatcggagatgatagatagctttttctaagtttttaggtccttaaccaatatttggtatgagattcgctcaatggtgtgtatgtgtgtgtgtgtgtgtgtatttgtgtgttagaattcatcagacaagaaaattaatttctattttagatattttacaaagaatcacttattcctaggattgttccccaagacatctgaaatcttaatttgcatatctatgtggcaaagctttaaatttaagttatccagtagtttaacataaaatcatactgaaacactcattaacacatttgagtatactatgtaagttcagaatataaattacttagtactgagccatgctgcattaagttaatctttatgttgttagattatttttatgttaaggaaacattatcccagattcggtttttctagatacatagaaagggacatactggatgtttttattatgttgaatgaagctgtgcattgaagctattatacttaagaaacatttttatgacagtttagctttttcagctgctttcattatgttgtgttttttagaagtctattcagggtatttttaatgtcttaactaacaatatgatttttgagctatgtttctgtcgtgttgtttctcatcactatatggatagaattagttatatagtaacaatgcctctgtgctcctttaccaccacaaaatacttattttattttaattcttatttattagttgaattatttattacattaatttaattcttattttctttgatgttttatgaagcagagtttattttcataattgtgtctcataattctgtacaataattgttggaggagtatgtttagtgaaaacaaattaaaggtggaagagatactattcttcctcagcattggtaataatgaagctcaatttcaagtcatatacttttttgttatttgggtattgaatatcagtttt

SEQ ID NO: 47022 - DNA, 1034 bp, Homo sapiens
ttgcactagttacgtatattaatttggcatctttcaattagaagtttaagacattagaatgaattatttagatattccatatctttcagtaaacttcatggctttttaaatatcagctggcgtattacttattaaatatatttctagatgttttaattttgttggtgttgctatcgagatctgatatactttgtgttttatatttgttcctggttaataggtaagctgttgttttgtatatttttttattaagccaccttcctgaaaattatacatagtatttaaaaaatttataactcaacattaagttgattaatgaaaaccaaacctttataccttaaacgatacataattttgtggtagaggaagtggctgtttttctccattttttttcaccctaattgttgaaagcttcctatcacaatggtcaagtatttatcatttaaaactgagcagactctcaatactttgggggcacatttcacctaccccaaggcattaggcagaaatgctgaggaagctggaagacttagtactctgttctttggtcagcaagtgatagttgacctataattaattaatagaagaaggaagtactctcagtgttttgggtcttttatcaaacaggtatgttattcttaggatcttttcactgttactccctttctgctattctaaaatataatcctggagtctcttctttttgttgctggttgtcacatttctgcaaacagcaatgtattgtgttaatagttatttcattacagacatttctgcgttttggtttacatgtgttcttgccttatttttcttaaattatttaaaggagaggagtatgttttgtgcagaattgtgttgatcagacgtgtactaagcagttactgtgtacagtgcagcagtgaaagggaatgataatactgagcacttatgtgccagttctgaacagtatcgatgcggaaaccaagaatctgaaagaataggtgtcttgtcaaaatttaggaagctatggaatgtccatttgattctaaattcta

SEQ ID NO: 47023 - DNA, 1033 bp, Homo sapiens
accagaacattaatgattggaatatttagcaaaacccattaatgatggtgtgagttaaggactatccctatatttcaggtatatggcagttatggtgagaacgtacaaccagaataatcacaatttatttgttacagtgaattccattttacgaagaactggcaggttttttaatctgaacaatattcataccaactaacatacttaagaggtactcagatgcttgctgaataaatgtagtttaagataatacttttgaaagttggctgacataagaaaaatggtaatctttaatgggaaattgcagcctttggtgtttatttacaaagagttgggaactttttaaatgctgttaaccctttatattggtttgaatctcatctgggataattgagaaggctcattgtcattttgaggatcccagactcccacaaaaaaaaagatgagagtggggtgttgactagagagctccaagtgataaaatctaggaaagaacactaaaaaaaggcgtcagaaggtttgggtttaagcccgctaatatgtgtttattacttacctataaaaagattacttatctataaaaaggtgatctctacctactttaagaattactacattcatgaaattagagtaagtatgtgaaagtacatacgagttgagtattccttatccaaaatgcttgggaccagaaatgttttagattttggattttttcaaattttgagatatttgtgttatatacttaaagtggagcataacatttcctttgagtgccatgttaatgctcaaaaagtttcttttttttttttttttggatttttgaattagggatactcaacctgttcttggaaatctgtaacatatggtatgcatgtaaattgatggttcaaataatcactaatactactcacattgctgccactgctgatgccttataactagtatcagaagagcctcttgggatgtttatactgtagtctacccttatctttagggaatacattccagcattcccagtggatgtctaaaactg

SEQ ID NO: 47024 - DNA, 1050 bp, Homo sapiens
taattgtttcactttcccactagacgataagttctatcaaggaaagcaatgtctattttgttcattgatatgtatatcccaagcatctagaatagtgcttgcaaatgatagtaactgagttaatatttgttgaataataaacgaatggtaaatattgggaataattgtaatgtttagtttaaccctgaatataccgtcaggtttattggacccaattttagtttgaaaatttttttttattttgagtgtttctaactatttgtaagaattgaggccaggtgcagtggctcatgcctgtaatcccagcacttttggagaccaaggcgggtgaatcacttaagcccaggagttcaagaccagcctgggcaacgtagcaaatccccatctgtacaaaaaatactaaagttagccaagtgtggtggcatgtcgcagtagtaccagctacttggagggctgagatgggaggattgtttgcacccgggaggcggatggaggttgcagtgagttgagatggggctgttgtactccagccagagcgacagagtgagactctgtctccaaaaaaaaggaattgatagtacatactttgattctttcttaaacgtcttccaaagactagagaagagttttacttttcttcacaataaaactaattctgtttcagaattactgtgtgggtacattggacccttttataaatctaagatacttcatggcctcctgccatatcttgaaaaactatactgtttcatcatcctaggaataattttatcattacttattcattatttccagttgtactgaaaaagactaaattattaattttttaaaaaaacagaagaatgatgaaattgcctagaaggataatgcaggagtgacatgaatcatcactgttacatcatccttcacttttattattgtgctgcctaaagtattgcattatctttcaagaatgtgcagtagaagtctggagacacactgtctttataatcttctttcactttcattgaacaaggctgagaattcacaattttatattttccacacaaa

SEQ ID NO: 47025 - DNA, 1045 bp, Homo sapiens
ttttctacattcagtttaccctaattcctaatgagtgtctcattaagagtctttcattttaggtcttaattgcgtttcttactacatagtaacatatgtttattttatattaacagctaatcagtacaaagtcatttttcatcctcatacctaagtggcaattctaattgatttaaggggtatttatgaaaggggtgtctctcattctcttttttaaagcattacttacctattttttaaaataataaaagtactttaatatgtacttccccaaagtcatgatacgaaagcagaaatatttttctaattttatttatattgaaatacacctatagtcttttttcttacagccctttttaatgcatgtctgaaatacacctataatcttttgctcaataaattagtatggctttctgttgaaatgaatttcagattaaaacagattagagtatgagtgtttggtatatatatgtatttctcatgtaaataacatgacaattatttattgtaattccaccagcaaatttatacttaaattgttacccattttttaaacaaacagtggtgcatttaataatgttttggtaagtcatattttataaatggaattgtgaaattaaaagacgtacacttatgtctggataagtattgtcaaattgctcttctaaaagattgtaccaatgtatctacctaccagcagtgttaagagaaatgagcactgcactcatcaacattaagtattatcagtctttaaaatttttggctggtcagaccaaaaaatgatattttattgttttaatttgtatttctttggttattaataaagtggtatatggttaattaatttgaatactctattctcaaggctatatagatagaagttgtcatttcattccaaagtactttagtcttattttttagtgtttaccaagtcttaaaaatgataaatcctgaattgtcctagcattatgttgttgtctgcattaagttgtcaattataattttcttagcaagattttctagtttggcagttatctttaatagc

SEQ ID NO: 47026 - DNA, 1051 bp, Homo sapiens
aatagatgtatactgtctatcttattgtagttttagtttgcattttctaatggctaataatgttgaatatcctttcatgcacgcacttatcatccttatttctttggtgaaatattaacatcccttcctaatttttaatgagtgttaattttcttcttattggctgttgatagttctgtctgtattttggatataagtcttcagttgggtatgtgatttcaaaatatttttttctagtccatagtttgtcttcttattttcttgacggttctcaggcagagcagaagtttttaaatttaatgaagtccaacttataaatttgaactctttacccaaccccagatcacacagttttttgtttttgttttttgagacagggtcttactctgtcccccaggctggagtgtagtggtgcaatctcggctcactgcaacctccacctcccaggctcaagtgatcctaccacctcagcctcctgagttgttgggacgacaggcacgtggcaccatgctcgtctgacttttgttttttgtagaaatgaggtttcattttgttgcccaggctggtcttgaactcctggactcaagcgatctgcctaccttggcctcaagtgctggtattacaggcatgagccaccatggccagccagaagattttctcctgtgtattctttcagatgtttctacttttatatttagatctgttatctattttgagttaaactttgtataatgtgaggtttagatcaaggttcattttgttttctttacatatggttgaccaattgttctaacaccatttgtcgaaaagactttccattctcaactgaattgattttgcatctttgtcaaaggtcaattggccatatttacatggattgattcctgtgctctattttgttgcactgatgtatgtatatgtcttgttgccaatgccatatggtcttgattactatagttttatagtaagtcttaaaatacatagtgagatttcttaaacttttgcttttgttttgtttttgagaccaagtctcactctgttgcccaggcta

SEQ ID NO: 47027 - DNA, 1047 bp, Homo sapiens
aaaaagtcagccagaatcttttcttttcctggttaattggatatatgttgggattcctaaatatctttctgagaggtccttggctacataagcagatctgtaaaaaccataataaccccatccacacagtagatatcaagtgataggtctgtttttctctgtgtgcgctttggtgtgtttaagaaaatagaactggttacatactgtcttgtaaaatgctatctaaacaccatttttattggtaccatttttgaggcctagcacataggttttcataagctaatacattataagttcattttggaagcttttgttttggtagttcaacttactttgcctacttcctcaagaaccagaaatactcttgtataaattatagtttttttcctctgtatctggtattgctgttttaatgttttgattgatcaggtgttgctattgagacattacatctctgccaaattgtcagaggtttagttttcatttaaaatgcccttagtactaaaatactactgaggtgaacgtgattgtgctctgatcattcagaaggcacatgactcttttgtagtgcttcagagccatctttccattatagtactataaaataaatcagactggtttatcttttgagttacttggtgtttgaataacaagattttttttttgaataagcattgatgacttgtaatagtccatctctgataacagagatggaaaatacatttggagaatgactaaaatttttaaagatttttcaaatgcaaaatttatatgaatagttttatgttatttaaatacttatcttgttcttaaagaatttgctgttaaaattatcatcataatttttacttcagtcttctcatattttgagtttagtaggaatgataattactacatttacagagtaagtcaactgatttttttttttaatctttatttcactggcatgtggaaccacattttgccagaacttatcattggaaaatgcaatttcaaagcaaatgaaacctggaattatcaatctcaataaatgagattcttttaaaa

SEQ ID NO: 47028 - DNA, 1049 bp, Homo sapiens
gtaataaagctactagataattttcattccatttttcaataatcatgtagaactgaatccattgggtaaattataagatcatctttataattttgtaatacatccattttacatagatatgtttctttacattgatttgtggattaccccacatttttgttcagttaggaaaactaagttttgggttgtgtcttaactttgtttatacaatatcaattttgttttcttggatctctcacatttcctttgtttacagttgtacatttcctccctgtttttaccaggccttagaaaactgtgctatacagttgggccagaagggcaagcaaatttctgaggaaattactaggtggcatttttttttatcataatagagaaaagaatgccagctttgggattggactgtggttcagagtctgagtctttcgtcatatactaaatgtgcaaacatagttaaaatatttaacttctaaagccctcagtttcttcatctgaaaaatggggataatgccttgtaggattttgttaagtatacgatgagatgataaatataaaatacaatacctgacagacagagcatgttaaacactatgcaggctgtactacagcaaacccaaaggcatctcacacctgtggagatggcctctggactgacgtcccaaactcaggttattataatgtcttctgcccaacattaggagattcctaaggacctctttactctgtctcctaacaatgtttccttcttatatttattgaagggaatcttttgttgacaaaattatttacctcagttttcattttctaattatttatacttgtcttattcttttccatttaggctacttcctttcctaatgaaaataactatataaaatgtgtatcataaaaatgcaatatcactttgaaaatacatattaataaatgtgtgagtcttaagtgataacttcagtaccatctgaatatagttctctatcataagcaaataaattatataaatatttgctctctatacaaatgatgagaataaaacgaaattgaaaaattca

SEQ ID NO: 47029 - DNA, 1066 bp, Homo sapiens
ctcaaggacttctcaatacagagaaggagggggtgacacagaatgtaaaaattaaaattatgaatttaatagagaccacaatataaggaatttggcaataaaaaagataaatgggttagaaggtattttctaaagaattcaaaaaatgttttaagtgatagaaacattgtcaaaataagtgtatcaccttctaaaatgacattttgaaaaagtaaaattgataatgttaataaattatagtatgtcagaccctgtcaaactgtcctccatgagaacacattaggcacagctatagagataattcacatattggaaaatagaagcaaagaaactaactagaatacagacctggaaaacacagagattgaaaatatgaaaaggagatttagtaacacagagcatagagagaaaaagcataccatatagttagccagagttcctaaagaaaatagtcccagtttcttcaggaactctggctaactatatggtacgcttataccatataagcatatcatatggtgtaagggggactatttgaagacataatagctgagaactttccagaattgaagaaaggcaccaagccatgatttaagaagcccaacaaacccaagcaagaattctttctagacatattgtagtgaaactgtgggacaataaatataaaatcttaaaagacagaggaaaaaggggccgggtacggtggctcacgcctgtaatcccagcactttcggaggctgaggtgggtggatcacctgaggttgggagttcgagaccagcctgaccaacatggagaaaccctgtctctactaaaaatacaaaactagccgagcgtggtggtgcatgcctgtaatcccagctactcaggaggctgaggcaggagaatcgcttgaacttgggaggtagagcttgcggtgagccaagaccgtaccactgcactccagcctgggcaacaagagcaaaactccatttaaaaaaaaaaaagtagagaaaaaaggcctcaaaggagcaactatgagagtgatagccaattagtcttcaaccataatataaatatagagacagt

SEQ ID NO: 47030 - DNA, 1048 bp, Homo sapiens
ctgtaccttggtgtatgctgttaactgctgtgttacgttacctctcacctggactgagggattaggtttaatataattaagtatatcaataaattatttttgtgacttagttattaatatatttaaacaaatattgactatatgaaactaacagcaagcatttgaagggctaaaaacattttaaaatatacttactgttacttcagcaaaagccaaaaagaggattcagctcccatgaacaattctgttgatgttaagagtgatttcttttttttaggccaggtatggcagctcatgcctataatcctagcactttgggaggctgaaggtggaggattgcttgagctcgagttcaagaccagctggggcaacatagggagaccttgtctctacaaaaaattttaaaaagtgtgattttttttaacgtatcatgactacaagttatttaatgactataaatttaatgtggacattcttagaagggctttatctagtttcctatgtcaattcatggttcagacaagggcatctgtgtcaaataaaagattatggctacaatttccaaaaattaataaatgattgaaaattactagaatgatttaatgaacaatttgagctacaatggttatcacctggtgagcatttttataatctatataggttaatttatttagaaaatgtttttaaattttatttatgttaatttatattaccactgaattttcttttcttttctttttttttttttttttttttgagacagagtttcactcttgttgtccaggctggactgcaatggcgcgatcttgcctgaatgcaacctccagctcccaggttcaagcaattctcctgcctcagcctcccaagtagccgggattacaggcatgcaccaccacgctcggctaattttgtatttttagtagagatgaggtttcaccatgttagtcaggctggtcttgaactcctgacctcaggtgatccacccacctcagcctcccaaagagctgggattataagtgtgaaccactgtgcctggcctgaattttta

SEQ ID NO: 47031 - DNA, 1057 bp, Homo sapiens
cccagccactcaggaggctgagacaggagaatcacttgaacctgggaggcggaggttgcagtgagctgagattgcgccactgcactccagcctgggcaacgagagcgaaactccatcttaaaaaaaaaaaaaagttggggggacaattttatatgcaagaggtagattgtttggaccaaacttccaactgagaataatcagaaaagctagagaaaatattaaatatttaatgtaagatatagaaagcttatgtgtgaggggattagagcattatcagggaaatgaagaaattgcagggtcaagttctaaaaaataggaaagccagtgatgtgagcccagcatttgagctcgcttctctgagagacatctgtcaatctcaaaagcagcagcagcaatgaggctgaatggtatttctttctttctttctttctttttttttttgagacagagtttcattcactgttgttgcccaggctggagcgcaatggcgcaatcttggctcattgcaacctctgcctcccgggttcaagcgattctcctgcctcagtctctggattagctaggattataggcgcctgccaccacgcccggctaatttttgtatttttagtagaaacgggctttctccatgttggtcaggctggtctcgacctcctgacctcaggtgatctgtctgcctcggcctcccaaagtgctgggattacaggcttgagccactgcgcctggcctctgaatggtatttctaatggactcatgggtgggatagatgagattacaagaattgcaatttaggatccgcaatttaggtttgggattgaaactcccctcccctcacccagtataccctaggactaaaggtgaatccagaatcgacagtactcatggggactaaaggccagcttcaaataatctcattccctacgtagattaagaagacctcagattgccggcacctctactctagcttacttgccataattaaagatgaatcttctatggaagaagaaaatatgcagctgagtgccgtggcttacacctttaatccaagttctttggg

SEQ ID NO: 47032 - DNA, 1048 bp, Homo sapiens
aaagtatagccaggttctgaaacaacataaacatctttgtgggccagaaatgaaacatggacacaaagttttaaacggggctgaaaccacagaccagctggctttcagtctagcactgacagctagtagttttgctcctgtcaggtaaaaggattaagaagtgcttaagtgtttcatgcgaggcaggaaccagagccagaatcactacatgaagtccggggtttggttaaaatatctgtcttatttatgaaaggctgaaaagagaaaagagctattcactacccgagactataagttttagctgataaaaacacagcctcatcaatagctattgaatgaagccacttgctgagtcagtaactgaatgtctatgtatgatatttccagtatcatgattaaaatggagccccgaaatgtcattataaggcctagttgtggactgggggcccagatggccaagtgggagcaactctgaaaccattaaataggaggagagagagaaattaaaaaccttttctattcaaaagaaacctataacccaaattctaaaatttataaagacatataatattaatataacaaaatcagccaccaaaacattcatttctctggatgaaattaattttatggagcagttcaacaaagactttattttaaaaaataaattatgtatttatttttgactagtaatagatgcatgtagtacaaaattcaaaggtacaaaaagggtaaacagtgaaaagtaagtctatctccacctctttcacctagccacccagtttccctccccaaaggcaaccactgttacccatttcttgctatcctttctaagataattgttgcatatacaaacatatatatatatatacacacacacacactcacacatatgtacatttttatataaatggtagcatttacacatattattatttaccttgcctttttcacttaataacatgtttagagatcatttgatattaatacccatgggattaccttattctttttaatagctgcatggtattccaatgattgggagaaactt

SEQ ID NO: 47033 - DNA, 1062 bp, Homo sapiens
tgatattacaggcaggcgtcaccacacctggctaattttcatatttttagtagagatggggttacatcatgttgcccaggctggtctcaaacttgagctctggtgatccgcccttgttgacctcccaaagtactggaattacgggagtgagacactgtgcccagccatctttttttaaatttatgttttactaaacagcaacttccaatatcaaagtttttaataagtaatattttgaggcaaaaatgagccaattaaagtcaaagtattgaatttctcattaaacttattcaattcaaaactattagcttttattccaactttatatttttctatatttttggtattaaaatatcctttcatgcaacaattatagttttttaaatgaccttattaagaaaaattaaaaagctaatccccctattttttatgaaagtccaacagtctggaaacctagccagttcagagatctttctgaaactctcattctaataatctctcttccttaaaactctcagaccactgtggcctacagcaatataaccccactggggttttaaatccatctgtgcattaagtattttctgtagaccgaataaaatatctttgttattttttaaaaacttttcaaatgtatgaatatgctcaatttattttaaaactttaactttccagtagctttttagaaaatattttttgtacgtatttttctcaatcacgtactttttttttttgagacagggtttcactcatgtcgcccaggctggagtgcagtggtgctatctcgactcactgcaacctccgcctccctggctcaagagattctcttgcctcagcctcctgagtagctgggactacaggctcgtgccacacctggctaattttggtatttttcatagagacgaggtctcatcatgttgcccaggctggtctcaaactcctgaattcaagagatcagctggcctcggcctcccatagtgctgggattatgggtgtgagccactgtgctcagtctcagtcacataatttctgtcaaatatggaagtcattgaactagtttta

SEQ ID NO: 47034 - DNA, 1047 bp, Homo sapiens
ataagaattaaaattttatataatgtgtctggttcatcagagattgttatcacaggtttggtgaaatcctttggaacatcaacgtgtaggtttgaaaactgtacccacttcatattggtactgagaagaaagccaccatttttggctatattgcccttagaactgtttacagaaaaattccccaatccctgccagaggcgccggcacacggccccaaacgccgtccgcgccgccacggtaaggctgtattggacagttatgaatattttgctgtgcttgatgctaaagaacttggtatctctattaaagtacacgaacctccaaggaaaatagagcgatttactcttctcatatcagtgcatatttataagaagcacggagttcagtatgaaatgagaacactttacagatgtttagagttagaacatctaactggaagcacagcagatgtctacgtggaatatattcagcgaaacttacctgaaagggttgccatggaagtaacaaagacacaattagaacagttaccagaacacatcaaggagccaatctgggaaacactatcagaagaaaaagaagaaagcaagtcttaaagcctcagggaggccatttttgcctgaatttgaaatgagggtgggccagatgagtatgtttaagtggagagtgcttccagctgagatgatttgagtctgccctaactgctctattgagttctcgtgccctcatcagctgagagcagggaatggaactttaatgcaagaaccacttttatctactcttttttgtacatgtcattgtttcagttctgatttcaacaaacatgagcaaaccactttgactcaaagcggaaagagtgaaaattctattttgttatgctactggtgttcaattattagtttgtaccatttttaatttatgtcagttgatgcatctgaaaataagtgcttgaagtgttcacacccttactttttttttttaagattcctagaaggaatctttggttaattcagattgagcagttaaagtttttgctatttacctttgtgc

SEQ ID NO: 47035 - DNA, 1061 bp, Homo sapiens
gcgaaagaacaagactccatctcaaaaaaaaaaaaaaaagaagaacatttgtcattgaattaaagacccgtgagtatatttcagaataagccccttcccttaaagtccttaacttaatcacaagcattgccatataaggtaatattcactgtttaacgtgtcattatattcaaagattccaaggattaacgcatcacatatcttttagaaaaaactattcggcctactaaactcgatgagtcttcatctactgagactcaggccgagtcagataaaaagctttacaatattccacacctctctctacacgtgttaaaaacaaggagaaagagtttctcttaaaattttaagttcactaaaaatagaacaaaagcagaaacaattgaggtttttgtggttgttgctgtttgtgtctttatttttaaagattctactttgtaccatatatacatggtaaattattcattatcatatctgcttcttttttttcatttgaagtaatcatatgccatggaaaatatttaaattcccaggcattgttagctgtagagctcataaaatgttcaatgcttcagtgagttgcaaattgaaaacagaaataaattcttggagaaacttgacagtattctacacactttgctcttgattgatgtcatgtggtgattccaataaatgacttttttcaaacaacttaagctataactgatttaagtaaatgggggtgcaatggttctttcttatagatctcatctgctgagatgctatacacagaatttcaatcatcttaccctatgatttttcaaaggtgtataagtatgaataataatattattattcattattatttattctaaaaataaaaataattatattcattattctaaaaataaatttttgtttattattaataaaataacatataaggatacatttatttattacaatcatgaagatatttagaatgtaccattttctaggtagtaaactagtgcttcacatatttttgttcatttaatctttatttttataagtcaacaactatagatattattttatattat

SEQ ID NO: 47036 - DNA, 1050 bp, Homo sapiens
gtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagaccgggtggtggccgggcagaggggctcctcacttcccagtaggggcggccgggcagaggcgcccctcacctcccggacggggcggctggccgggcgggggtgctgaccccccccacctccctcccggacggggcggctggccgggcggggggctgacacccccacctccctcccggacggggcggctggccgggcagaggggctcctcacttcccagtaggggcggccgggcagaggcgcttgtttatctgctgaccttccctccactattgtcccatgaccctgccaaatccccctctgtgagaaacacccaagaattatcaataaaaaaataaaaaaaaaataaaaaaatgcagtctctaaattttgggggagactgatttcagtaataaaactctagtcttccaaaaaaaaaaaaaaaattcttttaaaacttctaattattaggtttttttttttatctcttcagtacatcaaaatgtctggtggtaggaaaatactggactcatatatgactgtctacgtgatttgcagggcccagtgcaaaatgaagtggatgttgtacctcgttcaaagtgttaagcgtttcaagatggcaacagcagagcattaggccaagtatgaggtcattatgtacatgggtccttgtgtgaccacagaggtcacaggaacatgaagctagacctgagtgtatattcagataggtaaatcttacagatttttaaaactcaataaaagaaaaactacatttcatgtgtgaacacaaaaattggaatttaattggcaatagcattgggatttgtgctcagagtcacagtttacatctgaccacaatttc

SEQ ID NO: 47037 - DNA, 1039 bp, Homo sapiens
tattctgcaattttcctaaatgcaactattagttctaacaggtattgttttcagtgtataggatttttttgtatataacatcatatcataagtaacaggtaattttacttcttcctttagaatgtggatcttttctttttttcattgcctagttgttttgccaggactttcactgctatttttgaatagatgtggcaaccgtgaatatcttgccttattattaatcttagaggataaactttccacacttcagaattcagtataatattagtgatgattgtttttgtttttttgtttttgttgttgtttttgtttttctgagataggatcttgctctgtcaaccaggctggagtgcagtggcatgatctgggctcactgcaacctccacctcccgagttcaagctattctcatgcctcagcctccctggtagctgggactacaggcacacaccacaacgtcaagctaatgttaatattttttgtagagacagggattcgccatgttggtcaggctggtctggaactcctgacctaaaatcatccacccacctcagccacccaaactgcttggactataggcataagctgttgaacccagttggtgatgagttatttacatatcttttgctatgttagtttccttttatttctagtttattgtttttttatcttgaaaagatgattaatactgtcagttgacttttctgcattatttgagatgattgtgtggtttatatcttttactctgttaatatgatatattaaattgattgatttaaactctcattccaatatggccaaataggaagagctctggtctgcagctcctagtgtgatcaatgcaagatgggtgatttctgcatttccaactgagctacctgattcatctcattgggactgattggacagtgagttcatcccatggagggtgagctgaagcagggcagggcatcaactcacccaggaagtgcaaggggttgggggattttcctttcctagccaagggaaggcatgacagactgtacctggaaaaacagg

SEQ ID NO: 47038 - DNA, 2104 bp, Homo sapiens
gactgggctcttgggccagccaggcgccactgccattgtctacggccataccacctggaaaacgagagagacccaagctgcggcccgtgggcacgttcagcgccactgcttctgccacagtgaggggcgcactctacaactttcagggcccacagcaccaagaggacagggaggagccaacaaaggaatgacgctacgaaaagcacccccaaagcaaccaacaaatccaagtaaaaacatgtctcagggctccgttggttttcccgagtgggaggccctgcccccctgttccagcccagcccaggcaccctccaccctaccctggccaaaggggcccctgtctaccagatagagcctccctctccaaggctctgttgctctccctctcaagctccctcaccctttccctttccctacttccctctccaccttgctctctctctctctctctcaatctccctggttcctctctgtgtctctctccatcgctgtttctctccttccgtttctatctctcatccctctgtcccttgctctccttcaagctgtctgtctttgtgtgtctgtgtgtgtgcttgtgttcccgcgtgtgcgcccgtgtgtgtctgtgtgtttgggagtcggtttgctagtgactgtggtggggtgtgtctggatgtccatcagtacctttgtcccaggatcaggctgccaactctattgccaacgcctgggtgtcacagttgccgtgatagtctcacacacgcaggtgtgttcatctcgttcattttcacgtagacaacgagagcgaaaccacagagaaaagaaacatcccgtgcatcacggcctgacaatggattcctgtttcctgtacaatgtggagtctccaatatagcctgtttgaaaactggaaaggagagcaccgacacgatgctggtcttccacgcattcctggaagtttctggggccccacagagctcgcgaaacaaacagtcaacatggtcacgctttcggggggcagaaacttgagcaacaggcacctttacagagggcaaagaaacgtggaatccagaatcacgcttcagttggcctgggtgtgactcctgtgtggatgggactatctgcctcgagctctgttgcagggctcaacgtggggatatgtcatctgtgaaccatgtggatgaaaaacagacaactacctgagtctcggctcattgctctctggggaattcgctcattccttcggaaacggaattggtctgaattgctccgggatgaagtaacccaggctggtgatccagagggccgctgagcgccccgccggccaacggggctgtgggcccagcactcagcctgtactgggcacccaacatattcccggagttctgggtcctgttggttctggaggcataagacattttttgtctctgccttctgttctctgtttcttgctccttttgtctctccgtccatccttccatctgttctaccctccctcccctggctttttcctccctttctccctccctccctctttctctcccttccggggtccctccttccacccatccttgcctagctccatccttccatctcactctgtctctgttcctgtcctcatctctgcctgccttccctcttgcctggaaagggcagcaccctggtttgcgcgaggtctcgggtctttatttagttgtaaggcgctctatggtgctggcgaggaggctggcgggacacgggttggcaagtgatggtgagcgaagaggcggaggagttgagccacagaaaggagaactggcctggattctgccccggcccagtgtttcgcggactgaggtctccgccaacccgattgaagaacgcgggggggaaagggaggagagctccgcctgggctagttagaagactaggctgctgcctggaaacccgcgcatgcgcagtagacagcccacctccctgtacctggaccggccctgggatccccgggatgctcaggaatgctttcttttcattgttgacagccctactctgtgtggagtctctcgctggacctggaactcagggatcctagggaggtcagctggaagggaagacacgcctctccataccaagcctgaggttcact

SEQ ID NO: 47039 - DNA, 1516 bp, Homo sapiens
caggtgcggtgtgtgacgcctgtaatcccagcactttgggaggccaaggcgggtgaatcacaaggtcaggagttcaagaccagcctggccaagatggtgaacgcagtctctactaaaaatacaaaaattagccaggcacagtggcgggcacctgtagttccagctactcgggaggccgaggcaggagactcgcttgaacccgggaggcggaggttgcagtaagccgagatcgtgccactgcactcctgccttgcgacagagcaagactccatcaaaaaaaaatgtaatttaaaagattaaaagttaagatagatttttacaaatgtatatatctaccattatagtatcatacagaatggttttactgccgtgaagattctctgtgctctgtgtatccatctcttccttccccttggtccatggcaaccactgatctttctactgatcccatagtttcaccgtttccagaacgtcatataattggaatcgaacagtacgtagacttttcggattggcttcttcttttagcaatatgcatttaagtttcctccatgtatttttttgtggcttgatagttcatctcctgttagcagtgaataatatcccgttgccattatacttttgtcaagactcagaacgtacaacgtgaagagtaaacgtgaatgtgcactgtaagctttgagtgataatgaaggatcaaggtaggttcctggttgtcacaggtgtgctcctgtgaggcaggaagctgtagtggggaggctgtgtgtggggaaagggacatatgagaagtctgtactctctgctacgtttagctgtgaacctgcacttctctaaaaaataaaattagttaaaattaaaagcaaaaaattagaaaaattaaaacattacaatgtgttatatagttttcaaatcacaagacagaaaaagacataataaaagaaactatagaaaacaacaaggataggaataaaacatcagtgatagaaggcagaagacagaaatgtggagccaaacacattaatttattttaatcattagttatactcatttatactaatttatattgatttaacatattaattctgactaaatggcattaaaggaggtctgaggaatttgcatgtcacattctggatgacaggactcaataatattaactctttagttggctgtaaatcatttaaaaatatgctcaaattccaataaaaattccaagaaaaatattttcgaacaagaacatgtgattttaaatccatatattgaacacacacatacaatgagagccattattataaaatttactataagatatttaagattattatcactatccaaaattaaacaaatttgaaatggcacaaaaataaacacattaatgaaagagaattaaaaacacagaaattgagtgtaattttatctagtaacagggtaacattttaaacccacaaaacagagcgattgttccatttgtggtattaaaatattgggtaatgatttcagaatataaaatgacaga

SEQ ID NO: 47040 - DNA, 1052 bp, Homo sapiens
ctggggtttgtataaagtggaatgggaggaatagggaagaagcccccacctaccctctccccttgtccacttgtcctccttcactagtggataaagtccacgggaacaggcaagttattttaaatctgtatcttctgttgtcaagatctgtaatcagttctgctcgctggactggggacaggaaccaagggaacatgagggtgaacgggttgacatggagtccaggaacacactgtgcctacatgcagaatgtttgtgccaggaaagccagtcagcaggcagatggtctcagataccaagctagtgttgggaagcaagattcagtctcttgaaggcggtgttcctcattctgtggtttgtatcacttgcttcagaatgacctggagtacttgttaaaatgcaaattttgagcccaatcctagacctcctaagcctacatctctacggatgggtctcagtagtcgatattggaaacgtgcgggtccctaggagatgcttatgcatatagatttgaactgttgtgtttaagggttagggagctggcaaaagcaaggaatagaccaagccctcgggtgggaaggctccataaccttggcactgttagcattctgggcggaacaggattctgccacatgcttcgcagcatccctagcctctactctctaacaccgtattccagttgtgaaaacaaaaatgtcccgtgggaggcaaaatagtcaccagttgggaactggaaccactgctttgtgagatcagagtggttactttgttcccaatccagggatcagaacacacgatgagagaaagtccagctattggaactggagtgccaagttggagctagacctacaacaaaagctccaaaagctcctttatagagcttgatcccatgcctcagctacctagcttgtacagatgccatgtaactctagatttggtgacagaaggaatttaaaggccagaactagacagggtctttcaggttaggccagcacacaacttggacttttgacatcatccagatgcttgaaccaacctcagttctgaggcag

SEQ ID NO: 47041 - DNA, 1043 bp, Homo sapiens
taaaaatgttggaccacgtgtacatgttatctattttaaaaattagattttaaaatacaagcaagaaaacaagaaaatgaaagcataaaaagagcatgtggaactaccagaaaaatatactaatccatggagataatgacaaggtagctcctagatgcactgatttctctaccacattgtataaacaagccatcaactatgggatttgtaattaaaaatgagtctatttgaaacaccacactataaaaagctattaagtaaatctttaaagtgacagtaaatgatgacttaacattttaaagagatacagtcacatcgcatgtgtgaatgcagtcatctgtataaaatgtcatcattaccttgatcatttcttcttctgctgttttactttttgcttctatgtcccctgcttcattgtatctaataaagcatctatttgaggccaacaaagccattttcccctaagtgaaacaaaataacaaaatagccatgaggatacttcttgtagaagaaacattaagtgtttagactgaatgaatttttcctccctgatttaaaaatcacagaaaagaacttagagaaaaacctgaaaaatataatacaagaacatatagaaaaggaaaccaaaatcacctttcattttgctattcaaagattgccacaataaatatttgtagtgtatcttcctagtaggactaaattctaattagatgaggtaggattacttcctttctaaaagatctactgaagataaaactgatttagttctgtttgaaaaattagctttaaagacaagaacataattatgaatgcatactttattcaaatattagcattttaagtaaaatttattttcttcacaattagaaaacatgaaaaggcatatacaatgcctttggtgttttgaatttaagaatcaatgtctgagggacttttgtgtgtgaaaataaatattcatatacatttttagttgtttaatgtttgatgtattacactgctttctattaaacaaaactttaaaaactgattttcttgtgtatcta

SEQ ID NO: 47042 - DNA, 1002 bp, Homo sapiens
tgtcttttagaggcatcatagttttagtttttacattaaatctgtcattaatctcaaattaatttttggcatggtgtgagtttggtttcaagatttacttttttttttttttaacatcttgatagccatttgtgccagcaccactggtgtttcctttttccattaatccagtttcgtatcttcataaaaagtcaattaactttctatgtattggtctatttctggactctgttctatcgattgtctgtttttcttttggtatatttctcttgattgctataatttcatgaagtcttgagatcaggtagtgtgtgtcctccaactttgtacttactattagtttattaatttctacagtgaagcctgttggattttctcagagaattgtattgagtccagatcatttgggggagaatcaacatcttaatattgggcctcaatatttcataattttcaatgtagcagtcttgcatgcctgtttaaaaatttattcttaagtattttataattttacattactgtcagtagaacttttgaatttgactttccagttgtttgctgtcagtatgtagatatacaattgatttttgtatagtgactttatagtctgataagtctgtttcacttattacttctagtggtttgtttatatagaaaactaagaaatttgcaattatgtttcctgtgactatcattttacttctttctttcgaatcttaatgtcttgtcttgctttttattggtttattatactgtccaggacttccatagtgttgaacagaagtcacgagaatgggcataattgcattgtttccaagcttaggcagaaaggtttcagtagtccaccatatggtatgatgtctgtacgatctacagagaaaacctttatcaaaatgaggacattccttttaaactttgtttctcggcagtttttatcataacgatgtttaatgctgtcaaatgtctccttctgtatctgttgagatgattatacaactttct

SEQ ID NO: 47043 - DNA, 1050 bp, Homo sapiens
taaactggagccctcatgcattgccagtggtgcaaatggaacaggcattttggaaaatgatttggccatttcttataaaggtaaacatacacgtatcatatgactcagcaatcccattcctagctgtttacccaagacaaatgaaaacatacagacttgttcatgaatgttcacagtatctttctttacaatagccaacaactagaagaaaaatctaattttcattaaccagtgaatagataaacaaatggtggtatatcgacaacacaataaaattgtactcagcagtaaaaggaacaactactgaactactgatacatgcaacaccaagaatgtatatcaaaattattatgctgagtgaaagaagcttgaagcaaaaggtgacatattgtatgcttccatttatataactttctggaaaatgcaaaactatgggagcagaaagcagatgagtggtttccaggggctggggataaggggagaggtttgactacaaagggctgcaaaaaactctttggggtgatggaaatattcaatcttgattgtgatagtggttacatggctgtatatattcgtcaaatcttatcaaactgtatatctactaggagtgagttttactgtgtataaattatacctcagtaaacctaagtttaaaaagatacggtatccatgaaacataactaggatgtatttttacaagagagaatctttggaaaatacaaacaaaagttttgggaaattaaaaatataatggtagaactaaaggactggaagataaagtcaaggaaatttcccagaaagtagaacaaaataaagagatgaaaaactggggaggagaaggggaaatagaataattaaaggatcaattcagtagtaaaaataaccagaatggttactaaatagtaattcaaaaacttttccagaattaaaggacacaagtgttcagactgaaagggtccatcaggtgtccgatataataaagatagagtcccacactaagatccattattgtaaaacagaggaacactgaagataagtcaaaggtcctaa

SEQ ID NO: 47044 - DNA, 1036 bp, Homo sapiens
ataactcaatcatctaaattgcttattagttttatttctttttaattgtctattttgattaattttctttttctccattggtttcgtgtgtttgtggaggtaaaatatacagaatatagaatttgccagtttttctatttttacgtgtacacttcagtggcatttaaatacatgcaccattttaccttcccaccagcattgcacagggtttcagtttctccacatcctgcccaacatttgtttttctggttttcttgatttctgttttttatttgttttgataatagcattctaatgggtgtgaagtggtattgcattatggttttgatttatatttccctagtgactagtgaagttgagcgtcttttcgagtgcttattggccatttgtatatcatctttggagcaatgtccgtatatatcctttgcccagttttgaattgtggtatttgtccttttggagttctctacatagtctggatattaattccttataatgtatgtagtttacacatattttctccattctctgggttgccttttattctgacagtggttcttgatgcacaaaagtttttaattctgatgaagtccagtttgtctgtgttttcttttgttgcctgtgcctttgatgttctatataagaaatcattgccaaattcattgtcgtgaagctttttccatcttattctaaaagttttctaactttagctcttacatttaggtctttggtctattttaagttactttttgtatttggtgttagataagggtccaacttcattttagctaaaattttatgtattttaaaattgattatgaaaagcatgaaatgtttagttgaatagaaaattttgtgcagtggaattaactgaatctttaaaacctttttattatggaaatatccaaactaatccatacatagaagaatataatgagtcccccatgtgcccaggccccagcattaattatcaatattttgccaatttcgtttcatttacatacacacccccacacacgttttttcctaaaaaatt

SEQ ID NO: 47045 - DNA, 1158 bp, Homo sapiens
ctttacagcctgaagacccatgagccaatgaatccccttttcattatgaccacacagaaaataagtactgcaaagtggagctatgaaatatcttcaatgacttttcccgattgtcttggctgttagcactgggtttctttttaatgcaaatatctgaagccttcttgaagtttcccctggtggagagtggaagttggatgtgtgggaaggggacagttggagggtattgggagggtggggagagtttcgggggattgtgtttggggttacaggtgaaaggcaggagtgccaggctgcaacaaagatagctgaaaatgtaaagcggttcagaagtcggtaacaccagaagttggagagtttggagagcttgaaaaaagacaggaagatgagggaaagttgggaccattgtagagacttgttaaatagttttgattaaaatgctgacagaaggaaggccagggaaggtcagggaaggccaggcttacaaggtctcagatgaaaatgaggaacttactgggaacaggagccacggttacttttgttttgctgtagcaaagaacgtggctgcagggcgaccttgcccttgagatctgtgaaactttgaacttgagggtgatgatttagtgcatatctggtgaaatgaacttctaggcaccataacacaagagggatcctgtctgcatcaaacagtctgtgctgttatgtgtgaccaaggaaatgacttcaagttggaacttatatttaaatgataagcagagctcaaaagtttggaacatttgcagcctggccaggtggtcaaagagaaaagctgattttcagggggaaaattcatgaagtctccagaaatttgcataaaatggaggccagtgctaatagccaagacaattgtggggaaaaggcttggaggcatttcagagatgtttgcaacagcccttgctgtcacgggccttgggacctaggagagaagaatggtttcctgggccagccccatggccctgctgctgtgtgtagcctcaggacactgctgcctgcatcccagcagccccagctcctgctccgaccttggctgaaagatgtacaggtacagcttgggtcactgcctcagaaggtgcaagctataggccttggttgcttctacatagtgttaagccagtgggt

SEQ ID NO: 47046 - DNA, 1018 bp, Homo sapiens
aaatcaaaggcaaagaatagtttgattgacaactaatttttctttatcaacactaaaaataaggagactgatggcttagaactcttaatctagtgaaactttccttctaaaatgaaagcgaaataaacacatcttcagataaacaaaagctgagagagtatctacacaaaaagaaattctcaaggatattcttcaggaagaaggaaaattatcccagatagatatttggaataaaatgcagcaaggaataaaagaaatgttaaaaataggagttggtataaatgaacattggctgtataaaatattaataattgctgaaatatgtatattaattaatatggagaattaaattatacaaccacagtaactaaacaccatgagcataattgtagttaaggtaagatccttgaatatattggaagaaaataaaggtatagataaatactagactttgataggtcaaggattcatgttgtagtttctaggtaacgattaaaaaaaatagaaggaaattacataacttcttaagagaggaaaacataggaactttaaaaaattgagaaagaaaaacagctaggtcaatttcatccatgtatacatatgtaactaacctgcacaatgtgcacatgtaccctaaaacttaaagtataataaaaaaaaattaaaaaaaaaaagaaaaacagctaggtcaagtaaaaagcacataaggtggtggatttaaacttgaatttactggttattactttaaatataagtgaactaactgctgtaggaaaaagacaatgtaatggtgattcatacctgtaatcccagcactttcagaggccaaggtggtaggattgcttaagcctgggagtttgagaccagcctgggcaacataaggagaccttgtctttacaataaataaataaataaataaataaataaataaataaataaaattagccaggtgtgatggtgtgcacttgtagtcctagctaattgggaggctgaggtgagaggattgctcaagcctggg

SEQ ID NO: 47047 - DNA, 1047 bp, Homo sapiens
tagcttcaatcctctcctcatctctgttccagtatacatctttccttcttattctgcaaacattagaccacttgatattctttaaatatgtcatgtacttttcttgtgtctgttctttgggataattcctatccttttcagggaggcaaattgcacgtgagtttaagtatgaaggcaatgtatacctgctgattgtaaaatatttaaacattgtacatatctgtgtggttttaaaagtctgcttttaattatgtaaaattcatcttccctttccacagataacttctgttaacaacttgatatctattgtacaagatgtgttactggcatttccatgtatatatgtatataaatgcaggaaaccaacatgtcattgacacctctcttctttacttttccccatatctaatcattcctcaagtcttactgatttttatcagctagaatctatctccttatttctacctctattgccactctgatccaggctaccagcatttccctcttaggcttctgaagcaacttcctaactcccacttgtgctcctcacactcactctggtcggctatccattcattctccatacagcaactagagtcattcttttaaaattgcggacctgatccttccatctcccagctgaacgcttttcatttgcttcctgttctcatgagtatgccaaaatgtattaattctgggctaggaggccctgaggaatttggtccttccctcctcccccctcgttttctgtgcttcgccctcactggcttgcctttcttttccttaaatacatcatgttctctcctattttagatccttttccccgaaggtatggaaacattatttctgtaagcttattcttctatatagatgggaagtttttaaatcagataaggttctaagggcatgtggacaatttacgttatcatagtattgttcataacgtccatcattattctgtagactgtaagggcttacttagctcgtgtaagaattatccttcaaaaagcatttttaaggtattagtattgctaatctataaacttt

SEQ ID NO: 47048 - DNA, 1029 bp, Homo sapiens
tccctgcagcagaaggaagcttgaaattggtaacgagcctcagaagggacagaggcaggccaccatgctaccctgagaggatcgcatgtggacacggggctatgacctggccctgctttgacccactagctgtgctgtagggccaggtggagcctggagtggcctgtgctaaggggctactatgagctctttccactcccccaaggcattgcataaataatgtcactttctgtttgcacagcaaaatcagggacacaattttctagaacatggggtgcctcccctccccccagcccaacagaagttctacaatgactgatgggcccttgtttttgtttgagacggaacaccccacagggttccgagtggtgatttgtggcccacaggccactggcaagtggaggcagagctgcagagccctcgggagccacagagggcctgctggccgccacgacatgccaactcagctgctgctggccctcctgtgggcggcagtgctagtgatgtgcagaatcttaggactagtgccaaggaacctataaataccctgggtgacccaggcgtgcactgctgtggtggccttcacagtcagaagatgacaagctgagaaggggagaatcggcccaaggtgagatccacagaaaggccagggccaagatgcggccagcacctcaggctggtggtggtcttacgttgaccatgccagaggccagtccttgattgctccaaaccctctgttcgagggttccaaatgaaatgagcaggtcctcgtgtcaggacctaggttagtttctgaaaaagcatgaaaagcaggcctcctgaacttccccgagtgactgatgcaaagtgcgtcctgcatgcttcacagcaccatggagaggatcttcaggggcaaactgcagactatctgaatgacggcactgaccatcagcaaaccgcagagctgcctgaccaagaaattgcgagacagaagcaatgcttgcaggcgaagaagaaggggccagacacagtggctcacgcctgtaatcc

SEQ ID NO: 47049 - DNA, 1027 bp, Homo sapiens
gataccaaggaacaacagcactgggtctccttttggggtgatgcagatgttttgaagctaggcagaggtagtggttgcacaacattgtaaatgtactaaatgccaccaaattattcatttttaaatggttaatgtgttatgtgaatttcaccttaacaactaataatattataggtaaggcacaagttacatctgtagcacaaaaatggccctaatttttaaaacactgctccagcatagcaggtatcacatgtgaggtagcaaaagctggagatcaaagtgtgatacctggagacttatcagtaagggtcaaatgttttttcaggttttgagaatcattcttggaattgttccagaagatatatcgtataactcttcttagatgctaagataagaaggcagatatacactagctcattttgtgttattttctagagctttactccagtcaatttcttgggggcagcatttgtggaatcagtggttcatctgaagggctgtgctgtggaattactatgcatttgttttgtcttccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaa

SEQ ID NO: 47050 - DNA, 1043 bp, Homo sapiens
tttttgagacagagtttcactcttgttgcccaggctggagtgcaatggcatgatctcagctcactgcaacctccacctccggagttcaagcgattctcctgcctcagcctcccgagtaggtgggattacaggcacctgccaccatgcctggctaattttattattattattattattttagtagagatggggtttcatcatgttggtcaggctggtagcaaactcctgacctcaggtgatccacccgcctagcctatctttttcaatacttgtgtaagtattgttttttgagatagatgcttaagaatggagtgctgagtcaaagggtgaggagactgaagtgagactcggagaagttaaatgcataactcacatcacacaggcagcaggtggcaaagccaacagggctccttttggggctccacatcacccccattacaaagaaaacgatggttctggccgggcgcggtggctcacgcctgtaatctcagcactttgggaagctgagacgggcggatcacaaggtcaggagatcgagaccatcctggctaacacggtgaaaccccgtctctactacaaatacaaaaaaattagctgggcatggtggcgggtgcctgtagtcccagctactcgggaggctgaggtagaagaatggcgtgaacctgggaggcggagcttgcagtgagccgaggatcgcgccactgcactccagcctgggcgacagagcgtgagtccgtctaaaaaaaaaaagagaaaacactggtcctgcccagcacggtggtgcctgtagtcccagccactcaggatgctgaggtgggaggatcatttgatccctggagttcaagaccagcctgggcaacacagcaagaccccatttctaaggaaaagaaaatgaaaacattggtcctgtcaaaacgagtgctccactttccactttgatttgactctttcccattcttgtttgcccagactgcaggtgaagctcagtattgatttcaggacctcaggatacagaacacaagagctccctgtcacgagaggca

SEQ ID NO: 47051 - DNA, 1071 bp, Homo sapiens
ctgattttgaaaatgtttttttaacatggtttacaaatgtagcaattcttaagaatgaagaaaatatgccttattactataatgtttttcaacaatacaagtgtttttctgattaaagtgtatgtgcagactatgcttcggggaaatactttgcttgaaacagcagttttccttccacatctctttctgcagccccactgatttaccatgatgaagaaaggttgagaagttctttatgcatagctacaagccttagttctaactttcttctctgaagtcttcttttgtgcttcttacacattaaagacaaggtgaatttaaggtgcctttatggtagacgatatttttagggcctgaatttaattttcaaactgaatgagtcacacagtagcatgtactgatcaacttgcatctgtgtagcaaatatttctttttaacaattagatagttactagcttatttttatcatatgagcaatgtacattcattatagaagatttagaaaatacagaaaaataagggggaaaattacccattgtcctatctccccaagagaactactagaatcgtttaggtcagtggttgtcaacggggaggtggaaatagggaattttgctccccaggggacaattgtcaatgtctggggcattttttttgttgttatagcccaggggttgctattggcatctagttggtagagtctggggatactgcccaacatcccacaaggtacaggacagccccctgcaacaacgaattatccagcccacagtgtcaacggtgccactggtgagacatttgatttagataggttttcttcccatctgtaaaagggtacattttattagaaaaaaataaatatttctttgggaaatcttagagatgctttagaatggaattctgaggcaacattttaattatattattgttattctactgttattgtcttgaaagtaaatggaagtgtgtatatgcgtggagagggcagggggcatacagagactctatcagagtccatgtaggttaatgctgttcagccagggctgtggaaaacattgtaatgactaaact

SEQ ID NO: 47052 - DNA, 1023 bp, Homo sapiens
gtccaactctaatccccatttgtagtagtttgccgaagccacagtaacaaagcaccataaactgggtggcttaaacagaaattaacataaattattgtctcatggttctagaggctagaagtctgaactcaaggtgtctgcagagttggtttttttttttttgagacagagtctcactctgtcgcccaggctggattacagtagcatgatcttggctcattgcaacctccacctcccgggttcaagcaattctcctgcctcagcctcttgagtagctgggattagaggcacacgccaccatgcctagctaatttttgtatttttagtggagacgggtttcccattttggccaggctctaactcctgacctcaagtgatccatctgccttgacctcccaaagtgctgggattacaggtgtcagccaccacgcctggtccttattctttcttgctttctaatgacttaaagctaaacatattttccaaacagaaatcagagtgtgtgcttttttactcatgaaccaacaagacagagtgctggtcatttggcctatccttggaaatctgtgatgtctggacatcttaagcatagcatgtagatgagtaatactcaagctaggttctgaagcataatttaattatactcctgcatgtttaaaagaattcagaacctaagaattaaaagctgacccagaggcaggcacagtggctggccgggtgcggtgattcactcctgtaatcccagcactttgggaggctgaggcggtggatcacctgaggtcagagttccagaccagcctgaccaacatggtgaaaccccatctctactaaaaaacaaaaacaaaaaattagccgggcatggtggtgcacgcctgtaatcccagctatcccagctactcgggaggttgaggcaggagaatcgcttgaatccaggaggtggaggttgcagtgagcctagatggcgccactgcactccagcctgagggacagagcaagactttgcctcaaaaaaaaaaaaaaaaa

SEQ ID NO: 47053 - DNA, 1032 bp, Homo sapiens
gtagtaatataaatagtaatttaaaaagtcatgcagacttggttggggagaggcatgaagtttgggtgtggtgggggcggggtgaagcggtagaagggttcgcaatcactgctgaaactttcaacatattctaccaacaatatgagccaccagggaattccttgcctcatctctagaacgaatcccattaagcagttgtggctacagatgaatttatctaggttgagagctgattcccaataacatgcctcattgatttgactctaagcagtaatcaggggcccaacagttgttggaccaaccagccttgattttccagagaaggtgatttggtatatggtagtgtctgagggtgagattgccccagatgggagtggagggaagcagaacagttttctctggtgttttactgagtttttgtcttgatcctaaatccaagggttagggtcagaaacacagactcagaggttagatttaacacccatttagtgggttaaacacatcaatggttatgtgaactttgttaaggtttaaaaagctatttagggcctgtttctccctcataggaatttttgcaatcagcctttttagtagatgcccatatagaaagtgaatttgggagggtctaaggtggtattactattaaactttttgaaaaggctgtgtgatagcaatggaaaaaaaaattcaggcatggaaatccaatatgcagtattgcagtagctagttttaattttatttttgtttttttggttttttttttggagatggagtcttgctctgttgcccaggctgaagtgtggtggtgcggtcttggctcactgcaacctctgcctcccgggttcaagcggttctcttgcttcagccttcaaagtagctgggattacagaagtgagccaccgtgcccggccactagttttaattttggatggtacctaggaaagcagttgagctagtatgctgcatacattgtagtgtgagaggcagagttccgagttggagagtgtctgcttccactttttccatttgatt

SEQ ID NO: 47054 - DNA, 1047 bp, Homo sapiens
tagtaagccaatgggctggaaattaaacacacatttatctcactccgagttcatgttttttattccattttatgctttaaatttagtttttccatttgtcaaggttatatgtgcacatggtttaaagggtcaaatagtgctgtaagtctgaagaagaaattttcagttccttgtcccattttcaaaacacaatcacttcaaccaatttccaaaggcaatcagtcacttaggcattgtagacaattaggaaatctttctctgttacatttcgcccctctgccccaacacgtacttttatagtccctttctcaataaagttatatcatgattttggtcagagcaattttcagtgtttattttattttgactatcctctttcctctccagtaaaatattttatttttcttcaagttaacaaaggttaacttgttcaaaggtccttcttcatttgcttcatttttctgttattattgatacaaatgtcaaccatcctcttactgtttaagtccctcttccatatattcaagtacatctgttggatattctgtcactttcatccttcctggagccttttgacttgctctatctggactggcttcccagtaggctctgcatgttactatcatctttatcatcctttcaccattatcttgggcgttcccttaacctctcttgagatggatccctgtttcctggattccatagcttctttttttccctcactccccacaaattttggtggagcatcctgtagtagatttctgagaaaagggtatattaaaaacacatttaaaaaatcttgcatgtaaattgcaaaaaaaaaaagtaaaaatatttttatcctattcaaacttgatcaacatttttagctaagtataggattccaaaattggaattctctctcaaaattttgaaggcatggctccatagaattttggctttccagtgaaaaatctttcagcctttagctgtggttgagattttcttctgggtccaaagctgtggtcagaaaaaggaatcaggagttctaagtgacttttttttaaa

SEQ ID NO: 47055 - DNA, 1003 bp, Homo sapiens
gtggcctctactggaatttcaaagcctcaggggctgggatggcttccttaatctttcaggaaatgagccaagaatgacagaggctgaagagatatggcagcaaaacacatgttctttctgtacctgaggacacatttgcaaaaatcttagcgccgtctcaggctgtctgtagagggtacattggaggacagtaaaaaatgactgatatttcatggtggggatgagaaataccctctccaataagaagaattctttgacactgaggttgcggatgagcactctgttgacctaggaggaggcagcagacagatttagtttctgcagtggcagaaagggaaagtgactcatgtgggtttaggagccgagccatccagcagtgtgctctgagcactcccgaccttcctgtctcctcgctttcctttctcttctctgcttcaccataataatgctcatcactgcagatatttccactctttaagatctaggtgcatcctcggatttgtctctctgagtcctgagacagcctctggccaaatccaggttggaagaaaacagacaagcttctcatcaagggctttatccttcaaaactttctagaaagaaggccgaaggagggagttaaagcaaaacagtcttgtgagaaagaagacattgcccagtctaaaatacgtgcctagagccctataatcatattgccaatgggcaaacacctttatttttggaaattttaccaatatcagagtgcagtccactttccttttcaaaagggctgaatttattcacatttagatacatgtcctatcaaaaatatttcacaatgtgaccaacttttctagattcacggtataaatcaactttatagacactcatggtttaacctcagttggtaattttctttcttttaagcaggcaggcaagaatattcatgattgttactattttatgaccagttttatccagagttttcacacaacagaggctccccatttcctgtaaggtatta

SEQ ID NO: 47056 - DNA, 1094 bp, Homo sapiens
tcgcagggctgtgtgcttatttgcctaaaggagccaggtgaaggcaggtggctctggccagctcaggaccctgcagtttaagtggtcatttgaaggagcttatgaggtcttgggaaagtaaaatattctacgtccatgttaggaatatatatctaccatgtcttttaaggatggtagggtttttttgtttttttttaaagtcattgtcatcaaaagaatttggttgtacatgatactatgctaggtactacatgaagacaattatgcacacctagttctgatttctagatgctgcaatcctataggaatatgcattgtcttaaaaaaagtcaaaaggatttttgtatactccctcttttataatttgttatatttttactatgtatgagtagatgattgaattattgaaatctgaccttgtttttagaactttggatagaatgaagtacacgcacccacacaattcacctctctctctgtgttgtttgtgtatagatgttacctgaataattaaaaattaaaataataacactgacttttttctgaatatatgaatacctgaacatctctaaatatctcttcattgtagaaaattataaaaaataaagaaactaaaggaagaaaattaaaatctcctgtaactccaccagcaccagcttcttcttgtgaagtagtctagcagagttgacctctgctgttctaaaacacctatgcaaataaaactttgataatcctccaccctgctctctctaaggtcctgtcttgagcccttgcagtctcagttctggctctctgacagtgtgtgttatttgccacagctctggactgaccatgtgcgagccagagagaacattcctcttgtctctacagcagcttctaagtggagaggaagtcctgccgcctggtactgagcgtgtctctgaaacacagtggccaggcagcctggcttctgattcccaagacctgccttcactgtgggtctcctacaccctacctggcaagttgaggactccagcctcaacgggaacttagctgtttgcacagcttagggaaatctttccagaaccccttctcattctgcagacctgcggggg

SEQ ID NO: 47057 - DNA, 1032 bp, Homo sapiens
tcatttcatgattcttaaattttcctttcttcggcttttctaaattttatttttcctgtgtccattattactgcttcactcactttgtcttttgattttccttattttttctaagattgatttacctttttttcatttttcttcttttttgatgtacttatatgtttattttttcttttcttaccatcatcccattcactcttatataatgttgccttagtgtgccacttaatttttttttagcaaatactcctatgacatgacaggcatcactttcacctacatgctggtttttatttttcttttgacccattttcattttgttttttttttttatttttaccctttatacttgagtttcttttgcttctttatacatccctgtatctcttctttattgacagattagaggtaagtcacattttcgtagccattaagatatgtttcagataacaggatggaagtctgagaatctgaactggtgatagaaataaacgctcagtgattatcaggactgttattaaatcattacactggtatttactatttctgaagttgtcccagaggacaaatttacattaataaacctgttttgatatcaaaacaatcttttcttacatttggtttctgcctgtatcttgatttttagtatatgtgttagtttaaggtagggcattaacttctgtttgttgaattatttgcaaggaatatgaaaatgttcgtcaggaatatgaagaagtaaaactagttcgtgaccgagtgaaggaagaggtcagaaaacttaaagaagggcagattcctgtaacatgtcgaattgaagaaatggaaaacgagcgtcacaatttggaggctcgaatcaaagaaaaggtactttttggtttcaattttggattatctgaattttattttagcaaatataaaaaatattttgcaggtgtttgaaaatattttcaagggttttcttgtatctttcatttcttaagttttttaaccaggaattctgccaccataggattttcaaggacatactta

SEQ ID NO: 47058 - DNA, 1032 bp, Homo sapiens
aaacattttgtgtaattctcaagtgaaactctctggttgtagagatttcttcttggagggagttttaaaattatgttttcaacttccttaatagctattagactagtcaaataatctatttcatattaggtgaattggtccttttgtccaagttgtcaaatttatgtatgcataaattctcttatcctttgatatgtatagaatctgcagtgataaccctatttcattcctgatactggcaattccccctctcccccacccccctactctttttttagttaatcttgccaaagattttctaattttattgatttttttcaaggaggcagctgtttgttttattgatttttctctctgttttccgtttcattgatgtctgttcttatctttatgattctcctgcctgatgtagatgggctcattttttataggttcttgaggtggaagcatagattattgatttgatgcttttcctcttatgtatacacttggtgttatacattttcctgttatcactgcattagctgtgccccacaaattttgatatgtgctatttttgttttcattcagtttattgtatttttcttttcatttttcttgagatcacacaatttgtttattcactaacctggtattagacatttagactatttctagttttgggctactgccagtagatctgccatagatattcttctaccgctttttgtatggaagtatgcttttatttctcttggataatttcctaggagtagaatatcattggtgtgcgttcagttttttaaggaattgccaaaatgttccagaattttggtaaattaattgtaattaataaaagttgacttgtgatggcttggaatttttgtttttaatggtccttcgtgaaaaattacaccttcttaaggtgtaatttgagaaacatttctctggagtagccttggaggggttagatttaggtagctacatggagtctccttacattctacaaagcaaagcagaatgagtaaggatgtaggtaaagtgatagattta

SEQ ID NO: 47059 - DNA, 1042 bp, Homo sapiens
agtgagactctgtctcaaaaaaaaaaaaaaggtaaaagtttaaggacattaagattataagttatttttatttgttataagtctctattttcagtaatgaatgcattataacttttataatgaggaaggagaggagtaaatctgacttggaaataaagctggctaaaacagattatgtgatgtgttaaatttatctattttaatgcaaaattctagttgtaaaatgtaaattgggcatataagtgtatatttgtttatatgtgtgtgtcctaaagaaaatctttactctgtcttaggtagaccatagttttgataaaaatttcactgacatcaagtggcaagttacatagctggttataaaaatgtaatttaccctgaatataagtgaaggaatctaagcatatagactgatgattaaaatctcacaatattagtctgaagtattggtagaaaatatttccattggaagaaaatagtttatttctgtttcagattacaggttgagtatctctatccaaaatacttgggaccagaagtgtttggatttcagagtttttcagatttttggaatgtttgcatatacataatgaggtatcttgagaatacaacccaagtccaaacacaaaattcatttatatttcacatacaccttatacacatagcctgaatgtaattttaaatgatgtttttaataattttgtgtatgaaccaaagtttgtgtatgttgaaccatcaggaaataaaggtgtcgctgtctcagccacccatgtggatgatctgtggttgatggcatcaccatcattcctgactctctatttatatgctactcataaacaatcatttttaaatacttactcacacataaatacttaacagtaaaaactgacatacaactaatatagtgcaaaaataatgtgttctgggtaatttgtggtgtcatgtcagcactaaaaaaatttcagattttggagaattttggatttgggatttttggattagggatattcaacctgtaatagggtgacttgtaatctttattatc

SEQ ID NO: 47060 - DNA, 1109 bp, Homo sapiens
tttattttactttttagagacagtttcactctgtcacccaggatggagtgcagtgtcaccatcatacctcactgtaacttcaaactcctgggcttaagcgatattcccacctcagcctcccaggtagagccatcacacctggctaattttttattattattattattgtagagacagggtctcactttgtttcctgggctggtctcaaacttctggcttccagtgttatcctctcatcttggcctcccaaagtgttggggttatcagtgctaccacgcctggcccagttaatgtttttaaaatagatcaataggtcgggcacagtgactcatgcttataatcctagcactttgggaggccaaggcaagccgatcacttgaggtcaggagttcgagaccagcctggccaacatgattaaaccctgtctctactaaaaatacaaaaattagctgggcatggtgacagatgcctgtagtcccagctactcaggaggctgaggcgcaggaattgcttgaacccgggaggcagaggttgcagtgagctgagatcgtgccattgcactccagcctcagtgacagagagagactgtctcaaaaaaataaaaaagagaaaagtaaaaatagatcaataagattatgttctgatgttgcaaacttcaggcttctcttgagggctgtaatagttacaaataagccatagcaaggtttttttttttccccattagttttataaagtttaaagttctttgtgtttttgtgcctattagttattccatctgtgaagttctcttgaagattaagaaaatatgaaaagtgtggggaaagataagaaatgtttacactcaagtcacaatctaagactgtttgaaatattttcaatgagttgactagaaaggaactaaagttatttcttagatagtatcaaaatcaatatgcactgttcaaatcttggcctttgtttaaccatgtactgtattgattgtttctgggtaatggattagatgttttaaaataactctttggtaccaagttctttttttttatcttgttttttctcaagtattacaatctaattaaatccaattttaatataaacatgttttaataatc

SEQ ID NO: 47061 - DNA, 1035 bp, Homo sapiens
gcattttacccatagcagaatttctttttccttttcctttttttttttttttttttttttttttttttggggacagggtcttcctctgtctcgcagactagagtggaatggcctcgcaaaagtgctggaattataggcatgagccaccgcgcccagcctagaacttctttcaaaattggagttggtcctttcaaaccctgcctctactttatcacctaaatttatgtcatattctaaatcatttgttgtaatttcagcagtgttcccagcatcttcaccaggagtagggtccatctcaagaaaccattttctttgctcatccataagaagctactcctcctccattcaagttttatcatgagattgcagcaattcagttacatctttgggctccacttccaattctagttctcttgcttttccaccacatctgccattacttcttccacagaagtcgaacctctcaaagtcttccctgaaggctggaattctttcaaacttctgttaatgttgatatcttgagacctcctcccatgaatcaaaaatgttcttaatgacatgtagaatgatgaatcttttttagggggagacagggtcttgctctgttacccaggctggagtgcagtggcacaatcttggctcactgcaacctccacctcctgggtataagcaattctgcctcagcctcctgagtagctgggattacaggtatgcgccaccatgcccagctgatttttgcattttttagtagagatggcatttcaccatgttggccaggctggcctcaaactcctgacctcaggtgatctgcccacctcagcctcccaaagtgctgggattacaggtgtaagccaccacacctggccgatgaatcttttttagaaggctttttgtttactttgcccagattcatcagaggagtcattatctgtggcagccatacatagtgttatgaaatgtgtttcttgataagacttgaaagtcaaaattactccttgatccatgggctgcagattggatgttgtgtttgcaggc

SEQ ID NO: 47062 - DNA, 1034 bp, Homo sapiens
cagccatcaaataattgaaaagagttagggcttgctctggattaggatttggcttaaagggatgttgtggctgctttgatcatctattcagaccactaaaactttcttcagatcagcaataaggtaattttgctttcttatttgtgtgtacactggagtagcacttctaatttccttcaagaactcttcctttgcattcacatcttggctagctttcagcctagctcaacttttgtcatgccttcctcactaagctttatttttagcttttgatttaaagtgaaaaacctgtgactcttcttttcacctgaacacttagaggctattgtagggttattaattgttctgatttcattattgtcgtgtgtcagggaatagggacacccaaggagagggagagtgactggagaacagatggtcagtggagcagtcagaacatatgcagcatgtatcgattaagttcactatcttacctaggtgtggtatgtggcactccaatgacaatggtagtatcaaagatcatagatcactaacatatacaacaataataaacaagttgggagaattaccaaaatatgacacagagacacaacgagatgagcacaagctattggaaaaatggcattttagactttttttgacatagggttgctgcaaaccttgaatgtgttttaaaaaattgtttttaaaccagtcaaatttagcagtggggggttgtataccaactttaatgacactatgttagtaacttctgattacccactaccatttgaccagccaaaaaaaaaaaaaaatgttttttaatgcagtatctttgaaggtcagtaaagcaaagcacaataaaatgaggtatgcctatagttactttgtagagtccataggactttctatgtagaaagtcctgtcttttgcagataggccgttttactttcttttttttcccaatcttttctttcttgtgcattattacatttactcatacctccaggacaatgttgaagagaaatgatgtattagtccattttcacactgct

SEQ ID NO: 47063 - DNA, 1103 bp, Homo sapiens
ccatgatatagttagcacacagtgagtgtgatgcgatgtgatgtttcaagtctgcagaataatattgaactatttaataaaagatgctaaagtagtgggttagttattgggaaaatgaaatgataaattatcccttcataatgcagaaacaatttccaaaaggactaaatgtaaaaaatgttaattataaaataattataagtaaatatcttaatttggaatataagtaagcattctaaacataatagaagaaatttaaaaagagtagtttgtaatcataaaaagcttaagcttttctggtaagtgaataagtcatatgtgattttaaaatataaaagaaaaaagacttgtcctgtgtcattgttgaaataatgtatgttttacttattgtttattggtggcttatcaactcccagatttttttaatgatattttaagaagaaaaatctaatcaatacttttcctttcagacaatacggatttttctcttatttgagagaattatttgatgcacctgatcctgtaatgagttacctttgctgtcagtatcatattcatgaagttcctgtaggaactgaaaagaccagagaaagaattgaacgggtaggaaagtagtgaatcatgtactgaatcatgtaccaaaaatgtagttttgttaaaacttcttagctaaaggcaagcaaaacgtgtcagaatttaagtaagtctgttgtttttaaccatgcagaaattatatttgtattaattattttccatatgacatgaaacattgactgttaactaatacattgtgagaggagtgatgtggaattaactagaataaatacttaatacatttagggtaattccataaagttaaaacctgaaaagagatacctagtacactaacctgattctgccttgcttggtaaatctatgttcaaacattgtattaatagtttagtcttttaaattattatatttgagattatttttaagacaaattatactttagaatggtaggctggggtataaaactgtttttggtcagccttccttttattaaaacttgtacttaagattatctcagatatgaatgaccacttctcataggatttgtttgg

SEQ ID NO: 47064 - DNA, 1081 bp, Homo sapiens
attatgtgttaacataaaaatgtattaaaaatagctgttttccagacaaaatacatttagtgagaagagtggcgttttacatttttgcagatttctttagttgaagtcagtaggtttttccctacttaattctgtatattgagtttgtagtgagatgtttgagttgaagtatatgaaggaaatctggcttcccataaatatgcagttggaaaaggaggagtattttagacttttcaggtaattgtggatattattctttaatactacatcaaaatttgccaaagtgtagtttattaaagtttaattgcagtgtggaatctgaaaccatatcagtgaacttgtgtactctgttacattaaaatccattgcactttagatggcgcttttacttgtaaatgatttagttatagcatgcattggtcattgggagaatactggttcatcaagtcacatagatatttcaaacgttgacatattttattatgtaatatttttaaaagatcacattgatcactgattccatcagaaaagctgttaagaattgggaagctgtcaagcttgccagtggatacagattttctaaaattcaaattttcatttgaaagtttgaactttatcattggcaacaaatattgtcagttattttccttgaaatgacaagctcactttattcctgtttggaaaaagaaaaatgaccaaatagccaagtccagataattatagtttgtcatttttttaaataaaaatggtattccatgaaaaaaatgtctagtataactccaaacttagtcacacaagtgcttttccttgaaacaacatttatacttttgaatatactacaaatatttaataagcacagcctgccctccatattcgtgggttgcacatccatggattcaaccaaccacagatcaaaaatattcaagaggccaggtgcagtgtctcatacttgtaaccccaacactttgtgaggccaaggcggaaggatcacttgagtccaggagtttgagaccagcctgggcaacatggcaagacctcatctctttaggcagggcagggaggagggaagaaagaaaaatat

SEQ ID NO: 47065 - DNA, 1026 bp, Homo sapiens
atcgtgtcatcactagcaatatatagtttgttgttttatgctatttaacttacaaatttaatgcatcatgttgatgaggaagtaatacttaaaatacttaagactggttgagtaacttcagcagtttaatcttttgttaatatctgactgtgaaatgataaacacagaaatactgggtggaggggagagcatgtgatataccatattaacttaaaaccggaaggagagctggcaataagatggtagtggcagtggcatagtttttgaatctccaaaatcttttcccaaaaacagaagagaagctagaataatataacaacaaacctgtggacaacacgtataacaaaactaagtttcagggtatccatgtgggcatactgcagtactattctgacgctaaccatcctggtcactatcaaactgtataccataggggctcggttcccaaaaagaccacccttacttcagacaccgtcttcaagtttaggggtctccaggtcacttgtatttctgaccaactagctgcaaattcaagagttcctatgacccccactcaggttcaataatttgataaaacaactcagaattcgagaaagcactattcttaacgattatgattttattataaaagatacaatcaggactagcaaaattaagagacacagggcaaccaacattttggaggttcctaaactcaaaagtttctttactcttttcttgtgcagttagggtacatcaccctcctcacacatctcctggttcaccaaccagtgggccctaccaggcttcagtactcgggtttcttattggggtttcattatatagacatggttgttgattgaatcattggctatgtggttgagcttgatcatcagccctcttccctggagtttgggaagttgggctgaaatcatgtggctcaaagacatgtgtattgctcaaatcatacagttgatctttgtggcattttctatccccatcctgagtcatattcttagcattaactcaggagtgatctaaggggct

SEQ ID NO: 47066 - DNA, 1035 bp, Homo sapiens
tccagacatttgccccctggggagcaaaagtacccccagttgagaaccactggtctaaaactaccaggttacaataaattcaggacaggaagaaatatgttaaataacactgaggaatacagtcagcaaaacctagaatataaggaactctgtaggataaataatttacttcagcactgtccagtagaaatacagtgtaagctctacatgtaactttcttttttttttttttttttcaagacagagtcttcactctgtcacccaggctggagtgcagtctcagctcactgcaacctccgccttctgggttcaagcgattttcctgcctcagcctcccaagtagctgggactagcaggcataccaccatgccctgctaatttttttgtatttttggtagagatggggtttcattttgttggccaggctggtctcaaactcctgacctcaggttatccacccacctcagcctcccaaaggctaggtttataggtgtgagccaccacacccagcctacatgtaactttgtagtagccagattttaaaaagcaaaaagtaatgggttaaatgaattacaataatatattttacccagtatatccaaaatattgtcgtttcaacttataagcaatattgaaaatttactaataagctattttgtatctcatagtcttcaaaatactttatacttaaaacacatctcaagtcagatagtaaattttcatcagaaatacttgatctgtattctgactttctgaaactgatagttgaaaaagttaggttcacatacccaagctgttccattttccagtagctaggaacaagtatcagtttttaattttaaatttaaattcaaatttaaaattcagtttcttagttgctttagccacattttagtgctttatagccacatgtgactggtttctactttattagacagtacagtttctaaaatactttcaaggaaaagtggaaggggaaacctaaaagtttaaaaggacttaagaaatgtattaaccaaatataatgtgtatacc

SEQ ID NO: 47067 - DNA, 1050 bp, Homo sapiens
cccatctattattctacttcaccagagtctgtcactctccggcagggttatgtacatgattcactgtaacttaactgcataaatgtatttgttacataaatgtgagctatataggggtgcctttttgtggaaagcatccacagagggtagattttaggaaatgtagacataggactgcacaggtgaatggaaagattaaatcagagtaaagtagcagctttattctgaagccaacctcttcaaaccctttgacttaagaaaaaaacagtgttgctagcagataagcaactaggagcatgcaggcacaaacacacatagccaaacgaagctgaagattaggtttgatatgctagggctgggcaaaatccagagatgtggaagacaagaaagtcctctcccccactccccaccttcaccaagaacaaaggaaggaaaggatggcagaatgaatagcaatagtattctaaataggtagtcggtgtccagcaaaaagcaatcaaaggtaagttccaaatgggagtgaagaaactgaactagctaccagaggagagcctcatcagggcttatttcctgggcatgtggggaatgtcatctgctactttttcatctgttctattggtaagtaattgtagagtccatgctgaagttacttcattgattgagcttatgaatgtggttgttccatataggaaatgttgttataaaagaggtttcatgaagaagttgacccatcaggcagatactattaatatgtgtagctttaaatccagtaacacaattgtattggtccgttttcatgctgctgataaagacatacccgagactgggcagtttacaaaagaaagaggtttaatggacttacagttccatatggctggggaggcctcacaatcatggcggaagacaaggaggagcaagtcacatcttacatgaatggtggcaggcaaagagaaagcttgtacagggaaactcccccttatagaaccatcagatctcgtgagacttactgtcatgagaacagcacaggaaggacctgcccccatgattcag

SEQ ID NO: 47068 - DNA, 1044 bp, Homo sapiens
gtatatgttctaatttgtccccatggcatggactcagaagatagtactgtggtgaaattcaactgtcaaagtaattagattctcaggatgcttttttagttcttcataagtgcagtataaagttctaacttcttgctctctttcaatgccccacatattctggacccattctaccaattcagcaagtacccaccattccaaatggacacaactcctcactccccatggtatgcagtactcattcttttttcccaagctcctgttttccctctgccttgctcctccctagccatttgctttaaggcccggagatgaattctaggcctttgaattctcttaactctcctgtagcatgaactgatacttcttttctctaaattcctagcctatatgatatgtactgcttgttttaatactcaacatcaatacattgccttaaagtgttatccagtacatacattttgttttctttaaagtacaagcttttgaaggcaaatgaccctgtttattattcctttgtattcttgtgtgccagcatgctgttgaacagatagataacttattcagcagattatttttcttttaactatttgaatggaactgttttcattgtatctataatgacgggcaatttttttcttaggttttccaagaccttccaaacacattggatgaaattgatgctttattaactgaagaaagatcaagagcttcctgcttcacgggactgaatcctacagtatgcctgtttctctattcccattctgcatccaaccaccaccaccaccctccccatacacacacatacacacacagagttccctccagtacttgcctcccactctgtactagagctcttggtaataataagctagacagcaggaacaatgtactttaaatgccagattctgaatctattagaattttaaatagattcttcctaaggaacacaatgttctgtgccttttctttataaaaagaatagttgggctaacctgaaatactgcaatgtctattttttcaaggataaaaaatgtcactttc

SEQ ID NO: 47069 - DNA, 1047 bp, Homo sapiens
ttgagaggaattgctctgttgcccaggctggagtgcagtgatgaaatctcggctcactgcaacctgcacctcgcgggtttaagcgattctcctgcctcagcctcttaagtagctgggattataggcacctgccaccatgcctggctaatttctctctttttttttttttttttttttgagaccaagtctcgctctgtcacccaggctggagtgcaatggtgcgatctcggctcaatgcaacctctgcctcccgggttcaagcaattctcctgcctcagcctcctgagtagctgggattacaggtgcatacaactacacctggctaatttttgtatttttggtagagatggggtttcaccgtgttgaccaggctgatctcgaacttctgacctcaggtgatccgccttcctcagcctcccaaagtgttgggattacaggtgagagccaccgcacctggcccacccagctaatttctgtatttttagtagagacagtgttttgccatgttggctaggctggtcttgaactcctgacttcaagtgatctggctcgccctcccaaagtgctgggattacaggcgtgagccaccacacctggcagagttttgtttttatcttgttttttaagtggcagattagcacaagtcgaacttcagtaagattcatttatttgattgtcggatttgggggaggagggatggagtgtgtgagaaagaaacaaaaagcaagtagatgaataatagaactgttgccctgctaagaacagaagtggaggaaaagtacaagagctattatgttggtgcaaaagcaattgcggtttttagtaatggcaaaaaccgtaatcactttcacacctaacatttatatgtagaatatataaaaatattgattctgcctctcatttgtgtaatggttgggctttagcatatctcctttaatttttataggagctttagaaaatggatattctggctgggcgcggtgactcacgcctgtaatcccagcaccttgggaggccgaggcgggcagatcacctgatgtcgggagt

SEQ ID NO: 47070 - DNA, 1050 bp, Homo sapiens
ggcagggtttccccaccttgcagggtggagctaatcacctggcgctcgatttaaaatacagattgccgggtgtcacccctgctcaaggaccagggaagttcaggctaaaatcacactctgtaggtattgggttctgccagttctggcttttctcactctttcctgctgggaggggtggaccgtgccgggcagaactgccagcctccaggcgggaaggaaggaggagaacagatggcccactgggggtagaggatcacgtgttggacctcattctgggctgcatccagacctctccctttcagggcccagcccctccagctccagcgaccccacctaggcacacggaacatatgtggaggaaaccagtgttcattttgttgaaagcaggggaattagagaaggaggcgagcttgaggaggggagaggctaaagggataaagcttccaacaatggcgatgttcctggattttgaaatacaatcaggtaaagcccgatctggtggaacgcccgtggccataatgacagctaacacccaggggctggagggggaagggcgctcaggcaagcgcgaaaacttgcacgccgccctactttgctcccgccccacttagcagccttccgcaaaactccagccctctcctctgcagcgcagaaaggccgcccgttcatgcatatgcaggaggataagtttagctcgcagccccccgcgctccgaccggcccagcgcggcactcggtgaatcacccgcgctcgggggcgggcgctcggctccggccgcggactggcgggcgactcagccactcgtggaccgcgcgccccggcctggcatcgcccttttaaaaagtcttccgcaggcggccgccgccgcagcagcctgaggaggcgagttcatctgaggacagtcccagttctcagaaatcccttccctgctggaacatcaagctccctttactgcagttgaacaaactgccctagattgggggaccaggaacccgccccaaactcgtgcaaggagctccgggcgcccacgcccacgtgagctaaccttga

SEQ ID NO: 47071 - DNA, 1015 bp, Homo sapiens
tggaacagtttgtcctttttactctccgccccccccgccccgtctccacccccttggtaaatatagcgctcacgtttcatcatctctttgtccaacgagtgccagacaccccggcccgcggcccccgccgcctccctcctcctctccgctcggttacctcgcataacctcgcgcgggcaggcaccgggcagcagctctccccgcggccgcgcccgcccggcacccagcgcttcccgccgcagcacacccccaacccattctcccctccccttcttccagttcccccttctgtacggcccccatgctcttgtcccaccccctctactcggcgtccgggtactgggtcgagacgtgtgtaggtgtagggaggtggatagcccttttccgagccgtaggcgtcacccctacgcccaggcccaggcccagtgctggatcctgcactttcccaacctccccctcccaagttccaaggttgccctctgttcccctcccaagcgcaggtgacaagctgctgagacagtgtctgattcaccgacagctgaaccagctactggtacttggaggtgggcgtttgctgaactgttttcctcccacctcccccaaccccctaccccggtggggagcgggctggagggtcggaagaggcaaggtggatgacagccgagaagtgcgtgcccgctcttccctctctccctcctcctcccagtttcatttccacacatacagccacccaccggggaccggaggcggctagtgttctctgaacgccgggaactggctctctctgtggtctcctgtttacttccctcctcctcttttcccctcccttctccccgcccccatctcccggcgccgcttcccgcccagagcagctgggaaacctgcagctgaacactgcagtcatgggacttccctggccccgagctgtgccccaggtttgccctgtcctgtcctgccttgccctgtgtccgctttttggggggcacttatttgtcctgaaaagggtcttaaggct

SEQ ID NO: 47072 - DNA, 1035 bp, Homo sapiens
aatactaggattatgggtgtgagccaccttgcccggccagatgtgctttcttgagtgggactacagctagcacaaaatggcttagcctagggacagttaatcattgtggcagataagagagatattggaagtcgatgacttggtaagggttttttttttcccccagctcaaaatctctagaggtctaaagcagtgttcggttcctagcctgttgacacataacctcaaagaacggagagacctacttagaagaagggtcaagaattatcagactttctagctgtgtagacctgaaattattctcaactctgccacttgatacggtgtgtccttgagcaagatatatagtctctctggaaaaagagatatatctaataatgcccacctcacagggctgttgtagctgtttgaggagaaaacgtgtcaaactggctgacttgtagtcagccctcaataagcattggctgccttctcttttctcaaagtgggcaagtagagaactgaaagacatggaaaaggttagtttttcggggggtgcctcttaatgaatgggaggactgcctctgaggggtgaggtttgagtacttagatgctctgtagcagggaaagcaatttggtaattctgtaacctgaagccgagtaggtctggagaagccaatttggtggcctgttccttcctggaggccacaggaaacatgtcctcactcatatctgctcccctgggtcccatttcctgggagacatgatggatgagccacagccagcaaagactttgtcccccatttatcatcttctggattgcttagtggatccatttgctttccaacaggtgagtcggatgagatggattacttgttgtcaaaacagtaagtaatggaaagttgtggtcattcttttgagatgtagagtgggaaacatttaagcatttcaacttagcttaacagcaagctcaggaaatagacatttatggttccaaatcttccctttcctacctgttttacttattgattttaaaattaccacccaaagtgcctt

SEQ ID NO: 47073 - DNA, 1045 bp, Homo sapiens
gcctttactgtggaaggttttccctgtgagtccacactacctcagcctacaggccacacactaaggaatatgcttgttgtttctgtttaaaatggaattgtattacttttcagaagcccatgcatatttagggtattagagtattcaaagagggaagagccagggccctcttcaagaggggccttcttaggaaaagaaccagcaacctcatatcagggctctctgtgcctggaaggatcagtccagtgagccagactgcatgtctatgtgtaaatgcacatcaggggacatgaggctacaccacctccaaagaaataatctatggctcttgtcgactcccattgcattgtgcctgaggggttatatgatatctacagaaatgatcaatgtggctcctaatattcaggaatgcgtatataagcaaataagttcctgctgacattatttacaaatcccctggtaagagacaatgcaagaaacacatctgtacttacagctcacggttcaggctcgaatctctctgatctgcaggcactaattcctctctgtgccctctggatcccaagctctgtttactgttaaaacttgagcttttcacgcttcaagtgatgctcctcaaacaaccaagaatccagacaataggcagtccacattccgcttagaatctaagcagctgttggctcttgtgttgggactatgtgtccaaatgtatgctgcatatgaactgctaggaatatgataaaatagttgggtgacagcacacccttgtatagtgggctaacaacgttattctttcccagagcaacattgacacgtcagttaaaatacaacaaataaacattttcatcttggcagatttatctgtttttatttttattttttttttgagacagagttttgctcttgttgctcaggctggagtgcaatggtgtgatctcagctcactgcaacctccaactcctgggttcaagtgattctcctgcctcagcctcccaagtagctgggattacaggcacaagctaccatgcccaactgattttgtatt

SEQ ID NO: 47074 - DNA, 1033 bp, Homo sapiens
cggagttaaataagatcacttatgagagctggatatctgggctcactctctacatgcatggtttgtgctggcacacccccacccccacccccaggggcctatcatttcaacctatgcctaagttcctacccctccccatcttcaggagcattggcaaatcatgaaaacttctcatgaaggagtttacttaaaattgtgtaggacgctgtttaaaaatcagttcaaaatggaacttggttcatatggtttccgtttaccattattatacactggcattaattctgtagtcctgtgagtacagactgcaaaaaacaaaaaaaggactttagtggttaaaactctaaaatatactctcagcctccttctgacttgaactctttccctctccttgttgcttccttctcttagttgggtcaaattccatcacttgtaggtgaaatgaatattgttaactgccctggttttatcattttgcccaaatgattgcaaaacattccaaagcattatcttctcttgtcatatgtaggcctagtgacatgcacattcttccagaacctctgcattttaatacttaagtaactccttaaacctattttaatgcttaagtaactccttgaacctacatctgtcctctgaatacaagtctaatgtgttcagtggaaggaaggtaggcatagatatcagtgaagcttggatttaaatctcagctcacatacttcctagctgtatcaccttttgtaatgttaacctgcctgggcctccattctgtaacatgggatcacttccactttccttatagggcctttataatgactggggatctatatatctatctatctgtctgtctgtatctcccaacacactgtagaggcccaataaatgctggctgatattattctgttattctttttgtctcctcttcccttagtccttacttccctttgatccccaattaactgttcacacctctcttctttttttttaaattgccctcattattggttatgtttcctccactttcatcatttttagc

SEQ ID NO: 47075 - DNA, 1036 bp, Homo sapiens
tagagatatttgtacatccatgttcatagcagcattatttacaataactaaaacctagaagcaactgaagtatccatctagggaagagtagataagcaaaatatgttatatacatacagtgtaatattagccttaaaaaggaaggaaattctgacatattctacagcatcaatgaaccttaaggacattatgctaagtgaaataagccagtcacaaaaagccaggcgcagtggctcacacctataatcccatactttgggatactgagacaagaggatcacttgaggccagcagtttgagatcagccagggcaacacagcgagaccctgccccccgacccaaaaaaaaaaaaaagacaaatactctgtaattccatttacatgagatacttaaagttgtaaaattatacagacagaaagtggaatgatcgttgccaggggctaggaggaagggacaatgagagttatgtgtttcagatttggaagatgaaaagagttctggacatggatggtggtgatggttgtacaatatgaatgtatttaataccactcaactatacacataaaaatcgttaagttggtaaattttatgctctgtgtatttaccaggggagaaacagaaaaaaaataactgttggctgtttggtctcactccctccgtctttactctgtaacccatcttctgtttgagaggccacttcagtaatacagattatataaggaagtaaagagatatacaggtgaaagaggaagaagtaaaaaaagtgacctaagtttttttatctaaagatttttaaagatgaggtttgggacacaggaggaacagattgtattgctaattgagtgattgctgtttggtctttgaatctgaggtgtctcaaggatttctgtgaggagaaaaatgggtatcttgcctgcaatctgagacatcagaacttccagagacatgagttagcactagggacatagttttggatgtaatcttcgttgagctcattgctgaggctgtagttatgcattcagttgacctggagaaa

SEQ ID NO: 47076 - DNA, 1046 bp, Homo sapiens
atatacagtacttgaatacggattgatcctgatttggagaggaaaaaacagctctgaaagctgtcttggagaagttgaaatttcaatataaactgactacattcagtgacattaaggagttatctttcatttttcttaggtgtggtaacagtattgtggttaagcacgagaaggtctttattgctaggatatgatgagtattaagaagtgaagtgtcttgatatccataagttattttacctgtacccatacacacaaaaagcaaaaaggtaagaagatgttaatagttgtctctgggagtgtatatatgtatgcattagtattattgtttccactgttttctgcaagtttgacatttctcataatagaagggaatgcttttagagctaagttgagagaaatagtgtttattgaagatggccttattatatgtagtgcattcctgcagatcctatgactatcagggatctgtacctacattgtacacctaagaataactgtattgcactctgttttggcattgtaacactggcctacattgagaaccaggatagaaaacagttctgtgaaatgctttgtgttgtaaggacatttttgcgagcatcgcttactgtatcacatggtataggaaagatgaaactttgcacttcagtaacaagaatacttgtgctgcttctgagaaactggatttttggcatgttacagacaatgagttatgttttactgggtgctagaaagctcagatttcatttgtggcccatctctaacaagtgcactttccagctgcactcctgactgctttgtaatttccctcctgcccttacttttctctcattctgattccctcctctattttttggttgtgttttgtaagatactttatgtccaacaatgttctagccatatttaaaggaatttaaataatgtagtttatgatttgaaactcacaggctaaagccaggtgctgtggctcacacctgtaatccaagcaccttgggaggccaaggtgggcggatcacttgaggtcaggagttcgagaccagcct

SEQ ID NO: 47077 - DNA, 1039 bp, Homo sapiens
atgtctattcagatgtgttgcccattttaaaaattgggttgttttcttaccattgagttatgagtcttttatatatattctagatacaagtcctttatcagatataatttggaaatattttctcgctgtctgtaatgtgttatacatcaattttgagatatccttcacattaagaaactaacggtgtggataataatcctggtattgacagaggtttggactcctgaagcctgaaagtctatctgctgccacgcctgggcacatactgcatcatttacaaaactgtagagcacctgttgtgtgtgcagttgtgatttcttatagatttttagaattggaaggcatgtaaagaacacgtaatctggtacattgcttcagtaggtaagtcagtatgaacttctaagaatttttgttttcttctgtattgggtctattgtgggtatgtccaacgtgacaggggaggtaagggaagtggcatcccctgagatagtgactgaaatggctttcatcatctttaagtcaaagtgagatgccagtaataggatatatgtatgtatgtacttgtgtctctgtatgtatgtaaataaacaaacatgctggaaggaggaggtgattcaatcagggactttgtgaaagaaaaaaagaataactggaccttcctttaatgatgaaaactgtttatacagcaaaccatcaaagccaaaatgtgaattttggtattagcccgatttttcctaagaaactgttgatgtaaccactgtagttgcagagatcgttttggtatattctagaccctctttgttttgttctgtttggggtttcttccccctcaagttgctcttgtccaccactagactggctgccttttattccatagcagacagtccttaagtctttgcatatgtccttattcaaaaattaatcttcatcagtttttttctgcagaaaacagttttttaaatatcttacatgagaatgctctgcacctgcaatctctggttgatgcagtttcctttctctcttctctgttcccattggt

SEQ ID NO: 47078 - DNA, 1047 bp, Homo sapiens
tgagtcaccacgcctggcctttcttttcttttcttttcttttttgatggagtctcactctgttgcccaggctggagtgcagtggtgcgatctcggctcactgtaacctctgctacttgagttcaagcaattctctttcctcagcctcccaagtagctgggattacaggcgcctgccaccatgcctggcaaatttttgtatctttagtagagatagggtttcaccatcttagccaggctggtcttgaactcctgacgtcgtgatccacctgtctcggcctcccaaaatgctgggattacaggtgtgagccaccgcatctagcctctgtgggatcttgactgacatagaaattgctactacaggtggccccaggagaaagacactcagattgggaatcttggtttggatagtgcatttacttacttgccagtggtaaatgcgacacagataacccctgtcatagggcagcatcatggttattcacattatcactgtgtgggcatgagatgaagagcaggaagagggcaaggcattggaagatcaagtactgtggcactgacattatggtgattagtaatgattatatagaccatgggaccacctggcttcttttgacagtgctagaaagtatatgaagaataaaggaaaaatgaaactgtgagtttgcagttgagattgtaagtggataatcagaaagcctgggtggcagcttttgaaggatgaagtggcagcttttgaaggatgaagtgtctcctatactcacagagcagatgacaccgtgggccacgtccagttcctaatgctgagcattataacaacatttaattgggttgcacaccaacttcactaggccttttctgccaaggtgagggcactggtagaggagtggagcttaaaacaggggctggatcaatgtgggtaaagcagaattttgaaactccagactcccttggacttccctagctatgcgagggagctctgcctccactatttgagagaagcagttcttacctacataaaaatttttcaatacctgcacctggggcag

SEQ ID NO: 47079 - DNA, 1046 bp, Homo sapiens
ctcttcatatttggtattatttgttgatggattgagacccagggagcattaaataactgccgaagctagtgcagtgaatttattgtgaaaccttgaatccagaatctagattttgactctccactcttgagcttatggtagaactatatgccttagcccttgcaagcaacaaagagtatcactgggctttaacatagttactatagtacctccttttccttagtctgcttaattctatcccatcctaaagaactttatcttggtctgtcctgtcactctgtcttccctgcaaagtttcccttcataccttcattctttcccttaccctactggcatctgattccatcttcagccactctactaaccactgttatcgtcaaagtcagcgatgaacgtcttgccagatctccatgaggccccttctcagtccttaattgattccatattatctgagatgatagagcatggacaccttctcaaaattcttttctcccgctatttagccttgctcacctgttctgatctttgccctgtgactgttcttctgaaaactcctttttgttagtaaagatttattgagcattactgtggaacagacatcatgttaaacactttacctgagtaatttaagggtcagcctttctatcgtgcaagaatcatctttccctaattattttttgggagctaggtgtgtgtcacattccactcccatgtttatctgcactgctgcttgcttcatctctgtcaccagcccctaaagactgtgaaatctgaacacagatagttaccactttgatgggtcccaaaatgtgtaaatcagagatttggagattttttcaactttgggaggaaaaatgtgggacatggtagtccggtccttacaggggcacacaaaagatagcttccctcataacaaaattaattcatgataccatagatcccaaacagtttttctgaaaactcagttataggatctgagtgatgtacgaatgagtgttaaaggtttttacatgtgaaggtgttgtccttcattgtggctcttgcat

SEQ ID NO: 47080 - DNA, 1023 bp, Homo sapiens
tcaagcaccactgtaaaaaaatttttgttgcctcacttaatcctcacaacctccctctgaggcagggactgttataatcgtcatctgacagataagaatgctgagaggttgttccccttcctgtgtccatgtgttcaccggggcctgttgtggggtggggggaggggggagggatagcatttggagatatacctaatgttaaatgatgagttactgggtgcagcacaccaacatggcacatgtatacatatgtaactaacctgcacgttgtgcacatgtaccctaaaacttaaagtataataaaaaaaaaaagaaaaagaaaactgagaggttaagtgacttgtccgagatcacatagctgtaaaggacagaaataggattcaaacccaagcagcccaactccaaagtccatgttctttatcaatagactaatcctctctatgtagtatttgtgtgtcacagggaactcaggaatttcattacttgacccccaccaaactaatagctctgagcacatggaacctttcctctctagatgtgagaacttccatgtctgcctcccgaaaagcagctaattctacacttagttcagaggactgtttcaaattcaatgtataatttacttttttaagaattttcttaagagacaaagtcttgctatgttggccaggctggtctcaaactcctggcttcaagcgatcctcttgcctcagcctctacagtagttgggattacagatctgagccactgtgcctggctcaacttttcaattctgaaaaccagttgtaaatttataaaatttgaacctctgaagcagtgtttttcaaaatcgatcccatgaacccactgcatcagtgtctgcagggaatgtttgtttcaaacatggagtctgagcttcacccaaactcactgaaactgaatcctctaggagtaggtcccagtaatctgcatttttaagaagcaccccagccactcttattgacaagattgacaataattatagagttgcatctggaagtttca

SEQ ID NO: 47081 - DNA, 1050 bp, Homo sapiens
gtggattatgactaccagcaatttttttctaggaaagttaaaagaataaatcagaacccagggcaacaatgccatttcatgtaaacattttctctctcaccatgttttggcaagaaaaggtagaaagagaagacccagagtgaagaagtaattctttatattcctttctttaatgtatttgttaggaaaagtggcaataaagggggaggcatattataaaatgctataatataaaaatgtagcaaaaacttgacagactagaaaaaaaaagatctgtgttattctagggaactaatgtaccccaaagccaaaactaattcctgtgaagtttacagttacatcatccatttaccctagaattatttttttagcaacttttagaaataaagaatacaactgtgacattaggatcagagattttagacttccttgtacaaattctcacttctccacctgctcaccaatgaaattaatcataagaaaagcatatattccaagaaatttgttctgcctgtgtcctggaggcctatacctctgttattttctgatacaaaataaaacttaaaaaaaagaaaacaagctaagagagaagtttgtgtataagacaatgaaaattatggtctcctgtaagtatatcccagccaccaactcctaaagaactgcccttttctccatattaaacacacacacacttacacacacacacatacaaacccctgctttgtaaagtttccatcagtggaaactttgatttctttttttaatctcttatgctctcctgaagttcatggttgagcaccatctccaagataccacagaactcttgattgatgatcaaaacagtagtgtcatcttttccttttagaaaacggaacattttctcacctcatgattgatgaattctaaaccaatggggaaaaacaaaaaggctttaaaataatgaatctgtttctcaactactgttatattcaattaatttaactacattgaaccaaattacctttggttctaagaagacagctgtagactgcttattatgctgctacaggg

SEQ ID NO: 47082 - DNA, 1060 bp, Homo sapiens
tgtcacagtgttctcatctgtaaagtgaggataataatagtcccaccaggttttagtgagaattaaatgagattaattgcctaaagctgcttttactattaaggagtaattgttactatcgaaggaatagtggttgctatattaatagacatttaacagatatttttgatgggttgtgtattgatttatttacttccaattctactctaagatggagtttctccactgcttttaaaaaaatcttagttattattgaatatacaggagaatatacatttaattctttaggctttaaaaaatattctatatttaaaatgttgtatttttaatatttttagtcccaaggattataggctacagtcagtaatgaccacttcaagccctgttgcctctatatttctcccctgttcagctccgttcaattcaggtatgaagggggtagcatctggtacagcaggtagcctctagctcccacagaccttcctgactggttaagtgccatgccatacccattgttaaattttgaatctcattccagaactaggttagtcttatcttctttttctgaatgagaatttctgttggaagctgtttggtctctctctctcccctctgaccagcagccatcttctctggagggatagatacaccacagcatatcctaagctgacctggcctcctcgaaatcactgggaccaggcaatattgaaaggctgaggtgggctctgagggacattgctggcatgtgcagctccccaggcaggcctgggtccagttttaagctcctgttccccctcaggagatggggacagcaatgcgcaaccccagtcttggggatccattgaacaggaagaacgctaggtagctcctggttcttcctgccaacccatttctcatttgtcttgcttaaaggcaagggtgtcttggcaccacccagccccatttggttcttttttctcacccagctccttttaataaagtgtcaaccacggacctggctggactgaattgacgagtgtcaagacagactgatgaggagggaacagaatttcctgtgtta

SEQ ID NO: 47083 - DNA, 1044 bp, Homo sapiens
ttatcattagaaacattgatgttaatactttccattaataagctggaagtcaaaatgtaccataataaatgcattaatggggaggtcttaatttaatacttgctgattaatccattgcaaatggaaatttatgcagaatgacattgatttaaaagcaaaataaaaagtgaaagctttttttcttgtgttcttgtaaatgtaaaattctttcaggcaacttgagctggttgagagagtgtttggacaacagagtgggtgttaatggcttagacaaagctggaagcactgccttatactgggcttgccacgggggccacaaaggtattacattttgtttgttatatgtttctatgctgctgaaaatgtgtttcacctacgggagccagatttacaaaaaatgagaaaggaaaagcattggctattctttttgaatcctttagaataccggccaaaacccttgttcctggaagctctgtagaacagtgggtagaatgtggtcagtcagcctcactgcatgggtccctctcgcttgaaagactggacacttcctttcctctctcaggcttagaaaggttactggaaaacagcagtaatataaaaacaaaaccactgtctaatcttacagaaggaaagatcagaatttgctcctctagcttagcttttcacaaggtcttcttttatgatttgcattttaagtttaatgcaaactattagattcaagagaaagccaacatttgccaaagttagtgattccattgatactttttctgttgtaatcaataataatgacaaattgaatttttagatgtatttcttcctggacaaaaatttatcacccaccgcttttctacctctctctataacaaaagaaataaactcaacaacaataagaaatgaagatctcaacaaattaaatagcagtgccaaaggaaaatttgtaactgtctactaaaaagaagcctatcttatttcagctaataaacatgttagttatatgaatgaaaagtattatagtgaatgtaaaaatattcctctaagtgtcat

SEQ ID NO: 47084 - DNA, 1040 bp, Homo sapiens
tggggcagtagagaaacggagtacaacagtttttcattggacatctgcttctatccacctgccagcctccattcgctcccttcatctctttcttgccaatgtgctggagtagttaggatcataggtttagaattaaaagggtttgaaacctaatactgctccttcctagctggaggaccctagataagtgtcttaagctctctgttcctcagtttcttcatgtgtgtaagggatataataacaagagtgatccccgcatacaattgttgtgaggatgagttaaaagtagctagaatagtatctgacacacaaatactctgtaaatgagagttattatatcttgtttaaaatttttttggccaggtgaagaggctcatgcctgtaatcccagcactttgggaggctgagggagctggatctcttgaggccaggagatcaagaccagcctgggtaacatggtgaaaccctgtctctactaaaaatacaaaaattagccaggtgtggtggtctgtgcttgtagttgcagctacccgggaggctgaggtgggacagttgcttgagcccgggaggctgaggcatcagtgagccgagatcatgccactgcactccagcctgggtgacggagcgagactctgtctcaaaaaaaaaaaaaaaacaaacaacttttttttttttttttaccctgcagtaaatcggttcaccccatttgttttttacctccccattcactctcaaacatgtccaagtttggaagataaatgatgtagtcatcccaattgtatgtgaatttgtgtgtgtgtgtctaattacacacctatccttccactagctggtgagctttttgagagggcagtgcctcattcatgattgtatccccagcacctagaacagtgtgtggtacaggagaaacacagtgagcacgtgggcagggggcatgcagggtgtaagtaaagagggataaaaagtccatctggaaaggaagagaaacgttggtgcctcagactaaagaggaaggaagggcgagtggcgagtcagaggaa

SEQ ID NO: 47085 - DNA, 1083 bp, Homo sapiens
aaagtcagagtacacagtgtgacagcacgcactccgagaggcaagtcccagattatcctaggactattattgcttctctgtggatcttggtgaaccctaaggatccttctggctgtgaccatctccttggggtggcagtgaaagtcttttgtctattggagcagtgggaagaacagcacagagttccctaatgaagaaactggtcagtagtaagaaacaatttccaatcacgggcaaatttcactgtttatgtagaagcaatggaagtagcaaaaacagtcaggtttggtgcgcgtgaaaggtcctaaaagaagggtcctctgtataaaataagctgtacactcttgtgatggtcagaggctcatggcagggcctagccggattggccatttaagtgccaaaacactgaaattaaatccagagagaaggagggattgcagactctagaacaaacagtcataaattaagccctgcaggtcagtccttaaggagtggcttcagaaacatccttggagataggaaacaaactcaggacaaatagaacaagtatttattgggagttaactccctttaatgataaagggaacattctcttggttgggtgacatggccagaagccaatctctcagtagagatgagtctccccatttgacctctcttcttttatcagatccaagctgcaaacctccaggccttcaggcttgggtagatagagggaaaggtgaattgtattttctaggtcagatgaaggagcgatggaaaagctgagctttctcatgggatatatggtttgaaagtagagctattccttcctcacaattgtgatgggcctactgtaggtaaggcctttgtcactcttatgtggattattgtgcaagtcttaccctgtccccactgcctccccctttcctctggtcaaaaagaattgcttcttcctctccctttttcttctctttcctcctcttccttctttaatgttctcaacatcattcaacctaactattttgccattctgtgcacatgaactggcatgtcctgcttttctgcctctactcatgtcattctcactgccgggacatccac

SEQ ID NO: 47086 - DNA, 1019 bp, Homo sapiens
cagtggctcatgcctgtaatcccagcacttcgggaggccgaggcgggcggatcacgaggttaggagttcgagatcagcctgaccaacatggtgaaaccccgtctctactaaaaatacaaaaattagccgggcatggtggcacgctcctgtaatccctgctacttgggagactggggcaggagaattgcttgaacccaggaggcaaaggttgcagtgagccgaaatcgtgccattgcactccagcctgggtgacagagcgagacttcgtctcaaaaaaataaaaattaaaaaaaaaattcagtcaccgtataccatatagtggaaaaagcagaggcttaggagtgggttcacatcccagctctgcacatttttacgtggccttggacactttgcttaacctttttgaatctcagtttctctatctggaaaatggaaacaacatccaactgcttcttttgttgagaggattcgaagctatgtagggagagtatctggactgtcattgtggttcttggtgagcacatttgatgacactttctgctgcatcgttttttttcctcaagagaacatgctcaattgtgtatatgggttcaagaaggcactggccagaataccagggaaatctaaattccatacttaggtagctcagatcataactgggtgaaagttctttggccagaacaccaagtcagagttctaaaaatatcttatattataatgtttttcttttttaatttttttcactcaagacagtgaatatttaattgcttgactagtgtgcttacattgagagtattctagaaccctctttctgacattatcttaatgttttcaaatatttaaccacaccttgagataaaagcaatgaaataaagcttgtgtttaggacacagttgaaaaaaacatgccaacaacgcagtgagttatggggcagctagcaccaccccacctgccttccgtaagcggagagtctgtgctttgcacctgggatgtttgtccttgatacttgatggttacta

SEQ ID NO: 47087 - DNA, 1090 bp, Homo sapiens
agaactcatagaaattcaacagtattctcagtcacagtaagtcaagcatagcaggcccacataattttttttttccagctcattcctggtctgctgaaatgttttaagtgctaattctgacttttctttcattactgtgctctgtgtcccaggcccttccacttaacatttgtgcatttacacaagcacacaaaaacaaacactgtgcatgtttttgcaattagtgcttactttgaatcaggtggtctttaagaagatagtgaaaaagaactcacagaccactaaattagaatgggtctaaatcataattcaagccctcagctcatgctcaataccgctctagtaagttttcaaaaactagaaatatactctactcagatggctctttctgtaatgggtgattccactcaaaaacacttccttgtactttatcagaaacgtaacgtcacttggtctaaattccaggttggtgatcacatatttgatctagtttacatgctttcactgtaaatattatagaaatcttttggaaaatttaaaagcaaaagtcaggagactaatatatcatgaacatccacgtctccattaccaacttcaataattaccaactcaaggccagtattctttcatttattgccccctttactctgattgtcttaaaacaaatagcatacctcattcatcaccgaatagcctagtatgtatctgtttaagatatgaactacttttcataaaaccatattactatcacataaaaaattaatttgtttatattatcaaatatccagccagttttcaaatttcccgatctaaaaattttttctttgtcatttgtttgagtcaggctccaaataaggcttatacattgtgattgattaatgatgtgcctcttatttatttatttatttttttattatactttaagttctgggttacatgtgtagaacatgcaggtttgttacataggtatacatgtgccatggtggtttgctgcacccatcaacccatcacctacattaggtgtttctcttaatgctatccctcccctagccccccagcccccaacaggcctcggtgtgtgatgttcccc

SEQ ID NO: 47088 - DNA, 1049 bp, Homo sapiens
aaaagtcagttggctgtatatgcatagatttatttctgtgttctctattctgttctgttggtcagtgtgtctgtttttatgctagtaccatgctgttttggtttctacaccttttagtatattttaaagtcttcagctttgttattttgcttgggattgttttggctatttggaatcttttgtggtttcatatgaattttaggactttttttccatttctgtgaagaatgtaattggtattttgatagggattgcattgaatctgtagattgctttgggtagtatgaacattttagcaatactaattctttcagtccaggagcatggaacatcttttcatttgtttgtgttttcttcaatttctttgatccgttttttatagttttcattgtgtagtaattgtttcagtcttacaacttttatgagttttggttatattacttttttgtgctgttaacaatttgacaacatactctctactctttgatccagtaattctacttctaggaattcgtcccaaggcataaaatgatgtctgtactcaagattgttcttcgtattgttgttaatattagtgaataactgagcaaagttccaggaaaagaggacttgttaaaaagcttacggtgtgtatatatatagacagatacacacacactacacaaacatttatatatatcatttaaggaattatgcaatacattaataaccattaagtaatatatagattaatgtttagaaaaatatacataatattactaagtgaaaaaagcagtatatatctcttttatgtaaacttgcatgtgtacctatcagttgtaagcagtaacttgattatagttgcacagagagtagtggtctgaggcagctgtgctgtaaaattaaaagcactgaaatggatttgggggcttgagttttagtcactgttttgctaactgtgctactctcgatgtaccttttcgtatctctggtcctcctagatgccctcctctctaaaaatgagggaagggatgggcatttaacttcattagcaatgacagataaaccat

SEQ ID NO: 47089 - DNA, 1050 bp, Homo sapiens
tacctgttggggtagattaaaaataatatgatgcaggccgggtgtggtggctcatgcctgtaatcccaacactttgggaggccaaggagggcggatcacctgaggtcaggagttcgagatcagcctggccaacatggcaaaatcccatctctactaaaaatacaaaaattagctgggtgtggtggcgggtgcctgtaatcccaactactcaagaggctgaggcaggagaatcgcttgaacccagggagtggaggttgcagtgagccaagatcacgccactgcattccagcctgggcaacagagtaagactccgtctcaataaaataataataataataataataatatgatgcaagtcaacgtagccttcctgagctctgtagtgtcatttattttgttcttcctatgtctgtacaaaccttcaatttcacttgcctttaaaagcgtatcttcaatttcagtgagatagcctctggatatgtaaattcagtctagttatccgtgtttgtagtcctgaattttgtttgtattttcccaaaggatgttcctctaaatatctattaatatataatttaatattttaagcagtatatttctcttttccaggttaaataaatctttcttggggcatcaagtgagacaggaaattttacattctttgatagtattatcatttgtatttttgtgtcacacacattgtcaaagataaagaaaataattgaataaaaacttaatacaatattagattatagggtacaacaaagaaataaatgtgatttattggcttaattatttaaggaatgaagaaataaatgactgataaaataattccttcagttagctggctgaaaacctatgcagcagcctaaagtcattctggcctattggggtttatcatctacaaaaatgtagggattggaatttatttattcatcatattaagcttagcgagctcccactttctatatgctgtagataaaggggtgaaaaagacgtctgcatcttctatgtaatacataaaagttcctacattctagcaacaaaacagga

SEQ ID NO: 47090 - DNA, 1140 bp, Homo sapiens
taagtgaactcctcctcacaagagtgttctagtatggtatagtatgggtgtccctgttaagggaagattcaaaatcatgtagggattagattaggtcaagttgaggtctttactaattttgaatttctatgattctaaacagagatttgagaaagttgatagggagaacagacagatcagtttccttcaatataatacagcagtagtcggaaaagaaaaaccactatgtaacaaacaagggcccatggaactcagttgataatatcaactgattttaaagtatatatggcttagatagcaggtttgtttttctgcttcacctgagcttgcattcctcacctcatgtttgatgaatacagtcaaacctaatatttagctgtgaacattattataacacctatagccagttgaggtgggcatgggcatgagcctcacaggaacactcagcttattgatttgtaaactgagtcttggcaaagttaggcaacatggccagtaagaaaaatgactgtggcactttctgccatcgtgctctgtgcgatagcagctcctgtcgagtgggtcaggtgggcccatctgttcacactcagctcctagtcaaccgtagctgaattgtggtcaccaaagtgaacactacaacaaagatcttctctgagttcctggagaattgatcatccaggcaactgatttggcacacccctgaaccctgctgtttgttctgttctcttcctgttcatccttggatgaggcctatagtggtatagagtccctctcttgctccatttggttactgtctagctatttcaccggaaacaaattatcagcgcttctctttcccagagaaaaggctatgataggacttgctttacagagctatcgtgaaggctgaataagattgcacatatgaagtatgcagtcctgcaatgggtttcttttaaaaggaagggccacattggatgcatctttaaggacccaaaaatagtcactatagaggcttgtaaataatgcgagcctgataacagctgtaattttctctaaagcataatttgttttaattaagacaggattgtgttcatgggtaggaaatggagagggctgatcttctctatttcagaaatgttaggagttactccgtgtaag

SEQ ID NO: 47091 - DNA, 1065 bp, Homo sapiens
ctggaagccaagtaagccttgatctctatatgtcttcaatggtgacaacccctgatctcagggaaaacgtaccccttcccttgtataggacccctagcatgacaacctagaatataatcttcccaatcccacctttaaaacttcaaaggtttgggctttttaaaaaaaattcccctatattaagaagaagattaggtttttggttttacatgcttaaaaaatcaaactgtgtaattactttattatggagtcatagcacatgcatgccagttggctccaactctcttgccttgttgaggtttttattctagtctgggaatgttcctgagcgtcccagagaggttaggtctgcccatttctggtctgtttctctgaagcatgactaggcagctccgattccacgacaatagcacagtcacagactggctctgcagaatagaatatgccagggacgaggacaacccatttatatcaaatcctgttcagtatagtcaaattctatgtcaaaaagattactgtgaaagacccctttaggctatttgtaaataaataggtcctcatctcttttttctctaagaacaaataggttaatttgccttaacgttttgaaaacctaataatacagatctaatatctcttgtcctcaattttaaaatcctaaatgccaggaaaactgaacgttcttttgcaaatttaacactagaattcattttttggcaaagtttgccataaactcatttgaggctatttacagtattatttataacatttattgtgaaatattcatgtatttgattgtgaagtgctggctcagaccccgctggagattttgtatcatgtatgttataggcatcatctctgaaaaaattttgaattccaaacatgtcttgtccaattttagaatagggattgaaggcctgttctctgaggttctccctgcaggaggatcataagaaaaaggaactgaactaatgatataagcgattttctaaaaatagccctgcacctctgccctagggaggaagggaaaggcccattcatctagctgcaccctgaagtagagcg

SEQ ID NO: 47092 - DNA, 1034 bp, Homo sapiens
ttgaaagtcaagcagtcatcagcatcctatcctcattgagaaacttacatagcccagtgatagctcctctttcaaaagacagtgaatgtttttgtcaagaggttccattttaactttgaaggcttttttcccagggaaatcaagaaaaagcatgaatattaaattattattctttgacgccattttctcaaactgttaaagaagaagcccatgacaccacctcctctgaggttttatttctcgtttcctgtgtttgtcttgcttttaaggggcaggagctgatgggtgcattaactgcacagagggctacttcatggaggatgggagatgcgtgcagagctgtagtatcagctattactttgaccactcttcagagaatggatacaaatcctgcaaaaagtaagtggatctgccccctgggccctagcatttagacctaagttcttttgatgactatcttcataagaaaataagaaaacttagaatttgtaatgataacactaggtttaaacatgtacctgtggacactgttctgaagctttcacccagcttatcattgatatttttattcctttgcctcaggggcaccttaaaacctttaatatttcaatttcaagtacatgctccataccctttaaaatcacagtgtctacctgtgtcacctaacctagcaattgttgtgaggaaagatttttgagtaatcttcagagggataattaaatgtaagacattatgaggttgctagtaaacacaccttcccctgtgcatgtgtgaatggattaaaaaattgtacatttttctcatagatgtgatatcagttgtttgacgtgcaatggcccaggattcaagaactgtacaagctgccctagtgggtatctcttagacttaggaatgtgtcaaatgggagccatttgcaaggatggtgagtacaactgcccatatcgatcttatgaagcaaagtatgatctttctactttcaggactaatatttttccacttaaaaaagaaactcacagcatgcatcagatatgaca

SEQ ID NO: 47093 - DNA, 1110 bp, Homo sapiens
acacagcatagtgccattacaaatggaaaatcagatttcatctctgtttactgagcataaaatctgaactccttacctgagatctttgtgctgtcacctcacaccaccatcccccatgccctcacatgttctagtcatgccaactttcttttcatccttcaaacaaaaccagcttgtttgggacccaggacccttgcccttcacatggctggcttcttctcatcccacaggtctcagttcaaaaataacttcctctgagcagttccttccaccactgaccccacacctgcccacctcgttttgactttccatagcactcaccacatgacattttatggttcgttacttgttgtcagccagccccgtgagagctggtgcttcatctgtcttgttcacagctgtatcttacatgtccagcacatgccttgcttaagaaatatttgtggaatgaatgaataagaaaacatccgagagaagtgacatttgacctgggccttgaaggataagcaagaaattaaaaatcaaagaaggttatgatgtttaagaaggatattcgagagagagaacctgagcaaaggcacaaagccattgaaagggtcctgtggacggcgatcacttggaggcccaggcaggggatgagcagggcaggcagcttgggagaaaggatggagagatgagtggggtcaaccggtaaagaaccttcgctggactgtttcccttcctccaccctcttgtcatcaatgtcatcaaccctcttttcagagaggctaattgatttgcccaaggaccccatcaagtcaactcttggcctcctgccaacatatttgagaagcattcactcagacagaatgctgaggcggccagatttgctcagtccccaggcactgatggctgtattgagccagttgaacgaaagaacagggtgcaagctcacatgagaggcagcagcccacagcttctgttcactgtgatgtccacagtcagagcaacaatttggcaaggcctgtttgcaaaactggacttgggaccataagcctgctcagtaccatctttttctcctaagagaagatcccctagccctctaaactgtcatcaccagagaagaacaaa

SEQ ID NO: 47094 - DNA, 1059 bp, Homo sapiens
taagaagacataaaacctttaaaaaagagaacacaaagttggaagaacttgcagacattgtgcagtttcattgtcccttactcatcctggctttcttcattgattcatttggcacatatttattgtgtacttttgtgctttctgctttcctatcacttgttccgtttattccacatataataggactgtatagcctaatatttatcaagcatcaccaggctacacgcttaatgtacgtgatgtgttttcacatctgcaacccaacaatttttacatatggggaaactgagggttagagaaatgttgaaatgtgaccaattttatgcatatgggaaatgacagagtaattcagaagcagtttgtttggagcaaccttgtgcataactttgctccctgtcttcacaaaggaagtagttggcttagaagctctttgttataagtaaacactaggatacacagggttgtatttcccaaatctcggtgacttcaaacaacacaggtttatttctctctcatgctacatcttcatcatgggtgagctgagaactctgctctgtgtgatccttaattcaggaccaggttgatagagcagccactaccttgccatggcagacacaaagcagacactggctcttagaggtttctccaggatgtggcacttgtacctcctgcttacgtatttttggctaaagcaagttacatgattacgcctgggatcagagagtggggaggtgcaatcttaccatgtgcctgcagaaaagagagaaaataatgattgtgtgtaatggtgacagtctcacaggggaatgactatgggtcatgggactgttgctggcatattctgagctttcacattgtgtgtttgtacatgaaatagtcccagatgtgtgcccgatatgcttcaataaattatttctcttctgctcctctgaacttgtccattgtcttaccttggaaatgtctaacttttttcttctctcaaagcaactcttttgaagaagtcactatttaaaaaaaaaaaaaagatgaaatttccccaagtattctgttatctcactt

SEQ ID NO: 47095 - DNA, 1066 bp, Homo sapiens
tctatcacaggcatgtcctacgtccttattacatgtcctttttacagtaaaggaaaattttacctgtagggtaggcttttccaattagacaagcaagaactgctcgaatgtattagattttatgctaaaaacagacggtctctatggctgcgttattagagctcaccgtcagtcaagcttgcctttaaaagttgctcttcccagttgcagacagggaaagcgtgaagcttctgaggagggaggagaggggacaggtgtgggagcttggaatccaacagcaaagccctgcaggtgctcattcctccccgagtctttagaacgcgcctcctcacacttgagcgtcagttataggcttccttgcaaggtaattacaaactttcagcgacccctctgtgaccgaggtggttaaaaaacaaaatcctcttcctgttggaaaaatctgactcatgttctatgcggagacagtcacaaaaacaggagctgctcttcatttgatttcgaggcaagaatttgttaaaagggtcacttcggtgcaaaggcaacggcagccgaagagagtgctgtacaggaggagtgtgctaagggctcgagggagtgacagctctgtggtttttgctgggctggagaggaggcacgtccatggctgctgtctactacggcagttttacacatgtgacttcaaggaagagcagctcagagaccgtggaaagcccagcagccaaaggccacggagaacacgggccctatttcagagacagagccgagaagattattcaatccagattgggctatcttctgtgagttatagctgaagcaaaatgctgaaaatgagtttgtttggcattcaggcatttaagaggcagtgcaagccaaaaggaaaatggtctggtgctgtgtttctagctgaacatctgtattttatctggcgtccagatgatgacacggtccagggagccaagagttagagcaggcttgattccccaaatgattccacgtcccttcaactggactacgcattttgcaagcagaaaccaggcttcagtggttcccttttgtcgaagcacca

SEQ ID NO: 47096 - DNA, 1027 bp, Homo sapiens
tcacatacagtggcagaagccagatgaggaacttggtcagtcagtttcaaaacctgtgcttaaccactgtgctactttcacacagcacacagaaggaatctaatggcatgctatgattacagccgtttaatacggagacaagactcataatagttcataatagtcactgtgtcagggtggtgcaattttgtttcgttttcctctgttttccaaagctatccttgaggaaactttttcctagtgcaaagcttttcattgggatggtatgtttctttaaatggaaggagactaattttaccatttaaaaagtggtatttatttttaaaaacataaaagaaattccttttcaataataatgagatggggcatcgccgcggagcctcggttggcctcggatagccggtcccccgcctgtccccgccggcgggccgccccgccgtgcgccgggaccggggtccggggcggagtgcccttcctcctgggaaacggggtgcggccggaaaggcggccgccccctcgcccgtcacgcaacgcacgttcgtggggaacctggcgctaaaccattcgtagacgacctgcttctgggtcggggtttcctacttagcagagcagctcgttcgatgcgatctattgaaagtcagccctcgacacaagggtttgttaaaaaaaaaagaaaaaagaaaaaagaaaaaaagaaagggaaaaaaataataataacaaaagcaaataagtaataataataataataataatgagatgggaaatgtggccatgtgtttttcttgtgcttttgcacattctctctaggctttgtctgtggtcatggaataagaaaagccttttggttgccttgtttggaataggtgcggctttacttcattctccacctgagagggtagtttactgcatggggcattttgtttgctgggaaaagaatccatgtatgaatcataccacttaacatttccctgccagcgctgtgtgcatcttttgatgtgacatatttttgtttgtttgttcttttcta

SEQ ID NO: 47097 - DNA, 1078 bp, Homo sapiens
agagcaaactttcactcttcatctctctccttttaccaattaaaaggaagaacacagatggatctagagaaattgatcagaaattcagaaattataattatataatggaaaccagtgttaatcctcttagcatttctaatgttcattcattctgtaaaactgtgtacttgtattaaaactatttttttgattttttttttcttaaaatgtttctgcttttaagtatcatattggtattttgagggggagttcaatttgcctttattgtatttatggaagacagtgaattttaagtaggaaaaagataaagaatcttctccacacatggttcatctgactgaaccatggcagtgtgaacatctgggaactgtagaaggggtataaaataaatggaaatcagtgttttcaacttcatcactttattgccttgagactttggaaatataactcagttttttttccatttttattatttttcagtatttcgtcccatatctgctaatgccaaacttgtgatgaatcgccgatctgattttgacttttctgcccccaaaataaacttggaaattgagttacataacatagcaattgaatttaataaaccacaggtgattttctttaatataattttcaattgtgaattattgtttgataaaagcaaaactaagattttaaatgtttcactaaaattcatgatgttatatggtagcatttccctaaaaagtcagtaatgtaacttttatcttcagcaattgaacaaaaaaatgtgatacatttaagagctttaattttccattctttagtatttcagtattatggagcttcttgaatcagttgatatgatggcacaaaatctgccatataggaagttcaaacctgatgtgcctcttcaccaccatgccagagaatggtaaatgccttgatttttttttttttttagattttaaaaatacaacataaaaataaatttctcgacttcaagaataatctttaagatataccatttttaaggtctgatacaaaccataattgatttatagctagaaatatatgtagctgctttagcttattgagttaa

SEQ ID NO: 47098 - DNA, 1032 bp, Homo sapiens
aacttttttacatataagtcaacacaaataggattctttgtgaattaatctatgtcaatttagaggaatcattgtatgtcttctttgatgggaatggactggagtcagaaatgcaaagtgaagttgtcttcattaattttttaaatcattttcaatttttaaaatccttcacaattttactgatcgctgacttttttcttttttttttaatgcagatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcagtaagcatttttttaaattactaagttttaatataatttagtttgctttgagtttgtgttaatgatgtttattttaacagaggacagtgaatagtatagtggaattcttcagacctccaaaagaggtacatctagcacagctcactgcagcaactttgacaaaactggaagaatttcgcagtaagacagcaacaggtaaatgccaatattaatgttggtgaattaaatactgtatcctatattaaacttttatttatggtagaatgtttttagtaaagtttattttaaatttattatatttctagactggttttagtttaacagaaactaatttagtacttttatgtttaaaggcagataaaaccataatcattttttacactcagaaagttcatacctagtaaccacatttaagttagttgcaaaattttgcttaggatacttggacctctatttatgacaaaaactggcctctcgttttcctttcttagaatgcgttccagattttgatatatcagcctcagggaaaaaagttctatccttttttattctctaggagagtttgaataaggtcgggtacgatttcttccttaaatatttggcagagcttaatggtaaaaccacttg

SEQ ID NO: 47099 - DNA, 1046 bp, Homo sapiens
atatgttttagaaagtggaagtcttcagtattttaccttctgtacataataacctttaaaatttgaagtctgttcttccaactttgttttcttttctataccaatagtataaaaatgctaattctatgaaaaaaaatggaaagcttctatgataggtttttgcacttaatttttaaaatttaatatattttggattttttctagaaagttaaaatttacctatttgtgaagagactcatatatattataatgattctggttacttaggttctttccttccctcatattcctcctttcttccttttattttgttacattctcctctattaacatcctggtttctttcttgtattataggttgagtatcccttagcagaaatgtttgggatcagaaatgtttcagatttcagatttcttcggatattggaatatttgcattttacttacttgttgaacatccttaattgggaaataggaaattcagagtattctaagcagcattttctgtgaatatgatctttgaggatcatgttattgtggtgctgaaaaagttttagatcctggagcgttttgattttggattttcagattagggatgctcagcttgttattttccccttcctttctaagaactcaaggtctttcaggtctttttgttgtcaactatggcatgagcttacagagcctgctcaactagttatcctttgtctctggcaggaaaacagatgtggtcgtttgctaaaactcttctttcagagtacaaggttctctgataggatcatagtgaatcattttctttcagttatttcatttatttactcatttaaatatatatcaagagcctaatctatatgtcagacactatgctaggttttagggaacatagcaatgatcagaatggatgtagttcttgcctattgatagatgttatactcttatggataggacaaatataaaactaagagcaatatactggaaatttttgattaatgctgtatgggtccaatcaggaaagaaaaaccacacagtaattttgataggtatgt

SEQ ID NO: 47100 - DNA, 1028 bp, Homo sapiens
gcaggtattttaaattttatattggaagtattttgctgaggtcattttaaaattaatactaattttacattaagattgttttatcagttcatatatttagtgattctgtatttctcgagtaatttgtgaaaagtattcatagaaaagatttacatttttccaggtctactgtatattattgaaacacagaaagttcttgatctcaaaattaatttgaaggcttcatatattattgtcccacaagatggaatttttagtcctacatcaaatctgcttcttttggaccttggtcatctaaaggtatatactaataatatttgatttatgatacagcatttggggtgtttctttgttttaaatgtattttgttttttaaacagtttgatttattgctttttttcctagatttgtggtagataagtaagatttgagaaatctccctttctgttaaataaagtgaagtctcaattaggtagttttcctacacttatgaaagcaaaatgaccaattaaactctgcagggcaggtttgaatctaagcttgattgactgattgattgattgattgattgactgattgatttgagacagagtctcactctgtcgcccaggctggaatacagtactgcgaccttggctcactgcaacctctgcctcctaggttcaagtgattctcaggcctcagcctcctgagtatctgggattacatgtgcccgccaccacgcccacctaatttttgtatttttagtagagacggaatttcactatgttgcagactggtctcgaatgcctgtactgaagtgatccacttgcattggcttccctaagtgctgggattactggcgtgagccaccgcgcctggcccgaatctaagatttatatttgtagtatttgagagttgtgcttgagaagcttatttctttctcaatttagacctattacttgattacttaaagtatatagaatgatagagaattgtggaaacaatcaaatacgtcttcatctttctgaaattttttgtgcataaaa

SEQ ID NO: 47101 - DNA, 1027 bp, Homo sapiens
agataattcagtaaaatttgatctgttgaagagatccatatgtagagatctaagtgtttgtatgcagtcagattttaattacctgagctaaccaataaaaggagaaacaatgagaatccaaagtagttgttatcaaaattgttaatttgtataggactgaaacattttatttcttcaattatatttgcttcaggatagtgaatgtagtttgtatttttatcatattctaattgtggtggaggaaacccaaaggtatagtgggtggcagaagtacgttattttcagaattccacaaattctttttcagggaataaattactgggtttggttttccttgactgggattttatctgactcatagaattattatgttcaaatgagatagtatatatgaaaatgcattatatgactgagatcccattaatcttgttatgaatttttaaagttatttctttctgattatacctatttcagaaaatctgaacaactgagaaaccaaaaagataaacctttatgttactgcttaggcaggaacactattgatattttgttgcacatccttttagtatgtttttcagtgtgtgtacctgtgaatatatgggatgtgcttgtttggtgtttatattggaggtatttgtgaatgtattttttttacatgatttatatagttttatatccaggtattttttcttttaccagtaatattttggtcacttgaactcatggtttttattgtctatattatgctatatggctatggtctcagttatttaaccattcccttatggaacatttaggctcgtaactctgcagtgattgttgccaatcaacaacatccaagtagacttggatgtgaatttcagttttatcactagcagattgatcataggcaaattataaattcttttgagtctcagttttctaaagtgggattattatacagaattttgagaattaacatttaaacattacctagaagagtagaaattataaatcttgaataaatggtagcttttattagttactg

SEQ ID NO: 47102 - DNA, 1075 bp, Homo sapiens
gattgtcagtggatgcgcagtagatttgataacctactgattgtatgtacctgagaatgtgacattaagattacctagatgtggggaaatttcctcatataatggaatgtgtgactatgaagtattaatagttattttaggttttgtgtgttatagttacgttaaatatgaactattttctgtacttaggtgataattggagagaagcacgaaaactcagtgtatctacccagcatattttggtacccatgcacttcaatttggaactgtctaaggccatggttttcatggatgtaaggatgcccaagtatgtactgtttgtttcatgtgaatatggattttctgggtaattctgtagctagggaaataccatacttaactgactcttccttgtgtgtgtggtgaaatgtatataactgactcttccttgtgtgtgtggtaaaatgtatataaaatttaccattttgataatttttaagagtatagttcattgtcattaggttcacgcatgttgttatgcaaccatcaccaccattcatttccagaactgtttctcttccaaactgaaactctgtactcaattaaacaataacaccccatttcaccctgcacccagcccctgacaacaaccattatatcttctgtctttatgaatttgactattttaggtgcctcatataagtggaatcatagaaaatcagattttgtgtgcctgggtttcttcacttagcataatgtcttcaagattcatccatgttggagcatatgtcagaatttcatgtatttttaaggctgattaatattccttatatgttgtatatactatgtttttatttattcatccttcaatgaacatttgtgttgttaatgctgtttggctgttgtaataatgctgctgtgtacaaatatctgcttaagtccctgatttcagtatttttgggtgtatactcagaagtagaattgctggatcatattatagttcagtgtttaagttttagaggagtgctgtgctgttttttatagcagttacaccattttactttcctaccagcacaagagtttcaatttcttcact

SEQ ID NO: 47103 - DNA, 1033 bp, Homo sapiens
tgatctttgatacatagtctcatgagcaggctatttgcactgccaaaccttagttttctcataggaagcatgtacatataggaacttaaatagagagcaaaaataggttgtctgcctcatagattgtgaggactgtttacaataatgcatgtaaagtgctttcctcagtgcctgtcacatgagaaacacttgattagtagtaattgtcaattgtatatagcaaacagtagaaggacattacatgaaataagaacataaacctctgaaaaataatgagtttagcccatctaatgaaactggttaatacggtaagacggaaattggaatagagatttttagtgtttaaaatcacatttgattcagataatttgagaacagtctttttaattagtgcacttaaatcagaataattcctttataattacttatttttatcttttcaaaacagattcaagatttatggaaagttacctcttatttctttacgaatctcagataaaaaactacaagggattatggaattgattgaaagcattccaaaacctgaaccagtaactgaagtatctgcccctgtcaaatcattccaggtaatgttactttcaaaattaatataagcatgaattaagaaagtccacaaatagtatttcaaacaatcacaggaattttatataagacaatttgcaatttgttttgaatagacattaagaaaattactttttttttttttttttttttttgagatggagtctcgctctgtcaccaggctggagtgcagtggcgtgatctctgctcactgcaagctccgcctcccaggctcacgccattctcctgcctcagcctcccgagtatctgggactacaggcgcccgccaccacgcccggctaattttttgtatttttagcagagacggggtttcaccgtgttagccaggatggtctcggtctcctggtcttgtgatctgcccgcctcggcctcccaaagtgctgggcttacagacgtgagccaccacgcccagccagaaaattacatgttg

SEQ ID NO: 47104 - DNA, 1049 bp, Homo sapiens
acccaaggtggagtgcagtggcgcaatctcggctcactgcaacctctgtctcttgggttcaagcagttctctgcctcagcctcctgagtggctgggattacaggcgcccgccaccacgccagctaatttttttttgcatttttagtagagacagggtttcaccatcttggccaggctggtcttgaactcctgaccttgtgatccacccgcctcggccttccaaagtgctgggattacaggcgtgaaccaccgtgcccggcctgtattcttttatttttaaaattaaatgaaatcattatacacactattctgaatctgtattattttcaccattattatcatatatgccttagataaatttttatgttagcacatacagatctacctcatttgtttatggtgatatagtatttcattttctgcatataccatcttttgcttaatatatcttcttttgatggatattcacattatgagtgtttacagttatgaaaaatactgctttgaacttcctcatatatatacatatatatgtgtgtatatatatatttgcttatacttttattcataggataaattcctagaaatggaattgttgagtaaaagaggatgtgaattttaaattttgattattttgccaaaaaaaaaaaaatttttttttttttgggacgaagtctccctcttttgctcgggctggagtacagtggcacaaccttggctcactgcaacctccgtctcccaggttcaagcggttgtcccatctcagcctcccaagtagctgggactacaagtgcgtgccactacacttagctgatttttgtatttttagccgagatggagtttcaccatgttggccaggctggtcttaaaatcctgacctcaagtgatctgcctgcactgggctcccaagtactgggattacaggcgtgagccactgtgcccagcccagatttgcttaacttatagtttgctaacagtgaatgaatatctttctctgctttcattactgagtattagcaaatgttaaaattttattcgaagtgaaaaaa

SEQ ID NO: 47105 - DNA, 1076 bp, Homo sapiens
atttgtatagaatttgcattattccttaaatgtttgatggaattatcagtgcaaatattttttgtgtatagttgagtctgggattcactttattttattttccatatggcattcagtatccaaaggagatccacacactgcatttgattgatataccacttaagtctgttatagtttatgaatttcctttagtttcttctctgcccttgtgttagccatttgttgctatcttatttattctgtacaattttccatagcctgtatcttgctgattatgttttcatgctatttaacatgttactgtatcctgtgtttccttaaatcggtatttaaatctcagggcacagtgagattcagggtttgggagtaggggttggcaagatacttcatagttggtagtgtgtgttttcataggaggcacatagtgtgtagctgtcttttttttcttttctgttttgcactgtcttggaatattttcttttttttatgttagaagctatttgttgttatttcctgtaatttggtcttgaagtctgtgtctggagagtggccataagccaaaatagccactttctagcttgcaggcatgttggtcagatgggacatcggggaggcaacacaacaaaacaccctcgaggggtgcccaccagggaggctgacaggaagtctggaggcagtagggacgtttcttcatttattaaatgggagagttcaccagtctttatgctggtatcaccaatcattttggcttttcaaaagtttattctccagtagatttcttaggcagggctcataggaacaataatccttatttatatttgcagggtagtttgactggattttaaattcttgccttgaattttcttttctagatgatcttaaaacatattactccatgtcttatggcctagtattggtgttgacagttctgatgacagtttgactttctttcgcttctaagaactttgccattttccccagacattcagagctaatttgaagctttatgtagggactttggacaggtagacatcacagttgatggtcaggaactggtctagcaattttatgggttc

SEQ ID NO: 47106 - DNA, 1037 bp, Homo sapiens
catttgctgctataaattttcctttaagcactgctttagctgcttcctgtaagttttgatatgtcatatttttattttcattcaattcaaagtattttctaatttctcttctgactttcttttacccattgtttatttagaaatatgttatttaacttctaaatattttgagattttcagatccctttctgttactgatttctagtttaaattcattatggtcaggggagaaaccgtttcagttcgtttaaatttgttgatgtttgttttatggcccagaacatatatgattaatcttggtgaatgtttcaagtgtacttgaaattaatatgtgttttgctgggttgaatgttccatttgggcaagtaggttggtggatagaattattcaggctactgattttctgtttactggttgtgttgaagcctctgattataaccattgatttgcctgtttctcctttcagttctttaagttttttgctttgtatgttttggagatctcttgttaggtacatataaatgtgtatgaattttatgccccttttgtgattatgtgatgtgtctttttatctgtggtaactgtgcttgttctgaagtctactttggtagtaatatagccattccaggtttcttcggttaggtttgaatggtctatctttttctgtcctttagcttttaatggatgttttcttgtttaaagtgggtttctgttttttgatgcaaagtctcactgtgttgcccagggtggtcttgaactcctgtgtttaagctcgcctcagcctaagtagtaagtagctgggattatatgtgcatgccaccacatctggcttaaaatgggtttcttacagtcagtgtatatttagatctttcttttttatctaatctgacaatctcttggcttttaatttgtgtttagactattttataaaactaattattgatatgattggattgtaatctgatatctctaattgttttctgttctctaattttgtttatcctattgtattcctccttttggcctgatttttgatt

SEQ ID NO: 47107 - DNA, 1836 bp, Homo sapiens
atttattatacataataaatgtgtagttccttatttatataacatcgttttgacataggaatattctaattaattgaaatatatatttcatatagtaacattaagtttatgtgcattatatatcataaatatgttatatattaattagaaccttcgttttatatgtcattggcttaagtcttcgttttacctgacttgcaactataatttaaaaatactgaatatataattgaagtttgttttggtctgaagtcatcattaagaaaaggttattttaattttctagagacaaggtcttgctctgtcacccaggctggagtgtagtggcatgatcgtagctcattgtaaccttgaactcctggattcaagtgatcctcccgccccaacctcctgagtagctgagactacaggcacatatcaccatgcacataccaccaagctaattttttttttcttcaagtttttatagagatggggtcttactctgttgcccagtctggtcttgaactcctggcctcaagtgatcctcctgctttggcctcccaaagcgctgagattacaggcattatgtctggcccaagaaaatcatattttcgattgcattgtcattctgtgaatatcagggactttaaggagttagatttaacccctatatgactccaccctaaggcatttcggttcttatttcggcttttcttgtttcattttgtttcggtttttgtttttcccttgctgtcagctgatattttttcctgtgggtgtcacacctatctccataacatcactattcattcttttaaaatgctgtctcagtgttttagtgtatgaactaggtaatcaaatctaaggctgtagtggaataaataggccaagtgtggcaattcttataagcaagaaaagtatttgcgtgttcatttgaatgtatttgggaatgtggagccctcttttgttatttcaaaattctaagttaattccatataatgttgctgttttgtgatcttttaagccataacatcattttgtacacaaaaatgtaaagataaacaagtattccttgttgaatttcttctcttttaaaaaaaattagagttgggttcttgctctgcagcccagactggagtgcagtggcgtgctcctagctcactgcagcctcaaactcatgggcacaagcaaatcccatctcagcctcccaagtagattaaattagtagggacaacaggccctgctaattttttatttttaattttttttttaagacacgatctcgctgtattgcccaaactggtctagaactactggccccatgttatcctactacctcagcctcttaagtagctaatttatttttataaccaaaaaaatcatgtcacttgagccctcttgtacttatacttagaaattactaaaatgttaattttttctttgaacatgaaaattaggtataagagtataaatatagataattatattttatgtcattgaagtttttttttggaatttggaaattggaaaattattttgaaacttcttaaacatattttatttatttatttaccttacaaatataaataagctctctgtccactgaggttgtatagagaaatagggttgtttttcattagggaaagtgagataagggaagtagatatctgtaagacattccagtgatcccatttagctttgttctgaggactagatttttattttatctgtgtctttgtgtttctcagtttttgtggcagaaaattaagatttaatatagacagtaagattttgaataaataatgcttggttgtatcaagtaaaagtttttttttaaatggaggtaaaaccata

SEQ ID NO: 47108 - DNA, 1067 bp, Homo sapiens
aaaaaatatacaaaattcgtctatgatgattgaaattagaatggtagagaggttgggaattggctagcaagtgttaagagggaactttctggagggatataagtgttcagtatcttaattgaagtagtgactatgtggaaatatacacttatcaaatttcatcaaatagttcatataagatacatgtatttcattgtatgtaaatttttatcacaattgaaaatacattacctggcataatggtacttttctctgaagttagatataatgagaattagaaagtgctgcgttttcattttaagctcatttaatatgtgcatataatgccttgattcaaaattcaaatgtagaaaacaaattttgaattcttctgattagtagaaaaattttaaaaatgtctcttggttttagttttttaaagtaaaatttgaatactgaattatgtgccagttactgtaatatgcattttacatgtgctattttacttaatctccaaacatactcagtgattagttctatttttccttggaacagaacagaagtaggaacagaagcatcaagaggaaatagaaacaccaagtgttcaattaatattcccaaattattatggaaagagtcctaagccagaagttactgagttttacatctgaattttctaatattttattttcttgaatgtcattttactatacctgtttaataattctattaaatctatttcaagggtattttaatgagctacttttcatgatattttcttttattaaataactttaattttttcaaggagcaactgtggtgacagctgctgtggtagaagtacattcacgtgccttactagttaagacaacactaaacataagcttcaaaactgatgatctcaccatggtgctgtatagtccaggtcctaaacaggtaagtccaggaagaaaagaaaatgtattttcacatgtgaaatttgcataggttgatgtttttaaagtaacaaatgttaatatttaacatttattttgtagtatctgtccctctgagaaaaatgatctttttactttaataataattataac

SEQ ID NO: 47109 - DNA, 1010 bp, Homo sapiens
tctagtaacctcttggccttcctcctcttcataactctacttaaaattcattcctttacagacatcttttcaagttaactggctgacttccagcgaatacttacaaaaatatttgagcttctgaaggagtaatagaagcataagtttttgtttgtttctttgtatttttttcctgatgcttggtatgcatctatagaagcataaatgttctaaacattgtcaccatagaaatataagatgtaattttgatacaatgaatacatatatattaggatataagataaactgttgcccaaatttgcaagacagttggccctccactaagcaaagagagagaatagaaaatggagggtataccaattctctcttagtttttgacttagaagttttaaatatatatttcttctattcacatcttttttggcttgaatatagctgtatgaccacactttacttcagtaaaggttggagactgtggtatttttttctgagctaccttgtgctcagataaaacttctattactgtggaagaatagaacagatattaggttctagatgtcctttatatgggataattaaggagtgtattattaagtcactttttaaatagttgtttttattaacttgtttatttgacatacctattactaggaaagtctttaaatagaaatatttttatatttaaacattaatttagtggtattgatttttctctcataggttttgcagccctgtgacttgttttatcaaactactcagaaaggtacagatccacaagtgatcgatatgtcagtaaaatccctgacactaaaggtaaattaaaatataatcatttgaatatttagtgcacttaaaaaaagtagtaaagcctagaaagttattatagcaagtcttttaattgttatgcaaacaaaataggtgtgtttttgaaaatacgtttttatgagatatttacaaagtaatattatttaatacacattttatgaatgttattctatattttattattt

SEQ ID NO: 47110 - DNA, 1035 bp, Homo sapiens
ggttcacagcaaaattgagaagaaggaacagagatttcccgtataccacctacttctgcacatgtatagcctccccctttattaacattccctcatcaacgtatatttgaagactgaaaaaattttccaaaattgagaatgtttataccacactcgacactttattttaatcacaacaaggttcaggttgtctcatcatgagccttgcccacatgcttccttgtttgccctctgaatataattttcaaatctaaggccaatgttgcctatgcttctaatacaattatgtaacaagtattatgttacttgttacataatttagaacaatttagaacataatttagaacacagtttagacattgttctaaatattttaatccttacaacaactcttggaggtagatacagtttttatttaacatgtgaagggactgagaccagggaggttaagagacttcttgaagtaataatagctacaaagtggaaaagatgggatgcaaatccagctgcagaggcgttaaatccactctaaaccactatgctataatgcctgtgtcatcatcttgtaggttgttgtctatcctgagtttccttcatcctttggatgtttgcatgtgtgcaggaatgtatattatttgtttgaaatatattgtggatttatataatcatgagaatcggggcctttaggtggatgaaattttgcttctgaagcaagagactgcagaattactcacgtgtttcctacctaataatgacttggtcaacctgcagacagattttcagtggcttaaagccagttaaagtaacaacagaggtgactagcttagcatgttgagctcttttcatattagatcacttaattttattttccagatattttagatgaaggatatgaaaaggaattccttggtggtttttaggttagaatacacatggtcagcagatctgtgactcctaaaaaatggtaaagggtattgattcttatgagctctaggtttataacactgttctgctactattgtctgcctttgtaag

SEQ ID NO: 47111 - DNA, 1064 bp, Homo sapiens
gatgtttattctgtttttcccttgtctttagctacttgtcactttttagtttttaaagttctgagtaataaatattatgaaacttggatagaaataacttgttaaatatttgaggccaaaaagattagaatttaatattataaaggtttagtgcattaacaatataatattttgtttatgctaaaaagtaatttatcagtttaagcaggaatttttaaaggtacctaaattgtgatgtatttggaatatttttttcctaggttcaacttatggtaactgatagtgagttgtccaatcagttttcaattgatactgttggtagtcatggagctgttaaatgtaaaggcctgaaaatggactatcaagtgagttcattctatgcttatcaagaaacttttattttaaatgtttctattaactacttaattaaattttataaagatgttatacataacagtttttgagctgttaatttttttttcttaggttggtgtcactatagacctgagcagttttaacattactagaattgtgacatttacccctttttatatgattaaaaacaaaagcaaataccatatatcagtggctgaagaaggaaatgataaatggctctctcttgatttggagcaggtgggtagatgaatttcaaaaatatacctctttggattctattttctccttgaagttagatacctaaagtcaccatgtaatgttttaactctccccttactccaattttgttttagtttcatgaatctttattgaatatttgtgccctgctctagatagatgggaaggttcaatttttaataattaggtaactaggaatgcccagcttgttaagggaggtagacgtttaacaattactaaccactttggttaaataaagcagccaaagactagataagatgtaaatgcaccaaagagaaggaaattacttattctctctaggaagctattaggaatgctttcagagagtagggtaagccagactcttcttcaagttatttgaggagagtagtaacttagaagtgaaattttgattttgtgccatcattaaa

SEQ ID NO: 47112 - DNA, 1028 bp, Homo sapiens
aggcgttccagggggcaacggcaaccccctttaggtcccctcccatttatgggagctctgttttcactgtattaaatcttgcaattgcaaaaaagaaaaaaaagaaagaaaaatctctctggctgccttcagtcttctctttgtctttgatgttctgcagtcacactgctatatgtctatatgtggtttactttttatttacccttcttgaggtgctttacccctagatctgtggattaatgtatttcatgctttctgtaaaatttgctactattgtttctttaaatattgcctctcctccattcttccgtttttttccatctaagccgttaaatcagacatgttggacattcatactctatcctccatgtctcttaatagctcttttatattttccaactctctttgcttcattctgagtaagttctacatggacatctttcctttttttttttttttttttttttttttttgcttttgctgtgtctgaactactatttaagtcttcaactgagtatttgaataattatagttcttattcccagaaatttcaccttttttcaagtatattcattctttcaacaaatattgtttattttttatgtgacttgcaatataatagttaaagccacagtagttaaagcccatctttatgtagtttacgttttagtgggtataaggggaaacattaataataccgtaatcaattagtatatagtatgtttcaaagtgacaagtctaatgtgggaaagtctgatgtaggataagggacattgagagttcaagagccaggggtggtctctaattttatgtaaggtagttaggatgggactcattggagtgacatttgaacagtgccttcgaggaaatgagaaagttagcaattgtcgagagctcagctgaggaggagagagctgagctgccaggtgtcggaatagctgattaacacaaaccacaatgaaagtaacagtcaaacctttaatcacttactgtgatagtacagattgagcatccttaatctgaaaata

SEQ ID NO: 47113 - DNA, 1058 bp, Homo sapiens
ctcttgatggtgtaagtctagatgatgaggcacagttttttttgataatttcttaagagtataaacactgataatagcattgtagctgtgtaaaacagtgttccattaaaaaatgtacttgaagcatgtaggggtaaaactgacttgatgtctacaatttattttgaaatgcttcaaagaaagaaaaatggaagagctgaagcaagtgtggcaaaagcttgttcattgttgactctgatgaggagtctgtcagagtttgttaggagtctctgaattttgtctatttttgaattttttcatgtgtttaatatagtgtaaatatgtaaaatttcagatttttttttcaaacagtaggtaccctcttgttgagctgtcttggggaaaggactgcttccttaaaggctataattgaatcttcatggtttaggactactcttcaacattattcattttatttgctgttatatcttcttagtgccactacaggttatgcaagtttctgatcctctacttagtagttccaggctgtcttgaatttattttgtttcctttctttctttcttttcacctgttacttttcaacaagcacatatttatcattgcacttccactttccttccactgctaactgtacaacttctaatcattgattaaaatcaaacagacattgagtagggaccacagggctggactagcaagtacctaaaactcgtttggggtagcattctctcatctatttaagatgttaagaaagagggatgcctgttttttttaattatccatattataaaaataataagttgtttctaaacatgtgtgcaagtgtctttttaatataatgacttctcttcctttgagaagatacccagtactgggattgctggatcaaatgatagttctgcttttagttctttaaggaatctccatactgtttttcatagtgtttgtactagtttacattcccaccagcagtgtgaaagtgttcccttttcaccacatccatgttaacatctatttttttttaatttaaattatgatcatttttgcaggagtaaggt

SEQ ID NO: 47114 - DNA, 1035 bp, Homo sapiens
tcctctcaaaccctactgctgctttatcagttatttttatggaataatctaaatcctttgttgtcatttaaacaatcatagaatcttccccgataatagattccatctggagaaaccattttctttgcttatccataagaagcaatttctcctttgttcaagttttatcataggattgtaacaattcagttacctcttcatgctccacttctaatccccttgctatttgcaccatatctgcaattacttcctccgctgaagtcttgaaccctcaaagtcatccatgatggttgcaatccactttttccagacaaactcctgttactattgatattttgacctcgtcttattaatcacagatgtttttaatggcatctagaatagtgaatcctttccataagttttcaatttactttgaccagatccatcagaagaatcactccctgtggcagcccaacaaaatgtatttcttaaataataagacttgaaagttgaaattactgtttgatccatgggggctgtagaatggatggttgtgttagcaggcatgaaaatgacattaatctcgtacatcttcatcagagctcttgagcccgagtgactaggtgcatggtcaatgagcagtaatatttttctgagcgataggtctcaacagtgggcttaaaatatttagtaaactttaagtaattcttaaggactctaggattttttctttttcttttttttgagacggagtctcgctctgtcacccaggtagcctgcaatggtgcagtctcggctcactgcaacctccgcctcctgggttcaagcaattctcctgtctcggcctcctgagtagctgggattacaggcgcctgccacaacatgggctaattttcatatttttagtagagatggggtttcaccatgttggccaggctggggacgatctcctgacctcaggtgatccacccacctcggcgtcccaaagtgctaggattacaggcatgagccaccacacccggcacttttttttcttttgagataagagtctca

SEQ ID NO: 47115 - DNA, 1033 bp, Homo sapiens
tgcttgtcacctggaacagggagacagataagcatgacttttaggccaccttctttcatgtcactgaaggacagtaccacctgtttcaatttacctgcaataaagttttcttttaattccttcaccatgtgactgactttatcccagaaggtttgtttttaatcctcctgcttggccaggaacatccagagaaggctactggattcagttatctttgtctccctatcttagggctattcttactaggctcttttaagttaaagaggtacaaacatctctgtgaaatctttatatattagaataagccctgtatcacctccgtggcttttatctgtcatccatgcccaataataatagacattactggtagaaaggttgtgtattacatttacattttatttttgtaatttcaaattattttagaatagaaaatatattgtgagagcacctaaaatgctcaagaatgttgcttctactaccctctctggaattgtgtgtaagtatttctactccattagtagaatcctgtatctggatttatggaagttcatgatacaaaatcagcacagattggaaggaatttttttctttcaggctggctcatttcacttaattctgaagatgaacatccaaagaccttagaagaactgcattcctactattaaaccaagtactattgtccctgagccatctgggccattgaagtgaatgatctcttttgcaggatgaattttatgtattggctgtcagtattacacctaactaaactataaagctaacttctagatctccattcattacattttgtttcattacaagttcactgaagtaagcaaatgttcatttattttcccaccgcagtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgcta

SEQ ID NO: 47116 - DNA, 1075 bp, Homo sapiens
actcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagctcatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaaattgaatcaaaccacaagtttaaaatcacatgaaagtgtgtttccatgttgacctttgtttaaaaaaaaaaaaaagtgcttattttctctgtcgctaagctcctccagttttgcttttgtcagaattaaacttaacagtagaggtagtcagaaagcttgcatcagactgtcctcatccaaaacgaaatacttcattacccaatgttatgatttcaccattctcagaaaaattacagtcccctgcctccctgggtgtagtgtcgt

SEQ ID NO: 47117 - DNA, 1045 bp, Homo sapiens
ataaattttgcagaagtcgtgttcctgcgataagatacaaagatgtgaccttccagttgtgtaaagctcttaaaggctgtttaagtatatcaagtgtgctaaagaacctggagctaaatggactaattctgagagagagggatttaactattctagcaaaggtaagctttgtctcatttggcttgtagacatttgatagttgcttttagaggaaaaaaaacctcaataacatttttaacttttccccctcattaaagggattgaataaatcggcttctttggtgcacctgtctcttgcaaattgtccaattggagatggaggtttagaaagtgagtttaaatctcatttaactcttgtcctatcaggctggtttcatgtttccctacatgccatgttaattcctgtctgtaccttttttcttactactgcctcatatgcttgttcaaaccttggtccagtctcaagtctaccatgaaagcttggcatgctgaatgtaatctgaactaactttacttaagtttgtgttaaaccacagaccacacaaatatataccatctggtattctctgttttttgtgtttgttcatcttttagagtttttcttcaagaaatatttatgggaaggaaatagcaaaatgtaaagaggccgggcgtggtggctcacgcctgtgatcccagcaatttgggaggccgacgtgggcggatcatgaggtcaggagattgagactgtcctggctaacatggtgaaaccccatctctactaaaaaaatacaaaaaaactcaccaggcatggtggcgggtgcctatagtcccagccactcaggaggctgaggcaggagaatggtgtgaacctgggaggcagaggttgcagtgagccaagatcacaccactgcactctagcctgggcgatagagcaagactccgtctcaaaaaaaaaaaaatcatcattactttaaataattaaaacatatatacaatcaattttaatgcactgtggtatgttccaaaataggaaatataagcaaagtgctgtataggagcatat

SEQ ID NO: 47118 - DNA, 1020 bp, Homo sapiens
aaactattaaggcacttttctgccatcttaaatttacagtcaaatcaaatgtcttttctgtttttgtaaataccgtatgattctttaattttgggtcccagaactgctgattgcaaaccttttattaacatagagtatcttaacaatttccatttaagatgtagccctcataaatgatctgtaactgaaatatagtgtttattctgtctcttttagtaccagtggataacttctccatcagtgaaggaaccatccaaaactgctaaacagaaaaggagaactataattctaggaagtggtcacaaaggaaaagctactattagaattggtaaccttttctgtcttggctttttaatgctactagtgttctagtgtgttaaaattaaaatctcttctcattgtatgatattgacagtaacaaccaatattgactccgtgcatattatgaggtctgtaattgttctgataagattatgagaatttatggaatgtagaaatagtaaatgaatcattaggaaagggatgctagtgcttccatttaaaaaattacccttatttgtttttcatacaatattcatcattttggatatgttttctgattcatgattacttttgatactttgcaattgaaatttgggatgcactttgatgacagttttagcagtgcttttgtatgattttgttgttaatgaagaattatcctttcatacgatagaaaacaaaatttcttcccagttccattttttttcccttgtttcctcctccttccttgcaaattcttacccaaagttgttgaattaggtagcaccttgcttctttcaatgatgaaataaccttaaaatatatgtaatccttataaaacaatactgcaggtaagtttattacccagagatggaacattttagacaaacattccctaaatgtttgctatttatggtttatttaatctgccaaataatagtctagaattttgaaattgtctataattttgtgaccaagaataatgaaaaaagactttat

SEQ ID NO: 47119 - DNA, 1024 bp, Homo sapiens
tgcataaactatagtgctgaggccccagtctttacacttccatttaataacttcacagtttcatatcttcttgagatacttactaatttcaagtcccatcttggtcacaaggagttgtgaattagagaacaattaatatcaccagttaaagaagttagattagaaatctgaaccatcctaaacataagaagtacctgcatcttcagagtcttatcccaaagccgttctgctaaattgttcaattttctccatagcagagctttccaggcccttatttggaagtgatttatctctatgcacagttatgtatggatagtatacataatactagcaagtgttattacctagtgttaactggtggtgtatttacatcaaaatataacttaatttatcgatatctttttaggggtttcccattaatcaaaacacgtgatatatgtaatcagttgcaggtacgtagttaccatgtttataatatgtaggggattggaatgggaagggtggaagatcattctctgtgctctttaaattgaatagagtcgtaagaaacatttccctccctgaagtaaattctttaaaaattttctgggttctcccggtgccacagtataggcgtgtggatatgtcacacaatggaggccttgtggtttcatctgtgtagacaggaagtcatttctctgggtccacaaatcagctgttgcctccagcaaaacaaatttgaccaccatttctcacccgacacatggagctatcatagtcaagaatgtccttaagtttaaaagaaatgttcttgggggatacatattttatatgtatatatatatttccagattctaaagctaaaacaaagcaaccagtcctaaagcctctgctttctcagagcttttctttctcccttgtcaggatcaaacacattccctgtcattctgcatcatggtattagagcaagtgaattctgtcagagtatcagattttccttttcagttgtttttagagaccgtaatttctctgtaaaagatagcac

SEQ ID NO: 47120 - DNA, 1948 bp, Homo sapiens
caaaaaaccccctgtgatgatctactggcatgctattacagctaataaagctgaataaggaggctgtgcacaacaccaacacaccggtatgaaaagtgtgtacaccagcaataaccaattagaaaatgtatgaggaaatagactctcatccacaatagctgcgagaagtaaatattatctagaaataagattaacaagagaaatgtaaggcctatataaataaaaggataaatctatgctagagggtataaaagaaacacaaaaatagaggtatgccatgtataagacccaacataataaatagttctaccaaattaatttataaattcaaagcaatttcatataaccacagtaaagctttttaaatggatgtaataacctgattataacattaatctgaaagtcatcaggcataaagcaattttgattacatctcaaaacaatccatggagttagggtaaatgtgctgttcacacaggaataatcacaggtatagaaccgagaacctaggaacagagcaatgtatatatatatgtatttaaaaaatggcatcacaagtcagtagagaagggtttgaactattcagtaaatgatgttgaggttatttactactttttcttatttcatatcatggatgaaaaaaatcaagatgaattaaacatggaaattaaaaataactagaagaaaatactggaaaaaaattgtaataaatgtgtaagaaaggcattcccaaccaagacacaaaacccagtagccatgaaaaaaaagatagatttgactacatttttaaaaagtaaaacctttcactttttacaaaactttgataaaattagatttcataaataaaggagtgggaaaatacatgtaatagaacagaagatttaagataatataaagagcacctacaaacaacaaaaattggacaaaggctataaaaatattttataaataagaaatacagactataaacataaactttcaacctcgtaagcaatcaggaaaattaaagttaaaatgagatactatttttcaatacattgaaatggcagattattaaagattggtgatagtgctggagataatgtgaggaaaggagtattctcagtcattgtagaaattgatacagcttttggatggacagtttgacagtgtgtatcaacatgtgaaatgtctccagcctttgatctaatgactaattttaggcatccagcctgaagaaatattcacacaagtgcccaaagagtcagatacaagactgtgtgaagtgttttttgagataataaaaaactagaaacagcataaatgtacagaaatgcagaaattgttgaattagtacataccaatttctgacatataacactctgcagcagataaagacaatagctctctagtgtggacatgaaaatatttctaagacattgacaggacgaagaagttgcacagtaaccacgcactcctgtttacatttgtatagttaaaacttgtttacctatacgtagcatatatgcgtgtgtgcaccctagaaaagagtctgtgataacacatatcaagctattgacagcggttttgtctgctgaaggaggaaaaaaggggggcttctcacattttactccatttaattctaggttgtttggtttaaaaaaaaagtttttatgtacaacagacaatttttaaaattccttttcatcatagaaaatgaaaatgtgtactctgttatcctttacgctctgtccatttttttcttcaaaaatgtgtctgacctattatcaatgtgaatgaaaatgagctttgctacataacctcttttcagagctttgtattcctgaagtgttggagtcgcctacatggcatagtcaaatgtttttaacttaaccacaacccacagtaaaaatgaagctttctgcaaagttaaaagtagtagtcctggccccaccttccttgtgtgcac

SEQ ID NO: 47121 - DNA, 1088 bp, Homo sapiens
tccttacctagaagtttgagtaaaggtctcagtaccaaattccattggccagcctggggcaggtactcatccccttgagccagggttgaccacagttgaaccatgtcgactgagagtggcagaggggtaatttcctaaaggaacatcaggctgttgtcactaagaagaggaggaagagcttcaggtcaaacagtaaccctaggctttcaacacagtctccagtaaatagttgtccaaggattgcataaataaatgagtgaattagggaagacaaagtagtattgtaacattaccatatttcttgtagtaaatccacccaagttaaagcacttggtagagcatcacttgttctcaatctttgaccacatgagtttatgtattgactgttacctatgcttctgcccagagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaagtaagttctgggagctgagctgggtggtgacgtgctcaatggtgggttaccccgacccagggcaatctgtagttttcaattattttctccccttgacagtgttagttcattaccatttagattgggtggctgtactagctaagactagagcctatgcatactcttactttattttattttctattttttttctagacagagttttgctttgtcacccaggctggagtgcagtggtgcaatctcagctcactgcaacctccgcctcccaggttcaggcgattctcctgcctcagcctcccaagtagctgggattacaggtgctggccaccacgcctggctaatttttgtatttttagtagagacagagtttaaccatgttggccaggctgcttttgaactcctgacctcaggtgatccgcctgcctcggcctcccagagtgctgggattacaggcgtgagccactgtgcctggccta

SEQ ID NO: 47122 - DNA, 1083 bp, Homo sapiens
catggtaagtcctttggaagttgctgctcattatttttgccttacagccactataggaccaacttattatttctctgcagccttgcagagaaagaggtcactcacatttgccgtgcagctgccatgtgttggaagcttcatatatgtagtaccactaaaccgtcacaactagtctgaaatggagatattattattcccagtattcaggtgaggaaactgaggctgatggaaattaagtacaagtcatacaaggggatgataacccactgttccatatgcaagagtttgttttccctaagtaaacaataaatgtgctggggcagattttttgttttttgttttttaaaaaatcttctgcttgcatctaggaagtgttaagaaaaaaaaatctgttgatttgtttatgacaacccatacatttcagaaaagtagctggaataataaacatgtttttcagttgtccagtggagccccaaaatagaagcaagatgaatattccattccgcattggcaatgccaaaggagatgatgctttagaaaaaagatttcttgataaagctcttgaactcaatatgttgtccttgaaagggcataggtgagtacatctgcaatgcacgagcttggcaaagaattagcttagtttttcaaatgcagaataaaacaaatctataggagcctgcttagcttggagtagcagttatgtaatttgttgggccaacccagctgttataaggatgtgccttcttcctgttgtttatggaaccctttgcataattccccagctgagagtataatggagctccatcttccatgagggttttggcaaaattacctttgaaaatctcttacactgctcgtatagcacagaggttgccattccatctctgatgaggccagcaccactctgttctggaggtagagaatcattattattccaactgaacatcaaattagtagctagtcttgcatgctctatgaaaaataaatgtcctcacatgagaatagcagcagggaatgtcctcacatgagaatagcccagccccgatcttgctggcactgtcacgacaggctcatgaatgttga

SEQ ID NO: 47123 - DNA, 1080 bp, Homo sapiens
tccaacttaccttttcttccccacatcttgcttgctttctttgccaagagtgaatagttcgaatgactctaaatgtgagcatggtgaaccttcacagcttaagggagaattttctgatgactgagacgtgtgaagctctgtgccaggtgtcgggagtttttaggtaggagaccggaaatgatggtctcaggtgctgcaactctcaggagccagtggctagaaaaaggtgttttgatgcgaaattagacgtttttgttctcaatgcctggatctttggtcattctaggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccatt

SEQ ID NO: 47124 - DNA, 1026 bp, Homo sapiens
ttttggcagggttaccatggaagtgatactgtgtcctcctcagtgcatcctgggaggaggcacctgatgttggttcgtcttatcggtgatatagtcgctggtgtcttggttcatgtggtgtccacgaggtttctccactatcaagctattacttgtctctttgtagttaataagtgattataaggagatgttttaagactctaaatatcctgagagtcaccaaacaaattgcatagacgttccacaaaaaggataatacaagaggaattatttgatgggaaaggtgaagtgatttattactgcttttctaccagtatttcttgcaacctattcttcctcctcccaaaaaaaaacaccttaaagtataagcaaaagtgtgcaaaagatacactgggaagtcaaaaatcagtagtagtaggacatatattccagcaaccctgagagtaacaaatgcatttgagaatataaatagtctgggcaagtgtgctttttggtgaaccaggaaaggaggaaaagaattccctgatcaaaatatagggactcaacttgtagaattttcattccccgtctggtcaagtttgtttatctctcagtattttcagaagtgcagccctttggcaacaaatacctttaatcgaatagccagatcatgagccatacagcctgattatactttgaaagatatcatataacagcctaaagttaaagctgcctctgatggctctggctcagcagaatagtccccaatagaataataaaatcttggcttccatctagccgggtaaaaagcccaaggcatcttaaatgcctgagaaacgagacttgaagttgaaatctaagaatttacaggtcatttggggggagaaaaaaaaaagattatcttatccagcagagtgaacatcagatagagccgaatcattcctttctgctcccttccccaagtttaaaagcctagtttcttgaggttgaaagtccagggctgaagcagaaatatattcaggagttattgggaaacgacaggtgagc

SEQ ID NO: 47125 - DNA, 1023 bp, Homo sapiens
gtggctgtaagcccagggagatggactttgagcaagtggctgtcaactccatggataggtggaagtgatgaggacacccaagtgagccaaccctgagtcatttatactgatgggcatcatggaggatggaaaaattaacagccacacagagcctcagaggtgtagagacacatatgctgggatccacatgttacacacccaaccttgccctttgcggttctctgttttgattccagtcagctttctgtcctttcatttcttaggaaggtcagtaccagcccagggatagtcccctgattcttcctactgccaagccctagttaaacttcatatccacttccttgggttgccctgtcaatcagtttaacatggggagtgacttcctgccctaggctacctttctggcatccttctttattgatgatcttaatgctgtgttttcttccaaatatgtacaactcatataatgcatgtgtgatcaaaattatacaaagaactaaacatatacttcccattatattctagaggcaccagttggtgttaaattagcttgtttcttcactgctcttattctttggactcttttttcatccaagtctgtttttcttcagatgattgtctgaagaaaatttatatatatttatataatatacataattactataaatatataaaagtatatatttatataaatatagaaaaattttttgagtttggttagatcattatattttaccctcaatttcaatttaccattactctctaataatcattgaagtgctatttttgatatgttcatacagggattcacaataacaaaaatgcttttgaaaaatagtctgtttgcagaggagctcatacagcatattcacatacaagagtgaattctttttgtttgtttgtttgtttttgagacagagtctcactctgtcacccaggctggagtgcagtggcgcgatcttggctcactgcaacctccgcctcccgggtagctgggactacaggtgcccgccaccacgctgg

SEQ ID NO: 47126 - DNA, 1021 bp, Homo sapiens
aatggaagaccatatgtgcttctgcaagatcaaaacacaacgggcctggtttaagactctgtggtggctctgactccgaacttgtgtttattggtttgtgtttctgctttagcgctatcctccccaccatagtctctcccagtcccttacttttttctttcctttccttcaggagttcagggggccggataacttaaaaacttgtgtttggactttgcagagttcctatagtaggcagaggccatgacagagacacattacaggtgtctggaatatgaggcattattgatggtgcctccagaacagagcaattcctttctgcctgcagacttgccttttggaatgtactaattacaagaggttagagatttgggttaaagcaaggatgaaaagcgattttatttggttttctcccctctacccttttatttaaacaaacgaatataggcttttaaaaaagtgagagggcccagtattcactttccctatgtaaagtgagtgaatgaatcagactgctcagttttttttttattattattattgtgggtataagcataaatgaaaaccaaataagttactaataggactgaatgcacagcacatctttcttggagctcaagaaccttgtgaacataaatgcatttatctttgggatgactctttgagaatggtgtctggttaacataataccctctaatttgttatggcctatgcttagcttctttctcttgttcacaggagatcccagatagctctgaacaagctcatgatgaatgccagacctcctgtgagacaaagctttgtaatgggggataaataaaccacacacacttactattgacataaaatgtagttattttcctttgaataaaaaatacgctgtttgtcacaataaaggaagctctaatatagttatgttattttctgaatccttgtttagagcatctaccaggacccgtctgtatagaccatgtgatgtctcattatcagtctgtgtgacaaagctttcatcctgaggtcc

SEQ ID NO: 47127 - DNA, 1033 bp, Homo sapiens
gaactgattaacagcgtttttgcccacagctaacagaatcactatagcaaggggttaggggttgggggatgggggatgagctgatgcaatttggcttatattggggctgggggaaattcttcccaagcaatattccttgctaaacagtgggggagtgatgggaagaaagttatctacagtgtccactatttttaagttacctgttgccatatcattagattttcagcttcttttcagtgtttgaggaaccgaactgaacttcaactaaactgaatttcaaattttctcatgaaagtgcattaatgttggggtctcagaatttttgtctgacatgctcagcagtgagtgctgcttaatggacaaaagcttactaccaaagctaaatgttctagagaatcgatattactacaactgtggagcccttgtttccatacaagtctcttcataaagtaattcatgaattttaagctgctttttccagtccacattgttctagagaatgatagaacaggttagtaggtcactgccaaagttcaagtctgtaaccttttgtctccttctagaagcagtggaacttattcatttatgagttcttaaataattacgtcattaggggtgggtttgtcacaattaagattgatatttgcttgtgttgaggaaactggattttaatcccaaaatttctgtttttgtccttccattttcaatattccattatttcacataattatccaaacaatgtatttaaactgaaccctttctatgtgatcaatattatgctaggtatgctggggaataaaactgatgtaggagagatggctctaagaagtactctgaaccgggtgtggtagctgaagcctgtaatcccagcattttgggaggctgaggcagctggatcacctgaggtcaggagtttgagaccagcctggtcaacatggggaaaccctgtctctactaaaaatacaaaaattaggcatggtggcacgtgcctgtcatcccagctacttgggaggctaaggcaggagaattgctt

SEQ ID NO: 47128 - DNA, 1011 bp, Homo sapiens
cagacactttgcccaatcaaaaatactagtcagctattgccacaataatgctgagttataaaatatccccaaatttgtcccttatagaaaaagcatatattctcaagctcataagtctgggttgactgtgctttggctgttgtaggctgagaagctgtgccttagtcttcaggggcttctgggaatagctacagactgcaggttgggttcaagtcagcttcaggtgtgtttgttctggtgcatgggctcttgggcagcaattactgtagacatctcttttgatggggaatcaatagagagcaagagcaagtcatattaagtcctgtgaccccctaacccccatttcctaacatcccattggccaaaacaagttacatggccaaaccaaacacaagttaggtagagaagtaaactccactcacagtgggaagaggagggcggtgaatgtttattgaacaataattcatctgttactctctcttctccagcatgacctgtaggcaacctagtggtaattgctaggcacagcactccattaatagcattcattaattatgacagggactcaaaagaaatagaagcacaggcacagaacctcagtgttagctggtgttcattacctaactcacggaaggacaggaaatgttcagaagtggaaatcctcagggtctgcttgattcctgttctagttccccactgatctggctgcagtcccaagactctgtctctatctccatatcttctctggccttcttttctcttgggctccattcctctgtcactttccaccttccttttgggtccttgtgtgcccttgactctagagtgatgaccaaaggagtgatcctgggaggaaaaggtgccagggagatatgtgtaatacttgtagttaatgatagctaacattctcagtgctttttaaatgccaagaacagtgctaatggttttatctgtattacctgtcattctcacaatgacctagtgaggtggctgctattacaactcccattt

SEQ ID NO: 47129 - DNA, 1150 bp, Homo sapiens
catatgtctctccccatggtggcatgaaatgtaaggtggatttcacaggactcaagttgagtcagggaatctttaagggggagaaaaatgtcctgggcctctgaaggtaagaatatagtataataagcgtctcagactgaatgcatgcgtgaatcacttggggattttgttagagtaaaaattctgattctgcacatctggggtggggcctgagattccgcatttctgacaaacccccaggtgaggctggcactgctggtctgtgaaccacactttgagtggaaaggattattggtccagacagcaaatcctagacattctgaatgtttaaggtaggtaaacagtagtgatgtttttataattttgttgattctttacactttttttaaaaatcaggatgagaaaatttcttgccaacttgcctcagacaactttttgctgcataaacttcattaaaattttttgtttcccaaattctctgatgacactgaatctagatttaaagtggctgagacagttggccttgggataactttttccaaaacttttatgattggaaacaaccttaaaaagtgtagtcaggactctcaattgtaggaaaggatgttaagcactcagcctactcctggtattaggttagcacacccttcccagcttgaatctttgcctcttcgtttgaagcctcttcctttctcctttcaactcttcagccaacttttaactgtcagaagttcaggacaaaatttgtttttttgttttttttttttctccaagtgatggtccattttatcttcatcagcattgtccatttttcagaataaaccctgttcattttccccaaatttgtttcctcttcctctagtgttaagtatatccctttaaatagctaagtgcttttttctgtaaggcatttgggtcaattattgagggtaaatgagaagaaacaaagaaaagttgagagggaaaaaagtcaatattggattatcctggcggtaacaagatataaaattgctggagagtgaactgtgcatggtgtatgtatatagatgtaggtaaatgacaaagaaattatacagagacatgagcaccacccactgcactgaatcattcctcataccagtgcacagtgcaggaaggtgacaagcctctt

SEQ ID NO: 47130 - DNA, 1019 bp, Homo sapiens
caggtcctccatgccatccctgggtccttcagaggtacctcacagggacccctgtggtatacaaaatcctcatgctgttctgctgttctcttaaatccctcctcaagtcttgcctgtggtgggctaccccacagcctcttagtgctgaggtcttcttgccctggcaggaagctcttttgaattccacaaggacaaataggaccaagtccccttcttagtctgtactgggcccatgggagcccacatatacttgccatgccacatgctaggaggacaagctggaaccctactgtattcagaagtgtatgaatttctgggcttgaggcagcaacaacactgaggtttggtaagcccacatactccaaggaagaaatatctagcttttcctaacattctcgaaatgcatcctattcatgtttgtgactgcaccagggcagactgatgagtttgtttgacttgacctccagccaaggactagaacctcagtcccctcatcctgtagaaatcccatttgggtggatgactcttgcacctgttctccttctcaacaagcctcagactctgcttacacaggttgaatgggatggtgggatccaagcacaggtgtggccacctcttagcaaaacctgcaggaataggtctagcagctcctcttgagaacaaggtggggtacccacagcctattgtacttagctttaccagccttctgagacaataaagaaaacacaaaataatctttctacatagaaaagctgagtaacttttctgattctcaggtctttcctttgcaaaatgagagtaaataaaattctgtgcttgcttcggcagcacatatactaaaattggaatgagagtaaatgaaattctcttgttagtgttgttgcaaagacaagatgatgtatatgaaggtacctgacatatttaatctctctttcaactgttcctccattattcttcttcattcttctttgtttacttttcccactgcttctcctgggtccctaggttgatacgctagg

SEQ ID NO: 47131 - DNA, 1078 bp, Homo sapiens
atggtggccaaatcatgtctacaatgagaaattttaaaatattgaatagatttttgaaaattgaactggcagtcagctggctgtcttactgtcttataaaaataacacccctggatgtcggctgcagtggctcatgcctgtaattccagtatcttggaaggccgaggtaggaagatatctggaagccagttgtttgagaccagcctgggcaatatagcgagaccttgtctctacaaaacatttaaagattatccaggcacagcagtgcgcctgagctgagcctagctacccaggaggctgaggtggaaggatcacttgagccaggagttcaagggtacgtgtgagccgtgatcacaccgctgcactccagtctgtgtgacagagcaagagcctgaattaaaaaaaaaaaaaaagcctattggatatatagctgctgtgtctgggttctgtctctctgtttatgaaggtccattaacttatttcatagtcaaaatccacatgattctctgggacacagggaagaaagatactaaggaggggtagtttcttcttttcctatggttttgtagaatatagagaaagtggattttacttagtaaatgactgaatggtttcatatatcatctcatagaaaaacattaatttttaaattctgctgaagtggcttagattataaacactgctcttgttacttcatatcttgcaagtctcctttagtgctctgttattaaaatattgtgaaagagaaagagcgctgattaaacgtgcctacatggatacatttacattaatgcatgatgattaattataagttaatatgctcattcacaaaaatattttaaggtggcataatgataaggctgcattgataaccttgcacagccccttattaactttatcaaaagccagatatgaggtgacgttaacacattttggagtggcatgccagcaagccaactggctttccgtgagtgtcatactcactttggaccacaagatgccgctcaataatccgttatgatttaggtcttttgttacaagccaaatgacatttccatttattttacatgctctccaa

SEQ ID NO: 47132 - DNA, 1170 bp, Homo sapiens
gacaaagacaccctcccctatgtagacataacatgttgagtgtcataaggaagcatatgtatttgctataaatgtttacaaattcaaaagagaaggggcattgacttgggattataagaaatgaagtgtggaaagatatcatgaaactgtatccacaagcagcatttgtattgcaccttgaaataagggtatgtcggctgggtgcggtggctcatgcctgtaatcccagcactttggggggccgaggcaggcagatcatctgaggtcaggagttcgaaaccagcctggccaacatggtaaaaccccgtctctactaaaaatacataaagtagctggacatggtggtgggcgcctgtaatcccagctactcgggaggctgaggcaggggaattgcttgaacctgggaggtggaggttgcagtgagcagagattgcaccattgtactccagcctggatgaccaagtgagactccatctcaaaaaacaaaataacaaaaaacaaaacaaaacaaacagaaaaagaaataagggtatgtcttcaaagaaggtgggaggagggcattccaaggagaggaaaagatccaagtattcacaattccttccaagcctaagtgtgtgagaatttagaatgtttcactgtggaatatgtgatgatgatgaactggctgaccctctctttaatcttggtatttgcttgctataaatagaaacaaatgggattattgatattcctttttattaaaagttaaagaacagtgggtgggggatagataagtaaattatcatgcaaagaattttgattctagctccagtaagttcttgtcttgcaccatttctttgtcagatgggttgagtgtagggtcctgcttttaccatgcttcgctttccattattcccaatttaaatagatctttcttcctgctgttgagtggggtttgttcaatcttgttgttccatggttgtcctcctctagtacaggacttcttactgtggttaaatttcattgtgttggctttgtctgaacattccatcttaccaagatctctttggatcttgaatctttgatacagcataatactcattcctctcaatgttttgatagtgaaaattttgtaggtgtgttttacatttttatctaaatcattggcaccaagtttcaaaaaagaaccaa

SEQ ID NO: 47133 - DNA, 1034 bp, Homo sapiens
tgtttctttttctgtgagaactattgttacattttggtcatttttttacttgattttttttttgtctatcttattgatgttaagaactctttatattaagcctacttatacatctctgtctctatatctatgtatccatctaaatagctagttgtaaatatagatgccccttttctgtgatgagttgcaaatatctttttccaatttgtgatttatcttttaagattttaaaaatgactttttttgtaccatgtagcatattcagttttgttttcaaatttatcagttattatcttttatggcttctaggttttctattatacttaaaaatctttcttccaattcagagatttaaagatatttagtatgttttatttaatttttaaggtttacaatgttgataattctgaaatctattttggagtaaggtatgaggaataaatctaatttactttttttccagatggctacctaatgtcacaaaccattgattaataatctttactggcttagaattctatctttattatcacataaaatatttacaatgaggaaaaatgaggcaaaaattttgaaaaaatttaatgtaatcacttttaatctctggaagaataagtgaatagctatttctaaaatatttttaaaaacagacagcatttacagataaagataactaattaaaaaaacttaaagagagtgcaaaagttagagtataatcacagagcatcatatctgtatttttcctggtctgctgactcagtctgggctagttgcacaagaatcacatggagaacataaagaaaaggataaggaactctagtttctatggtaggttctaggcatttacattttaaaaaatgctctagataattttgagagtaaagccagattaggaaaccatgggttcacattgtcacagaatagtgttcattctatttttattctgcctattgtgtataaaatcaggatattccttaggaaaaaggtatcagatttatataatttacaactcaagtatgtgtatatgttcattg

SEQ ID NO: 47134 - DNA, 1069 bp, Homo sapiens
tttgctacatggtttagttatgaatagtgtttgtgtacatataaacacagaatatttaagtaatctaaacatatagctctattaggatgatagagggacaggagagaatgagtgtgatgggagctaggagccagagctggtcatacagaggaaagttaatagaagattaaaagtgaaaaatcaagaagcagcaatgcaaggatgttatttaaaaataggtactgaaataatcagttaaaatatataaaaattattgcctttgtggatgaggaaatgatgaggagcctgctgtgtttcataacaaatagtcatttgattctttaaaacatgttaatctataacttcaataaaagtctgtcttaaaatgaaaatcagtgtaatttacctcattaacatcttaaaaattgtatctaccaagaaatgcaagacacatgtttagttacatacaacatttagtaacatctcttagcaaactttcttaatctgataaatggtaatttaaaaggctgtagaaaatattatgtttaatcatgacacaacaaaagcaacatattcaaagccaggacaagtcaaggattccaactgtcaacaactcccctcagtgtagcacaggagatcttagcatgataagacaaagcatgagaatagaaaaggaaaaaaacatatatcattatttgcaggtaataatattgtttatcaagaaaaactcatgtgaatcaaactattcaaactattcagggagttccacaaggctgctagatacaatattcatttaaagacatgaatagaactcctatacaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaatcaccttgggcagtatggccattttcatgatattgattcttcctacccattagcatggaatgttcttccatttgtttgtatcctcttttatttcgtagagcaatggtttatagtt

SEQ ID NO: 47135 - DNA, 1031 bp, Homo sapiens
aacactagaaacatgcaaatatatttctagagacacagtcagagaatcctagatttaggaaaggtagatattagaaattagaaccaaatcatgagcaaggtgaagctcttaaaattgcatttaaatgttaattgcatttaaaatgttaaaatcttaacattgcatgggggaatttcacaactaataatgtttgttgtggtcaattcaactatgagtaaaagtaaaataacattttgatataaattatgtattttaggaaagcagaattctaagataacttgttacagactaacactaagtggccgtgaaacattttgatttctagtatttgattaactttgtctccccaaataagctaaagctggtgccccagccattactgagctgctacttctttgagttcatctgaggagtaaatgaggcaacagaaggctttcctcccacttctgagacagccgtcctggaggatggtgggttctggcctactgtattgcacaggattggggcaggaaagggaacactgaaagagttgcgagacctggtcttgggcagggctgtattcagatttcttatccatcatgtttagagaatgggttgatgtccacagtgatttctctaactagtttcaaactgaactatcaactctttaaaggaagaacatgctcatcctcatattgtaaaaaaaatatttggatctggaaccagagctggggaaacaggatgacaaggatcaatgctacatcgttcactgtcctagtgtagtcatcaatatattggtccctcatctcttttgataagaacctgatattaagtgggctcaagttggttgattcatatgggttaaatggactgttttaaattacgcataaactatacaagccataaaattgcaagagtgagggaaagggtgacttggtgatggaaagaatgctggccaagaagagtagcaggaatctgtgagagtaatttcaagagataaaagcctggaattagttgagactggcagaaagacaggttcataacagaaaatg

SEQ ID NO: 47136 - DNA, 1044 bp, Homo sapiens
tgagagagatatataaacaggaagttcaaaaatccccaaataaatttaacccaaaatggttctctgaggcacattatagttaaaagtcaaagacaaaaacagaattctaaaaacagcaaaagaaaagcatcaagtcacatgtaaggaagtctgcattagactcacagcacatttcttggcacagaaaccttataagccaggaaagaataaagtgatatattcaaagtgctgaaagagaaaacagctttcagaaaaggacactatatctagcaaagttatccatcataaatgaagaacaaataaagtattttgcagacaaacaaaaactgagggaattcatgactagaaatactaaagtgagtcctataactggaagtgaaaagatatctaccatggagaaaacacatgatatattaaactcactgatagagcagatatacaaataagaaagagaaatcaaacattatcactacaatcaccaaactgcaaaaataaagagaaaggatatgcaaaacagaacaattaacaaaataacaggagtaagatcaccagtaacaaccttgaatgtaaaaggtttaaattccccaattaaagacatagatgggttgaatgaattaccaaaaaaagcctagctatatgctacctacaaaaaactcagttcacctgtgaaaggcacatacagactggaaatgaagggattaaggaaaagatattccacaaaaatggaaaccaaaagtgttcaggggtagctatacttaaatcagacaacaaatctaaaaacatagactttgaatctaaaacataaaaggatataagaaaggtcattatgtaatgataaaggggttatgttagcctgttcttacattgctatgaagaaatacctgagactgggcaatttataaagagaagaggtttgactcacagttctgcatttctgtggaggcctcaggaaacttacaatcatggtggaagccaaaggagaagcaggcaccttctttacagggtggcaggatggaatgaatgcaagcaggggaaatgccaaat

SEQ ID NO: 47137 - DNA, 1051 bp, Homo sapiens
ttccagatatcctagggatataaccagcttaaaatatcctttaaaatttgcagtattatttatatgaagtgaaatgcgtagatcttattgtgcagttcaataagttttgacaaatgtatacatttatgaaactcttacccttgtcaaaataaatatctcggctgggtgcagtggctcacacctgtaatcccagcactttgggaggctgaagtggggcggatcacgaggtcaggagatcgagaccatcctggctaacatggtgaaaccccgtctctactaaaaatacaaaaaattagccgggcgtggtggcgggcacctgtggtccctgaggcaggagagtggcgtgaacccaggaaggcggagcttgcagtgagccgagatcacgccgttgcactccagcctgggcaacagagcaacactccgtctcaaaaaaaaaaataaataaataaaataaataaataaataaataaatatctccatcatcctagaaagtttattcatgcccctatgaaacaggtcgtctcatcactgttcagcttgctatctcacctacggtagtttttcctgttctagaatttcctaagtggaatcgtatattatgtactattttatgtctggcttatttcactcagcatgtttttcagatttacccatgttgatagatgtattgatggttaagttttgttttttattgctgaggggtccactgtatgggtatgccacaatttgtcctttcacctgttcgtagatgttatggttattatcagtttttggttgttatgattaaactggttattatgaacattggtatacacatttttgggtggatatgttgtatttatttttgggaaaatacctaaaagtggaattgttgggccatttggtaaatgtatgtttaactcctcaaagtaaactttcagttttctacaggactgtacaattttaaattcccaccaccaaagtatgagtgtttcagttattctgtatccttactaacgcttgatattttaaattttagccatcctaattattatttattgtagttttacat

SEQ ID NO: 47138 - DNA, 1024 bp, Homo sapiens
agttgagctgaagtctcagatatttttattttaaccttagattaaactctaactgggctttggaatgccagccctgtggaatgagtgggtctctaaaataccttagattttgagcccttctttcattgcttactttctcgcaaaatgcaaagtggaacatgagtaatgcgtatggataaattgtcaggtgttgtgatttgcactcagcttctagactcaaatccatcttgccagctcacgctgtcatctaaggctctgcttgtttcttactgctgcaaagtcttccattctttgtgaggtatgttcctccatctaatgatatctacatacttttcctccccacccccaaggtataggagttgccacagctgtccctaaacctatgaagagctcatttctctcttgaatttagtttaggaaggcttcttggtattcacttttctttatcattcctatagagaaatggtctttcattttctgggctttctttggtgtcctaaatcttaactggacttagaacaactttgaataagatatatacttcagaagagaagtcagaagctcatagtgtttatccgggggaatgccatatcaggtgtaccaattattagggggactagccagttgctgaaacccccaatcatgattggtattaccataaagacgattataacgaatgcatgggaggtaacaataacattgtagatctggtcatctcctagcagagttcctggttggcctaattctgctcgaattagaaggcttaaggccgtgcctactatccccgttcatgtggcaaatagcaggtgtagtgttccagtatctttgtggttagttgaaaacaatcaacgattgatgaacataagtgggaaaaaaatgtaaaatggctgagtaaacattagactgtaaatttaaagacagaggtcaaggcctttttatcagccctgaggtgatttctcatgttgagttataaattcaaaggagcagcttcagtcctgccggagcttctctggcctttctcccc

SEQ ID NO: 47139 - DNA, 1060 bp, Homo sapiens
agatagtctgagaagcactgatcaagacagttttttaaagaaatggcatttaaagtacgatgtgcatcatgttagaaaatatcaagctgtttttcctgttcacaaaataaatccaagcataattacctcaaacacatttgtaaaatggctttcaaaaacagacatttgaagaaactcattgggtcaaagtttagagaatctgaaaaaaagtcttttatcgtgaactgtagctgtaactaagactacagtgtatgtggaaaggtagatcgtactgttctgattcttcaggccctccctgtattcaaaggatgcacccatgccctttgccatgtgagtttgcacttgctaccactaaatgtcaagtgttaccctacctcgttgatgtcgggcttcaccaaatgacttgcactggccagtagaatatgggcagacatgccagtgttccggtctctgtgacaaagcctcagaggcattgtgtatttcttgtgtctgtcttcagtttgtgtgaccactgtagaaggacatgcttcagctgtctgctgccccttgagggtaggtcccagaatatgacacgtggagcagaactaaacctgatccaaggcttagagccaagtccaccacactgcagcctgaagtactcatcaaagccaacccacagaccaataagccagaaaaagatctgcctgttgttgtaggccacctagttatggggtggttcgttatggagcattatcacagcagtaggtgaacagcacagttgggttataatacatgctatagttacggatggtatttgatttactattccagcctggacacctcttctaagtggcattctcatgtatgcaactgcctatttgacatgccaactttggtctccaataggcaactcaaatgtaacacattcaaacatgcactcttgattcccctccccacaaccccaaactacttcactgcttggtaaatggcaaatctcttctatcacttgctcagaccaagatccttggaatcatcattgatttctcactttttttttcacatttcacatctagtgggatgg

SEQ ID NO: 47140 - DNA, 1038 bp, Homo sapiens
cctgagacacagctatggcttctctttgtaagtgcctattaaatgtttcttcctaagaagctggatttgtcagtttctttcttcggcctctcagcttcctcagcctttgggagtagatttgcatagagctgcccattgcggaacactaagccaggaaataaagagaactagaaaccaaacaaatagtaaaggcaaaataagatggcaggtggacttctgggcaattattgaagtagcgattacacacctgatttcaacagaggaaaaaagagtaaaataaaattagactttatagttacactcatgacaactccaggcacagctcagctcatccttagtgtagctttgcaacaggcccaccccaactccaaagaacctagagcaagagtataaatggagatctaaatactcaaaagtcctacatcaaactcacaagttgataaaatattcttctatccttctgtctttcttgtttcttgacacaaatacttttataatatcctagaagaccagcttcaaaagtagaattcttggacttctgtgccagaatatggctatgtaaggagaacagcccccataccttgctaactcctgttcacttcccactctgctttgtcctgctctgcaaggggctttgcgtacacatgtgtggatactccagcctgcatgttcaagctctctctacatccccagaaaacaactatttcctctttatatcttgggcctaaggtgtgcctattggcatggtctgtacttagaaagatcgttgagggaaggtttggagcagttggaaggtgtttgggcaggagactccctctgttagatcaaaaggggctcagttagtttctgctagtgtggagataaatcatattatggctaggggccatgatggtaggagcagtcatagtaattcttgctccagtaagagtaagtaatcccagggctccggatgctgagttcatggtcttgaatgggggcagggcagaggctctgggtgggcatgagccctttgccttgcagacttctcccttgtgtagg

SEQ ID NO: 47141 - DNA, 1046 bp, Homo sapiens
gtttggcacattttttactttgtcacttaccatcgagattttgtacatagaaaaaaaaattgataaatgcccttgaaaacatgagaatgtgtagattttctgtcttgacaaattcttccccccttcccacttagtctcacaaatcaggcagtctctgtattctataaaatgtaaagtttagttggatgacttttcataaacttcatttttaacacatttcttctcttgtatttctataatatatgcaaaatgccaagctcctcaaaagaactttacaggtcattttcctgccataatagtcgaatcagcagcaaatgcacttcatggtttaaatgcagtgacagaagtagtctgacagcagaaatacgtactggatagtaacttccacaaaagccttgagattttcacatgagtagagattatagctttggaaatcgctttttcttttctttctttctttttttttttaaagatcggtcctgtgtaaatatggacaaagaacgtttattggctctgtactaccaagtgtccttgacctagtgacattattgatttcccaccattgtctttatatgtattggtccaagaggacagaaccataatagttgcctacttcaacaattaattttgatctctatgtaatgagcctcatagaagcccttgaaagaataacttttaggtcagtgtgtgagcatgcacgcgtgcgcgcgcgcgcgcgcacacacacacacacacacgtgcacacacacgggaacatgatgcctcttattttttcaaaccagaaattaggtcacctggtctgctaaaagatttttgcactgatctgtgaatctcttggatatgaaaagagtggcacaataaaacaaaattatttggggttattaatgtaatgttacctttattgtaaagaataaaattaaatgaaattgcagtggttgtacaaaattggagatgcttatttactcattggtggtgaaataaaactaccccctctgtctaaatataaaaagtgctttggtcactggagctcatgctgtgttctcagt

SEQ ID NO: 47142 - DNA, 1018 bp, Homo sapiens
gctttcttttcctctcttggcttgcagaaaaacaaatgctaacagaaaacaaagaatgcttcctttattgcttgggtgatgaaagccaacatcaaagttgatgaagaaacagattggacttgtttaggtgtattctgaatttcttgctaaatcattatctaacataacccccccattgaaacttctagtaatccttgctttcaatcttctgtgaacagtaagacttcctgcatgctctagcagttctggattgggcatgtggagtaggaggttctgggctgacaagaactaaattccaggatcactagtaggtttttgtttcccttttgtaacacagagccccgtggtgtccttggttcctcagattattcaccttatctgtgatatcttgactttctaccttgcctaagtgccttgaccttaaaagtagtctatggaccttatcaaactttcttctctaacctaactattgggctatttcctttgtttcacttccaggacaaaaggggaacataccccagaccctcagacaggctggggataatgttacaaatgtgcaaaaactaggaagtactcatgctagcttctccccatttccagctttggggcaataagtaggaatagcaactaaaatgaatgcacaaaccatccagtgcaattgtgttaacaccaacaaaagtctagctgaattaaataagtactcctagagtaaaagcaactttccttcctctggaagccctcctagattattacaaagagaattttgaaggagatggacttggcaatgctgttcatctcatacgtttgttggcaaaataaatccacaacacaccacattgttgttaaatagaatgaatattacaaagccaatttaaatctggaataaaactatttaaaaggatgatcatttaatagctcttgaaagcaagtaactactttctctgtggcatagtagaagaactcatttgagggaagtgaagactgtgttagaatatctgggccttcctcagaatttctg

SEQ ID NO: 47143 - DNA, 1037 bp, Homo sapiens
agtcccagctgctttatctctttcctgtgcaagctgattccaggttggccagtgattttcttctctgcctgtctccattctggagttcccatatcaccctctggtcctgcttgccctagagcccttttctctgattcctctgggtaaaaagattagttttttgtaaccagagttttagccaccactgcaactattgctgaccacatggcaaagttgtaaaaatataaaaaaatgcattctatgcagggccctttctctaagtttccaactccccttcaaaatattgttgcttttagtcccagcaccctctaggtcactccagatcctcccaatccttctattagttattttttggatttttccagggttgataactgttatttgtaggaggattgctatgttaggagctcatgctttgtaccagaaatgtgtacattttctttagagaaagaaaaaatcttacagaagtattaaaacaaatcatagctagttagctctgtattattttatatacacttgagtttgtcaagcacaattcaggaagtgtgttctccttacatataaatgaccacaagttgtagattgtccattgctctggaaattcaataatttctacgtctggatggttcagacctctagatagcagtgtgcttgcttgaagctactactgtgactgttcaaagtggaaggttctttggtaattttgcaaatggatgaaaatactagtgggctttctttgaactcaccctggtattaattgcccttatttctgaaagcagcaggggagagggaagttggcaaggaagagaagaagcagccaacattgacttctctttctctgtgctctagtgaataaaggatgaaacattcacagagagatgaaaatcttttggtttgccctgaatcaagccagcatgcttgatgactcagggaaggcattgatgggtacgatgttagaagaagaaagaaacagcaagcataggttatgaacatattgttctgcctgtaaaatagccacttgtctacttgccctgtac

SEQ ID NO: 47144 - DNA, 1034 bp, Homo sapiens
aaatgccttctcttatataggggttgactttgatgtctaatgctgtcaatatcctgtcagtccctgaaggtgaattttctactcaattcctttcaaaatcatttcccttctgggcagaaattatcataaatgtagcaatttattcttgctatgccctgagaattaactcagggtaagttgaacttgcagcgccagagtcaggctctgacagaacacatctgtttggtgccagcagctgtagctttggtcatagaactcattttcaaagtgtgaacaggaaagaattgggtcgggtttttttttgtttgtttgtttatctgtttggctttaatgatgtccacaaaaagaaaagatggaagaaaatatgctactggtattgcctctgttacttctataattctgaagcaccttattacagtaaattaagtaaaattcagaaggaaaagcaaaatataaatctgttttttaaaataactgctgcaggttaaacacaacacaactctctttgtagaactgagatgaaaagtcactacctagaaccataactaactacagtgtcttttgcatcattcatctctagagagatggcctttaaaaatatatataattgcttgttaactcactttaagagcaatctgaaatggagggagaggaggaggaaacttctgaagcataaagaagcaactccctgggttgatttcctcctaatggccatggctttctttcagagatactttttctgtacatcatgcttgcacattttgattttacaagtgacacaagcttttcatacctccaataggagcatgtctgaaaaagtacaaagtccactcttcctagatgctcctttatctatcccaacaacacctgaagcttctaatacaatgatgagaaagcttgcattttatttctgtcttaagagagtttaaaatgaatccagattatacttttcactgttttcatttccttcctagagatttgaaaattctgagatagaaatttcagaattgtttaaaattaaaggtaagaaaaat

SEQ ID NO: 47145 - DNA, 1050 bp, Homo sapiens
caaaaagatttggtatatattgttttcaacctgattatgataactttactttggcactttctctcagcttttttattatctagtttcaagccctcaaagttccacttgttaaatacatttttagtattatttacaaagttactataaattccatgcgattgaaatcactacagttgaaactttcattattatcatagcaggtaatatctgctcatctctgtcatgctgaaaatatctccctttcctaatagccagaaaatatctttctcttgctctctttgccttttaagtgaacagatttgatgtcactatgttattatcactttccttctggcatcattatctcaggttttcccttagtttatgaactgattttattttgtgaagtgcaagctgcacaaattaaatatattaacattatttaaagtcatattgtatttctaggtggatcttttactgatagaaataggtgaaaaatcttgataatcaggtatgtttggactgacggaaagagaactcgaagcgatagagaacaggtgaagttgtaagggtttactgctaggctttcattcaatagttaaggttttacttctagtactatttgaaaggtaggcatttcagtctaggatttcatgatcctacagtttatgagcgagaaagtattccaatggtctatgtctgcttctgtctttagttgtccagcgtatttagatgatatcgcctgaatccacacaggaagacatatatctagggattaccaactcacaattgggtccatagattatgaggacaataaaaaagacaatggctgcacatgaatggatccatgtggaataaaatatgctataccatcacattacagatagttctgtataaatatcatgtgcaaatattttactaaatttactactatagatgaaacatacaagaaaaatagcagtgatctgagtcattactatgggataaaatgatatgcactaattttcatcttgagctaaaattcaagacactataatagcttttaatattctttcctaaatatatgggtat

SEQ ID NO: 47146 - DNA, 1049 bp, Homo sapiens
taagttatgcttaaattgacatataattaggaaataactattaactagaaaaaaaatcagagagaagagcattccaggcagaagtaacagcataggaaaatgcactgttgcagccaaggcacggaaaatatagtggactgaaagaaaaccagtgggaatggagtggaaaaaaacaagagaacaagtgctatgagttgacagaataggtacaggtgaggccatataggagacaaaggctattggaaggggctttgtctttactttatagaaagggatactgtattagtttcctattgctgctataaaaaattagcacaaacttagtggcttaaaacaacacgaatatattctctgattatagttctggaagtcagaagtctaagatcagtttcactgggttaatatcaaagtgttggcaaagctggttcttctcaaggcactgaggagaggacctgtttccttactttttcggcttctagtggccacctgtatcttttgacttgcgcctcattctctgtcttcaaagtgcgtcatcccaatctctgattctgtcatcacagcaccttctgctttgaccctgaactcgcctgtctcttttttataaggaccattgtgagtctatcaggcccatccagatgatacgtgataatctacccatccaaagttcctaattaatcacaattgcaaagtctcttttgccatataaggtagcattttgtttctgaagattaggacatggacataatgggggggctggtattcagcctaccgcagaagccattgaatttgttcaagcagggaaaagggcacgttcagatttgtgtttttaaaagattctccagttttcttgtaaaggatgaatagaaagagggccaagtatgtttgtgaaccagtttgggaggccaatgctgggttctggcaagggaagcagaaaaataacttcgtaacaaagaagggaaaataacattttggctaaaagaatgcaagactgttagaggtaaaaagaagtttagagaacactatcagtgctgtactgggtctggtttggt

SEQ ID NO: 47147 - DNA, 1041 bp, Homo sapiens
ctgcaacctctgcctcccgggttcaagcgattctcctgcctcagcctcctgagtagctgggattataggtgcacgccaccatgcccggctaattttttgtatttttagaagagacagcgtttcactgcgttagccaggatggcctcgatcttctgaccttgtgatccacccacctcggcctcccaaaatgctgggattacaggcgtgagcctccgcgcccagggcatatttttattgttttaatctttttaaatgtattgacacattttgtggcttaatatatattctaccctgagaatgctccatgtgcacttgagaagaatgtttatttgctgttgatgaataaagtgttttataattgtctgttaggtctacttggcttatagtgttgtgcaagtctcctattgcatcattgatcttctatctagtcgtcgtttctattattgaaagtggaatattgcagtccccacatattactgttgaattttatcctttcagttctgttagtgtttctccttgtattttgaggctctgttgttagatgtgtgtatgtttacaattgttatattatatattaacccctttaacattatataaagtcctttgtctcttgtaacagttttttacttaaagtctattctgtctggtgttagtatagccactccagctcacttttggttattgtttgtacagaatatatttttccatcttttcacttgaagcctatttgtgcctttgaatctattgttaagtctctcatagaaagcatacacttggttcatgtttgtttttttaaaaaattaattgttccaacctttgctttttgatggaaactcttaatccatttacatgtaattttttttaacttttattttaaggggtacatgagcagattcgttacataggtgaacttgtgtcatggagatttgttgaatagattattttgtcaccaggtattaagcctagtacccacttagttacttttcctgatcctctccctcctaacgccctccaccctctgagagtgtgtgctgttcccct

SEQ ID NO: 47148 - DNA, 1034 bp, Homo sapiens
tttttcatagagcgaagttttaaattttaataaattctaacttatcagttacgtctcatgtattgtgcctttagtgttgtatgtatctgaaatgtcatcactaatcccaacatcatctagattttctctgatgctatcttctaggagttttatagctttcattttacatttaggtctacgatccatttttgagctaattttcgtgacaggtgggggtaaaatctctgtacagatgcacttttgacatgtggatgtccaaatgttctaggattatttcttgaaaaaactattttttctctattgtattactttttcttctttgccaaagatcagatgactaaatttttgtgtatctatttatgggctcccagttctgttttattgatctatttttccattcttttaccagtcacattgtcttgattaccatttatagtaaatcttaaagtcaagtggagtttgtttttcaactttgtcaggtacaccccttcctctgatctggttgttctctctacctatatcactcttcctacagatgtccacttgcctgattctcttctttattttcttcttccttcttcgagccccaccactagccccagatggtcccgctgatgataaaactgaaagtaatacatcacattttctttgacctctccaaccatgtgttgtgaaaacgtagtttcctttgcatgtggtctcccatttttgagatctgtctaggtcacgtgatccatccgttgcttcagtaatcagttaagaggatgttaccgtttaaatgtaatcagtgtagcaaggggtagctgtaggaagtttgcacagaaaaagagggctgacttattacccaggatatgtgtctcatccctgtacaatgactggaattactttgctctgacagacaaagacaaggttattcctacctcagtatgactattgactatgaacctttcacagacaatttaatcagcacctcaacctagaaaaagtcccagccattcatggacctgacctaatacactgcacagagaaaagaa

SEQ ID NO: 47149 - DNA, 1035 bp, Homo sapiens
taaaaccattataaaatactaagaaatgtcacatcataccaagagtaagaaagatctaattcacaaaaatgatcccattctgccacccttgaaaagactatctggttatctaaacaagttgactctagaaagaccataggcatattttccctgaattgtataagaaggttttcaatagtgtactatacaaggggtaacctatcaagtgattattaaacttggaaagcgaacacagaccttggcccattaagtacagccccatgggctgcatcagacagaaggagccagccaaatgccactgagcaatccatttgaggaacaatttgattctctcatggattaatgaggtagggaaaaaaaagaaaagaaagaaaaagaacaggcagtaaagtcatcccatttgcagatgatgaaatatggggagagcatgttaaggagagaaggccacatcatttatctcagtggggagagctccatcgtggctgcatttttcagtcatgtggtactgtgcattggggctttccaattcctcctgacaaatttgctttttctttaataatacattgggtttgtggaatgcttttcttcctaacagcataaagtacttttgatggattttatttcatttatcctcatcaaaatctgtgagttttcaaaggccaggtaaacttatctttttttttttttttttttttttttttttttgagacagagccttgctctgtcgcccaggctggagtagtgcagtggtgtaatctcggctcactgcaagctccgcctcccaggttcatgccattctcttgcctcagcctcctgagtagctaggactacaggctcccgccaccacacccagctaattttctgtatttttagtagagacagggtttcaccgtgtgagccaggatggtctcaatctcctgaccttgtgatccacctgcctcagcctcccagagtgctgggattacaggcgtgagccacagcacccggccaaaacttatctattttacaggcaaagaagagagttgtatgaaggtc

SEQ ID NO: 47150 - DNA, 1047 bp, Homo sapiens
agcctgggaaggaggcgtggctggaactgaaagccaaggtctaacatgactgtagtctttattggtctttttgtcatacttaaacacataaaaaatacttgtttcagctcttccaacctacaggtcaatgatcctaagtaataacaataacatttatatgattctttatgacttccaggatgttatgtcatttgatacaataatgtctaggataagctctacattaagaggatgctgagtgttcactgatggcagaagcttttgcagacacctggttcttttgacacagacaaaagaaagaaatcacttttccattggcagagtacatgtgtttggtgtggggcactgccccatggaactgttcatcttcttcttttagtgtgtttgtacaaggtgggaggggtgagaggctctcagtcctctcctcattgagaggaggagagaactcatgatttaaaatgtctttctagtctttggtttgttttttctctaaggaaatcaagagatctaaatgccctgtaagaaatctgattcagatcgggtgttgggaatgatgactgtaagatgtaaactgcattctgtgaaaaaagaagtgacattatcttgagggatttctggacaatttgtagaccatgctgtcggagggtaactctaactccattttgcctaagttgaggagacatgcatggagtgtatagactcatgagtctgccaccaaatggggataacactcaagggaacgtttgtggcggagcctgagcgccatcctccaccatggcaagattggattaggtgccctgttgtgtctccctttagcacacgacacttacctcagacacaacatttgtcacacttttaaataactgtctgtttagttgtctgtgatggttaatattaggtgtcaacttgatggtgttgagggatgccaaatggctggtgaagcattgtgtcagggtgtgtttttcagggtgttgccaggggagactgacattcgagtcagtggactgggagaggaagatccactcttaagggtactgtccaatctgt

SEQ ID NO: 47151 - DNA, 1450 bp, Homo sapiens
ttatattggtttgaggaatgttgtagtctcctgtataactgatgtgttctgccagaatttctatgccagttatactacacgttcaaaaaaccagatctgcttttacagaagtattatgaagcatatttttatgattgtccaagaaagctccagaataacccactcatttatttttctatctagcttttttgctttgaatgtgtgaatatgagcagtacactaacaaatcagaaatcaaactctaagtagcatcaccttttccaaccttcctttcaaaacatcagcgtttgtataaggcattctttgctgttaacttgcctgctgtgcttaggaattaagagtccgtaggataccaaattttcatcagacttttttgatgcatctgcttgggatgtataaagaaactggagatgttaagaatgctgtgtttgaatttaatttttcttagttttgtgtgttttctcttagaatttgtgtcttaaggtggttaaagatagtgatgggctcttgatttattggcataggttatatgaagatactggtttaggtgaggcttttatgtttgtttcagatttacttggggcattttgaacaaactagggagattgtttgatgaaagtcatgcatttaattgcttttccttctttgacagtattatgaaatgtcctatgggttgaatatagaaatgcacaagcaggtaagttatttctttataaccattttaaatgacagtaatactgggacactatgaaaagaaaattgtatgttttgcagttttattctgcaagccgttgtggctacctgtatttaaaagtctgggtagtgaagaaaatgctgttttttcatgtgtggctccccatctttctttcatattatcctaatttttataatttaaaaatgttattttaaaaagtctgaatacatattaaactctgtacactttcaaaagcaggatgctaaattttaaaatcctcttgttattcttctgaaagagttgctttatgtattttgggcattgcaaacttgtcttgtgaaagagcttttcttggaaaatattaaacagtaaaattaaattgtgtggcgccttcgttggcttgatgtgaaagaatggatagagggtgagctgggaggatgaaaatgaaatctgtggagctacaaaagaaattgatgtaaaatccttgtactggtcccctgaggctacttagttgggtcttaccaagaactataaccgttacttccaaaatttgtacagagtaaatgagcctgataggaggatgtgataaggttcaacattgggtcttgaaatctagcaattagttcagtagcaaaaaaaaaaaaaaatgattagtcagaaagcactgagagatacgactcaaacagtcttctttttgtgcaggagactgaataaaatggtttggcttaaatttcctagacagaagaataatagcgg

SEQ ID NO: 47152 - DNA, 1084 bp, Homo sapiens
tgtgttgtctactagtttgtggaaaagtgacacttggaaagaggaagcaaaagcaaccgaacttgctgtgcctttgaggaacaagttagtatagctaaagtagaatgtatgtattttagtatgttgagtctgcctttttaaagatgaaaacatgaatcattccaaacagaatttaaaattcagtttgaacgtcactgtatcactagtcagtgtttatctgaataattcttttactattaataggtctgtgtacctgtggtttgaatgaatgtggagcaatatcgatcttgactatattgtgtgtttagctaacttccctgcaaatcagtaaaaaatgcaaggttttagttcttttcaagggacaaggaattttgaaaatgtcttaattttttttattagtagagatagtataacgttgttgaaagaatagtaatcataacagtaagcaattttagattgcttatagtgtcgataatatttcacttattcttacaacaatcttatgagattatagtagtagtattatttccattttacgtatgttggggctgagacacagagagcttaaatagcttgcttgaaatcagctagccggtaaaatagatcttgggtttgactcaaggtcagaacgctggtatgacagatatttctgccttattccagttgatatgtttggaatactccaccatcagcatacttactaccttcccccaaatgcttgactgattccggagcctcagattctagttctggccttgctagtcaccagctttgtgatattgctgagtaccgtacctttaagggccatgcttttctcatctttaacttagggcgtaagtgaacgcccagatctcttttagctcttttggttaaaatgaccatttcagtttggtttgttgctgtgatccagtgaacagaaattgaatttttttttttcagtcttagaaagtctcttttagcacttattttcagaatttttaaaatccaaagttacccaatgtgcctaggagtagaaatgtatatttatatactattaatactttattttttataaggtactttctcatccttttttttcatgtaa

SEQ ID NO: 47153 - DNA, 1050 bp, Homo sapiens
aaagaaaattgtgtgacttctgaaattgtatgaattataaagtgatccaataattttcttccaaagatgtgcaaagggactatgtagcagtttattacctgttgtgtaattagctccgggggttactcttctagaatctaaggtaggtgtcagtttctctagcttgaggtaaagcgtgtctgtaaactgtggcttacagtgagcttgacatctcaagtcctcaggactttcttgctttgtcccatcaaggaccctttccttagggaagataaattcattgtaaataaatgacttaatcataagtagaagaagggagaaatgtttaatcttggccttttggagtttataaatcaaagacacagtagagatcaagttccttcattaaagtgtagttccaaaaaggaagaatgtggttttggttttaaaaaatttttttatttttaatttttaagagtacatagtaggtgtatgtatttatggggtaaatgaactattttgataccggcatatagcatataataatcacattcgggtaaatggactacccatcaactcaagcatttccctttttttgtgtgggttagaaactttctagttatactcttttagttacttttaaatgtacaataaattattgttgactgtagtcactctgttatgctatcaaacactataccttattcattctgactatatttttgtttacagaagaatatgttttgttcactgctggtaccactagcacctaaaacaatgcctggaatatagtagaagaaatgaatgaatgaatgatggaacagctaaaggagtggtttaattttttcattttattgcatttcatgtagcatcacatattctgagtatcagccacctttatataagctgtcttcgtttctgagtgcttagggagggcctggctttatgctgagcaaaaaaggcctagataggcaatcagagagtgggagttcttatctcagtctgctacaggtccttgagctgctgattggcatttttaaaatttagaattggattcatactttgccagatgat

SEQ ID NO: 47154 - DNA, 1010 bp, Homo sapiens
cagttgtgccttaactgctgaccaggcagaggcatccctgtgtctccatcatatatgctgtgtctgatggagatcatgtcacccaaatgaaaaaatacttttctagtctaggttcaaagggtgatacataaaatacataccacaaaaaattaatgatacaatgaaacctcagatctttaaaattattattgacttattggtaactttacagtttcttcaactccttataggcaatacgatcctaaatatttttaaaaatctagtcctaattcagccagtaacttcctgtgacattggtaaattatttaacttttctgagtctcagttcctcatccataaaacaagggtctaggactggatttttactttttataacatgttggttcccaggcccctgatctgggccttaggcatcagtatttttctaaaagctacagaggtgattttgatgtacagcaaggttgaggaccagcgaactagagcagtgctgctcaaaattcaatgtgcatacaaatcactgaaatcagattctgtttctgtaggtctgggttggtgcatgatactctccatttctaacaaaaagatcaggtgatactgatactgctggtccactgaccacattttgagtagcaaggagccaaaacatctccaaaatgtcttccatttctacattgtatctccatggtatagtttatatagttcatgaagtctgtgtgctgcttgaatgagatctcacatttagtatgttaagattgatagtgtattatcttattatctgcacaacctctctttgcttaagctccatccagactcatgcatctttatttttgtttttgttttgtatttttttttttgggagattcatgcatctttgaaacaattcctcatattgaagtcattttaatagtaccttgctttagacagcctgacagctctagctggtggctggtgggttgttatatttgctgtagagaagagggttttcatttctttcttcttcgttcactcca

SEQ ID NO: 47155 - DNA, 1024 bp, Homo sapiens
attttgttttaattttgttctcatgcatgtacattctctgcagaaaatttattaagcgtaagtttaagggagcaaaactccaacttaaagctcaaacatacttaagctgtaacattttttaactctgtactttaaccatatcacttggcaattgtttttagaaataagaaaatactatttatagtttgtggttctttatttttgtttgctgcagctcaatctcacattggcaggcatcatgacccagtagaaagacccctgaatggtagtgtctggagagctgatattctaagccttcacccacccttaagtagtttttgcaactgtagacacttgggttctgtaagtaaaccagggaagagattaaggaatgctccatttcttagggctgtgttggagaatttggttaccttggaagaacatacctatcacctaaagtctaaggcaataagaaattatagtttgcgattggggaatgttgcttcggagcagtgacactcagagagtggtccatggactggtgcaggtctgtgaactatttcttaaagatgggtgaatgagataaggtacttgttacttgtgcaaaaattaactcactgttttcttcatagagaatgtctttatttttaaaaaacaaaacaaaaaactccattgaactaaacgtagttaaccgttatctttttgctgatcggtaacaatgtgggaactagctactttctgctttagaatacttaatcggtcaaaagttgtatcaggttattttataatttaagaatagaccaaagtagaagttcataaaatgtagcctaaaaaataaaaaagtaaatttaaaggcaagttaggttaaagataagaatcaaattcaaggtggtctggacgtatgtagcatagttaagtccaaggcagttaacacaggttcacaagtagtagcttcttacagaagctgtaagaagcactgcagtttgtgctttggttaatgcaaaacttgtttaaattcttctgagtgcttctaaattatctgaga

SEQ ID NO: 47156 - DNA, 1050 bp, Homo sapiens
gcttgttaactttgcgaggaatcaatggcttgtgataacaggtttgatataggagagcatggttaaaattgcagagatcccctggcaagtatgcagtgacatccctaagaccatcttcagaaagtgcttgtgttaagtgccagcagcctgcacagggcacgtctgcttcccagttggagccattttgtcagtcttggtaatatgttatgacagtgccatatatcggaagaatgtcctaaaatgaataatagacatggattggggcttctggggatttggcccagttttctgattttcacattaggttgtgggcatgggtaacttttcatttaaaaaatatatattttctcataatactgaatgagccatcagagagcgtaattctgtcccatattccgtggttgactgattggcttgctgtacctgaccatgtattttggtgacagttggctgcttggtgagattcatctggtggcatcatggcctgtttgacctcaagaagtgaaagatgattctcaggaggtagaacttttttcctgtggtttaaatgtgggtctctatccaaaggcagcaatgccaacctttatctgtatgtctcaacaaattaatgagtgtttgagaactgactcatttatttgacttttagttaggtagtgattagattattattagtggagctaagtttgaaggtaccttgagtagagctgcattgtccaatacagtagtagctatgtaaagttgaataaaattaaaagttcagtttcttagttactctagctacatttcaagtgctcagtatccactcatatgtggctagtggctgtcatattattagcacagatacagaacatttccaacattgcccaaagttctgttggacagcagtgaatttgtagagcttacctatccgtgaagaatgccctgtccccatgtaagtgagagtggagaaggcaaggccaggtaggcagtcagtaatgtgctcctaagagctttaatcccatgttccacagctaaaattgtttgggaagccaggtatacttatttactctc

SEQ ID NO: 47157 - DNA, 1080 bp, Homo sapiens
gtggtccttttctgccctttgtgccaaacttgaaactgcagggaaatctttgttacagagaatccagaaaagacctattaacagcattgaggctgtgtctgccacttcatggctgtgtattttcagacatcattgctatttttcagaattaaattaattatcttaatggagtacttacttgcttaagtttaaagttcactccattttaatgtttattttcttgagtggcccatcaaggaaataggaagaagtagtttattttgtattgtggtttgagataagagaggtttttatttattattaattttaagtaaggcacccaaagataataaaggcctaggaaggatagtgagaagaattttgccatgatacatattttcctcaataggtcttcctcagtggtggttatgtatgtacgtttattttaatactctagtctatgccctctttaattctttggcttgatctttgttttgtttttcttctaaagcctatatatatatatattttttttaacctgctagtttataatgtatcttaaattacatccgtaacaaatctgtgttatactgtgtactcttaatgtacatttcccttccttttggtctttaaaaagcaaggggttttatgtttcttagtgggactgtaagataaagtagaatatctttgcaggttaattgctctgtaattaacccagatggggcagagggcagaggacagttttgacttaaccctgttgggaaacatcagcaagctttcactttactgtagagcaatccattagattatggtactctcagctacttgactaatatccagagaaaccttactccttttccagggaatcctgagttcctctgttgataagatgacttaatagaaatatatttttaatgaattcttgacatttgataaattaaggccatttattttagcagagaaaaaggtgaagttctacttagccattggtgacttactacttttatttaaagaagatgttttctaatatgttttattgactaacccttatcagttataaaatacctgctactctagttctaggctagttcctaaggtgaa

SEQ ID NO: 47158 - DNA, 1117 bp, Homo sapiens
actctacctttttacggtcagcatacatttctagatatcttactcccttgattattggtaaaatccatttcattgttcatcaccaatgtatacagacaaacctagatttcattctgtcccattctcccatcataaggaaaaggcttttcctggtgtaattcaccatgaagtattcttgacaccacaaggaagcacactgaaacatttagaatatgagccattctgtaggaaggctatgccaggttctgcaacaatcctctctaccactgggtaagctgaatatcaatagacaagtcacttaacctccatggatctcaaggctgtaactcaaggcattcttccaagtatttggaatgtagctattttcttatgtgttatttagtcctgtcctagaaacaaattttgaaataaaaatcttataccataggttatgtttcagcaataaagttggccataccattagccaagtaaacacagtggttagaagtgaggaaatcatttgaggggttcggtggtagggtgataaagtatgcctttcaagcatttaacgttataactctttcaatttcccaaaataacaaaataagatggtaatttgaaattaagtgttttagcattgctattgctttttaattatttgtttacaagacttttaggtatttatttctaccatgtattttactatttacagttatcaaggaacagttaagaagttttgttctatgaatctatgatgcagtaatttgttcagtattaattgatacctgcctctaggcatgtaaactgtgtgaaacgtaacaggtgtcctaattctagaaaaatgtgtggtaattgtttgtttgtcaaacagatgaataaatatctttagggcatagctggtcctcaggtggtgagcataaatggattaatgatgtgagtgactcggggagacacgcttgttttgcagcaccctcctccgccgatcgctgaagcagaacaaatactaattaacaggggcggcctggttggcaggttggctttctccagctgatttggcaaaatggtttattcctttccctccataaaccatccctcttagttattagacattttcatactgatgtttagttaatttcta

SEQ ID NO: 47159 - DNA, 1067 bp, Homo sapiens
ttaatggatcgttcctcttcatttctcagagcttctggtgagtcctgaattctttaaaatgtgcatataaaaccagtttatgatgatgggaggactagctctgaaggcagtcttcccaggaagctgcccgggctgatgtgcaaatgcatgcaaacatgaacctttagcaaacactgacagtaatgccagtggcaacgttctgtcgactcccaatcgggatatgggccttttactcgaattcagaaagtgttttgtaggaatcggcaaaacaattgaactacagagctaaaatatttatcatctgattttttggcacttgaataccctcacttgcttttcaggtggtttctctgttttcaaaattagtaaataattttatttgtttttttgctgctcccatttagctctgatgatattttcttctttcaagagtatttttaaaaattgccagctttctagttgttacttgaagccagcttcagaagtagaacagttaacacggattattagagacctttagaaggaagtaaaattctcaaattttatttctatgtcttggactgttatttggtttttgaaagcacaattttttatgccaagaactaaaaatctgtagacactggtggtaaaaagtagaaattccacaattacaagtggcagtgagtaaactggctagagtgagaagcaggaatgaggtggaatgagtatgaatctctgctgtttccttcatctgtgtgtgtgtgtgtgtgtgtgtgtgtgtgtgtgggtggggttttttttttttgttttttttttttttttttttttgagaaggagtctccctatgtcacccaagctgctgctggagtgcagtgtcatgatctcggctcactgcaatctctgtctcctgggttcaaacgattctcctgcctcagcctcccaagtaactgggattataggcacgtgccaccacacacctggataattttttgtttttggtattttttagtaaagatgtggtttcaccatgttggccaggctggtttcgaacttctgacctcaggcgatccacccacctcagcctccca

SEQ ID NO: 47160 - DNA, 1187 bp, Homo sapiens
atttgttttgggagatgtacaaatcaaatctgattataacaaatattataacaaaaatatccctctaaccaaacaatttctagaccccaaccagtggtccacttatttaaaacaatattgaatgtaacccaattccattaaggcaaaataatgtgagttagtcttggagtttttctttcatgagttccttaccttttggaattcatataggcaattggcagtgattccaaaaatgtttatttacctttggaactatatgattttaaaagtgtagtttatctttcaaattattttctgcatagttccattttacagtatctgtttttgtgggaagagactactccaaatgaaattctggtttctgattggtttcctccttgcctattttagtttcttatacttttatacctaaaaagtttttcttgcatttaacagagtaatttccccctaaaaactattgaagtagtagcataatttacatgttacttcttgtcaaccaccaaaaccacagggtacaacctgatcaaatacactaaatatgaaacaaaacacaggctcaaaatagagtagatggccattgctgcatgtgagtagtttttgccccgacccctggtcagttgattccagtcacgcctctccatgccttcctggggggtgattttgtagggccgttctgcttaatgtttcctgactcaacctgtccctgggttcagaacccagggatcttcttcctcctaattacccttgccctctttagtcctcccaggcttcaggcttccctccaagtggggatcccttcccagataaaagagttgagaagtggtttattgcttttctcaatgtttaaggaaaaccactagaaggctgcttagtatagagtgaaaaccatgtgctttgtagccgttgccatgggctctggagacagctctgcccctgctagctttatgaccttggacatgaataataattagcactgtgggtgcatatactctgtgctgtcatcagaacagcccattaaggtggagtttgctattatctccgtgttgcagatgaggaaagtgagacacagtgagactaagtaagttgcctctggttcacccagaacataagtgatgagctgactaggattcagttagtcttcagagcccatgctcattatctctattctagggtcagttttaaaccct

SEQ ID NO: 47161 - DNA, 1053 bp, Homo sapiens
tgatggtgacactaaacactgaggctttgatgtttatacgatattcttccccactaattaactgcactaatgaagttaattgtggggaagaatgccgtataaaacatcaaagcctcgatgtttaatcacaacttaaaaagaagttttatactcttcaattgccaaatacattccaattagctgaaggaaggtcaaaaattctgttttcttccatctcatcttcagagcttttctggttgaccattggttacttgagctgcctgagtgttaatctagacaagctgacagtggcatgtggaggacaacatatcttcccccaagctataagccagcataactgagagactcagtttctgcaaaaggcagtgatgacctcttctgtaatgtgttgatgaaaaatgaatgaactcacagagtaatgcatttctctaccctctaattttattattagcttgacccactactccattttcctatatgtttccatatgttgctcttataagccacttctctaatttctgataggcatatttccttgatgaattcagactgcaaaaccaaggaaatgtgtatgtgtgtgtgtgggtatgtttaaaggcatagggcgtatgtaagtggaggctttgcaaagttgataagaattcttaaatgaccagtagtagaacaagaactccttctcaggtcaatttccctgtggtgtgtgttacatcaatttttattgttgttttttttttttcttaatcaggcagggtttacaatagcaataatgtaattcaaataagcaattattgtaattgaccttggcgatgagtatccttggcttttaccacagtttgcttaatacctgaggatgggcaattatctcataatgcccactttattgagattattgttttaattatggcactcaaaatacatcactttgtcagcattgtagagtcaagcatggaagcactgcattcagtattcagaagtgcgtaaagagcatcttgcctcatcttatgacatggttatgattgcgttttttctctctcccaactgtggttttgaaat

SEQ ID NO: 47162 - DNA, 1112 bp, Homo sapiens
tacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaaaaaatggtgtcttaagtgcttagtgtttgatgtcattaacagtttcgtaaaactctacagtgtagaaagattttgatactaa

SEQ ID NO: 47163 - DNA, 1011 bp, Homo sapiens
cataccactgaggcacccactagtaggttcaggaacactctgaaacatacatacccctgtaagagctgagtcttagttttctcatgaatatatactcagagcttactattcctaaggaagctacaggaaaaaggtagattttgcgaaaaggaatgtgtcagcgtatatcatagtgatccactgaccctttatgtaaagcatgaaaaagagaaaataataacacttatatactgctatccataattagcaaatgtgaacatcctatcctatttgcctcagatctattttttaaaatgaagcattagagacccagctgaacttcccctttgactgcatattgtttctataattaatgtatagcattgttgtgtatgtgttgtgttggcagttatcagactttggaaaatctttcatttaaaaaaattaagtatctgtaatgtttcaaacaatatcaaataccattacatgtcttgaaccagagcagagttggcgttcattattagaactgagcaagaagtattgtatttcaaacttctgattccattttgtgatgactaagcaaaactcatgtcattttcccacattagcaaactgtatgtctcatccatcttgctcctctcagttaagacaaaagtttgtgttttttatttattatttatgtatttattttttgtgacagggtgtcactttctcgtaggctggagtgcagtggtgtgatcatggctcactgcagcctcaacctccctggacttaggtgatcctcccgtctcagtcgctggagtcactgggactacaggcacgcaccactactcccagttaattttttttgtattttttgtagagtttctctacgttgcccagactggtctcaaacactttggctggagatccgcctgactcggccttctgaagtgctaagattacaggcgtgagccgccatacctggtcgctgtttcatattatatatgcaagaagtagagaaatcaaatctaataaaaataaatggacctc

SEQ ID NO: 47164 - DNA, 1033 bp, Homo sapiens
tcataccctggacttggatcatccctttgtccagcatatctatgctgtttatgctacccaccctttagtcacttagtagctggttggtcatcggatttaaaaaaataatatatattaagtttgataatatttagagtttcagacatccactgggggtattggagcatattccccatagataagggaggctaatgtaactactgtttactgaatatcctttataggtctgacattatgctttacaaatataattcatgtgatcctgttaacaatcctataagatagatggtagtgttgacattttatagatgaaaaaactggttacagaagttgagaattttatattaggtcacatatcttgtaacttgacagagccagctttcaaacctaggtatagctgtctcaaaccttttgattttctcattttaccatctgattatgtgtagtgtttcaatttcgaccatgtaagatgctgaagagtgaaaaatctaaagggtgtgcctgtctgtgcattgtagagaattacagaagctgtattcaaatatactgaattatctaaatttttttgttttttgttttcaggtaatagatgcatattatttcttttatttaaaagaaatgaatgtgactagtattgcattaagagctgaaacttggcttttagctgcatggcatgttaaagtacctccgatgtggctggaagcttgtattaactggattcaagaagaaaataataatgttaacttgagtcaggcccaaatgaataaacaagtgtttgagcagtggctccttactgatctgagggatttggagcatcctcttttacccgatggcattttagaaattccaaaaggagaattaaatggattttatgctctgcagattaattccttggttgatgtaagtcagcctgcatactcccagatacagaagttgagaggaaagaatacaacaaatgatctagttacagctgaagcacaagtaaccccaaaaccttgggaagcaaagccttcacgaatgttgatgctgcagc

SEQ ID NO: 47165 - DNA, 1050 bp, Homo sapiens
aaaagtacttgcaagattaataggggaacctgatcttgtagtttcagtcataccaaacaattctaacgaaaacattcccagagttacagatgttctagatcctgcattaggtccttctgatgaagaactcttggcaagtcttgatgaaaatgatgagcttacagcaaataatgacacttcctcagaacgatgtttcaccacaggtagttcctcaaataccattcccacaagacagtcaagttttgagccagaatttgttatttctccaagaccaaaagaggaaccatcaaacctatctatacatgtaatggatggagaattagatgacttttcactggaggaggccttgcttttagaagaaactgtccagaaagaacagatggaaactaaggaattgcaaccattgacttttaacagaaatgccgatcgaagtatagagagattttcacataatcctaatactacgaataacttttctttgacttgcaaaaatggaaacaataattggagtgaaaaaaatgtatctgaacaaatgactaatgaagacaaatcatttggttgtccatctgttagagaccaaaacaggagtattttttcagttcattgtaatgtacccttagcccatgattttacaaataaagaaaagaacttagagacagataataaaataaaacaaaccagcagttcagatagccattccttaaataataaaatattaaatagagaggtggtcaactatgtacagaaaaggaattcacaaatttctaatgaaaatgattgtaatttacagagttgttctttaagatcatcagagaatagcattaatctttctattgccatggatttgtattctccaccctttgtctatttgtctgttctaatggccagcaaaccaaaggaagttacaacagtgaaagtgaaagcatttattgtaaccttaactggaaatctctcaagttctggtggtatttggagtataactgcaaaggtgtctgatggtactgcatatctagatgtagactttgtggatgaaatacttactagcttgat

SEQ ID NO: 47166 - DNA, 1038 bp, Homo sapiens
gtgtgccacaattctgggccttcccactgctcccttgagggaatggcaccctttttggagatgtgttttattaagcagagcttgactcggtgaagagcccacagtgtcactgcactttaacaggggcagtggggagtggttttctgggaaagagcctgctgcccgcctgtcagtggccctgacctggcacttcctctctccttcctaaccctgtgcctttgggatcagttgccctgaggcagagagcaggagaggccagggctgtggagatcctcctggaggcaggtggaagtcaccaggagggggcagcgcagcacacaccttggtcttctgtttccatgcggaggctgtggagcagggaaagaaagctgttagctgtttgctgtttgggtggtccagggaaccaagaacttgagctcgggtgtgtttgtccactgagtcactgagaaaccctggggtctggctttcctgcagttatttcctttgtatggttgttgcagtctctgtctctctttctttccctctctccctcccaccctttcttgcttgctgtctctttcttttcttttttcttcataaattttaaaaattcaaaaaagtataatgacataataactttatataattacattcagaaataatagttgaatatttttaagctattttttcttttaataaaataatttagcagtttaataacataaatggtataaatagtttctgtgtatgtgtgtgtgtgtgtgtaaccccagacccattctcctttcccaaggccaccttccttggaatcatctttctatacttggcatatctacttgactgtgaacactatgtgatattattttttgtgtatttttaaaagttcacacagattgttttatgttacatgtacgtatcagtatacaattttgcttatcttctttctcacttcgcatagcagtgtctttctgttcaaatatgtagatctgatttaatctaatatatatatatatatatcaccttattttaaacaatgtctatttctttatggatggacac

SEQ ID NO: 47167 - DNA, 1043 bp, Homo sapiens
cgaccgctgagcctcccgagactccgtgggggccgctcgagtgacaggtgccaccgtcccctcaccgccgctggcgcccgcactccctcccggggagccaggcgctcggaaatttctggagcaacgacctgactcgttgttttctccctttcaggttttgaagccgcttctctggccgagttaggtttcgcccagcgcaatttctttctctatgtactttgcgaataagtttcggagcatcggttaacagcctatgggtgaaatttggctttcattcatgaatgaggtatagtgaattactttttgaatatagtgctcctcgtcctcccccgccagctattgaaaagtgatttttttttctgttattgtttggaacagccttaccgaatttttgtcagatttcgagcattaaggtgcttcataaatattgaacagtaacgacaaaaatagtttatcaaattggctgattgccttttctcttcctcctctttttcactctttaccttcgccagatttttcagagtagatgctaatgctttcattagaaggactaatgaaagatcgtctgtcttacactaaaaagctggagacacttttcttcaacatttagcattgcctgttgtgtagtaaatgtgcttgggattgtaactggaatcacttaataaatgtgacttgtagctataaaaatatttgagaagctttttggcaaattaaaatattaaagatcttcatacaaatctagatttcttttctcaacagatttataacactatagtagcttcaattctggagtaagagcaaaacccagaagttgaccaaaagaaccttgtgtgaaaatagatgtattttactcgtgggagaatccctcaggtcctcactgagtacctgcttgtatttttttgtttaactttcttggcctacagaaagtgggagctgcagattggagaggggtctcagtacttaactgtgaggaaaaaatggagtttggggcatacccattgggtttacatcacttacagtaagtgtgtttggagcagagtttt

SEQ ID NO: 47168 - DNA, 1052 bp, Homo sapiens
tgtctgatgaggtagattactaggacttggagcacttcccttttcatagttgacataactccagagcagcttgtgcaggagctacccactgaggagcactggatgaggtttcttgtatctggaagtgactggaacagaggcttttactttttcaggggtttcctggctgccccaaggcctaagggaaactttatctaaggataccctggtaagatagctctgccttatgctacagaaagaaaatttctgtgagccttggagagatgtttcagaatagacatttatgaataacgcatgcaaataatccatatatgaaattcacagttttcatatcagtcctagaatggaaagaaatttttttgtgtaagatataagtcttgataaggcttcagtagcaatctgaaaatctcagcagctgaaagcagcaaagttgctttcttgctcaagctaccatgtccaccacaggttggtaaaggggctttgttcattgtggttcactgcgttccagcctagactccatctcaaaaaacaaacaaaaaaagtgtgtacagttccttacttatctccttgccttaactttctaactccctggttatttaatatttagattaatgaactgggaaacattattactgtagaaataaaggcccaatggaatcccatgtacttatcacctagcttcatcatttatcaactcatggaccccacacctagattattttgaagcaaacccaagacatactagtttgtctacaaatttacgatgtattttacaagacaggtttactcatttcaactatgttgtattgaaacaaaacctgttctaattgactttgctttagaaggtggttagtttattgggatacaaggaatcagtaattaaaatttgctttttatttttgatacacaggaatccagatcttacataagatggaagtctctcacactagatactgaacattaaatagaaaatctatttagtaaaatctaagttgccaaggaagaaataccagtaaaagttgctgtaagaattagacctctgctttgcaaag

SEQ ID NO: 47169 - DNA, 1033 bp, Homo sapiens
aaaaaaatcagcagagtgaacagacaacccagagcgggagaaaatcttcacaatctatacctccaacaaaagactaatatctagaatctacaaagaactcaaacaaatcagtaagaaaaaaacaaataattgcatcaaaaaatgggcgaaggacatgaatagacaattctcaaaagaagatatacaagtgacaaacatggaaaaatgctcaatattgctaattatcagggaaatgcagatcaaaaccacaatgtaatatcaccttactcctgcaagaatggctgtaatttaaaaaatcaaaaaataatagatgttggcatggatgtggtaaaaagggaacacttttacactgttgttggcaatgtaacctagtataatcactatggaaaagagtatggagattccttaaataactaaaagtagatataccgtttgatccagcagtctcactactggatatctaccagaggaaaataagttattatatgaaaaagacacttaacacattacacttgcatgtttatagcagcacaattcataattgcaaaaatatggaaccagtccaaatgcccatcaaccaatgagtggataaaggaagtgtggtatatatataccgtggaatactactcagccataagcagcaacctggatgcaattggagactattattctaagtgaagtaactcaggagtggaaaaccaaacatcatatgttctcacttataagtgggtacagcatacactgctagggtgatgatgggtgcaccaaaatctcataaatcaccacaaaagaacttatccagtaaccaaacatcacgcgttccccaaaaacctactgaaatgaaaaggaaggaaggaaagggagggagggaggaagcagggggcggggaagggacgggaggaggagggagagaaagacaaagaaagagaaaaaaaaagggagggagggaggcagaaagagaaaatgtgactgggctcagtggctcacgcctgtaatcgtagcactttggaggctaaggcaggatgatcccttg

SEQ ID NO: 47170 - DNA, 1078 bp, Homo sapiens
aggctagagtgcagtggcacgatcttggctcactgcaatctccgcctcccaggttcaagtgattctcctgcctcagcctcccgagtagctgggattacaggcgccctcaaccacgctcagctaatttttgtatttttagtagagatgaggtttcaccatcttggccaggctggtctcaaactcctgatctcatgatacacccacctgggcctcccaaagtgctgggattacaggcgtgagccaccgcacccagcctctagtctgtcttttgcattcctccctaagcactcctctccctgcattggcttagcacatcattcccaacaactctcaaattctaccctccatggtttaattgaccactgtgagagcatcccccaccaattccctacgtgactgctggacgaccctcatagagcctgtcagcattgtgggcaagaccctggggaagtttctcattttacatatgaataaactagatgcagagatgttaagtaacctattcacagtcacagagctgaaaagaacaataataataataattgctattatttattaccatttgctgaaactgtgctgaacaatttacatacattttcttagaatgagaaacctaaggtcagttctggctttcgagtgccaccccaaaatatgctgcttcagcttcagtatgctaattagttagaactgagggctttgaaggaagaataggaagttacgaagagggaagaaggaaatgggagtggataaatggaatggagggctttgcagccaaaaggaagaaaatgaaaaaaggatcagagagttgggacaaagagctttctgaaggactttacagtaataaagaggtgccatctctagatggagttagtggggagaaacccagattcagtatatgcccttgggtaggtcttgtcacctctaaggactttaggtctctcttttgtaaaacaaaagatctgaaaaataaacagaagggctggactaaacaatctctaaggtagttttttttgtttgtttgtttgttttttgagatggagtctcactcttgttgctcaggctggagtgcaatggtgcg

SEQ ID NO: 47171 - DNA, 1052 bp, Homo sapiens
actagccagccaaaaccataaactagccagctgacccatagaataatgagaaataaaaacatttgttgttttaagccattaagcctcgaggtggtttgtaaaaccccaaaaaagcaaaagctgactgatataaaaatatgtattttttcttttttaaaattattttattgttgttattggttttaagttctggggtacatttgcaggatgtgcaggtttgttacataggtaaacctgtgccatggtggtttgctgcacctaacaacccatcacctatgtattaagcccagcatacattaactcttttccctaatgctcttcacctccgccccctgctctccccgacagactccagtgtgtgttgttcccctccttgtgcccatgtgttctcattgttcagctcccacttataagtgagaatatgctgtctttggtttcctgttcctgcattagtttgcataatggcttccagcttcattcatgtctctgcaaaggacatgatctcgttcttttttatggctgcatatattctgtggtatatatataccacattttctttatccagtctatcattgatgggcatttgagttgattccatgtctttgctatcgtgagtagtgctgcagtgaacatacacgtgcatgtatctttataatagaacaatttatattctggattgctgggtcaaatggtatttcctgttgtaaatctttgaggaatcaccacactgtcttccacaatgattgaactaatttacattcccaccaacagtgtaaaagcgtgcctaaaaaatatgtattttaaagataaaatatatattgacattaacactttaaactaaaacccaaatctatagcgttttttaagccctttattgatctttcactgaaacttctttctcctactctaaaaattccaattgtaaacaaaataaacagaataactcatttgttttatctcgatctacatataaagaggtctcagaatgataatactaatacaacctctgtcacaggttacattttgtggagcagacactgagatggaatttg

SEQ ID NO: 47172 - DNA, 1071 bp, Homo sapiens
aatttgccacgcagttgggggatttcactgcacctaataaacagcacacttcccccacccccaaagtttcgaatcaattgagaaataggcaatatattagtttgctagggctgctgtaattgagacataaagaaggaagaaaatgtgacagttaataaaagtggactcagagatggaaaagatgttggaactagcagacaaggactttaaaataacaatagtatatatgtttaaaagattggggtgcagggaggtagacaatatgtaggcagggaatttcattccaggaatggaaactacagaaaagatgcaatggaaatgctaggactgaaaaagtacaatattagaaatgaagatttcatcagttgggcttaatggccaacttgacaagagtggaagaaatgatcagggaatttgaatacaaagtgtctaaaatgaaatgtaaagagaaaaatgaatggaaaaaccgaacaaatctttgagacttataggtaataatcaaatcaactaatagatgtgtaattggagcctaagaggaacaggaaagggagagtggggaaggaaaaatacctgaagaaataatggccaagaattttgcaaaattgatgggggattgagggtggtggtggcaactcacagatcccaaatcttaaacaggggaataataacaaaatttttggctgacttctcatcagaaagaatggagatgagcaaacaatggaacagcatctttaaaatgctgaaagaaaaaaaaaggctgaacctagaagtctatatacagtgaaaatatccttcaaaaaattaaggccaattagatacatttataaacaaaaatggaaagaatttatccccagaccagtgccataagacatgctaggggaaggggaagtctttcggttgaaggacaatgtagtcagatggaagatcaaatctgcaataaggaatgaaggataacagaaaaagtaaattagtacataaacattttaaaaaccttttaattttttttttttttttttgggacagagtttcgttcttgtcgcccaggctagagtgcagtggcacaatctcggc

SEQ ID NO: 47173 - DNA, 1040 bp, Homo sapiens
actgtttgtcgagaaattctcatttctactgcttcccccccgccccactttctgaccatccctttctttttatattgacattaaatcattttccttagaaatatgtaaaatttattcatttgttcattcagcatttattgattgctagtgtgtgtacttgtattaggtgttttatatgtatagttttcacttatgttttacatgagctttattagatatctgtattatcttactgcctgtgattacattgcttgggaggggcctagccagaatcttaatcctgatccttcatcttccaaagctgtctctttaccccctcaaagatttctttattaccttttagcagtttacagtcctagtgggtggagtaaagaaaggagtcaaaggattgctgggaacagacatgtgaataaacaattctgacaacatgtaaatgcttttatgacggtgccgtgggaacagagaggaggagttaattatgtctgagagagtaagaaaggctgtagaaaggaattaatactggtgtgaggtactaaagaatggtaggcgtatgacaggaagattcatggtttagtaggcaaagagggtatattgcatgggcatgacaatgtgaaaatgttcattttggaaaatcataaatagctgcttaagtctggcagggagccaagtaggaggagtgtgggattagtggagagtggtggagaaggaggaaaggataaacagagggaggatttttgccaaagttgaggaactattctgtgagactcttgggactgtatttaaaaatttggactttaaaaggcagatggtttttagtctggaaagtctgtcttctgcacactagttaataccaaatacacaccttaattacagagttttccacaaacatttgtcattttgcaatgcagtagcgtatgtcttactctactgcagaattcttgggcttaaggtaaaaataactataaacttgggcaaatgatttaaactcttactctgtttctttacatataaaaggagaaaaataccacctttctcaaagt

SEQ ID NO: 47174 - DNA, 1035 bp, Homo sapiens
ttaaatgaagcatatgttttccaatttgccagtctctaccattccctagtgtatgttgtagctagccagatgtatttaggaagataacctgccttttgagttcatgacccctgccctggaataagtcattcgttgaacacatatttattgaatagaagtctgtttagcactattctaagtcctataggtgaagtagtaaataaagccgtgatctcatggattatacctttcttgggacagatagtcaatgtatatgtaattaaatacacatataatgtcaggtggtgattaagtgccatgaagaaaagtaaagcaggctaaggggatataaaatggtggatggtgctgtcttagaatgcatggggaaaatctctatttgaggaattgacattagaacagaggctggaatataagggatgaaaccttgtaaatattttgaagaaaatcattttggtgtgggagccgtgagaggagaacgtgtttggtatgtttgaatgacaagaaagacctgtcagactgcagtgcagtgaatgtgaagtggtaggaaataaagttggcgagggagaccgggccatgtgatgtagggccatagaggccatggtggacttagggattttgctatgaggtagaaaactattgaaaggttttgaataggaaatgacatgatgtgacttattttcagacaatccttctgccttctggtggtatataaattatagcagggactagtgtggtaggtgggggagttgtctggaggtggttacaagagtgagcaatagtggtgacttaaactagagagagctgtgaaagggtgaaaagtagttagactagaatctgaagatagagcctacagtgttttctggtagatttgatacaggatgtagaaaaacgagaggagtagaggccaggttttcagcctgagcaactctagataggtagtagtgccatttagtggtatggtaaacactaggaagtaggcgtcaagctcctttttggagatgtaaaatttgagaatcctgtttgatgtccaagtag

SEQ ID NO: 47175 - DNA, 1051 bp, Homo sapiens
aataatgttagcacaggtttttgaataaattttgcttctaagagaagttactatttattcctaattagatggggaggaaagtctttgaagaggaacttctactttgctttttacacacagtctactctgaacaccaggcaggcgttagatattctccctgttttggaaaagatttcactctgtatttttcctgtgctctcacaccaccacaacagtcatcagtacagaagacttgagtgataactgtgtaggtttttccacacacaccagctggatgccctctaattaaactcccattgaaggagtgtttgtggtagtgtggaaaacacaaactccaacctctactatctacccggaggtaatgccagatcccacaggttgacggctcagtccccaagactgctcttcctccccaaacaccagttccatgtctgggtttccagaacttctgacccactggctttaagttgggattcccacgactctctttttggtttcagctaattggctggagcgagtcacagaactctgggaaacacttggtgtgtttactggtttattgtggaggctataggatgtgaaggatacagatgaagaaatgcatagggtgaagtatgggtaagggtctcggagcttccatgccttccctgggtgtactatctcctaggaacctccacatgttcagatatctggaagctctctgaactgtgtcctcctgaatttttacagaagtttccttacataggcatgattgattaaacctttggccattggtgagcaactggaccttcagcctctctcccatccctggaagttgtggggtggggctgaaagttccagccttgtactcatgcctgtctttttggttatctgccctaccctgaaactatcagtcattcgcatatcaaaagacagcactcggagagtctaaggattttaggagttaacgttaggaaacaagaaggaagaccaaatatatatttcataatgtcacaccctctgtgttctcactgcattcatacaggcctctgttacattttcttgtactttg

SEQ ID NO: 47176 - DNA, 1029 bp, Homo sapiens
tcagtttattttgactattttaatattactactcttgggaggtttttatttctgtacattttttatcctacatcagaattcaccttcagtaaggattaataagtaacactcattgtggagacagcaacttataaaaaattttcacaaactttttatattttaatcacttgcgtagtctgtggcatttataagtatactgattttacactaatgacaattctgtgcgtgacaccgtaactaatatataacatttgttttaagaccactttcctggtggataacaaaaaggtctttggaactcatctcatgcaagacatggtgaaagatgcacttcggtcttttgtcagtcctccggtgctttcccccaagtaagtattgtaagacattttagagttgtatgtatgtgctcctttaaaagcccaacttctctgtactccttctttatagccaaagtatcaaaattgggaccaaatctccatgtaaagtaacttaatagtgttaaaattaattgatctctgccacattgtttagattaaaactaaggtttttatgaggttgacaaaatttctgataactccaagttttttgtctccagcgtaagtccttaaactttgccgtagtagaggcactgccccgaaaacatgctgccatcagaggctgaaaggattgcatgcagaaagaatcatcatttgaaagctggcattctgagaaatgtcaggcttttccaacagggaagggaagaaaggagtcatcatttcttaacaaagcacttacactttgttaaaaaaaaagatacacctaacagtgtatctttttccactgaaagatacacgatggctttctatcacaaattacttcatggtagatctaattaattatatgtaatggctgccaaatatttcataataaatgttgagtatcttttatccaaaatgccctggaccagaggtgttttagatttctgatatttttggatttttgaagtatttgcatgtacataatgttgctcaggctggagtgcagtggcat

SEQ ID NO: 47177 - DNA, 1016 bp, Homo sapiens
cagggccaggaattgtttactctccatatgaaattataggccttattatgttatgaaatgcatatatatttttatatatatatatatctcgtagatttgaagacttttctggcttagcagtgttaaagttctgaaaaattagtgtctggtagagaatgttctgttttatatttcatttattaaataaactcaagtaaattgtaaatgtgaatgttcttaatttttaagaatgattttatataatgccgataattttttatctttttctgattttatttgctttgtgattaaaagaaaatatttatagactgaactgaactgtgttctgatataataaaaacttaatgggcattcatttgatttgcatatgtacatgtataattatcaagaaatcttctggaaagttgtaaaatgtagaaagggaaaattaatccttatgttcatttcttgtaagatctaatctattatctaatgaatgatctgtttttaaagacctaaagcattatttgaaatatctatcgttaatatatgtgttgataaagctgtctcatttagacatctaccattaactaacattttgtatcctttaaggtatctctctgaattcctttacgcatggttgatgtcaacattgagtcgtgccgatggctctcaaatggcagaggaaaggataatggaagagcagcagaaaggccgtagtagtaaaaaaacaaagaaaaaaaagaaaggtgctgtggattatttttaaacttaagaacagagtgtactttaatttctacagataaatagatggagagctactcgtgagttggtcattatattttagttcttgttcctcttttcagaaactataaggtagagactgagtcccagtatcaatgacataagctttttggttcctttctttgctttcatttctttgctgttctgtgtatcagagaatctttgatcaagaagtagccacgtggagtgtgcaagcaagatatcggtgagggaacaagacagcaggaggccag

SEQ ID NO: 47178 - DNA, 1035 bp, Homo sapiens
gtgcgagtataaaatatctttataaagataatatcagaattggtagttttgtttccttccttggagggaagcagagtgcctggaagagagataggagagacactttttaaaaattatatgtaccatctaagaaaatataaagggggagtctaaaaatttgaggagctacctatgatgacatatttcatttagtgaaacttcatttattcaaagatgagtctgtgctcctaatactatgctgtgctgccttttcaggactttgcagcctaatttttttgttattcaggaaagcaagataaggtagccatttcaattcagagttaattgaaatgaagttctatattattaaaagaaatatatttataattttaaattgcttttatttaataaaacatcaacacttccattatacaaagtttctattagtatctgtaattaataaattttgactggccacagtggctcacgcctataatctcaacactttgggaggccagggtgggaggtctgcttgaacccacgagttcaagaccagcctgggcaacacagtgagatcttgtctctataaaaatttaaaaatgagctgggtgtggtggtgcacagccatttgggaggctgaagtaggaggattgcctgaaccaggaggttgaggcttcagtgagccgtgttcttaccactgtactccagcctgggttgacagcaggtctcaaaaaagaaaaagagaaattttgactatgaagttaatgtttcagtagttttatgttcatgtttcaggttaatagaattttaaaggttgccaaacccaactttgtggttatgaagttattggcaggaggacacaaaaaggaatctaaagtgagtacattgtgggaaaaataagtggtcttagattattgtgaagtttcataagttttgcaataagatgtgtaaatattacaggaaaaattaaaccactgaacaaaaatcattctaaaaattttagttcagcagcaaaaaattagagcttgccattttgtcttgagatgtgtattttgt

SEQ ID NO: 47179 - DNA, 1050 bp, Homo sapiens
agggctccaccctcaggcttgtgcccatggacctaatgagaacaaggactcctgtcttcttgcccaaatgttgcattttccaagaccactctggcctgccatgccacccattctgtgcctataaaaaccctgagaccccagcgggcacacacacaagcggctggacgtcaagaggaacacactggcagaagaacacatcgaaagacgctggcaggccattgatggtggaacgattcggacgccaagggaaattcggccaaggacagtaggagatcccggctgctgagcagccagactccagaggaagactaccttcccatgctatcccccttctggctccccagccatctgctgagagctacttccaccactcaataaatcttgcattcattctccaagcccacatgatctgattttttcagtacactagggcaagaacctgggatacagaaagccctctgtccttgcgataaggcagagggtctaattgaactgattaacacaagctgcctgtggacagctaagctgaaagaacgcactgcaacacacacccagtggggctccaggagctgtaaccactcaaccctagatgctgccgcggggttgaaacccatcctccccacaacctgtccgtccgcatgcttcccctaggggtttgagctgtggggcactgaagaagaaagccatacccccattgcatgccctgtgaaggggataagggaacttttttttttttttttttttttttgagacggagtctggctctatcacccaggctggagtgcagtcgtgcgatctcagctcactgcaagctccacctccggggttcacgccattctcccgcctaagcttcccgagtagctgggactacaggcgcccgccaccacgcccggctgatttctttttgttgttgtagttttagtagaggcgggttttcaccctgttagccaggatgatctcgatctcctgacctcgtgatccgcccgccttggcctcccaaagtgctgggattacaagcgtgagcaaccacgcccagctggaactcctccc

SEQ ID NO: 47180 - DNA, 1032 bp, Homo sapiens
ggaagtctgaagtttttaaaaatgaaatgtacagactcatctatcttgtataactgctattgtttttgccaaaaaatgagtgaatgattgttttttggaaaatttttcaagtcctgattttatgtctgccttggatgtagccacttcctgaaaacaagtcctaatgtaaaatggacatgtaggaagatgctgcttatatgacatcacgtgtcactgagggaagattgggagtggaggcaggagtttggtggcaggaaaatggaaatgggcagatatgtggcacaaatgcaaggtcattctaagcagtgaattactagtagaccagtatctaagatttaagactttacttggccaggcgaggtggctcacacctgtaatcccagcacttttgggaggctgaggtaggcaaatcacgaggtcaggagttcaagaccagcctggctaacatagtgaaaccctgtctctactaaaaatacaaaaaaaattatctaagatttaagactttaattggccaggcgcagtggcgcgcgcctgtagtcccagctatttgggaggctgaggcatgagaatcgcctgaacctgggaggcggaggttgcagtgaatggagatcgcgccactgccctccagcctgggtgatacagcgagactctgtctcaaaaaaaaaagaaagaaaaaaaagactttacttatatatctttagcagtcatctaaataataacgattcacttaccttataaatgtagtgagacaaagtacatagccaggaggaaagatgggtttttgaagaagtagagtacaagtattattgttaatgttattttacttttaggaaaattgaaaatgttcgtatttgtgtgtactgcctaagacttctgtaaaagctctctgtcaacggtcaggaactttatagagtattgcaactattgcagcagtccatctgcagcagtaatagagcagatgggccactggacagataccctggtccaaaacctggctctgcaacttgccagttttcttgaacaggccattta

SEQ ID NO: 47181 - DNA, 1035 bp, Homo sapiens
tagagacggggtttcaccatgatggccaggctgatctggaactcctgacctcaggtgatctgccctcctcggtctcccaaagtactgggattacaggtgtgagtcgccgcactggtccaacttttccttttcaccttagaaagattgtcaggatttttttttttttttaaacggagtcttgctttgtcgcccaggctggagtgcagtggcgcgatttcggctcactgcaacctccacctcccgggttcacgccattctcctgcctcagcctcccgagtagctgggactacaggtgcccgccaccacacctggctaatttttggtatttttagtagagtcagggtttcaccgtgttagccaggatggtctctatctcctgacctcgtgatccgcccacctcggcctcccaaagtgctgggattacaggcgtgagccaccgtgcccggccacgattgtcaggatttttgagaccttactacaacccctgacacctgacccacagtatagaattttccaggtgaaaaagacatgtagagaaagtcatcaatgccattcttttttttccccattcatgaaaatgattagattttcctttgagctgcctgtctgtctgcctagcacctcatatgtctatccaggactgggctgcctcagagaggataggtacacctaaagcaatgcaagaaaaaaagtggcggaaggataccatgggacaggcagagagaagaggtcagaatttagtgttgattcagttccgatatttccaccctcctttgagaagtttttcgaaattgttttgcctcctctgtgtaaagctcaatttttgaggccatctgtggtttatgggtaagcagcagaaatgtgtgtctctgggaaagtgatgaaaggctgcaacctttggagtgtaatatttaatagactaggaattacaagctgtttggctttataaaaacaaagctacaggcgctgcaggtatacgtatcctgtagagaacagacttttaatgggtgctgctcatgttggagatgctgaatg

SEQ ID NO: 47182 - DNA, 1023 bp, Homo sapiens
tcttctgtgcacttgggatgggaatatagaaaattgtcttcctagatattggctttgccattcaaagtctctacagtcagtgtgtgaactgctgggagtgatgccagaatctttcacagatttcattcctgggagctcttctggcgtcagatgatcgcggtttcttttccttctgcaccacagcacatggaggaggcctctttctcacttgctccgttcctttgccattcatggaggcagtggcaccagtgagctcacggccaggccgcttttgccctttttctgactaagtcactatagatggactaaacagaatatatttacagttcgcccatttagaatcgataagggtgtgccccaggctccatcgtatattccattacatacagcctcaggcatccgtttcaattgtttgggagaggaagtgaattagcacaagtggaatatctacaggatgaaacgttgtcagtctgtgcgttcctccccaccccttcgttggctggaagagataacgcttgacacgtatggagcagacagggtaatgtcagcctcgtggccatggagaagcaggaagtcccttggttttgttcagtgtgatttgggcattgaatgagtagatcctgttttaagaatattactcattaatatgaaccatcattttgtaggtcttttagaagcaacattctctttagtgcagataatgcttatctgcattgagagaagttataataacctggagaatgagaaggaaatacacatgcgaaatggcccagccggtttctcctggcaacctctccagagcatgtcctaggctactcctccaggaaggctcctgctctgatttcctgtattccttcacgatttggagtagataactggccacttggcattcttattacaggggacttatgcgtgggattattggcttcccctgtggactgtgagttttctgagggtagagaacatggccttttgtctctggtgttggttggaattcagctaagtgcacggtaagccatgttt

SEQ ID NO: 47183 - DNA, 1065 bp, Homo sapiens
acctggctgattgtgacaaatactaaatataaaaacaaaatgaagcaaaattgtagactgactgatgttcggaatgagaagaacaaggatgggttggacacgttggttggactcttggaaggatgaaaggaaagcagcaaacactaacaagctggtcatctcaggccaaccgtgtttctttgtctgagcacatcattgcactgatgaaacagaaattttatcacagcatacagggggttttggcaggtccctccttgcaatcactatggaaagagcatgaactgataactatacattcgggtgcctggttgcaaagaaaaatagcaagaaagctcattaatgaagggttgctaatgcagagagaagctccccagaattcacgttggcagttaatctgaagatatagatggactgctcatgaaatctagagttccttccaaaacaaattattgtgagattaaaatattctctttctgttggcacagcaagtgaaggcaaagtcatgggaacctggtggactttagaaatgcttggcctctcctcccgtggtggctggtgccaagtcaatctgtagctgattattgtctcgaatatgtactcaaatgagctgtgtagtaggccatctgctgtctcctcgactcagctgataggccctggaaaagggaaatcctgccaaaatgcaaatatcctacttaactgataatatagggagaggagatacaggctgtgggggaatgggggtagggaagggaatggggcgtggggaagaaataagtgactgtcttcacccttcctcgatgtctttccatcctcctgtgtttcttcctgttagagaaagaccaggtgtggatcagtagaccccgctcacaattggagttgcggggtcagactggaagtagccagggaattaggctcggttgtgaggatgctttttgtagcctcttcatttgaattcaagaacctatagcctcttggtttccactggcacgcttgccatggtaggagcccttgttaggattaagcttttctcagtgctggagatggagttgttgcactcatagggct

SEQ ID NO: 47184 - DNA, 1047 bp, Homo sapiens
gggagagaggaccaaagcacaccttcccaagaaaactggacttcagaatgcttcaaaaccaaaaatatgtaaggaaggaaaaaggttttgtggttaacagcaaccccaaaccatgtgaaatgccgaatgctattgcccctcgtggaaagggccagttagctgagtcctgcatagagcaccctgttgtgactctgtttacctacttttgcttaaacttgcttggccatgactccctttctccaagcagcatctctttatatgagctccagagacccactttgggaaatattcttccagatggatcttggaccttcctcctgcaaagaggtatcataggaacaagggggagtgaatgaaggcacccactgctatctttctaatctcccctcagtttaatcctcagccgctctggtttgtaaatttcttaatgataaagaggtatcttgagctacctgactctcagcatatttggtttccttgtccccacgtgcaataccaaaccagtgcgtggagcccgacccacgctggccttgggtcctcggttatgccaccttcttctcctttgcagtcttccaggagaccttgtccttgggaggatgctttcgccaagggaccgacctctcctctgctctccttggcccattgcgctgttcgcccttctctttctgcatctctttcctacctctgtgtgttgttctggttcccagggtgacggactgctgtttatcccctcagtaaactctgcttctccctgttggtgccgtggcaacctgagctgcttgctctacaaatcacagcccatttaaccgagcccttgtattagtttaaaatagtttttggagggttgtacttttttttcatgataataataattttttaaaaatcaccgctttgcttttttttttggtaaaaagtattgctttcctctgcctcgtagcttcttgaagggcagaaagagaataactccaggtgtgggctacattccaagggaattgtgtaccacttggtgctgaagtactgagttcccatacagggtttgccttcatc

SEQ ID NO: 47185 - DNA, 1099 bp, Homo sapiens
cttcagtctccctgtctctgcttctctctgggcgctcacgaaccacaatagcacacactcagacttcctcaatgcgttcttttgctgccacatttgttctctcttttctgagctcgagccagctcttttgactttttgaacttttgtctttattcacaaaggtaatttcaagagctcttgtgggttccacttctggcatcccgctcctcagatacctactattaggcaagagcagagaagtaaagtgcatttggcagcagtctctgcctttcaaagcagagctaaatcatgtaaaataggttattttccatccaggcattctcttgagaaagaaaaccctgtgtgtgtcttcccccatactctcacttcttgccagttcagttgaaaagtgttcccttaatgttattaaataggtattttcactcactgaagtggattatttgatttctgcacggtcttaagaaaaagtgagacaataggagtcttacaaacaaaccctatgtggtatctgtgagctcatagatctgtagtttttaggatatagtcataactttagtatctgccatgatgttctccatgctgaatacatgagctataagtaatatttggaatctctgtttatctccaagaaagacccatgatcgtggttaaagtttgggaaactgaggcaatgctgcttagtcacagctccaggcaggtgactattcttagactccttcccagggactagactcttctgcatcactctctggggtggtgcaggtcctgcaaattgttcatacttcctcttagaaactctccctgatctcatatcttcttcttcctgttttggccaactgcttccccaacctgcacatcaagcgggtgtaatggaagagaactttgtggaattgcggctttagctgtcccctcacaggtactggttttgcctcttgcccagttccctctcttcgctgctccagtatgttccccatccttgtcgtgggctccccggcactgtggctgccgccatcctggccaggcagctgcctctctccacccagagccaagtcccttccaggccctgggactgcctgtttggtggtcaggctccactcaa

SEQ ID NO: 47186 - DNA, 1028 bp, Homo sapiens
cattagggatgagaaggatgagtatatatgtagggatgaaggaggatgagtatatatgtaagatgaaggaagatgaatatatatgtaggaatgaaggaggatgagtacatatgtagaaataaagaaagatgagtgtacatgtagggatgaaggaggatgagtatatatgtagggatgaagggtgatcagtatatatgtagggatgaaggagattgagtacatatgtagggatgaaggaatatgagtccatatgtagaaatgaaggaaatgtagggatgaagggggatgggtatgtagggatgaaaggggatgtgtacatatgtagatatgaaggaagatgagtatatgtgcgtatgggtgaggggggatggagtgaatacatagggccttctgggcatcagttgataagtcctgacctagtgggatagggactctcctaacctttctaatgtctaactgaaggacttggttgcctggacagccatgacatggactgcttcataacaagttgagatttgaacagggacttgtgagaagggtcaatgatgaaaactaagaggatcaactagtgctctccttctcccagtcttgatcagtcactacactttgcagtcctggtccctaactcttggggttccagggttattcattgtccttactcctgtggagttgagtttctgaggacgcaaatactgaataaggcacgagatgaccaggccagagaagggcaagcctaatttccattggctgagcctagtaaacaagcccagttcaagatggtgcatgttctagccttctatggctatgtaaaaaactatcccagacccagtggggtgtagcttgggttccctgggaagcagactctgagatggagaagagtgtgcatggtgtttattaagaactatacttaggatcaagatttggagaagaggagaagggggcaggaatgggtttagtggcagccccagttggccaacagggagttctggggccagaatgacccttgagagttgccccaggttgggctg

SEQ ID NO: 47187 - DNA, 1031 bp, Homo sapiens
gccgtggtagggatgaggaagaccacagcactagattcccaaaagtccttagaattaggcttaaaatagagagagagcaaccatttctctttctcgctctcattctttaactgtacttttgccttagagagtaaatgcagagatgtttgttctatagactaagaggtcccccagctgttcacttccaacagctgttgcgttttggttatcacattgtctaccatcactgcttatgtggcacaaaggacacagagcaaggcccctgcagtctgtgcttctctgagggtgatctgcaagggtcagatcaccttctccaaacagcagagaagaaaatatagagagagaaaggatgtggggtgtccagctctgtagttcaataatgaaacatggaaggagaatctctatatcctgttgtcttgatttataagacctttaaaattattctttaagcaaatacaacccattctgctgtaggattgcccaccctgggagagtgtgtgctgatagcaatgaacacgatctcgcaggctttgtcgtttgtactcatttgacaattgttacataagctgtctctcctcctctcaccctgcctttttcctccccgccctccctttttttttttttttttttaaaaaaaagcaatccgttcgcttgatatcactgtgccaaagattatccaggtcattcctgtccagaagtaacatgagtgttgccagaagcgatgatactctggtaagcaaacccgtgagccctggtgctcctttcttagcactgggtactcagaatgaccaagctgttctatttgttcaacctcccaggaacctgaagttgtggaaatggcaagcttattcttgatcccctcggaggggtttgggggtgctgattgatgcaccctcttgcttctttcctctttttttctctttgatttggatggtgctgtcccccctcatagccccatacctctaacactaccctccacctcgatgcaaacataagcacagaccacccccgcaacacacacacatacacac

SEQ ID NO: 47188 - DNA, 1035 bp, Homo sapiens
tgagttgtgattaaacctgtggacctgaaaggtgtcgctattggacaggaagacaccaacatgtgctttgttcctgcgtcttaccttcctgtcctggacaatcaagtgaaataaggattgcacagccagagaaacacaccgagacgtgctctttgtccacctggcttgcttctcacacctgctatgcttgtttctgcctcagacccacggaattggcgtatggaacacacacagctctccttttcagagaaaagaaactaatgcatttttctccaacaggacggaaagacggcagaagatcttgctagatcggaacagcacgagcacgtagcaggtctccttgcaagacttcgaaaggtgagaagttctgttataggtctgaagttctctacctgtgtttatgtgaaaaagtctcagtctttttccttatttgagaatgagcaaaatgaggctctagacagccaggttttaggaacagtggtccctgtcctgtggtttacatgtcagtcggtataaatgcatcagctccctatctgttttcttctctatttggacttggaaatcatttagcatgtttgcagttgccgtgcctggttttccttctcccactctctctataataaaccactcccacaaagtagcgggggatgaggacgctgactctgcctctttccttcttatgtttgagctccaagatggctgttaagctcctatttatcaaacattgttgctctgaggcttaaagaaacatgacaaaaataagtaaaggcaggtgcaccctttccagcctacaacatgacagttgtgtcaggagacttcacaatagccataccctttaatctaggaactctgttttatgcttaaagatgttcactgcagtattatttataatacagtaataaaaattggaaacacagataacccacgataatgtctagtaaagggtcctacagccatagaatagaatggctttggccttttaaatattttaagaagttttactaataggagtttattgcttggggtggggggggg

SEQ ID NO: 47189 - DNA, 1094 bp, Homo sapiens
gacaggcctcatagctttaccgagtgcataagcctgcttggtcaggtgtgctcaggtttccacacagagaggctgcaaacccacctgcagcacctggcacctggcttgcatccctgagtccccatgctgtgccctcccaggtgtatgatgccctggctcagctcacacagcgccagcacttccaccactaccgccctctggaaatccgcttaccacattcactctcaacttcgagtgctgtttaccatctaagaaactgtattacagagcaggggccagggggacctgcagtcagctcattgtgaggcggacactcagctgcagcaaggtgacctgcaacaccctgtcaggtcactcgggaaacccacctcatgcagagggaggaggcgtctcgtgggctgtgctgtgttctgctgcccatgcccccttagcaatggtcccttctttgacttaaaagtagcttactgtgcgagatgcaaacccactgtttggacgagtctgaaaacagtgaaggaatgctcagaaaaaggaccgagggagagcagtgttgcactagccggggatggtcggatcggtggtgggtggaaggtccttctcccgtcctctgtccccgttatctgcagcctgcttagatgactggcatagtgaggagtagagatgcaaagcaccttgctgcggcgcttcctccaaatcctcagtgaaaggggcttgttcccatttagaattctgagtttctgggggtgggctctcaccctgtctcagtttgggattttcttttcttctatccattggtacctttgtttttggtgcctagatttttaaaagagatgggaagtgaactattacagctataaaatacaaaatacaaaaatataaaatatattttatagtttataaaatagaaaaaactataaaatacaaaatattattttgtgttttaccattatcctgtggtctttttctctaaaggagaggtcaaggaaaagaatagtcaccttttttttctttgtttttttttgagatgaggtcttgctctgcggctcaggctggagtgcagtggcatagtcagggctcactgcagcgtcaaactcctg

SEQ ID NO: 47190 - DNA, 1050 bp, Homo sapiens
tgggaggtggttgtgcaaatgcactctccagtctgagtgacagaatgagaccctgtctccaaaaaaaaaaaaaagttcacatattagatggcagaatatatatctgcaaattgtcagtactgtcattataaattattagcctttgcacaatcctgtgattagatgggtaacatatagctgttcttgcttctatgtaacgtgaagaatatacaagccattctaaatatacacatttctctattgtgaaaaatgtcttatggaagtaaacccagaggtctcattgaagagactggagtcaattttcagtttcagattaactaatagcatttcacttcctgggatgatttataacagtggtgacttggaaatactaagctgcacactgctgagtgttgtggttctaactcatgttctccaggaggaggacagcagtaatcaagtcttttttttccctttacctttgaaaggaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggtaagcatatttttctttgtagaaattgatgcagaaaaagagtatcatgacatacgagcatgatagactctggtttgcaagtaaagttcagtgtagatatttaggtgcttagcatcatagttgttcattctgtacatgcaatatttatacctgatgtttccatttgacattatgttgcgtatatctccatgaatataagtacttcataactttttataaatagctatatttactgtgtagtttaatatacttaaaatattctgcaattgttggatttttataatttttccaaagatttttacttctattattaaatccgaaaagagccttttgattcaaggattttagtgttctgtgctatttttttagattgatatcctagagtagaattacaagcttacaaagaggggtctttttttc

SEQ ID NO: 47191 - DNA, 1044 bp, Homo sapiens
tatcaagtacaatgtactgtacgtaattgtactatacttttttttgtttgttttttgagacagggtctcgctctgtctcccaggctggagtgcagtggcaggatctcggctcactgcaacctccacctcccgggttcaagcgattctcctgcctcagcctcccgagtagctgggattactggcatgcgccaccatgcccggctaattcttgtatttttagtagagacggggtttcaccatgttggtcaggctggtccagtactcctgacctcgtgatccgcccacctcgccctcccaaagtgctgggattacagtcgtgagccacagtgcctggcctgtactatccttttttttttttttttttttccctgagacagagtttcgctctcgttacccaggctggagtgcagtggcgcgacctcatctcactgcagcctccgcctcccgggttcaagtgattcttctgcctcagcctcctgagtagctgggattacaagtgtgagccactgcccagcctgtactatacttttgtatgactttgaacacagtagttttgtttgcagtgcagtgggtttgtttacaccagcatcaccacaaagacggctatgaaatcactagacaataggaattttttagctccattataattttttttgtttgtttttgagacagggtctcgctctggccaaggctggagtgcagtggtgccatcttggctcactgcaacctctgcctcctgggttcaagtgatcctcacacaatctccctagtaattgtgactacaggcgcatgccaccgtgcctggcttgtgtgtctgtgtgtgtgtgtgtgtgtgtgtgtgtgtgtgtgtgtacgtgtacgtgtagagatagggttttgccgcttgcctagtctggtctccaacccttggactcaagtaatctgcccaccttggcctcccagagtgctggggttacagatgtgagccactgtgcctggctctattataatattatgggactaccattgtatatgtgatccattattgactgaaatgtctctgtg

SEQ ID NO: 47192 - DNA, 1026 bp, Homo sapiens
cgcagactcggttcactgcaagctccgcctcccaggttcacaccattctcctgcctcagcctccccagtagctgggactacaggcgcctgccaaccaccctcagctaatttttttgtatttttagtagagacagggtttcaccgtgttagccagcatggtctccatcttctgaccttgtaatccatccacctcggcttcccaaagtgctgggattacaggcttgagccactgtgcccagccagtatatactagaattttaaaaaatcttgtgtgtttcttatgattagagcatctgtctattggcatttgacaaagtaactgacgtttagtttcaatctgttaataagtactttctgcctatcaaacctgttttttaccttttcctgtcctttcttgccttcttttagatgcttattttttatgtttgttctgctgttctaacttggaagttacttaaacatgaatcttttactatcaaaatctaatattatttgatactttcctcctctcctggatactctgttgagctcatttttattcacattgtcattattgcattgttttaattctgtctgtattttatcttgacaggtttaatttgtattttcaatagccatttagatttacccacaaaatttatccttttcatttcctaactagatcctccatcttgtaacattttcttctgcccgaagaacaccctttatgcttcccaccttttgtgtaacttctagtagtgaatttcctatgttagtctagacatgcctcaaattgatcttcctttaaaaaaaaaaaaaaaaaaaaaagatggagtctcactctgttgcccaggcttgagtgcagtggcgtgatcttggctcactgcaacccctgcctcccagttcaagccattctcctgcctcagcctcccgaatagctgggactacatacaggtgtgcgccaccatgcttggctaattttttttgttattttcagtagagacagggttttgccatattgcccaggctggtcttgaactgctgatc

SEQ ID NO: 47193 - DNA, 1022 bp, Homo sapiens
cctcacacccctgtctcccacccccatactctgtttctttgtgtcccattagacagatgggccatgctgtctaaatcttctgtgaaatcccagcatccacccttttctgatttctagcagcaggatgctttaggataataatggggatgtcagacagcagctgtattgtgttccagttgatcttggaagagcttcacttttgggtcttgcacatgtcccaggcttctttttttaaagagtctatcacctctttttctcctttctactttgtcatgtcctaagaacccaggtcttaggaaataaagttaattgctttgggacaaaatgcactttagctaatacttttgcttaaaattttatgtttaatggctcactaggcataattttgctctcttgatgctctagtaatgaactgtttcactattttacagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggtaggcattgcggttctacacatatttaaatatatactttaatataattcatttcaaacaagtgtaaaattgggtactttcacataatagctagtgaaaaactttgtcatttctagtatgttatacacatatgcatatattaagaagcagatttaagtttcttgaaagggaagtagtcacatgaaatttctgtataatcctttagcaggttataaatgtctagtaaatttagcaagtgaattgtaaatatctgttaataggattatagtaaaaggagttttttccggaagagttaaagtgaggtgacatgagttggatttagtgagatttagtgtactgagagcaacttttaggaagaaagataaacttggaatttcttgt

SEQ ID NO: 47194 - DNA, 1035 bp, Homo sapiens
ttgcaaaaatctagcgtttgtattcctgaactttacctgaaagaattaccagaggatgtatctagaaagacagaatatacatgagaaaaaaatgtgaaaatactacgcaaaaagcaaccaaaaaacctttcttgtttctaaattaaaaagttactaagatagtagcaaaatgaaaataccaatttgtaacaaaagtctacatttcagcaatgcagtagaattagccaggtaaggttttaagtttttcttttactaaggattttttcttgtttggttttagtgttgctttggctgggggatgaaaagtataggttttgattaatcacagattttaatagaaaaatgaaagtttaggtataatatatgcaaagttaaagataattgttggaagactagaagcaagttacatcatttgcgttagaagctttatttagtgaaaagaaacttcaatcattctagtggcacagatgaaggaagagaggaaagtgaggaaatgaaaacagaagacaggtagacaacacagaacaaaatgttaagtatgagactcatagtatcatttaccacagcaaaggctaactcttaataagaagatgaggaaataaaatcagttcaaaagggaggaatatgcattcccagaattaaaggaccccgggtccagtttgaggaggactcttggccagatacaagccccttgtataatgctcaagagggaggagaccttatttgctccttggaggtgtctagtatgaaaactgcttattttgaaatgtgattctagccattatcaggagcaactgcagataattcccatttacagaggaatgctgctaacaggtgtgggagggagcagcgacaacgaaaaattctgctgtcataggtcacgtttatgttggttttcttgaaaatcaagggtagaaaatttcatgcctctagagagagagagaaaaacacatgaggagggaagcggggaagatttatattaaggaattggctaatgcagttgggactgaacaagttcaaaatctatagggtagg

SEQ ID NO: 47195 - DNA, 1122 bp, Homo sapiens
gattttattagtagggtgggatacacccaaactaatattacttttttttgaagtatttattttgaaatattttcttattacagtgatgctgctcttgtttaaaatattggtttatacttttagaattgtctttataagtctataccattaaataataaagtttcagcagatctagacttgggaggtaggaattttgggatcaaattgtcacaggaagaaattagttcagtctcctcgctttgtttttcttcagactgtgccattgtgtccctgggatataacgagtttccttaggaagttaattctgccttagtagcaagttattttgttttactcttctctttagatatcaaatgctaaatccttgctcatctgtataaatatggttcagttttcaaagaaatctttctttaaatttaaatctttattattactcctaaaagtaatattaagtctttgttattttcaacattctcatctattcttaagtgtgactgatcacctgctcttcctcttgatgcacatcctacatttcttcttgatcatggcattaatccatttcccatataagaaactttaacatattaaaaatcttaacagcagaattttagtctctgccccttctgagacgacagctagctcacttgaaggttcctgcatattgctgcatgacctgtggttgttggtccttttgtcatcgaaggatagaaactgtacaagtatctctggtgatgggactaagggttccatgttgtttgtagtttggtattatctctgtttccaacaatagtaattttgtaaacattcaagcaatataaaaagaaacccaagagcttttctgtaaatcagcaatatatatgcctaattcagctaatagttgttattaattttagtattcgtggtattaggttggtgcaaaagtaattgcggtttttgacattgaaattgaaagtaatggccaaaacagcagttactttggcatcaacctactttagtctaaaaaattacttgctcttcacttacgttttacgtcggaagcaattgcttcaggcagtacattagagtataattaaaattatgtttttcttaagctaaagttagagaaaaaagtcagtcagccag

SEQ ID NO: 47196 - DNA, 1050 bp, Homo sapiens
attattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgac

SEQ ID NO: 47197 - DNA, 1136 bp, Homo sapiens
tatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaactcctgactgtaaagtttgtgctgatgagcaacatgtgatgtgttaaacttgattctgaaaagttttttgggccaagtaaccttttcaccacatgtaaatgtcagatatgcatagaaagaaatagaatttttatttgataacattcaataatacctgaaagaagaggaggcagtcatcaatatcacacatatattaaatattgaagtttgcaatttgacattgaga

SEQ ID NO: 47198 - DNA, 1050 bp, Homo sapiens
tatttattgcatgcgtcgcttccacaggggcccctcaagagctgtgactcgggagagctaccttactttgaccaacagcctgcccagtgtggatgtctcttacagagggggcccaaggaatcaccaccccgcttcagtgtaaacaacgtgccttgtccactttgggctccagagtctttcagatgtactaagctgctgacatcatccactgccttctgctgcatcctagacaccctccctgttgttcacagagagggaaggtcgtgggccacacaatgctgtgtgaccctctccgtgtgcctctgaatggtgttttgatgattttacactacatttcctgtgcgtagaatggatgcttgtatattcgtacatctctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtccctgcgtaattttaatcgtattccaaagcccaattatgtgatggttttcaggtttctgcaaattacagaagagccagccaagatcacccaggagcttgtgcccccagatgggccaaagaaagagcctatgaaggagaagcagaagcagacggctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgatcgtgactatca

SEQ ID NO: 47199 - DNA, 1047 bp, Homo sapiens
tgtggcccacgcttccggcctcgaccgactacgtcatcaccaaaccccgtgatacctcactccaccttcaggtcctccgtcccaacggttccgtgtcctggaactttccacgttcctgcgcacgcgctctgcggcccttaacgtcccgacttcgccctcctctggccacgcccctgcccgttaagggccctgccacccccgtgacgtacctatcttccctcgggcaacctcgcaacagatctctgattggctgacccaggaagcggactttgcgaggcggcggcgacgataggctggcagccggccgacttccgcagaaggtgattggtcggcgctgctgtccaatcggcggcgggctgtcggattcaaatccggatcgttgggactgcggtcgttagtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggtgggcgcctttcttagaccccgagccggctccctcagccggggcccccgcgggcggggcgacccaggcatagtagggtcgggggtgggggccggggcctggggggcggagcccggggccggagggcgagggccggggtttggggtcgcggccacctggcgccccgcgcagtcggacatggttgggtgcctggccgcgccgggccggttgggcctttgttcggtgtgcgcggagggtgagggaagagtgcccaccgggccgcatttagtacctgggtaggaaccggcgcaacttgggggtcatggggtcctcggcgacgcggagtgaccatcccgtcacttttttctcggccgtggccgaagtaattaggccgttcagtagctggtctcagttccagttctttgaaccagtccaggaaaacccacctggtgccgtcctttttcctttagcaaccgtgacacactttccctgtcgctgacggggtgatgcagctttta

SEQ ID NO: 47200 - DNA, 1047 bp, Homo sapiens
tgatgaaaactctacaaattatggtagtaagctatgacttggtggccttaaggcaatctaacaacacagtagaatttttctgaggctcactttgccctgcaaataaattggtacttaaccacagactaaaatttaagttgatgacagctgggtgcttatagcgggttagggattcagtttactgtgtctcagaaagtgaccagattgcacctcattcatccccagccagctgactcacagacagatatcttatactggttaaaaatttgggttggtggttatggatggttcagtataaaactgttgctactactgcaggtggtaaacatggagctgagaattgtgactttcataaagtcctttttatggtaattgagtaaaaattcttactcaatttggggaaagagatttgttaggcaaatctttgatagaatgctttgggatactgttaatgatacagatttgtttttgagaatctcgtaaggctacaattatacatattgatggtttaactttgaaggttattccatgcttgcctaagaaactgaacaatgtaagttttggatataggtcagtaaattaactggaaaacggtgaggttgcacacaatgtgtatgtacagttagtggttttctgtttttaattttgaacaaagtacttgaagtataaagcaacttctggagcatacaaggactagtagctactacaaagctagtgttgagtaagaggaaacccaaattaactgtaacttagattttttcgttacataaaagtctaataatctggggcagggataacagctttacagtcaaggactaggctgggtccttacctcttgttgctttaccgttctcaatttacagttgcttctatggtcctagattcctgctctggctccctgatcatattaatgtgcattcaacaagaaggagaaaaagagttcagcatgttctttccctttgagaacacttttcataataagttacacattttcttatatcttgttggcttatgatttggaggctggtaaccatatgttcaacttat

SEQ ID NO: 47201 - DNA, 1056 bp, Homo sapiens
atgaaatgtggagggaagggcaaagaaaggaccaaataaacgtactcctcctttttaaggttaacattttaaaatcttgttgagcgaaggggaggggactagcaaccatagctgcctctgtgtggataattttttggaaattgttgacttttgctttccacctttttactttatatctgttaatatggagatgaattttacacatttcaggcttaagttcttctaaatttgagttgaaagaaggcttacatttttccttacattttctttttccttctcaggattcattctctaggtttacaaaatggcttcctcttgcagctgaatttagacaaaaaaagtattaatctttcacataattgtgtagatttatttgtagatctgtttttaagatttgcatcaggtgtagttctaatctaagaatcctaatgcttttttcttctttgatatgattctaacttgtttccttttatttgtgcctgcatgatgtaattgaaaatagtttgtactgtatataaattctagaattatatttgcaagaatgagaattgtaatgaataagaaaatgattgagttgtcttttgtgtttaggaaatactgaaagttgtatttttttgacgaaagttgaaacactacctttatatgctggaatttggtctttggtaggaataccctatttttccactgtatttcatccactgtaaaggggagtttggcatgggtctcacttgagttgttccctaccttgagtgtctcacataacaaaatacaaaaatatatctcagtgacaagagctcaaagccatctgctaggtggtatttagttactcaaaatagtggtggaaaacattcacatggctaaaggaacattttggcagtaacatgagtggagactaatcagagactcaagaatgggcagtgctgaatttaaaaattagttttcttggccgggtgtggtggctcatgcctgtaatcccagcactttgggaggccaaggcgggtggatcacgaggtcaggagttcaagacgagcctgaccaacatggtgaaaccccatc

SEQ ID NO: 47202 - DNA, 1033 bp, Homo sapiens
gatcatacatgagaacagaagttgtaaatggggctgttttggggaatggatgttaaatttgggatttatacgtgctgaattgggaaaaagtgaaatagtaagtggaaatgacctgaaagttggagatggaggcctggactagggaaggtgctggattgtttatatttatgtcaagtcctaagcagaaagataagaggttctgacccagaatgtgtcagatgggtgagataaggagggtgtagaggagactgcactagggaaagagacagagatagagccttggagggcaggtgagagccaggcgagcaaagtccaggccagggagcttttcaagtcatgtgatggtcaagccagacccaacgggtgcctggagggagaggcaagaaggaggtcctgggagacctggaagccgttggtgggaaaggggcaaagggaagtggagccaggagaccagcaggtattgcacaattactcagacagtttgattttagtatggatggggtagcttaggacagtgaatgagaaacaggtgtgttactgtgggtttagggtcatctgggccactcctggcatctggaatttcccagacatgccatttgaagccacgccagatgctgtgagttactgctttgatgttttgtattttgtgttgttttctgcatgtaattgtgtttgcactggatggaaatggaaaataccaactttccagaggaggaaggaccagtgaggggacagaaacccaaatgacttacccagaatagaaaactggattgtgattgagctaggaccccaaccaaggtctcctgactcctggatgaaaatttcctggatgacagcagccgtcaaaaccaatggaacctgtccctgctttcctttttagctacatttcatttgtctgttcatttatctatttattggacttgggacagtctttttcacatttttttttctgtcaactcatcttttatgaagaacagattatccaccttcagtgacacttgccccccactagcttttctcaactacaaacaaa

SEQ ID NO: 47203 - DNA, 1039 bp, Homo sapiens
ctttttcattttatctttacatcagttttttgtaaaaagaaaagcacagtttgtatagttttataagtaaacttacgaattttgaactttcaggataattttaaaaataatgtaaagaagagccagcttccagtgcagttggacttggggggcatgctgacagccctggagaagaagcagcactctcagcatgcaaagcagtcctccaaaccagtggtagtctcaggtaagagagtctttccatctcaggcaagtgattggaagtctttttcagctagattattatgttaccattttctcttgttatcaaaagttatttatagataaaacagtgtgatgctagaataagcatagataaggacctgtggaatagaattaagagtccagaaataaattcatggatctgtgaccaattgatttttcataagtatgcaaagtccatgaatagaacaaagaacagtctctttaaaatggtattagaacatctagatttccacatgctaaagaatagtcatacctcctacctcacaccatagatccaaatgaactcaaaatgaatcaatgagctaaatataagagctaaaactataaaactcttaaaagaaaacgggtaaatcttcatgatcttttattagacattggattttcagatatggcaccaaaaagatgggcaacaaaagaacaataaactttggacttcattaaaattaaaaatttttgcataccgaaggacattatcaagaaagcggaaagacatcttacagaatgggagaaaatatttgcaaatcatgtatctgataggggattaatattcaaatatttaggaactccagctgaatagcaaacaatccaatttaaaaatgggcaaaggactggaaaagacatttctccagaagtacacaagtggtcaataagtgcgtgaaaagatactcaatatcattagtcatcagggaaataaatattaatcaaaagtacagtgaaatactatttcccacctagtgggatgattataatccaaaaacagaaaataacaggtgtc

SEQ ID NO: 47204 - DNA, 1044 bp, Homo sapiens
cagaggtgaggatcctcccttcccaccaggtttgatctgtgtgatgctggatggtcctctaacttgaagtggtcatgagaattaacaccgctagctgcacagctgcttaccagcaagtattggagacgtgggggcgtgaacacaattgtgtgtttttaaggaaacttcatattcagttatacattcagaaaagtgcacaaatatcagtgtacagcttgaagacttttcacagtgaccgccgcattcagatcaagaagcaaaacacagcccagcaattgcttgtgccctcttgtcagaggcctcccccaggagaccctgccccatggcaaccccaccaggggctgtggctgtggctctagtgcaactgtgtgttacgtgctgctctctttgtcccctttccttcagccttgctggcaacatggagatgccgtttattttcattactgtgtaaaattcggttggacgaatgtacagggttgcggatgggcattcaggcattttccagtttgggtaattagaaacagggttgctgcggacagtgttgtatgtgtcttaaaggacacaagcactcgttcctgtggggcattacctgggagcagaattgctttagtagctcctgcccaatgggtttctgactgttctaccagttacagccccagggaggctgagagttgcaggtgctccccatctctaccagcccacggggcactatgtttttcaaccttgccattcttgtgggtgtggtatatgttttttcattccttcatttggtgatctgttactgcaattgcattttgatagtcggtagaagtaactagttggggacagtaagctatcactgcatcagatctggtgtgtttaaactaaacacacctcttgagtttctcatagtttagatgttggagttcagctctttctaaaggattatttcaaaaagaaatggtctcaagcatttgagaaaaaacttagaactaaaatcctgttttttaaagctccctgataagagattcttcaaaatcaaaaaataaatttggccactgaact

SEQ ID NO: 47205 - DNA, 1029 bp, Homo sapiens
ggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattattaaattttgtttcagactctggtgattttaggcttctcagtggtctctgtcttacttgatgattcctatgtcttaatttacctcctttggacagtctgggccctgaaataaaagggggccgcgtagtgggggttctgctatccccagcactcctaggtctggaagtagtgattgtcaaagcctccagcactgcacagacctgccggagccagatcctggctcaatcccaacctgcacttgcgttttcaccacagccaatggcaggaaagaattttcactgctttttgtattgttttggctttgaaagtgctcttaattgaattcagtcttggcaatattgtacctcttgagaagcggcctgtgatgagcacataaaattggaatagtgagtcagaaatgacatgctatgagcagg

SEQ ID NO: 47206 - DNA, 1062 bp, Homo sapiens
aagtgttttaagtgagaaatctttgtcagttgaaattattttatcaaatcatttttgttctgaacggcacttttgttttaacgtatttagaaaactcttgcattaaaacagaaattgatttgtattatcccctgtatttgaagtgcactttaaagtgtatttgaatgagagattataatcaaattacttgatttgtgtcttatcctcttactcttctaccttggatttgaaaaggttggatttgaacactaggaaaaaagagatttttctactgagggattgtgggaagatttttttttaagcctctgtatttgaagtgaaatataaaataggattttataatagtcttaataactagaaagttttaagctaggataaaaatggggtgtatactttaggtctttatctttcctgagagatgaaattggtagaaacgttattttattgctagatttcactttagaaatgaatcaccctgatctttgttaggcccctatttaatattctaaatgcaggtctaatctctctgcttttttttaatggaagacttcttagtagaacttcacttatttagcacattgtttgcccatggttataatccaatatgcttgtgccaagacgtattttggaattcaagctttttcagaatttggaattaaaatttagaatctaaatttcagaactgagaaagacattgctcagaatttagaaaggtaaacatacatgttgaccctgctggttacatgccattccaatatagtctggagagaatcctgtaattccatgcattaatatttctgtacttttacatttaagaacatgaatattctcactaagtggaataaataaagactataaagagctgtgtgtctgtttagagcaggtgttatcactacgagagcttctctaagacttaccaaaaaaaaaaaaagtgttgtttttcagagctttttagagctgcagctgagggactgagtctgtattagactccactgaactacggtttgcttttaaaaggaaagtgcatttatgttgttcaatacttcacactttccagtaatt

SEQ ID NO: 47207 - DNA, 1051 bp, Homo sapiens
gaggctgaggcaggagaacagcgtgaactggggaggcggagcttgcagtgagccgagattgtgccactgcactccagcctgggcaacagagcgagacttcatctcaaaaaaaaaaaaaaaaagttaagaaaaagttaagtgtatattgaatgcacaaaatatatgtagtctattttttcatttactaccataaaatgtgtacaactctattattaaaattaaaatttatcaaaacttacacataaatacttatatgccattcacagtcgaggaaaatgtaaataaatataaagatgcagtattaaatcataattgcataaaattaactgcagtacacactgtactgctgtaataatttcatagccacttcctgttgctattgtgatgagctcgagagttgcaagtacctgcctaaatcactgtgtgatgctcatcatctctgtgtgagcagttcatctctccagtaaattgcatattgcagtaaaaagtgatctttaataagtgatctcttgcagttctcaagtatttttcataatgtttagtgcaataccgtacaacctgaataacaccatgggtcccatgtgaagggtcacagtgaggctggaagtgctcccaagaagtcatgacattataagaaaaagctgaattgcttgatgaggattgtagatggaggactgtagccatggttgcctgccatttcagatggatgagtcatcttgtaaacagatgacagtaaatttatggtattgataaatacagtacagtattgtaaacatatattctattccttatgattttcttaatgacattttcttctctagcttacctcactataagaatatagtatatgatacatataacatgcaaaatatgtgttaatcagttatttatgttataggtaagccttctggtcaacagtagactattagttaagttttgggggagtcaaaagttacacatgaatttttactacagggtgggtggtcagcatccccacattgttcaagggtcagttgtatattcactgtggaaatcctaaaaagcaaagagc

SEQ ID NO: 47208 - DNA, 1051 bp, Homo sapiens
gaagtgctcctttccatgatagctctttaatacattagttaaaacgattcccaggaagcccttgttccaagtatgcaggatcagataaaaagcgcagaaaccctcagagcagggaccgacggtgagtgcagtttgccctcagaggccttggtagtcaccccttcccaacccccatgccaccactgaatccccatgtggcttgttcttatatgccctgcagctgaaattcaggtgccctcctgaccttccttcccctgtccattttgaaaagaaataagcagtgtaatctttgagtcatcccttttgtactagccaagttccaggtgcagcatgacacactcgttatctccacctctcttctccccttcctttccctcatgtctgcacacactcccatcccctcacttcttccccctacagcccgcctctctctctctcacacacacacatacatacacacacacacacacacacacacacacttgagaaccgcggctgcatatcatctcctgtggacctgtgcacaacctgtggggcccaacttaaagtactgcatccattctccgtggtttatcctaatttaggtttgtttcctggtcatatagaatactgaagtatatgtctttaggaactgtctcaatttcttagagaaatgggatatacgtgaataaaatttttatgattcccttatactgagtcccacttgcactgcaaaggattaataacatctgtttccaaagcaaggcgtcacctgccatgcaagccacctgctggggaggggaggtgaagggtgtgagcattggtgagaggtgttgttctcatgttcaaggtgacaggtatgttatctggtgtccccaggctgggtcccacccagggcctgctcctggacgagggctgtatggctctgatttgcacacccctgattctggtggacacaaccctttttcttagaaagccagaatcactgtatcttctagtccttagctgcataaaaaaatggggtgcaaaacttctctggactgtctattcttattgttcattggtttatcct

SEQ ID NO: 47209 - DNA, 1031 bp, Homo sapiens
tgggcaccttatccactgctgtataacaaatcaccccaaacttactgccaaaaacaccaccaggtgttggtttccctgccgtcctgctgtgtgggcagggccaggtaggcagggttcagtgcgtctgctcacacaggggattgcacagtggcccgagggacaggaggaccgtttccactctgctcactcacactactcagccactgagcagctggttagacacagcccatgctggagacctctgcggggctgtcagccagctcacctgcacatggcctctccttggggcccttgggcttcccttgggcccatgcttcccttgggcagcatggcagctgcgggctgagagcagttacccaagaggcaggaagtgggggctgccaggcctataaaaccaggcccagaaactacctcagggtcacttccacctgatcctattggtcagagcagccaaggccaccagcttcaaaggatgggatagatagaaccacccttttgaggagaagtgtcaaagagtcaaagaacatggggccaattctaaaactgctgtagatattaaacagcataccattaaaaagtaaactaaactaaaaagtaaaccaaagattgtctttggacaatcaatgaagaaaaaaagccactagggaaataaaagccatcttggaagcagcaaaaagagacaaaactaccgaaaagatagggtagtggaagatttctgtatgaaaacaaagcaaagtgaaatggaaaagaataaaaagtgggccgggcgtggtggctcacgcctgtaatcccagcactttgggaggctgaggtgggtggattacctgaggtcaggagttcgagaccagcctggccaacatggtgaaatcccgtctctactaaaaacacaaaaattagccaggcatggtggcaggcacctgtaatcccagctactctggtggctgaggcaggagaattgcttgagcccgggaggtggaggttgcagtgagctgagatcgtgccactgcactctagcctggccaacagagcaa

SEQ ID NO: 47210 - DNA, 1027 bp, Homo sapiens
gacttttactagcttaaaagccgcagcatgaagattaggcgtagagtcttgacaaagctaatgtggtttgaatgggagatttcagacagggacatcacaagagttgaaatgcttttttcctgtgagtaatatgtgctcattttagcaaacttggaaaaatatagaaattatgaagaagaaatatcattttaaagccagaaatctaagtagttataggagtttcttgaaattaattgcaagtaattcagcaagagtaatggtaccggaagagaaatatcttgttttttatttttttgttctttttcctttgttttttgtttgttttattttttcgagatggagttttgcactgtcacccgggctggagtgcagtggcgtaatcaaagagctttttgaagtcattattgttttccatagctattagttgggcagacacagtttctgtggtgtgttaatgaatgtagctgaagctaggtaatcaaatgatcttgatttccttcaaaataatcatgtgaagaatgtagactttattgcagctatgcttttatttctccaaacattttttagaactttcttttggaatttccttcagtgcctatgatgattcttttaaattctccattttgattctgtaagagtcggtttacaaactaagtaatggaatttggagtcgaaaattaagtgttactgcaaagtaatgagagtagggtttttttttttttttttgagacagagtcttcctctgtcgcccaggctggagtgcagtggtacaatctcagcttactgcagcctctgcctcctgggttcaagcaattctcctgcctcagcctcccgcgtagctgggactacaggcacgcagtgccatgcccagctaatttttgtatttttagtagtgacggggtttccctacattggctaggatgatcttgatctcctgacctcgtgatacgcctgcctcggtctcccaaagtgctgggattacaggtgtgagcccctgcgcctggccgagagtagtattttaatttat

SEQ ID NO: 47211 - DNA, 1030 bp, Homo sapiens
ttttaaactttttacttcttttgcctttttccatatgttctaagagtctatttcttaatatgtcttcaggttactgtctagtgtcctttctttcactctacagaattctcttgaccatttcttacagagaaagtttaatgataaccaactccctcaacttttgtttgcctgagaatgtcttaatttctcctgcactttttttattttttgttttatttttcttttctccagccacatccctttgatcatctccctcattattattattattattattattattattattattattattattattttgagatggaatttcactcttgttgcccaggctggagttcaatggcgcgatctcagctcaccgcaacctctgcctcccgggttcaggtgattctcctgccacggcctcccaagtagctgggattacaggcatgcgccaccactcctggctcattttttttgtatttttattagagatggtgtttctccatgttggttaggcttatctccgattcccgacctcaggtgatcctgccttggcctctgaaagtagtgggattacaggtgtgagccaccgcacccggccactatctccctcactttttaaggacagttttgcagaatagaaaattcttggttgacagatttttttttttcttttagcactttgaatatatgacctcactgacttctggcctccatactttctgatgaaaaatctgctgatcattttattgaacatcccttgtatgtgaccagtctcttttctcttgctgctttcaagatattctctctttgtctttgtcttttgacagcttgattataatgtttctctatgtggatctcttagttcatcttggagttctttgagtctcttggatgttttatattcatatctttcatcaaatttgggatgttttaacactttattctgtctgcttcttcctctctttttttttttttctgagactcctacagtgcagaagttggtagtttgttctcttgacatgtccccatgtcccacagt

SEQ ID NO: 47212 - DNA, 1049 bp, Homo sapiens
agtagagacagggtttcaccatgttgcccaggctggtctcgaactcttgagctcaggcaatctgcccgccttggcctcccaaagtgctaggattacaggcatgagccaccgtgcctggccaagtttattattttcataccaacttgtcataaatcccttctgtaattcctgtctaaaccccagaatattcaaatgttctttttgtgaaatgttgatcagctcctttttttttggagactgaatcttgctctgtggcccaggctggagtgcagtggtacaatctcagcagttcactgcaacttctgcctcccaggttcaagcaattcttgtgcctcagcctcctgagtagctgggactacaggcgcccaccaccacgcctagctaatttttgtatttttagtggagacagagtttcaccatgttggccaggctggtcctgacctcctgacctcaagtgatccgcctgcctcatcctcctaaagtgctgggattataggcgtgagccactgaacctgtcctgatcaacttttataggtctttaacatgtctgttattcaaagagtgaccaactcaaattaatattttcaaattacaactttaaaacaaaaaaaaaaaggccaggcacggtggcttacgcctgtaatcctagcactttgggaggccaaagtgggcggatcacctgaggtcaggagttcaagaccagcctggccaacacccatctctactaaaagtgtagaaattagccgggcgtggtggtgtgtgcctgtagtcccagccacttgggaggctgaggcaggagaattgctcaaacctgggaggcggaggttgcagtaagccaagatcacgccactgcactccagcctgggtgacagagcaagactccatctcaaaaaaaaaaaaaaaaaaggtgtatctgcttttaaaaagtcctctaagagtcccttaacttctgagttccttataagaaacatcagatgagctctgatgtaactttaaaatgtcccttaaagttgaataaagataccttaattgtaatgaaaaatgaaaaa

SEQ ID NO: 47213 - DNA, 1097 bp, Homo sapiens
aaagtgtagagcttttttttttgtttagttttctttttcagggcatttattctgcagaatgcctttcagttggcagaggtttctcatttttggcaggagtaccatggatcgtcagtgctgtgtgtccaaaagcacatgatatctgtttatcccattcctgataatatctttggtcacttggttcaactagtatttgccatgtttctcactgagtaaagttaatatttttcacttcataacaagtaattctggagaagtactttgagaatctaaatgtctggtgtgacattgtactttcatatactagttttagcatccattgatgattcttacccgaatcatttgtgactaaccaaatagtgattttctaattccatcattccttctacatttgttagttggcactctcttcttatttttatatcaatatgaacttgttttatatattttgatatattttattattttatttacttacttatttttgagacagagtcttgccctgttgctcatgctggagtgtggtggtgtgatcttggctcattgcaacctccacctccccatttcaagcgattcttctgcctcagcctcctgagtagctgggattactggcgtatgccaccacacatggctattttttttttttttttgaatttttagtatagacaaggtttcaccatgttggccaggctggtctcgaacatgacctcaagtgatctgcctgcctcggtctcccaaagtgccgggattacagacgtgagccatcacacctgacctattttgatatattttaaatatatcaaataaacatgtcaaattttattttttgaattttttttcttttttttgagatgaagtctcgcttcgtcacccaggttggagtgcagtggtgtgatctcggctcactgcagtctccgcctcccgggttcaagcaattctcctgcctcagcctcccaagtatccgggattacaggcatgtgccaccatgtccggctaatttttttgtatttttagtagagactgggtttcaccatgttggccaggctgctttcgaactcctgacctcaggtgatctgcccgcctcagcctcccaaagt

SEQ ID NO: 47214 - DNA, 1046 bp, Homo sapiens
ttcaaacagaatcactcaagagttgctgatgctgcattatagatgccagtttgtcaaaaatccagaggttgaaaatgaagaagataatggatttgtgacttctgcagcaccctattcttgcctgcgtggatgttaaatttatgcgatgatatacataagtacttcttaaaaattaattgaggtaactgaaacttaaaccagagatggcctttacatttattaagactattagatgagtcagtcgcactttaacaaacaatatttaaaataatatatgaaaagtaagcctaccgttgtagctgttttgaagttttttgtggttttcctcaatagatgttcatgtctgtgcattagccccaagtgggagggtgaatgagaaaagctatgtcttgatttcaaactgctgagtaaaatttcagggcccagcagctttaagaacagtttccatgtggtagagatctttgccagcattctttctctagggtgaaatgcagtgtgttgtactagagaactgtgcttaagttatttgttgtaactgctgcactcagtctgcttcaactaatttgactataaacttgtgtgattttattattgtgtaataaacattcatgttttggtgaatattagtttatgaaaaatgatatagttttaaagtcatccttttcattttggtgatttcccaggagatcaaacaatctgctttttgaatgaaataggacaccaaatgacaacatagtccatgttgttaattttatgaggattaaaaatattgccctaataccataattaatatatagccagtgtaatatatttttccagtgtaaaaattagttttagcacaaattatttgatagttttgtcatttggattttttctcccctttattttagttacatataagaaaaactgatgcataaaaattagctttttaaaagtaaatttgatttatagtttttgaggttgatagtaaaagatacttttgtttgctgaatgaaggaaactttataaaattactttaatattgaaattggcttttaaaaattaaa

SEQ ID NO: 47215 - DNA, 1046 bp, Homo sapiens
tgcttgttacttgcttctacttgttacttccagtgatgctttatttaaaaaagtaaattccaaacattgatcttcaagattggggatgatctgaccttggcctactacttgcccattcttggaatgttcagtttgcagcactgctggtttctgcgctgtacccacactggcttctttttgaccctcacattgccatgtttctgtctcactatgacctttgaaggagcttctctgtctcttgaggatgctaggcctctgtacctctcaatcttgttgttagctaactcttatctttaagacatcagcttattccagttgcaattaattatgaatgtaattatttgtctgctttctcctttctgataagactcttttatgagctaccatgtccccaaactgtctgtcaatagtgggtgctcaataaatattgtttgaatgaatgaatgaatgcacagtaccctccaatgtgcatcttcttctccattttctgaatgtttctattttcctgactgttggaggaaagatgcctccagacaatggcctctgtaccaattcaggggaataatcttactctcacctcccagaccttacctggtgaactcatcagcaggcctcatatggcctatatgtgaaacaaacttttattaacataaaagcatgaatacagaaacactgaaaacagaagacaatcagtgaatacttggctaaagtctacagaacacagagaaggtaaagaacaaatgactgttatccttaactcagcatctgaattacctgaatataatcttgtcattttcaggccaagtgcagtggctcactcctgtaatcccaggaccttgggaggctgaggagggcggattacctgaggtcaggagttccagactagtctggccaacatgatgaaaccttgtctgtactaaaaatacaaaaattagccgagcgtggtggtaggcgcctataatcccagctacttgggaggttgaggcaggagaattccttgaacccaggaggcggaggttgcagtgagccgagattgcaccattgca

SEQ ID NO: 47216 - DNA, 1126 bp, Homo sapiens
tggcaagttgaacatttgctgggtttgatgatagtaaggaaatattgtcaattattttttggtatggtaattgtattgtagttaatgttttaaaaagtagagagaggtattctttctaaggccgaaataacccctaccccaaaatttgacaggtgcatcacaagaaaatagaattacagtccagtaaacacacaaatagtaaataaaacattataagttaaaatttagatatatataaaaacaaggccgggcacagtggctcacacctgtaatcccagaactgtgggaggccaaggcgggcaaatctcctgaggtcaggagttcgagaccagcctgaccaacatggagaaaccccgtctctactaaaaataaaaaaattagccgagcgtggtggcgcatgcctgtaatcccagccacttgggaggctgacgcaggagaatcagttgaatccgggaggcggaggttgcagtgagccgaggtcgcgccattgcactccagcctggacaacaagagtgaaactctgtctcaaaaaaaaaaaaaaaaaagaaaaaacaaaaaaaaaccactccattatgatcaagtgggatttgtatcaggaactccaaattggtttgaaaaagcccagtgtgattcataatattaacagaataaaggaaaattatatgaacatcttagtaaataaaaaacatttgatacagttgggcacagtggctcacgcctgtaatcctagcactttgggaagccgaggcaggtggatcacgaggtcagatcaagaccatcctggctaaaacaatgaaaccccgtctctactaaaaatacaaaaaaaaattagccaggcgtggtggtgggtgcctgtagtaccagctgcttgggaggctgaggcaggagaatggcgtgaacccgggaggcggagcttgcagtgagccgagatcacgccactgcattccagcctaggtgacggtgcaagactccttctcaaaaaaaaaaaaaacattggatacaattaaatacaccattatgatgaaaatttttaggaaggtgacttaatttgatagagggtatctacaaaaatatctgccactaacataacatgaggaaatactcaactctcttctccccaaaaatt

SEQ ID NO: 47217 - DNA, 1036 bp, Homo sapiens
tgaggtaagtgtttgagatgtggattttgaaggactcaccctaaaggtaatgattacaatggatgaaatttttagggaataaagagaagagaccaaatgaaggatattggggaacactagccactaaaggacaaccagaaaagcataatgtgtgttagcaaagttgtaaccacccaagggtttcttccagcccactgcacaaatgaagactgcagcattgtagtaaagaaagagtttaatagacacaaggctggccacaccacgtgggagatggagttagtactcaaatcatcttgtgggttaggggtttttctcttttttctttttttttttttgagagagtcttgctctgtcacccaggaggctggtgtgcggtggcatgatttctgctgactgcagcctctgcctcccaggttcaagcgattatcctgcctcagcctcccaagtagctgggattacaggtgcccaccactatgcccagctaatttttttgtatttttggtagagacggggtttcaccattttggcaggctggtctcgaactcctgagggttaggggtttttcaaaggcagttttggagaagtggtcagggaggcaaggcttgctgctgattggttggggcagagatgaaatcctatgatttcatctctaggggggtgtaagccgttctcctgtgggctgaattgcttctggatggggccacaggaatgggattggaaggtccaggtgaagccgtaggtgtcagccatgcaaaaaaacctgaaaaggtatcccaaaaagccagtctacaatagttacgttatttccaggaatggctgacaatctatgtctacaccttagcagaatcgggctcctctcttcacccagttcatggccttccattagctttacaaaataagctgagttttgggcaaggtctattacatttaaactatagcctaaatgtcttccaaagttagctcagcccaaaagcacagtgataatttaaggaaagggaagatggagggtaggttagtcagatcttttttactgtca

SEQ ID NO: 47218 - DNA, 1076 bp, Homo sapiens
attttaatccccaatgttggaggttgggcctggtgggaggtgattggatcatgggggcggattttccccttggagcagttctcatgatagtaagtgagttctcatgagatcaggtcatttaaaagtgtgtggcacctcccctttctctagccaagtgaaatgctgctcccccttctccttccgccatcattggatgcttcctgaggcctccccagaagcagactctgccatgcttcctatacagcctgcagaactatgagccaattaaacattgtttataaattacccagtgtcaggtatttctttatagcagtgtgagaatggactaataaaatcagctattattgtttaatgttatttgtataagataattttgggaaaatagattaaggagaattgttaggtcagccacaacagattaaggtccatgtgaatagaaaggtaatacagactgaggtaaggcaattctttctttttattattattattattattatactttaagttttacggtacatgtgcacaatgtgcaggtaagttacatatgtatacatgtgccatgctggtgtgctgtacccattaactcgtcatttagcattaggtatatctcctaaagctatccctcccccctcccccgaccccacgacagtccccagagtgtgatgttccccttcctgtgtccatgtgttctcattgttcaattcccacctatgagtgagaagatgcggtgtttggttttttgttcttgcgatagtttactgagaacgatgatttccagtttcatccatgtccctacaaaggacatgaactcatcattttttatggctgcatagtattccatggtgtatatgtgccacgttttcttaatccagtctatcattgttggacattagggttggttccaagtctttgctattgtgaatagtgccacaataaacatacgtgtgcatgtgtctttatagcagcatgatttatagtcctttgggtatatactcagtaatgggatgtctgggtctaatggtatttctagttccagatctctggggaatcgccacactgacttccacaatggttga

SEQ ID NO: 47219 - DNA, 1033 bp, Homo sapiens
tccatgaaatattttggaacccacaaaatgcttgcaaagacacttttaaatatgggatattatcttttgtgaaataaaaaaaagcaaatataaaaaatccataaactgtatacttacaaacactcataaacaaacaaaaacaaacctggcaggaatatacctgattgatgataaactctgggcactagaaccatagatgacttgtgttttcctttttcctttaactttcataatgagcaatgagtattacctttataatgaaaaagctaataaacatcgtaaaaacagaaacagattatcttacctaactctgtattcccaaaatctttctattgccttaatgtattcagtgtccctgaaggaggaatatcttcattgtctccttagacaacatctggaatttttccttaactgatttctctccacctttcccaacctcactctcatagttggtcactttttccacaattggtatctttttccttctaatctgttccattgtctaatatttgatccaaactgtctgatgtccagactattctttcttactcatctttccactgagttcggtttgcttgttttgtttttggggggccaggttgttttcagttgcatttttaaaatgcacacaaaacagaactatacaaatgagaaccttcagagcatagatttattgccatatttacatatcctaatttttaaattattacctgtgaaatgtgtatattctttgaaaatttcaaaaattaaaaacattatgaaattattcaaaatagatgcatcctagagatgctcactggtgaaactgagtcctggcaggagggcatccactcaccaccacagcagagggctccgcagaccctaatagtccaccaggctacagtcacctaaatagtcctccaggcctgccattgcccgagtgccagagagcagctgagctgcaaaagacttctatagtcagccaggattggcccagcctcgggaagacctacccctccaaatcccaactggttgcaatttcccagaaccaaaa

SEQ ID NO: 47220 - DNA, 1035 bp, Homo sapiens
cttttttaatcaccagacgagggctagaatgtcctactgtcattagttattaacctgataattactttatttaatttctcatatgctccaaaaatctaaatggtggcatgaacatttgcccactgggtagctggatggcactggtcaggtatgtgtgatattcctgtgataatccacactaacttatgctaggaaggaggttacaggacagatctgagaatggcaagagttttttatattttaataatcctatgctgattccaatttcaaaactagccctagcctcccatctgtacactactttgtggaggtgttaattcagatgttattctagactcatccctcataggaaatgaggcgtaaagagcttaagtgacttgcccaaagtcacctaccaaatataaatggagccagagctagggctcatgtgtcccaactccctgttctgtgctgccttctgctccagctcatgtggggggactcagttgttttatccagaaatctcgtggcttcatgggcatactctgtcattttttcttatctaaccagtatacaaattactgttctgtacacatctgtacataaagaagcacctgtgtagcttggattggaaggtagagaacagaatgattgtgtgatcagatttgtgtagtactgggtgagagattgtgctggcaacacagggttcagtggcttcttttggagagccccaggtggaaatcaccaactgtggctgactactgttctgtagcaggcatggggtgtccctgctggcaggcaggttgatgtttcgtattccagtcatcctgtgaatgctgtatggggtcctggtaaaggttactgggggcttccttctcaatatcactttgtccctggcacattgtctctgtgcctttgctgtctgtctaactttgactcattatgtgttttgacttagggctgttgtgtggctcctgactccttaaggtttagtgcccagctttgcctcaaccttcaaaatactcattccctagaaaattcagctcttggtcctta

SEQ ID NO: 47221 - DNA, 1039 bp, Homo sapiens
ggttcacaatttcttgaggcttaatcctatttgttctggtcaatgggaaatgaagattttgacaaggttattttttaagttggttgattgtgcttttttgtttgtttttttggggttttttgtttgtttgtttgttcgagatggagtctcactttgtcgcccaggctggagtacagttgcgccatcttggctcactgcaacctccacgtcccaggttcaagtgatcctcccacctcagccttcaagtagctgggattacaggcatgtgccatcatgcctggctaattttttatatttttgtagagatggggtttcaccatgttggccaggcaggtcttgaactcctgaccttaagcgatccacccatctcggcctcccaaagtgtgccactgtgtgagccactgcacccagcctgaatgttttagtttaagttttttcccatagaatctttgaaccaaatgggctttagattcccagtctggaccggaaaaacctatttaacagataatatatccaaaatgtagaaacaaaaaaactatggaacttaaaaaaaaaaagtaaaacaccaggaatgtgttagagatccaaagtggggtgccaagaacacatcgtggtgttccttgtggcctggcagcgggagcaaggactggcctcagctcctttgcacaccacgtaatggtttcccagatgccttcagcctcgtgccaccgtcaagagaggcttccccagtactgagctgaggttcgagatgaggaactggatcaggtatgaggagcagaactgagagttgagaggagaaggagaaggcacacagggcagggaaggcagggagcagaacagtagtggtcctgcttttttccacatccctgcctcagggctgctgaccagtcccccagtggcatcaggagaagcatcagccggggccccttcctttgtctctcctctttctgagactgataagttacaggagaccctccctgcctttaatcaaaactgcggtaaaattaaaatatgaaatggagacttctgcctgcaagtt

SEQ ID NO: 47222 - DNA, 1060 bp, Homo sapiens
tagacaaaggaaatctttgaaagtgttaaattctgactgtatacatgctgtgaaaatttcctaatctttcatattgaatatagtgctagctaaactattgctgataagtattctttcttggaattgaatagatttccatttgaacttttcagtgccatttcattataataaggaagacatttatcaaggaaaaaaatgaatattcaaatgtataagtaaaattgacatttcagtaattcacacattttaaatacacattagaaaatattttaaatattgaaaaatatatttactgtttcatttaatatagctgtgatatccccaaacttcatgatcattattatagcaatgttattttcctagataaacatacaagatgtttatttagatgacttttaaaatcaatcatgttaacatttatggtaaggcataatgacaggttttcacttagctgaaaaaaaaagtcacataattatatttaaaatacattcattataggtaagacataaaactagaataattttaggtacaaatttaggtttgtatttaaatgctgatttttaagaaattatagagataaactttggactttatcctattatttataagcatttattaataacattaatgtctccttagtattgactgtaaagtatacatcgatacttgtaagatagacatgaaacatacctgtcagaagagagtagtcctcctaaaagtagaagttatccaccatgtactacttatctataatgtaaatgttctcagacactgtgtaagaagaaaagatgaggaggtattacatttaaaagaaaaaaaacacccttcaacacagtcctggtgtggctgcaccctgggtgatactggaataaactgctcccacagattagtccatgttagtactgaggagcaagattaaaacttgttactgctcatgtgttttccatcactgtttgtatcgtagccaagacttctagctaaactctagacgtctactggaagattctgaagaagaaaaaaaaagaaagtttaataatgcatggcaactggccattgaaag

SEQ ID NO: 47223 - DNA, 1021 bp, Homo sapiens
tggacccccactggcccacagagtccaaggggtttacttctggccctttacagagcatgtgtgcagagccctgtcttagtgtattagacccactcctttttccactatattcaataccaatctaagaaatcagttattttaaataattaatattcaccacactcagaggcctggaagccttgagcgagttaagtaacttcctgctcaccagtttcctgtagtctgtccctggaaacattgacactcacctttattatgtctaccctgtgcccagcacctccacaggatatcaacttgtttagtcttcccatcagccctgggaggcagatgttgtttcctgattttgtgcacgaagaaactagaactctaagtaacttggccaggtccatggctagtactgattctagttgagagccaagatactcattattgtttttttaactacaagagatgaatctccatgtttcacagactttgggggcttaaggcctgtaatggtcatttggtgttaagttagagctgggcagaaacttcttttcatgggtacttttaatatttttgaattttaagtctatcaaggatctgaatttacgttcaaccatggatagataaatagttcagtcatctgtcagtctgtaaatgtttctgccatgaggacattttctatcctttttctaaataagggaaagaggtggaatcaatatcataaagggttttactccgccctttggaagtttcacttcaacagcagaatttgagtatttcattcttttaagtcagcatcttaggaacatagtaatttatggtatgtttaaatgatggctttggaaggcatagtcagtgttgctattatgcagagcaatcagattgattactaagtattaccagttgtcaaagcataacttaattgtttaaaaaatttacttagctttctgaggtccttgtcagaaatgttaataacataaatgattcccttttacttttgtgaccctgtataaatctttttctgctcagtttctaa

SEQ ID NO: 47224 - DNA, 1469 bp, Homo sapiens
tcagagattggctcaactgcccttctcttgtaggccccttcaggtatactccttgcctgtgcattcagctttgacctcataccttcccgtctttactgtcctctccttgtcttgcctgacccccatggtgacaccccaagttcagcattctctcacagatggcccctggctctcaacttcttagcagcattatgagaatcagagcagtttcttctttggtcccttttctgtgtgccccttatctgacaagataactattcactgaattccttttgatgtctctcgtatctgtgctgtgaaggctctcactctctagatttttgcagtgagtaattctttttcctttcttaaactgctgctttcatggaacacttcttgcttcagcatttttcagtggtatgctgcatttctcatcgccttgaatctggtctaattcctggcctgaggagccctcgtcttgcctctcctttcctgccatagtgaggctagactcctgaccaataagcccagacgtgagtccctccatctgcttccctcactgattcacattcctgtttcaaggtccattgatctttctcctctgaactacgtgtatgtgttgtatggtttagtgttaattatatcctgtattatatcacagtcatcttctgttactccccacctaaattagtaaaattagagaaaccatttttgcctgaagcactatgcctaacacaaatatgctgccaaaaatttggggttttatcctttagctatatacctgtaatttgtggcttaaattttcatatacttatgccgagtctaaaataatcttaaaacaaacattgtcataatttgttaacatttccaagtcactttaaagatttatactacatattattaaacagttactggaataattatgtgtgagtgggaataatcgtcttgatgacccctggaggtgtccgtgacaactagaggacactgtgcatatttcaactgtacaacattgtgggtagtttctttgtgttttaatgaaagcagtcatcttacggagtaattaactttgacttaatgagaatggcttctaaggagatgtacgtggagccatttgatgatgccatttgaaggagaggtggttttgagtatctttctcccctcgttggtaacacctgccataccacatgccctataccctccggttgagcatcagccgcccaggttcggaccttttattaggcagcctgccactcttgggtcccctagactttccatccaaattctaagggagagacagcttggttcagcaggaggagcaccagcctcagagtcagaagatgcaggggaagtccagactcagccacatattccctgttgttctcatgtgccacctgccctcactgagccccagcatcatcacctgccctgcaaggaggttggtgagcttgcagcactgtgctcgttcctacagaagcttgtcgactagccat

SEQ ID NO: 47225 - DNA, 1036 bp, Homo sapiens
ttacagaggaattccagctaatgagcatgagaagcatggcaaaaatagaaattcatcattttgttacctctaatgaaataagaattcaaacaacattcatctgtgagtgaaaccattggttcaatgatggaggagtaaatttgtcttaggagataccaggctgtgaccacttcaatccagtgatcaattttagaatcaaaaaaggtgggacaaacattagacgccttctgatgcaatgcagtatgaagcatatggcacaacctgtgaagtatttttgccaaaaaattttgaaactgaattttacaaagtcttcccaaacccccatctcttcctccagtacctttaaaaacacgaacttttctgtgtttttgttttgtctttgtaggcatttagtttatttggacttttagagaaggggaaagactaagaggcataattctcagggacagaacaacaaggttattgtctccctcactgccaatgataaagaccttactaacaaaatattctggattaattctcaagacactcatgccatctaggcaggagtgatgattcagtatataagctgaacacatgcagaaaaatgtgttcccaaaagtagggaaagtgagtcttaataaatgtattcagaaatctgacttcagaaaaaactagatagaagcagttttaattttagcatatatttacgttttatgctttatagattagttttatttatttatacatggaggtaggagtagtaacataatctattgctttgaagactcatttgaacctctctctaaagttctaagtgttatatataataatctgttaatcttttttttgagatggagtctcactctgtcacccaggctggagtgcagtggcaccatcccggctcactgcaacctctgcctcccaggttcaaacaattctcccacctcagcctcctgagtagctggcattacagacacgcaccaccacgccctgctaagttttgtatttttagtagaaacgaggtttcaccatgttggccaggctggcctcagac

SEQ ID NO: 47226 - DNA, 1006 bp, Homo sapiens
tgtacttactcttgatttatccaggctaaaggagcaatcctattttcttcaattttgttataacgtagtacaatgacattgatctttctggtatgattgaaacaaatttcagttatttcttcaatttggttattttctaggtataattcctataattaagagagaagactattatttttcttttgtgttagttgatacgttcaatttcatggagactaaaatagtgacatagactattatcattagtattatctaaagagtcttactgctctttcaagtaagctcatatttttaagttgtctttttttttttttttttttttgagacagggtctcactttgttacgcaggatggagtgcagtggcacaaacatggctcactgcagccttgacctcccaggctcaagtgatcctaccacctcagtcccacaagtgactgagactacaggtatgcgccatgaagcctggctaatttttgtattttttgtagagacagggtctcaccatgttgctcaggctggtctcgaactcctaagctcaagtgatctacccgcctcggcctcccaaagtgctggaattacaggaaagttgtcaaattttataactaattagtaaaataaaacacactgccatggttatggaatcaaatgaattttatttaaaatgtattagctataatatgttgcaagaaatggcataccaaaataattatacaaggctctctattttataaaacttattcacataaattatctcatttgggcttaaaaactctgaaaagtagacagatattttaatctctacttaccagtggagttaagttgggcctggagagacagggaagcccacccgtggttacatgactaatgctgagaggggcttgtcctagccgagcctccagctcccaggctgcctgtttcctactatttcatgtggtctataatattttaggctcatgtttttagatttgcttttgttataattaattaaagttaattaacagcctt

SEQ ID NO: 47227 - DNA, 1029 bp, Homo sapiens
tactcagatctgactaatgtatcataattttaatctaaaattagtaacaaaaacaaatggaagttaaagattaatcacacactgatattttgcttagctaaatctctgtaccagtagcggagcagaccgggcagcattccccttcaggtataactgtttgggggcacctctggggatggcacatggtttcatcacaaagaactcttccatctgagcagaggcaggtagtgcagggctcaggcgaccacacagctttgttgtacatggttatgccctttaccaaacagtgtcccttctttcctagaagaaaacaaaagcacaaatttaaatttcttatgtgattatcagtaactgtgaatggaagtaaacacaatgtgaagtcaaactgctctaaccacacaagaatagaattctatgtgcattcatgtatagggtaaagatgtcgtatagacataagaaatgctgaaatgcttttcacaggctctcctctcagccctttcacgtaggctctaagagtgaactcctcatggtaacttggggctgaactgcgcttccattttgtatccatcaggatagattaaattatacaacatcaacaaacaatccccaaatctcagttatttttcatttatactttgtgtctaatgtggggacacaggggctcagctcatcatattcactcaggattcatctataagcaggctgtcctgatcactgcggtagtggaaatgtgaggttacaaatcacacatgagctcttaaagtgtctaattatactgaccaaagcaaatcgtatggccacaccagacttcccaagccgccagccaatccagttccctcatgtgaccagagagctgagctagcactaatgatgagctcacagcccacccttgatatgcacatgggaataggtgaaaccagacagcatgcttccgtggtgcttctcaatgagacactgagctatgtcttttatggtttattatgctattgaaatatgattcacatactataatattcacccttttgaagt

SEQ ID NO: 47228 - DNA, 1063 bp, Homo sapiens
cattgatatacagaattttgctttgcacttaatatttgctttcataaacaacttcgtaattgagtgtttgcctcctagaggtaaattttctgggattccaatcatagtatcatttttatcaagtaatttttttccttctagcacttactgtgtttatcccaacattaaatattatttataaaccttgattaacttatttttcttcatttaaaatttcttaccagttatcttaagtaaactttaaaaatattaatttagaattttaaaattctacatgaagtcatgagatgtctattatctattttcacttcattcaacagatttaaaatgaaaaatattttgaattatttatgttcttttaggacttaaaaattaataatattttcaaaccaatttatacttctattgaacacataattccacctaaacatataaaaataatttaatactaagtatacaaggtctgaaatacttgggaagtacatcgtgaaaaaaacaaacagaataatgcatactttgaactttaaaaatctattagtaacgagctaatttactcaagagttaaacagttgtgaaataaaatacccaaatattaaaaccattccacatgctaagtagaaacttaaaatttaaaacttttttacctggagatctaaactaagtaggctttgcttggtgtcatttaagtctccagctgaaaatgaaacaaaatcagagctttctttaaaaacaaagaaaggacagaagggaatgttgaaaagtatttgctgaacttcttagtaaaatctaaaataactgcctcccttggggataaatgcctttcagttctttgtgcagaaaatcagccaagaaagtaaccagggaaaatggttaccaagggaaatattttttttaatcataagaaaagtagaaaacagcagtgggtgtgggggaagagcattttgtttgcaggctgaaaaggcagagttggaaacacaaaaatgagcttgattaagaaatctgtggttttcatagactattcgcattaaaaatgttaaagtttatactagccaggatgatgtca

SEQ ID NO: 47229 - DNA, 1033 bp, Homo sapiens
aaaggaataacagatatgaaggtcctaactcagtgcctatcctagactaggtaattttagaactattttttaaattttttttttttttttgagacgggagtttttgctctgttgcccaggctagagtgcaatgtcgtgatctcagcacactgaaacctccgcctcccaggttcaagggattctcctgcctcagcttcccgagtaggtgggcttaaaggcgcctgccaccatgccagattaatttttgtatttttttttttagtagagatggggtttcaccatgttggccaggctggtctcgaactcttgacctcatgtgatccacccacctcggccttccaaagtgctgggattacaggcatgagccaccgcacctggcctgaaattcttatatcgttatttcaggggtccaaatcatttggcaaagaggagctaaatatttgtttaaatgacgtggttagactgaatcaggattttgtaaaatgacctagatagactgaatcaagataagggactaaatacataagccactcaacttcctaaaaataaggaaaatgatatctatttttaaaaatgtaaaactagctgagtgcagtggctcacacctgtaatcccagcactttgggaggcagagacaggtggatcacctgaggttaggagtttgagaccagcctggccaacatgtgaaaccccgtctctactaacagtacaaaaattagccgagtatggtagcacatgcctgtagtcccagctactcaggaggctgaggtaggagaatcacttgaacctaggaggcggaggttgcagtgagccaagattgtgccattgcactccagcctgggcaacagagcgagactacatctcaaaaaagaaaagaaaagaaaagaaaaagatgagtacaaatgagcaaacaccattaaacaggcagttcatagaagaggaaatgtcagtggtcaataaaacagaagaggaagatttctcaatctcagtaacagtcaagaaaagtaaattaaaacaggaaggttattttttc

SEQ ID NO: 47230 - DNA, 1065 bp, Homo sapiens
caaccattcccctattgatggacatttgggttgtttcccctttcccccctcaaatagaatgggctttttgagtttgtgtacgcatttccaggttgctttccaaaaaggttatagtaaataatgtatactttcaccagaaatatataaaatgcccatttccctgccactttattttttaaacagttttcacatttttgaatgggtaatacatataagtggcataaatttttaaagtgcacagttaaaatttcagttttctatatccaatactgatagtttgataccaaccttcccattgaagtaagaaagaaatgagatcagccgggcgcggtgcctcatgcctgtaatccctgcacttcgggaggccgaagctggtggatcatgaggtcaggagattgagaccatcctggctaacatgatgaaaccctgtctctactaaaaatacaaaaacttagccaggcaaggtggcatgcgccagtagtcccagctacttgggaggctgaggcaggagaatcccttgaacccaggcggcaaaggtcgcagtgagtcgagatcatgccactgcactccagcctggacgacagagcgagactgtctcaaaaaaaaaaaaaaaatgagatcacatataaaaacatcttaaaataatcaatgaaggctgggggcagtggctcatgcctgtaatcccagcactctgggaggccaaggtgggtggatcacaaggttaggagttcaagaccagcctggccaacatagtgaaaccccgtctctactaaaaatacaaaaattagccgagcatggtggcacgcgcctgtagtcgcagctactcgggaggctgaggcaggagaatcacttgaacctgggaggcagaggttgtggggagccgagatcacaccactgcactctagcctgggcaacagagcacgactctgtctcaaaaaaaaaaaaatcatcaatgaagtgagaatataataaggaatcactggacctagatcaggagataactgtgagcagccttttgccttgcgagtgtttgctaaaaatattaaagagcaaaaatatcgataa

SEQ ID NO: 47231 - DNA, 1008 bp, Homo sapiens
taccctctggccctggggttgcttgcactagcagtgtggtctgtcttcagggtgatagagccagggaagaggaatgcataagccctggaaacaaagttatttgggcagagaattccaggctaccagatactcagagcatttcctggggaggtggctgtgggagagcacatagacatcttgcttagtggccaagcggagcccatgtcacaaacccctcttgtccaggtttaagtgtgacgctgggattggaagccaggaattatcatgagtggaagccacagtttcaggcaagaaaatttgggtgagaaatatatagtactgttatatagtaaggagttaagtatagaagtcttattgtgatatagcatacttccccaaaatgacgtctgatgctttttgttttttgagatagggtcttgctctgtcacccaagctggactgtagtggcacaaccatggcttactgtagcttcaacctcccaggctcaaacaatcctcccaccttagcctgtcaaatgtctgggactacgggcacataccaccacacctggctaatttattttattttattttattgttttatttttccataagttattggggtacagatggtatttggttacatgagtaagttgtttagtggtgatttgtgagattttggtgtacccatcacccaagcagtatacactgcaccctatttgttgtcttttatccctcaccccactcccactcttcccttcaagtccccaaagtccattgtatcattcttatgcccttgcgtcctcatagcttagctcccacatatcagtgagaacattcgatgtttggttttccattcctgagtaacttcacttagaataatagtctccaatctcatccaggtcatccatggtgtgtgtatatatatataatggaatactatggagccataaaaaggaatgagttaacagcatttgttatatatatggtgtgtgtgtatatatatatatatatatatatatatgatata

SEQ ID NO: 47232 - DNA, 1107 bp, Homo sapiens
tcaagatttagagtttcttttagcagttcttgtagtggtggcttagtagtggcgaattctctcagcatttgtttgtctgaaaacgactatatctttccttcacatgatgctgagtttcgctgaatacaaaattattggctgataattgttttgtttgaggagtagggtcccaatcccttctagcttatagggtttctgctgagaaatctgctgttaatctgataggttttcctttgtaggttacctggtgcttctgtctcacagctcttaggattctttccttcatcttaactttggataacctgatgacagtgtgcctaggcaaagatcattttgcgatgaatttcccaggtgttctttgtgcttcttgtatttggatgtctggctctctagctaggctggggaagttttcctcaattattcccccaaatatgtttttcaagcttttagaattctcttcttcctcaggaacaccaattattcttaggtttggtcgtttaacataatcccagacttcttggaggctttgttcttattttcttattcttttttctctgtctttgttggactgggttaattcaaagaccttgtctttgagctctgaatttctttcttctacttgttcagttctattgctgagactttccagagcatttcgcatttctttgtttgtttgtgttttgagacagagtcttgctctgtcgccagtctgcagtgcagtggcacgatctcgtctcactgcaacctctgcctcccaggttcaagtgattctcctgcctcagcctctcgagtagctgggactacaagtatgcaccaccacgcccgactaatttttgtatttttttagtagagacgggatttcaacatgttggccaggatggtctcgatctcctgaccttgtgatccacccacctaggcctcccaaagtgctgggattacaggcgtgagccaccgcgcctggcctgcatttcgcatttctaaaagtgtgtccaaagtttcctgagttttttattgtttttttctttaagctatctatttcattgaatatttctcccttcacttcttgtatcatttttttggatttccttgctttgggctttgcctttc

SEQ ID NO: 47233 - DNA, 1030 bp, Homo sapiens
aagactataggccctttgtcttcagctaccagggtggataggaaaggaccatcaggtggggacagggctaggtgtgtttgagctctccttgggtgggtcttgctgcggctgctgtgggggatggggtgagattcccaggtcactggagttgtatacctaggaggattatggcttcctctgctgagtcatgcaggttgtcagggaagttggggaaagccggcagtcacaggcctcacccagttcccacgcaaactgcaaactgaagggcagttcccccgccacccaacagccccaagtctgtttccaagcagagggcaagaggggcttgaaaacttacccgaggctgtccacctcccagctgccaaagaaaagggctcttcccccgcctctgaagtctgcacactggattcgcgccctcccccagttctggccaggaggcttcttgtcccgttcaaattgttacaaagttcggctagagaattcattctccctgtggagttttacccctgctcctctggccgccctcccgatggatccctgtggtgtcaggcaggaatgggctgcttggggacccaacgagctcccagggcttttctgctgcttcctctacccctgtatttcactgggctctctaacttgactcagctccgggtaaaatcggaaacttctcccgcaaacagaccttcagcttctccagtgggggtgtgtgtttaggagagacgggtctccctttcccacttccgcaattggggcactcacagtagttggggtgcctcccaggtcctgcaggagcagtccatttccctcagagggtctgtgggtcctcttgggattgccaatttattcttgcagtcgatctggagctagaattcacaatgcaggcctccagatgatggtctctctggagctataatctagtcctgcctcctgtctgccatgatcccctccatctcttaattttcttttttaattttttttcatagagatggggtctcactatgttgccagggctggtctcgaactcctgggc

SEQ ID NO: 47234 - DNA, 1033 bp, Homo sapiens
actgacttttcttttatgtgtacaaggattattcttttaaagcctcaagtctccactttttggtagcctgctcttttcctcaatccctgacttaaatatcatgccttccaagaagcattctccagcttcacggtgctcccatagcaccccacttaccctgctacaccaggactcatttctctctgctttacgttatgaatggcagttaccatctgttttccccaaacagtacataaattctttgaggatttacacatatgtgtatcagtgtatcatttttattgagtgcatcttgagtgtaataataaagcatagctcttacagtctattagagtcaatagtctatacgaagggatcaaattactgtctctgtgtaaaacagtgtgatcatttctgtgattgcagaaatgtgaagttattttggaaatctataggagagtacacatctagagtttttaaagaattagcaaatggtttagcagcatttaacacagatgatctttcttcaaacactcaattattttgttttttaccaaaagaattggtgagagtgagagaaactccctctctcttgtgtctcccttcttaatctctttggctggttcctcatcctccctccccctcttcctcccccctccctacccctcttcctcctcctcctcctcctcccaaagtggggtggtgtgaacatgattgtgaggctggagggttgagtgcaggaaagaagtggccagatcacaacaggctttggaaatgacagtgaaggtctgggacccaaaggctacaggggaggaacataaccaggtctgcatggtgaggggggaattatttctttgtgtatttatttacttagccagttacatagcaacaggtctgcattttggaaaaatcactgattgtaatgtggtgtatgaagtgaatgtaaggatcaagtctacagggcatcatttaaaggttactgcatttgcctgggcatagtggctcactcctgtaatcccagcactttgggaggccgaggtgggcagatgacttg

SEQ ID NO: 47235 - DNA, 1048 bp, Homo sapiens
aaaactctttcaaaagtgagggagaaattaagacattctcagatgaacaaaagctgagggagtatgttaccactacatctgtcctgcaagaaatatttaagggagttctacagggtgaaatgaaaggaccatagacagcaactcaaaacaacgtgaagaaataaagatctcaataaggcaaatagagcaattataaaagcttgtattgtaacaactgtttgtgatttcacttttcgttttcaacatgattataagagactaatacttttgtattttttaaattgacaattatacatttatggggtatacagttacataagatagatatatatatatatatatatatagatatatatataaagtggttagtgattagattaattagcgtatccatcatctcaaacatttatcatttctttgtgttagcaacattcagtatccttctagccatttgaaactaaatatattaactataatcatcctacagtagtatagaacactagaacttattacactttaaaaatattattagtctaaaagctaatattataattttggtttgtaacttcaaacactgctttctacataatttaagaaactaatgtatttcaaagaatttgtagcttgtgttttgggactcactatgtatacagatgtaattttgtgacagagctgttaaagtaacagagattaggtgtgttattgaagttaaagtggtataaattccatttagactgttataactttgggatcttaaatgtaatttccaaggtaagcacaaagcaaatagctacagaacttgtacaaaaggaaacaagaaaggagcttaaatacctcactacaaaaagccaaaaaaacacaaaggaaaaggtaatacaggaaatggacaaaatagatataaggaatatataaaataaattgcaaaatgacaaaagtaaatccttcccttatcagtaattactttaaatgtaactagattaagctctccaattaaaagacaagattagcagaatgtatttttcttcttttttttattatactttaagtt

SEQ ID NO: 47236 - DNA, 1035 bp, Homo sapiens
atatgaactttaaagtagttttttccaattctgtgaagaaagtcattggtaacttgatggggatggcattgaatctataaattaccttgggcagtatggccatcttcatggtattgattcttcctatccatgagcatggaatgttcttccatttgtttgtgtccctttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataggaaggcctgtgatttttgcacattgattttgtatcctgagactttgctgaagttgcttatcagcttaaggagattttgggctgagatgatggggttttctaaatataaaatcatgtcatctgcaaatgggacaatttgatttccttttttcctaattgaataccctttatttctttctcccgcctgattgctctggccagagcttccaacactatgttgaataggagtggtgagagagggcatccctgtcttgtgccagttttcaaagggagtgcttctagtctgcccattcagtatgatattggctgtgggtttgtcatagatagctcttattattttgagatatgtcccatcaatacctagtctattgagagtttttggcatgaagggctgttgaattttgttgaaggccttttctgcatctattgagataatcatgtggtttttgtctttagttctgtttatatgctggattacatttattgatttgcatatgttgaaccagccttgcatcccagggatgaagcccacttgatcatggtggataagctttttgatgtgctgctggatacggtttgccagtattttattgaggatttttgcatcaatgttcatcagggatattggtctaaaatgctctttttttgtggtgtctccaccaggctttggtatcaggatgatgctggcctaataaaatgagttagggaggattc

SEQ ID NO: 47237 - DNA, 1007 bp, Homo sapiens
ttctataagacatacattatagtttatgcattataaaaatctgtgtcaagaaaccaaataagatccaaaatatatatatataaagaaactcacacctaaatataatttaatggaactgcagtgaccaaagatgaaacgaagatctttgaagcatccaaaggaatggattggctatattggcaaactctgatccttcaacagcagcaatggaaaccaggaagcagtggtagcttcgttactctcagagaaaataatagcatacttcctatacccagcaaatactgtctttcagaatgaaagtgaaataaagagaatgttagattaaatagaaactgagagaatttacctccaatagacacacattttagaatgaaaggatcatctccaagtagaaggaaaatgatccaagaaggaaggtttgaggtgcaagaaggaataaaaagcaaagaataaggtaaatatgtcaaacagtgactgtataacataatcataatgatgtcatatgagaggctttttaagctagcattcaaaaatacacagtaatacaaggttgcttgaaattaaaatgttctgaattcttgtgttcaagaggaggactgagacatccatttgtttagactttgatgagtatagatgataaaatgtctaaggtaaccccttaacaaaaataaggtatgtgacttttcagctaacacaggggaaaaacacttggtggtgttttgttttgttttgttttgttttgttttgttttgttttgagacaggatctccctttgtcactcaggctggagtgcagtggcatgatcttggctcactgaagcctcaacctcctgggctcaagtaatcctcccacctccgcctcccaagtagctgagactacaggcacatgccaccatgcccggctaatttttttgtattttttttgtaaagttggggttttgccgtgttgcccaggctggtctcgaactcctgagctcaggtgacctgcctgccttggcctgccaaagt

SEQ ID NO: 47238 - DNA, 1047 bp, Homo sapiens
cacaccccagctcacaaagagcactcgttctgtgcacctgtgatctgtgcgtgtgacagctgtctgtgccggctgtgtgcaccagcgtgcaaagcttcctcaggccagtgcaccccaccataccaggcgagagagggttaaaggactgaaagatggaaaagtaattatgtggaacatgtgagcgatgttcccccagcccagtggtataaacgaacgctgaaaaatcactttatcatgagccaagtattacaaaacccaacaaaaagtaaaaagtagatctggccattccagcgccaaatggatggaatgtcgacaagccttcttctttgcctctcctgtctgctgagaaacgcaagctcctttggttcacatttgaagagatctggtttctcattttattctcaaattttatcttcagtcctttgtattttgcttctcagggcttagttttgtggttttaacctcagaagtcgtgtgcttataacaagatgtgattaattatttgccctgaaaaacacatttaggattactccgagtcctgagctctgactgctgtgtgtcccgcttttcgtctccgggcactcagcgcacagcactcaagacactggctaaacaagtgacctaagctcagttcagtccaagagaagtatcctgggttctggtgtcccaatgtttactacgctttgagatttagaaatcaacaagccaaaccccaacttcaaaagctcctgccgaggagaggaaatactgatcagcacgtccctgctctgacgctgctcaccatggccttggcgctcactgctgccctgccccagaatcctgtttgtagaaaaaacaaatccctgactaagctgctggggtaagtaactattctcatctgaagagtaaacagcaaataactcatttacaaattaaggtcatgagtctcgctccagaagctggagtgtgcctgcagctcatcccaaggggccacattttattgggagaacctcagaagcccaaggtactgctcagttctgaggcctgagacccaagctgggtgcacct

SEQ ID NO: 47239 - DNA, 1054 bp, Homo sapiens
aacacactaaagagacaggattatggaggacatccaacagcccttctaaaaacaactagatccctgaaaccgctccttttaacgtgttgttgggcttgcataaggtaaggaaaatccctaacccaaccccctcttctcaccacccacccacaaagagctgcaactagagttttgagcatgaagcaactgggaaggctgagctgtcctacagtccagtgccactatcagcactgattctaggaataagccacagggtagaggatctatctaaaccagagactcttcccttttgccaaagatccctatcctctctggaagaaggcatcccctatttgggtctccaggattcctatagattaagatcaaacaaatcaacaaggcaaacaaaatcaagcaaggcaacacggatgagtcagccaaaataagagattttttttttttaaccaccaaggttttattgtatctgatatcagaatataaaataacttcataaattgcttaaagaaataaaagacagaattttgaaatagacaagccacaaggaactagaaaaaaataccaaggagatgtgaaaacaaaccaaatagaattttcagaaattaaagatagaactactgaaatggggccaggtgtggtagctcacgcctgtaatcccagcactttgggaggctgaggtgggcggatcacaaggtcaggagattgagaccatcctgactaacacggcgaaaccccatctctactaaaaatacaaaaaattagctgggcgtggtggcaggcgcctgtagtcccagctactcgggaggctgaggcaggagaatggtgtgaacccaggaggcggagcttgcagtgagccaagatcgcaccactgcactccagcccgggtgacagagcgagactccatctcaaaaacaaaaaaagaactactgaaatggaaaactcgataaacaagtgaaatggcagattagacacagctgaatgaatcaatgaactggaagatagagctgaaaaaagaaaagcacctggaatgtagcacaaggagacaaagatatgaaaa

SEQ ID NO: 47240 - DNA, 1047 bp, Homo sapiens
ttttacatccctacctgccacgcatgagttccagttgctcaacatcttccaacacttggtactgttgatcattttaatttcattaattttaatgagtgtgtaaaagtgtctcattatggttttgatttgtatttccctggtggcttatgttgaaatcctttcttgtccccattgaccatttcatatcttattttatgaattatctctattgaagtatattgtcatttttattgagttgtccttttacaattgggttataaatttctttacattttcaggaaacaaatcttttgtcagaaatttattgcaactatttcttccccttctgagtctttccttctcaccttcttaagtgctttcaaaggacaagagtttttaattttgaaaattcaaagttatgatttctgtttttatagttcattatttatgtgtactaacttaaaaatctttttttttcttttttttctttttttttgccggtctcagtctttaatcctggcagggattcacgggcgcacacacacacactcaggattcagatcttgttgaaagctgcgatatcgacactctgcacgtgctcctcaaacttggtgatctcctccagcaagtctgtccccaccttgtcgtcctccaccacacactgaatctgtagcttccggataccgtagcccatgggcaccagcttggaggccccctagaccagctcttccagctggatggagcacacacaggcctccagctgggccatgtcagtctcatcgtcccaaggcttgaaatccagcaggatggaggacttggccaccagttcaggcttcttggccttcttctccgcgtactgctgcagccgctcctcctgcagctgtgccgccttcttgtcctcctcctcattgtcgctgccaaacaggtcagtgtcatcatcgtcgtcatcctctgctggtgtgaatggcttcttggccaggggctccacttggcgcatgggagacatgtgctgggtctgtggggccgtggcccggtggccaggcgagttcttctccagcacgttcagcc

SEQ ID NO: 47241 - DNA, 1056 bp, Homo sapiens
tgtcgaaccagatcttctcatgtactaggaagtttgtagccatttttctgacgcctgccaaggacgcgacgaccagggaggaggaatcggcggacgcgggacacctgaggaaagggtactaccttaaaaatcttttcctatagtcttggtaaattttaaatgatagctctataaatgatatttataagttatggttatttttttttttagtttttcattaattttgatcaattgtatcttactaggagatcacccatttactgtaggtagtattctcttcctactatatttcatatctacctactacatttcatatcattcctactacatttcatatctacctacatttacatgtaggtagatatgaaatgattcaatatccatgtctccttttactcattacaaatcttacataattttgctctctcttatctctttaccttactcgggtttatgtgaggtatttagtttactaaggttttaaaatattttcatattcattttagtaggaaaaggacggattattttataaatttcattgcctgaataagtttaggtatggtttcgggtacaataagaaagagataaaatggaatgctttatgccaaacatgtttatttttatcacacagctaaagtctgtagttaagttgctgctacttttgagtcaataacatcaagaccagtgttggtgaatcttttggcctttccccaatgcttgaaagaagatcaccactgctggaggcataatgtacaaggcaggaaaagggatggaattgatggtgacagctaagtctgtcttttttcttaggaaataaaggttttcctaggatacatttaagtgttttgcttctcttgggctgaggcaggtcatttggccactaccagtttcagaagatgatgatgttacagcactattcacaatagcaaagacatggaatcaacctaaatgctcatcaatagtagactgcataaagaaaatgtggtacatatacatcatggaatactatgcagccattaaaaagaatgagatcatgtcctttgcagggatatggat

SEQ ID NO: 47242 - DNA, 1025 bp, Homo sapiens
aagggcatgattgtccttgtccaattgattatctgttgacagactgttggagtggttggaattgctatgaatggaagttcaaaaatcaagaagacataaaatacattataaaagttacagttaggccaggtgtggtggctcatgcctataatctcagcaatttgggaggctgaggcaggaggactgcttgaggccaggagtttgagactgacctgggaaaaatagcaagaccctgtctctaaaaaactaaaaaaattagcaggtgtggtggcgtgtgcctgtagtcccagctactctataggctaggacaggaggatcacttgagcccaggggtcgaggctgcagtgagccaggattgtgccactggactcccatctgggtgcctgggcgacagattgaaatcctgtctctaaagtaaataaataaagtcacatttatgccaagttatatatgtatgcatgtgtgtgtgtacgtaaatatttattttaatagaaaggaaagtgttggatggtctgtttttctccactggtttgagacatgggcttgaagttaaatcagtaaacaaaatgaactatgtttattatgaaatctgcttctataggaagaccttttccaatgtatcaaatagagcttcttctctatttgaattttatggcatttaataagacgatatattcttacaaaacctattcttaacaattacttgtctggtatacagtaagctgtgactcacagatgaagatttttccatatacaatatataatgtacagtaatcacagggcttctctgtagtatgaataatttaaaactggttctgacttctgtgaaaagactttctcactttcaagaaatacaatttcactcgtgtaaatactgaagaatactaaaacctgatttctgtgtgaagctactgccacatttgctcttaaccctgtctccttctggtagaaactttctgatatattccaagtgaagtgttttccagtcactgttcttataggctttgttctccaaattgtgtttt

SEQ ID NO: 47243 - DNA, 1023 bp, Homo sapiens
aaaatttaaaatccactttctcagtcctactggccacatttcaagtgctctgtgccaagtgtggttagtggttcttgtcttgaacaatgcaggacgtttctggcctggaatgttctgtggggcactgctgccctgggccgggggctgttagaagttcttggacaagcagactttggtcacacccctgcagggatagggcatgtttgctgggcattgggcagtggacgccagagagggacagtggtgggaacctggcctgggagggccccagggccaacactgctgcctgagaaccctagtgcagggcctagagacagacagagacgtctttgttgttggttacaaaacatgaacaaacgttgacattaagtcagacaacttgatacgaaggacaggaatgtctgcaccggaacaggtgaaaacaaagtcacaacggggaagaccagtgggaacgagaggctaggaagaaggcagttagtattgcatggtaagaaagttgcgcatttgcagtgaacacctgagcagaaataaatccggtgtgctcatgatagccctcggctcatgtgtcctgaccacagaggtgctcgctgttttttctttcttttgaataagctttttactgaatacatcacgtctgttgaaaatgtccatcagtcaccagttccaggctgatgattcttcccaagcttcacttctccaggccgggctgggtctcagtaaaaagaagtggagggggttgcagagaggtgggaggggcggctgctctggaaggttcctgcggaggtctgactcgggtgtggaaactgaggcttggtgataccatggaaggtgcttgggcccttggagccaggaatgctggggtgccagtgagctgcgtgtttgtcacagactctgctcctcctggcagctccttgtccatgggggcactggtatgtggtacatgagggattcagtgggccacatggtgtaggttacgccgtgaggtcagtgcagggagcagcagtctctcagctggacttcctg

SEQ ID NO: 47244 - DNA, 1015 bp, Homo sapiens
ctctgacagtcccagccattctgaatgaaaatgctccagggctctgaagtcactcctctatgacctgtggtcactgctcctgctgctcacactatgtgagctgcccctgactccctcagagcccccagcatggctgtcgtgagtgtggacacagggaggcctccctgcgctggaccaggggtgatcgagcaggtcattcccagcctgccaactttccttttctatttgaagagctttacatggttgagatttctgcacctgttgggtttatctttgggttcccttcaacagcagctacacaaaggtgtctcggagggaaagggtcatgctgtcttcatcccgtgtcccctcgtccccaatgactgtggctgtccttgcatgcaagtgctgtgggcagggaccctggttggggcccacactgacacactcctgtgtctctttcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaaccca

SEQ ID NO: 47245 - DNA, 1045 bp, Homo sapiens
catacctgtgtgaagtaagcatgctacagatatacaaatttggtccataaaaacagcccagcagccctcctcctcacagcccattcctatcccagggacagactggctccagaggttcgagttgaagggtgggtgtgtggcctgtgggacaggcgctgtttagacaagcttctgcccgccctgtggactgtctttctgtgagtgtgaggtaccagctgtccctgaatgtcccatcagtggttagaggtcggcaggccttgggttcatcattctgaccatgacgaccttgccagccccttagtaaaggtggaactgcagaagtttcatttaattggcgtggattctaatgccaggttttacctggaccttgtatttttagatttttattttgttttcaagttaattttattctcaacatacttgaaaagaaacataataggaaaacattttctagttgcaaaggggttctagttcagttttgtttagtgaaaatttcacaaaattggaacgttgcttaaattctcgtatgtggcactccagtcacagctggctggatgttccaactttggccacagtgtactcctcttagacaacattgcagtcacatgttacactaaattaagtggtgaatcacggaacacagcacaagccagcactttgtctggaggtgtatgcaggtggtgctcctggggttggggtctggggtgccaggggagtgtggagcgcagaggagctctgcttttcagccagctgtttatagtagggcagatgtgcccatcctagaagggatctgagaccacagatgccccaggcagggcctagagcatctcggtgactgcagaggtgtctgcctgggaggaggtgccatggcaggaaaggggcagggtctggaccccactgggtggtggcacaggctgacctcttccattggttatggttttatgagatgcacagcattttctctgcctgaatggccgaggatttagccagagccggtgtgagcccagggccacatgcccactgtgaaagttggagactgtggaca

SEQ ID NO: 47246 - DNA, 1837 bp, Homo sapiens
accttcacagctcaattaaagaaatactaaagggaatatttttagacagaagaacaatgactgcagatgaaaggccagaatgcaggtaggaacaaaaactgatggaattataaatgtatgagtagatctaagtgaattttgactggatgaaaaaataatgtcttgaggtttaaaatgtttggcatgttaaaatgcatgaaaatggggcatatttatcaggaggcaggaaatgcatttaaagggctccaggattccatgttgcctaggcagagagccaaatcaagaatgcaaatgatagtctctagaataacccctgtgagactcgtagaatagcagataacctccacacttgtggagggggcaggtggggaaggaattttttaaaatatggcaaagaaggaaagaaacagcaacactgaacatggagaacacatagaaatctttagtaagatgctagttttaacccaagtagatcagtaattaaatgtaaatggactaaatctcaaagattctcaaaagtgaaaaaaaaaaaacagaacaaagacataagattataaaaagattaagagtaaaaaacaaaaatggaaaaagagcacactaatactcacctagaggaagctaatgtctatatttttatatcaatgtagattttaaggcaaaaacataatggtgaaagattcaactggccaggaagatataataatttaatgtttgcttatatttagtaataagccctcaaaatgcataaaataaaaattaacacaactaaaacaaatggagcaatttacaatcatgggagatttcagcttttggaataggagacactcagtagggatagagaaaatttcaaccacagaattagtatcttatatatacaggacactgtactcagtagctgaagaatgcactgttttttcatgcacacagaatatttttaatttaactttacgcagacccaaaacaaatctcaacaagtttcaaagaatcaaaatcacttgatgcatgcttttgattaaagttggaagtaaacccaagctcattaactagaagataactagaaaatatccacatttgatagttaagcagtgcatttataaatatctcattcggcaaagaagaaattacaatggaaactaataaaacattctgaatgatgatatgaacatcatgctaatgaaaatattacgtatcaaaatttgtgaaatgcagttaacagcatattgagcagaaactttgtagcctttaaatgcatatattggacaggagaaaagtctgatagtaataaaagtatgtagtgcaaaaagttagcataagagaaaatggaacccaaataaagaaaggagaaagtaaaatagataagaacataaattaatgaaatagtaaacaaatatacaatagggtatcaacagagcttagcaacggttctttgaaatggctcatagcattagtaagccccctgtgatgagactgactaaaggagagagaaagacataagtaatcaatattagggatgaaaagggggagacactgctacagtcctacaaacattaagacaaatataagaatttgaaaatttctttggattatgtcttagggaactacaacttaccaaacttaagaagaaatagaaaatctgaaaggtgctataaacattaaaaagtcaaatcagtcattagaagccttctcatgtctacccttcatggtgacaagattgctggaacaactcagtgtgtatagtctttcaggtagaaaatagagaccctttttgaaaggtttcatacatctggccctgactcccattatgcagaacaaggacacattctctaaagcagttgtg

SEQ ID NO: 47247 - DNA, 1060 bp, Homo sapiens
tgtcacaaacactttatttttcatttgaagaaaatgccattgatttctaaacaaggtcttccaaagaaaatgtttgcttatttgagttgataccaacttgaggttggtgtttttctattatctactccaatatcaaccactctgtaaatggaaataaatacataatgcatgtcacatagtagacacgcagagctgaatgattgttctgatcaatataattctatataatgttacataaaaggtaatattccttttagcattactattttttgttaagaatttggacaaagcaagataacttctttgactcagaagctctacctataaaattactgggctaaatagcagttatttccaaggaatacatttgctaaaactctttctattttgaagtagaaataatcgtggccttttggtaacactataattttatcattttgcctcaatatctaatggtattaaaacaattactgttttaaaaagtgataaggattggaaaggaagaaataaaactaccactgttggctgataacatgattatatacatagagatttaaatttacagataaattggaattaataagttagcaaagtagctacagactgcagttatctttctgtataccaacaacaatcagaaaataaagaatattgaaaaattcaatttatagtaacacaaaaatgccaaacaccagtgtatgaatctaacgaaaagtatgtaacatctgtataccaaaaactacaaaacattgagagaaattttaaaaagaaatgagtaggaagatatgtaccatattcatggactggaagattcagtattataaacacttcttcccaaacagatctgcagattcagattctaacaatttctaaatgagcatcaacacactgattatatactctttacagaaatgcaaaaaccagtaaaaaccaagacagcttctaggggaaggataccattctcccagatgttgtgactcatataaacctggagtcacagagacaatctggtcctagaacaagggtagagaaattgagcaatggagtcaagccagctcag

SEQ ID NO: 47248 - DNA, 1030 bp, Homo sapiens
aggggatatcagctctgtgttcctggcagggtttcatctcagaacagagcagccagggaacagcccttcggagctgctcacccagagcccactggtctggatccctcccgctgggctccctcctttttattagaacagtaaagtctgcaacagaacaccacctcacctttccccacactagctcaggaacagacagaatggactaaaaatagttgagctaggtttccaagtccaggatgcacaactcaggccgagcttgggccaaggagctggacgacaagttgcccgctgtcccccgaggcaggaggcatgagcccttctggagaaggaaggcagacgttgccaggttttctgagtccctgcaagatcagagtcgctcctttttaggtctcccgggaacagcgctgaggagcgtgttcctgctgcggagggagtgtgctcctggcaaggggccgtgggctggagtgtagacagagcctctgtgctagtgaggctttgccgagtgaccttggggaagtctgagcctgtgcttgcccgtcccagctctgcctgcctataggataagcagggatggccgtgccttccggcccagcctgccctggggaccttgtccccaccaggctgggcactgactggctaggacattgcattcagtgtataccaggtgccctctgggtagttgggaccagtcggtttagtggtggtcccagttagaaggaggccagaaatgttccaggctgaggccttgccctaccccttgtggatactgacttgttaatgaggcggtagtgtccccagacattgaggtcagcccctagatagaaaccctcgagtcccctactcaacacttgccgctgacctcatctgaggcagccatctgagatccagacttggcctccaacctgcaaaacaatgtatctttttgcacttggaaaacctccgatgggcttcggcggccaagcccagctgtgcccagctccattccagagctcccgtggccgactcagcagggtgtcctgcctccatcagt

SEQ ID NO: 47249 - DNA, 1032 bp, Homo sapiens
tttttaaaaaaattattccattttaaaaatgccaagcgaaggaaaacttggttctaagttagcttcagctcttgtgccaccaatttgttatttgagcactgatctttatcaacaattatcatggtcatctaaatctcttccttttttttttttttactttaaaattaaacctatcaaaaaccactctgtcttttcctgtctgcctccttgaacctttttcaatgatcaaaatgcttccatttcctggggttactgcaatatgatgtttccttaaatgccacaatcctcttggccacttccatagtatattcttcattatatacttctcaatattacatattttgaggtgagtgctaacccacatgtttatttgacatctcaccatttccaaggcacagcctcactgtcctcaaacacttcagcacctggttttacattcttatatattatttatactgtgtcccatcaacacagacactgactcttcacctctctcatctggcatcctgattctgcaactggagtgaatttctaattgcactttagatactccagagcttggaccgtataattagtgagaaaagtgaccccacctttaacacttctgaacgctgtgtccctgtcactccttgccgctcccaccgtctgtcccctgcttgccttccgccatttctcttttcccattctgttggcttcctttttagctgtaactagcttgaacttcatgatcattcacttcagagttacaccctctaccaccatagagtcatgcttggtattccagcatcccatcctcccagtccctagaataatgacacaccaggccaattctggctcagtagtctcctacttaactgttatactcttccttttttccagtacccccaacatttgaattcaccatatttatccaaaaggtcgaagaaatgctttgcaaacccttcagtgggttgtgaaaccaaattattggatgtttgccattacttaaaaataacggagtaaaatagaatgaaaaatagaatgcaaggcata

SEQ ID NO: 47250 - DNA, 1410 bp, Homo sapiens
gttaatgcccaggcctggaggagtgaacagaacaggaaaggaaggaaaccttcagggagcctatagcctctgggttgaggaggttcatttaaatcctttttttcttgtttggaactttctttaatactgtagaacaatatgtttactcagtgaagacctgtgagtggctctcaagtagggttgacagttgagacatttggcaggggacatttggcagtgcctggaggcatttttggttgtcacagctgggggaggatgttaactgaaggcatctattgggtggaggccaaggatgctgccaaacattctacagtgcacagaacagcccccatagcaaagaataatgtggcctaaaataccagtagtgccaaggtaaggaaatcttggtatgagcaaatcaaagaattataagctttatgcctttgtaaagtcatataaatgtttgcgatagagatgtccaagtacaccaggaagaaagtaatcaaaactacaacttaattttctgaatcaaaatacacgcaggtatacttcctcctatgtctaacatgtttagatcgacattgttcttcattttagttttctgaaatttatatgaataggaagaaactaattaacacatattacacattccaaccttaataagcactacaccataggaataaatgtcaaatatcgcgtaacatgaagaagagagattttaggatttgaaaacttagactactttccagtagatttataggcagaattttctaaataaaacaggcatttaaatgaatcacagttcagataaaaatattcttaaattatctaaatgtctccatatagttcatcgtttatttccttttcgcttttttttgagatgaagtctcactctgttgcccaacctggagtgcagtgacacaatctcagctgactgcaacctccacctcccaggttcaagtgattgtcctgcctcagcctcccaagtagctgggattacaggcacgccatgcccagctaatttttgtatttttagtagagacagggtttcactatgttggccaggctggtctcggactcctgacctcgtgatccacccgccctggcctcccaaagtgctgggattacaggcattagccactatgcctggccctatttttgcttatttttatgttttctctagaagtaaatctgatgaagaccttgcctgttatccagctcttagagcgatgcttggtgtgtagtacatgctcagaaaatatttgataaatggatatgaatcaccagttacaggcaaggaagtgtgatggcagaaagatggtaggaagcagaagttttaaagtccccctagagttaattccaaaatcactggtgtcagcttggccacctggtgcagagcttttatctttgagtaaaccttttatgcttctt

SEQ ID NO: 47251 - DNA, 1918 bp, Homo sapiens
atacaaataatgtgtgtgtttcttccttttatcattgtatttttttatttttaaagtttgtaaagtttaatttgcatttcttttatgacatcactcctttattattattaatatttttagagggaaaaatcaagcagttttataattcgaacatcccaaatctgaaatgctccaaaattcaaaactttttgagcaccagcatgatgcacaaaggaaatgctcactggagcattttggatttttgatttttgaatttagaatgttcaactggtaagcataataacaaatattccaaaacttgaaaaagcctgaaatccaaaacacttcttgtcttaagtgtttcagtaaaggacacctaacctgtattattgaataaccattgaaccagactgtgatcacatcacaagcagtgtgtgctaaagagattgcgaaagccaaaaagaagtgtcaccctttgatacagcctggcagatacaaactattacatacatcctaattgtcgttaatcaaaggaaaaggaaaactctgcctttttacaagtaggaagttaattttggagccaaagcacctaggccttctgagaagacagggagatacccttctttttattattattgtttcttaaaattgtggtaaaatacacctaacataaaatttaccaatttaaccatttttaaatgtacagttcagtggcattaagtatatatatttttttgagatggagtctcgctctgtcaccaaggctgtagcgcagtagcgtgatctcagcccactgcaacctctgcctcccgggtgcaagcagttctgcctcagcctcctgagtagctgggattacaggcgtgcgcctgccaccacacccagctaatttttgtatttttagtagagacagggtttcaccatcttggccaggctggtcttgaactcctgacctcaagtgacccaccacccttggcctcccaaagtactgagattataggtgtgagccaccacgcctgtccccggtggcattaagtatattcacattgttgtataaccatcaccaccatccattcccagaattttttcctcatcccaaactggaactgtgtacccactaaactgtaattccccatttcttccatgccccagctcctggtaaccaccattctcctctctgtctctgaagttgtctaccctatgagcctcatataatgagatcgtatagtatatgtaattttgtgtctggtttattgcatttaacacaatgtcttcaaggttcatacatgttgtaacgtgtcagaatttcctccttaaggctcaataacattctgttgtattggatagaccacattttgtttatccattcatcagtgggtggacacttgggtttcatcctttttgtcattgtaaatggtgctgctgtgaacatgaatgtaccgacatctcttcggacccattttttcaacctggaagtgtaattgctgtatcttagggtagttctgcgttcagttttttgaggaatcaccatacgatttcccaagaggccacgctgttttacattcccaccagcaatgcacaaggaatctgtttttctccatatattcttgttgacatttgttattttcttttttttaaaaaaatagtagccatcctaatgggtgtgaggtattcagtgtctcattgtggttttgatttatatttctgtaataatgagtgaagttgagcatcttttcatgtcccactcccttattttaagaaatgtttttccttgtttttaagatcactgtacccaattctcatttattctaaatgagatatataagataagcttattcagctatgatttcagcttacctgaagagagagatttctttttagaggcattgctgctatgtgtcataacatttaaattgccctttaaacagcaacaaaaatctgc

SEQ ID NO: 47252 - DNA, 1026 bp, Homo sapiens
ccttaaggaattctttgtgctgtgtacctagatagaaggaaatctttgagctgatgttttatatattaattttcttacttaaaaattttaattttgtctttaggtagtatagttacttgtcacttagagcaacatctttgcatagttgataaatttcataactaattttctacaattataaaatagtttataaagctttttggatgatgagggagactcaaatggaagtgatccatttgtactattttattaaaacttaatattctttttctcccttttgattcccttcctgtttgtgatagtaataaacatcagagatgaggcacttaattctgattttctgcagtggaagtgtctgtgtttgatgtgagcataggagtaatgagtgagatatgcacgaggcactggaaaacttcagcttggacttgttagtgactcctgtgattgtaatgatcatttgtcagttcaagtgcctttcttgacttggggaattaggaagatggggacctagactttgtatctgcttcccaccctgggactgcttccttacagtaaagagtggcggttaaattgggtgttttccgaagggctgtaaaattttgaatgttgtcgtaattaccctccctccataaacaattttaattggtggctagtttcaaatgggagtttttcttcctacattttaatttacctttaactctggtgatacccaaaagctgaagtagaattcctttcctcctttcattttgttccctgctgtttcatctctggcatgctttttctttttcatctctggcatgctataaaatgttctccttttcaccctaatggggtttggtatggactgttttcaacttcttgttcaaaaattagtttttcttctcttgttagaaattacatttctggccatagaatccctcctgtatgttttcatgaatgaagtgatgtgatctgtcattcggactctaagcttctggtgatgccatgattgaaatgtggattggggaaatgcagcgtgtaatcagc

SEQ ID NO: 47253 - DNA, 1053 bp, Homo sapiens
aacttgaaaagctgtagaatattatacatgtgctgaattataaaaaacattgtgatacacatgaccagtggcacactaatttatgaaggttttcctgcctttatttcagtctagaacagatgacaaagttattcgatttaagagagcaattggatattattcagcgactagtaagcctatgtcatttcatccaccacattacttaggtaagtaaataaaagcctgtgatcaatattgaccatatgataatccaagtaggtttaaatattcaccatataatcttgtaggtttatgtttttgaaacatgattttctgtagttatgccagtaagtatagccaaacttcctgggcagactcagtagcaatccctgaaaatattgaggaggaagagaacttaacagccttcataggatgaagaagaatcagagggcattgtgcagatgaggcagcaggtcgaggggatgttgacgtcttggcagctctgagatatccgcttctaaatacagaattgcctgaggacgtagaagggcctccacaactgcaagtgatttcataaatgcagtgtatttgtagtctctcttttcttgacccctgcctttttttttttttaattcttttttgttgttgagcagagtattgcactgtcgcccaggctggagtgcagtagtgtgacctcggctcactgcaacctctacctcccaggctcaagtgatttttgtgccccagcctcctaagtagctgggattacaggcatgcgccaccatgcccagctaatttttgtatttttagtagagatggggtttcaccatgttggccagacttgtctcgaactcctagcctcaagcgatctgcccatctcagcctcccaaaatgctgggattacaggcatgagccaccacgttcagcctgcaaaagaccaaaagttaattcagagatttgaaattgggaaataaaaatatttataagctgttagcctgaagcctgcttcatattgaacgtcttgtggaggttataaagcactaaactgtaagtagaagtatgagaaatagaccc

SEQ ID NO: 47254 - DNA, 1050 bp, Homo sapiens
gtctgtttctgggctcagttctgttgaatttctgattatcttcatgccacaggattatgccgttctagttgccatagccttgtaataatacttgatgtctgattggggaaatctgcccatgtaatatttctgcaagaggtcgagactgttcttgatccttttcacttttatgtacattttatgatccttgtggagattttgattggaattacaccaactctgtagatcaatttggaaagaataaaatctttattattgagtgtactaaagaaaatgttacatttctttattgatttgaattgtcctgaatatctttccgtaaacttgaattttcttcattaagcattcataacatcttttcttagagatattgctaaatatttatttttgggtgctatttctatgtgtgtcttatattttcaaattaatactgtaagttgattttatcttaacaactttgctcagttcttattaattttcatagtttatttgtatcttgctttggctgattgtgtctcctctagtatctttttgatcttcctgatccactgagccagctgtgacttagggcatgatttttttttttcttcttttttttttgttttcaagatggagtctcgctctgtcgcccagactggagtgcagtgatacaatctcagctcactgcaacctccacctcctgggttcaagcaattctcctgcctcagcctcccgagtagctgggattacaggtgcctgccaccatgcccggctaatttttgtatttttagtagagacggggtttcactgtgttagccaggctgatctcgaactcctgacctcatgatctgcccacctcggcctcccaaagtgctgtccacaaatggacaggtgtgagctaccacacctggccggggcacgatttttaatagaaggtgcgatggtgactgttcttgtctagcccttgatcttaagggggagtctgatgtcttgtcatcttaacccttagcattatctcctctaccttttccatgttaaagaaatatcctcatgaaagagttttaatctggg

SEQ ID NO: 47255 - DNA, 1036 bp, Homo sapiens
catcttccatgtcctgacgaaggtattatcaaaggggccctggagtggcttctgttatttgatgagtggccattcctatgggtgttttgtccttttgtccttttttgaaccatttttctgtcttactaatctacttgaaacaaagttcactttcccctttctaaacattgaatgaaagatgaacatttataactgtaaatagttttaaaataactcgtgaaaagtctcacttttttccttcaacttagtatagaatattttatacttctaatgaaataatgcatcacattattttatgacttgtaattttattctttttacttcaatttcagaattttcttaaaccatatttgtgctgtaatgtcaggtttaattctgatgtcagatacaatatctggttcctttatcatttgtgcttagaaaataatgtttccccctttgaatggctcatagtgcttcatgtgttttgacttgttcatgacctcattgagtgcagttttaatagtgctaagaacaaaaaatataatacaggattttgttaacatacgcatagtcagaaaatgaaactatcattttatacagtgtcataatttcactttattagtgtcttaatgtatgcttaaatatatacatatagtgtggcatcaattattttttaatcttggtgtctcaaatgtatctatgtgtatttaaatttcctcagtgatttgtagtctttatgttggcacttttaatcttagccccacaatttaacaagttacctcagttactagattaatcctgcagaactggtttattgctatcatgtattattaacatgaatacctatatgaccatatataaccagacttttctgtctattctctacaacccatctgtggtttgtaaaatggagtcaataaatgcaataatgaactcctgttctcaaatactcctgaggtggacttcaactgttaactgactaatccaaatattgcttacttttattaattaaaggacatggaaaacatgtagccagtactatttgctcagatcc

SEQ ID NO: 47256 - DNA, 1308 bp, Homo sapiens
atgtaggtggaggaggaaagggacacaggagaacacaaaacaggatggtggcagcaggtggcactgggtcttctcttgagacatggctgagatggacaagggaacgccgtatcttcaaagtgagaacttacaggaactcccttccctcctctcctcttctccttctttttaaggatgggagactgaatagtttggttattgttatgttatttttttggccaatggggaggatttagtgggggagaggtgagtttatcagagagaataggaaaaaattagacagtcctgataaagagtttgtattagtagacttaggtgggaaggagaagcagaggcagaagtccatactttggggccatctttgttggtgaaggcaggaaggattgggggtaaggatacctcagatttggtttgggaaagggagtcaactagcactgaggaaaaggacagaggcccagccagctgcacttattagttgatcatggagcatgggtattttctgcactgtagtttagtacttctttgccaatggtagtttagtacttcttcaatggtaaatgagattttaaaaggatttcataaacatttatgtcttttgctattgtgtgtattacccttagagcagtgtgcagcaggcagtgaaagaatgaataattggtttaggtacacacaacttattggagatgaagacccggtttggtgcgtcagaaaattaaactttgttgtgtgagggtgtgcgtaagtgctgagatgctttgaaaggtcagtgctaaacaaattgcagtcttttctgctcaagtgatttatgaactttgattttgatattctgtagagatggggagccattgaaggtttggtacaaatgatgtttctgtttagaaagatgagttggatagcgatgtatggactgaaccaaaacagaaatgaagcctttacgtgtcaaagatagggcaggtgcagatgacctttgcctagacagttaagaccctagaatttaagtgtttagaaaaatgcattgttaatgtgctatgacaaatacatatttatttctgaatggaaaagatgtgtagatttgacctgagtttagaatttgggagaccttactcagtactgtaatttcagtgggtgagatttttgtaagcagctttagaatctaggtctttatagggagctgataaaattgaacttgtttcatgcgttagttacattcaagagggggaaacaagcctataaaaaagttttttatgtcagtgatatatccatgattatcactgtaattggaacaccagctctccagaagggaaattt

SEQ ID NO: 47257 - DNA, 1382 bp, Homo sapiens
agacagagtaaaaggcctacattttaaaagattgtagagtaataagaatacccagctataattgaagagcgcaaagttcagaaagtaaagctcagtgattcgcacatttttaaaattaacgtcatcttaataaaattggcttttgtttcttgcctcccatttcctacaaaagtcttccctaatacctcaaaattaagtaaataagagaaacaggcttataagaagcagacagataaaaattatacacacatgaaataaatatgtggaatgagggagcaagtttataggtgagtactatttttatgaaagattttcctatattgattcctgtatttttaaaccaccaagaaaagccgaaaggagcattttttcctggtatagtttgcttcagaaatgtttttatttgtgctaataattggaattgctaataaaaagtaaactaagtctgctcactgtggattatactatgaaacagaataatcaatattatggtgctgatttaatattgtgaaaattggtattgtaaacattttccccatgatttctgttaataagtctgtctgaatttctttattctacagagctttctaggagcagcattgaggtttttttcacagaactttgagtagacctagcacaacagatgattgcttaggaaggcaaatgatatgacaggccaatctgtgatattactcttttggattaatattcatttcataagtccttgtactcttttttttttttaaccagtgttacttgccaatccttgagcttttgagtttctaatatattaggaataacatacatggaatgaggaatatgaacagcatttatctacatgtctgtaatactgtgttctgctacatgtcctgtgccttactaagcatttatatttttgtggactgtgggctgctccatcctcaactatcaaagttttaagaaaatatccacagccttttacctttgagaattacagagggtgcttacagacgtatcagcctgaggagaagaacccaacctgctacctacacgctggggctgcttaaaaattagggggcagtttttctatcagaaggaaaaaaaacagtcttcgttgtatccatttttctgtttctctcctgatataaatgaattggaggtttttgttgttgtttatggtcataacaaccccaggaaagctcgtcaagtataatagtagctgctccctaaatacacacaaccagaagtctagtcggccaccatcttggaggccattcatctgcccgcatctcttcctcacctatgaacaggcgtgcatgcatactgcagttctctctcctgcgcccttagtgggcattgctaattaatggtcaagctgtggcactgagcttagagacatactt

SEQ ID NO: 47258 - DNA, 1050 bp, Homo sapiens
ttgtttttttttttttgagacggagtctcactctgtcgcccaggctggagtggagtggcgcaatctcggctcactgcaagctccgcctcctgggttggcaccattctcctgcctcagcctccccagtagctgggactgcaggcacctgccaccatgcctggctaattttttgtatttttagtagagacggggtttcaccgtgtcagccaggatggtctcgatctcctgacctcgtgatccgcccacctcgacctcccaaagtgctgggattacaggcgtgagccaccgcgcctggccgccctagagttgtttttgccagtgtaaaaagttggtttagtgtaagttaaggaagacagtttaatattcagtctttcagaagtaggctacttcctgaagtagtaactttttctgacagtgaaaagagattaatatttgttggtggtgatacacaagatttattcagaggttttcagttagatgagctgacctccaggaatctcttactgttttaataagactcagtaggaacatgttgctcttcaaaactaccagtacggagttcatttttatactaccatgctctaagtcccagatggtacccacccaggatgtgctggagcccagtgccatgggcaagcccacatacccccaggtttctgtaaaaactcagattactttctgtgagctggctactttgtatttgcttatttcctgtggattgaataataccgtgagggctgagaagtccttcctcctgggcaacagtgactctttggaagaaagcagcagcccagagagagaagagcagcagacattctcatctctagaggctaccctccagctgcccctttgcaggggacttgtaaatcagagccaagcatttttctttcctcaacttcttccactcttgaggcagctgtttcaacccgaaaattggatgtcccttggaattcttcataagcactaatttgtaattaatttaatgtaagtgatgtgtaaaatgtgagttcatctcattatctctacataatgaggggtgctaggtgcttt

SEQ ID NO: 47259 - DNA, 1032 bp, Homo sapiens
taaaatgattaaagagaggcgagaacagagccgatgaaagggaaagaaaaaaatgaaaaagttaaaggccaatttagtaagaatgcctctctttataacccctaggggactcctgacatgcacaacctaaacccatgctctgtgtgtggggtatgtttcagtgtgtgtattgtggtatgtgtgtggtggggggtgtgtgtggtggggtttgttgggggatatgttgtgtgaaatatgtgatgtgtgcatggtatgaaatgtgtgatgtgtgtgtcctatgtgtttgcgaggtgtggttatgtagagtaatctgatagcaacatagcatattggcgaacagctcattctggaagctccccttgcctgttttctcttggggtggagcagccttggtgttggatcacaggagggaaggcaggtcggctcacaggaaggcctgtgcatggtagtggtggttgtggagatgatcctgtatgttccgagtctacttctgggaaagcttctggaagctgagctgtgctggagatccacaggatcggggtgggggcagtgccttagattgtgcgtccaacgacaggatatgcttcgtgatggagaccttattggttttatatctatacctaaaagtattgaataaaaacaaataagcatgtatttatatatacatgtatgtctgttttgacttgatggactttaagcatttggagtgtttgaaatattcctttaacatctaaacactaagatattcaaatgtaaatgaaagacatttgcctaatgagagcagtaacatttttgtaaaaggaaaattttcagtgactgccttaacttgtaccccagctctgcccggcaggcttcacgtaaggggacactatctggagttggctccagaagggcttgtcacagagccctatgaggtcttgactcaacgtgttcctatacgtgacactgttacctgacttgtcaggtattgaaatgtatttaagcattttttttctgttgctgagaaactgtgtatccaagtgtctaactcct

SEQ ID NO: 47260 - DNA, 1062 bp, Homo sapiens
caaacatagagaaaagttgcaagtacaatacagaaaccttttttttaacttaaatactttactgattttctaacagttgatggcattttactttataaccaccaaagaaccatcaaaatcaatccgcagtgatgctgtggtccattccacccttcagagctgttaggcttgttgtcccaacagtgtcctttatgacaaggaacctgttcctgttccaggtcgtctctgctttcaggagtgatgccctgcctgggggtgcacacctccttctgtcccattaggcaggacactggctcagagggtttggtgcagggtgactgtggcttctccgtgtggtgctgctctcaccttttgtaaccgtctcacatggaagtgcttagaggccctgtaaaggtttcactcctcagacaggcagcacgtttttatcagcatgaactcagagcctcttgtttctctaggggccttcagctcactgcaccatcatctgttttgatgttccctttgtcaccttgcaaactggccttcgtcatcttctctgagcacctcctttcttctccacagatgttctgcttgcccctgtgtctccctgcctcagccctgggatccccatttctccaagcagccccagttcttccaagtgggggatggcatttagaagccaggctctcagagtcggaggttctgtgctgcaggaactttgccgccctggccctcccagtgcagcatgagggatccaccccaacattgctgttgtgtattcctatatctcattgaaaacagtggatttaccctggtccttccaagctggcacagtccagtgtccctccctgtgttcatagggtacggtctagcatcctgctgcattcgtagcttctggctctggcagtgagaggcttggctgggaagccccatggccccttacttggtcaggatccctgtgtggtgcagtccctattgcccctgtttcttttggggcctgtctcaccctctgggctggcaccgcttttgcaggcatgactgaccatccctcccactgggtcccaactacctgactttaggaag

SEQ ID NO: 47261 - DNA, 1049 bp, Homo sapiens
tcctggcttgaacaaaaaaatgaatgaatcctgaaaattggtacttagaatgtacttccagggtttaaatgtttcacaagagtgaggttgtatcaaaaatcactgactagctagttttcagtatccacaattcagtgtgctatttttaattattctaaagtaaaacattctgacatcctgttttcatttgtaatggtatcatcaaatgaaagtagaaaagtagaaaagctgaataagaaatcacatgggtcttcttagctcacatcatccgggatttacctagaacctcccactggacttgtctatatgacgggcgaccactcagtaatcaccaaccttttgtttctgcccctcaccaggtacatggtgcagtggccgggagcacgcatccttcggcgtcaggagctagatgccttcctggctcaggcgctgtcccccaaactctacgagcctgatcagctccaggagctcaaggtaatttatcagcctcattgcattgtcttggacagtctcactttggattttggtgtaatactgctaactttcaacaggcagaattgctaattctttaaactaattgctttagtccactaaactaataatactaatatgataagaacttgatcaatcgccttcatggcaaaaggaatattcctttctagttatggatttgctatccccagtttggaaatgattagtcccactttgtcagagaatgatttccccttgtttaccattggatgtttattcttatttatcacatcatgaaataaacttgccttttatattttagggggggattccaaaccctgagagggcttgatcttaagaattttctaacatctagcaaggattctttttcttatttcatttcattgttcctaattacaactttagttttctctaaaaaatattctttgcccctcaactattataaaatcccttataaaaaaccacttgaagaacgatgttacatcatcatttctatccctttttaagtcagcatttaacatcatattccttttaattttgccttctagtaattcctt

SEQ ID NO: 47262 - DNA, 1026 bp, Homo sapiens
aagattcctcctccggccccatcttgaccgtggctcatcactcctggggtggggatcctcgccagcccagcccttcttcactggcaccgactggagtgctgtcccagaatgtgggctttgacctgggagggatggatttttgtggcaggacctggcaggaggccgctggaggccggttgccttcggaggtgtcttgtctgcctcatttggtggggatgtgtcgctctgcaccggcactgaggaggacctgtcctctccttttagggatcctactcttacataaagccacttgggccgtacactgtgttcccttgtgcctgtgccttccaactggaggatggagaccaggccccatgccctccactcctgcctgcaaagtgagctggcatctcactttgtcaccaacttactttgaataatttaaatctctgggaagcaggaatgcttctgttaaagttttaaacatccttaacatgtagctttctggccctctttcagctgcttgttctattggactggaagggtttttggaggtgtaatcagtaaaactgacttgaaagaaattgaaagctgttcaggtcacttaagtgacagacatttcattcatacctcagtaaatatttgttgggcttgtattctgtacggagttcagagctggctgtgagggcccaggggttagccaggcagcttctcagattggtggcagccaccctggagggggagtgtctcagcagaggaggggcgagagtggactgaggttttgactgtcccccgtgttgcatgttgctgtggggagaggttgggagaaggttaggggcagggagccagtgaggaggtgactgtcaccctgcctgtgtacccagggggtggggagtgaggactggggtcggtagaagggtcacattctggaagtgctcagaaggtagagtggacaagacttgcctggcatggctccctccaattcctctgtgtccgtctgtctgtctgggctcagcctgccctcctcctcagggccctgtctctgtg

SEQ ID NO: 47263 - DNA, 1112 bp, Homo sapiens
cctctttcagcagtatacaagtcttgcatctcctaggttaaatttattcctacatattaatattttgttatttttgatggtattataatggtaattgctttcttgattttattttcagattattcattgctagtgtgtagaaatccaactggtttttgtgtgttgtttttgcacctacaccttctgaatttatttgttaggtatagaaagtttttctgtgtatggattcctttagagttttctatatgtaggattatgtcatatgcaaataaaggtaattttatatcttcctttccaattcagactccttttatttcaggattttttttttttttttgtctaattgctctggctagaacttccagtactgtgttaaacagaagtggcaacaataggcatcctattttcctcctcatcttatgggaaaagctttcagtctttcaccattgtatacaatgtttgctgtggatttttcatccatggctttcatcatgttgaagaagttcccctctattcctagtttgtagagtatttttatcatgaaaggattttgttgagtgctttttctgtatcaattgagatggtcacgtaggatttttcatcattgtgttaatatggtgtaatgtgtcttggggaggatggggaattggggaaggattgggagagatgggaacataagaatgaggcagagggctgtgccagctcaggagaaagagccaggtgagccctgctgcttcttgtattttacccacttggggagatctgtcctccagggtgaaggaaagagaagcacagcttctgctgtcccatcctccaggacagagccccaggattgcatctttttcttcttgcagtcagacttgatgctttaggtgttgaagcactgatttattttcatgtactgaaccgtccttgcattcctgtgataaatcccacttggtcatggtgcaccgtccccttaatatgctcctagactttatttactggtgttttgttgaggatttttacatcaatattcattagagatactggtctgtagttttcttatagtgtctctgtctggctttgggctcagggtaatgcttaggaaatgttcccccctcttctatttt

SEQ ID NO: 47264 - DNA, 1031 bp, Homo sapiens
ttttggtcatctgagtgctttgcatttttattcagcattccaagtttagtttgtcaatttctgcaaagaagtcagctgggattttgatagggattatgtggaatctgtagattagttttccattgtttcttgaatcccacacctttcttctaagtttgatttccttcttatagaattatatcttttagttatttcagcaaaggcttatgaaaatacatactgtcttgtctgacaatgactgtctttattcttacatgattctaatattctaaaatggatctaaagttctagagtgaaagctgtttttctttaattctttgaaaggtattttattgtcttttgacatctcttgctaatgagatatctgttgttagtctagttgctgtttctttatattgtttgatgtactcagtacatgagtgtacgatattgcctctagatgtacatttgtttttgtttattctgcttagaacccagtaagcctctttaatttggagagtcacatgtcaattctgaaaaatactctgttttctcttttagtagcatttcttctgtattctctgtatcatttaaaaatttttcttcaaatttactattttttcagccatctactgtttagtgcatccattgagtttaaaaaattttgatcattgtattttttatttctaaaatttctataaatttccttttcaatattgcctggtcttttttcttttttaatacatccctgtgccttgccgcatcctcttgatttccttctgaatgtgttgagtatatttattttcaaatctcttttcggttgttctattatcctcagttctggtgatctcttttgactggtgtgtctattgactgaccctcttggtggttcacctccttctgtggggcatggtgcttcagaggggtcacattccattgggactagtatgtccttggctgctgtccacctacaagacggtttgtgtttgccttttgctaaggttttatggttttcacaagattagttccagatccagtttggggttcccaac

SEQ ID NO: 47265 - DNA, 1413 bp, Homo sapiens
ggtgaggcaaggggtgcggagggctgtgagcccggtggcaacctcgagagcctcatggttccagcggcaacacttgggcctgtgtgtgctcccggtgcgtgggacatgtcacctgctgaggccccaggcctggccggagtcagacaggtcccagcaggaggggcggccacttttctgcagcagccactgactaacttggccaggttgtagtttcctcattgaagagatgagaggagaaggcctctttctgggtggtggagaaagggagcagtgcccaggcagagtcttgtgagtgtcagggagctcagggcaacacgcgaggccattcagccaaggggcaggtctgcggggtcctgtggctgcccagcttcatggccctgggcgtgtcacttgctttatctgaagctctgcttctaggttcctgggaagctattaaacggcattcactctgtgacggtgctagggagttgacgatagagatgagaaagagcggtgtgactctagcctgtggacacgtgtgttctgcggcccagcccgtaaggcagcgggctcgccgccccttcacttagagcattggaagccgcctcacctaggcactgtatccaggtgtctgcacttccatttgctcagaattggagctgtgtctgtttgaagttccagacttttctgcctcagcctgttgtccctgctactatatagagagaaacctgtcctcaaacccctgggaaggcaaaggctggagctgcttgcaggccaagctctgaagtagtcctccttcacccaggcagggagacaaattacacactgtttcttagactgttacatctatcctgtagccctggccctgagtttatttttccaacatagctatggagaaaaaaaccaggaaacttgggtccttttccggttaaagaccaattcagcatgtgccaggattcctaggcaggcccgaggcggggcttaagcttgtccagtggccctgggacagttgggggtcactgtcttgagcatctaaactgcctggggaagggctctctctgcctgaatgtggtgtgtggggaggcacagcattgtgtaggaggccatggggttggggagtgtcccctcctgtgggcagatagcttcccacagtggggactgaaggcccagcctggcctcctgtctgcagaggcttgggccctctaccctcctcccatctcaactgggcctgaggcttcttcggatggaaattcaaatagtggcaacgtcacctgcctcctggaggccatcctgccgcggccctggcagaggacccctcgggaggtcctacctgtccgctggctgtggggctatgtggatgctgctgacccactcgcttctgccctagctccaaggctctcaggcccccgacgagccctggtgtgttcggggcct

SEQ ID NO: 47266 - DNA, 1032 bp, Homo sapiens
aatagagtaggaaggtgcagccttttaggaggtgtttaggtcgtcagagctccaccctcatgaatgaactaatattattagtaaaagacctgatggagggaattctttttttgcccttccactttctgtcatgtgaggacacagcatgctcccctccagatgatgcagcatgtaaggcaccatcttggaagcagagagcagccctcaccagatggcagtgccttaatcttggcctatccagcctccagaactgtgagaatcaatgtctgttgtttaagttgcccagcctgtgctattctgttatagcagcacaaaatggactaagacagcgattggtaccaggggagtggggtgttgctaaaacatacctaaaaatgtggaagcggctttggaactgggtaatgggttgaggctagaagagttgtgaaatgaaagcaggaaaaagcttgtattgccacgagtggagcattaagagtgattctggtgagggctcagaagaagaggagagctgtaaggaaattatcactcattcttctgagaaactacgtaagtggttttgaacagaatgctgataaaaacttggacagtaaagaccattccgattaggtcatagacagaaatgaggactatcattggaaactggggaaaaggccatctttgttacaaagtggcaaagaacgtggctgaattatgtccatgtccatgttctaggactttgtaaggggcagaacttagcgatgaaccagaatatttggcagaagaaatttctaagcaggaaagtgtgcaggatgctgtgtggtttctcttttttttttttttttttgaattgtgttgtcttttttttttttttttttattatactctaagttttagggtacatgttcacattgtgcaggttagttacatatgtatacatgtgccatgctggtgcgctgcacccactaacgtgtcatctagcattaggtatatctcccaatgctatccctcacccctcccccgaccccaccacagtccccagagtgtgatattccc

SEQ ID NO: 47267 - DNA, 1048 bp, Homo sapiens
actatgtggagacatagagagaaaattgtcatctacaagccaaggagtgaggcctcagaaggaaccaaccctggtgacacattgatctcagacttctagcttccagttctcttgttcaagccacctagtctgtggtactttgttatggagcccgtagtaaactaatacagaagacaaaattccctgctgttccttaattcttccactataacttgtgtgtatttctttataattctatcttaaacaacatatttcttgattttgcctgtttataaactttacataaattgaacaatgctgtgtgtattctcctgtgacttgccttttcttttcaacgttctattcacatttatccatattgatgtgtgagctgtagcttatttgtattcactgctgtatggcattccattgtgtggatattccacaaattacctcttttacttgtgatggacatttgggttgttcatattttcacatgtctctgggtatacatgtgcaagagtttctgtaggctatgtagctaagggtaaaatttgtgaactttagggtatatacaatttcagtttcctaggtaatgacaaattatttctcaaaatgattgtaccagttcacattcccaacagcagtaaatgagagttcccactgctctgcatccttgtcaacacttagtattgactgactttttgatttttgccagactcagttggtatgagatagtacctcaaatatgttaccttgttatatgttttgagccatttttgtttcttttctctagtgcttgttcatgtatttttcaatttttttactgtagtaaaatatatataataaaatttatcattttattcatgtttgagtatatagtccagtgttattaaatacattcataaatgttgtacagccattaccactatccatctatttaactcatcattttgtaaaactgaaatgctgtacctattaaacaagaactcccccatcctccaacatgccagcccctggtgacaccattctttttgtgtctctcattttaactactctaaatacttta

SEQ ID NO: 47268 - DNA, 1044 bp, Homo sapiens
taattatagtaaactgtggaatctagattaaataattacaccctactttttttcttggcttgtggatgtgtagactacatagtggttttttcaacccaggaacataacagtataatggaggataggaaggcagaagatgtttaaagggttgagaaataatggtatatgtataatggtcagtaagcagaacaagccagccaagttggatattcttcaagactatcttaagtgtctgctatgtgtctaagtgaaaggaaataagcaatagtccttttgggaaacctgacctagtacttagctatttcagacttaatgtgatgtttgatagagtaggaaataagatcttaaattagaattaggttaaattgctttagagaaacttatttataaatgtaaagaatttattatctcatgtgttgcacatgctctatcgaagggagcaaaatactattggagagtttgcttattaatgtaatactcagcctgcatcattgtcggataattttgttgataattcaactatttgagattgaaagaaatctgttaaagtagccagtgttgtaattttgatctgtgtttgattacagcgtatgaaacaaaaatgagactggaggaaatagtttacttgtgaactttttgagctactttgttttaggagtatttaaattaatgtaaaagtgtagggaaatgtcttagctcagaaaatttaaacttactagatattaagtgcttaaaaggtagagtatgcttgcatttcaactaaagtttagagtgttttaggaaattagaggctattttaaaaaatattttgaagttaggagtgtgttcctaagtgttttcaccataagaaaataagtctgtggggatagtacatatgttaattaacttgatttagctataatataaacctattttatgtacaccataaaaataacaatttttatgtcaatttgaaacaaattcattacaaaaatgaaattaggaatgtgaatgttaataagttatgaaaacttacttgatgtaaatgtagatatagacaagtct

SEQ ID NO: 47269 - DNA, 1049 bp, Homo sapiens
gattttgcccacaaggaggtaactatacgacctgctgcctttcttagggccttattattcaccgataacctgtttccttgctactttgctttggtgtaagcagagttctttctgtaggttttttcaaatgaaaacattgcaagaatatcaaagagagcagtgtttgcgttagtgattataaactgcagcatggtgctgacattgataactgaaagtcaactaatgagaatttgagacttctgaagtacacttagttgctagtgtctcccttttggtgtcactggaaagtttagaaagcatggttttgtttttgctcaggtttctctttctgtgatgcagagactctcagctgttcctcctctatgtctacattatgtctgaaggaaagaatttaacaaaacttgaaatactgctgtttttctacaatgtttgtaaatatttatcttgctgcttttctaggtttgtcttctggatttaaaatttggggcggctggggtggaattgcatggtttgggaatgggtaattgagctgctgctcattatggtatgtaacagtgatttgtctgtttaatatgtacaagaactggaaggtcaataaaatgaaagtggttgtcttgactgggtaatagtgttacatattttgttaaaagttatacatcttttcaataaaaacactgcatacttcaaaactagtgctttttaagtcatccttaacccttatccccatccttgcagtagtagatgcatttttcatttgtaattattatgatttgttcttagtttcatttttcattagcaataatttggtgattggatggtcatttacagatgttttaataaagctaacacgagcaatttccagctcttccatttttgtaaacacttgtgtgactttgtacagacaattaactgctcaggatcaccctcctttttgttttgtttttgagatggtctcattccgtcacccatgctggagtgtagtgaaatgatcacagctcactgcagccttgacctcccggactcaagcttcctagtaactgggactacag

SEQ ID NO: 47270 - DNA, 1050 bp, Homo sapiens
attctctgcctcaggctcctgagtagctggtaccacaggcgcccgccaccacgcccggctaattttttttgtatttttagtagagacggggtttgttttttgtttgtttgtttgtttgtttgttttgagagggagtcttgctctgtcgccaggctggagtgcagtggggtggcgcggcgcgatctcggctcactgcaaactccgcctcccgggttcaaggtattctcctgcctcagcctcccgagtagctgggactacaggcacgcgctaccacacctggctaatttttgtgtttttaccatgttggctaggatggtctcgatctcccgacctcgtgatccgcccgcctcggcctcccaaagtgctgggatttcaggcgtgagccaccgcaccccgctcgagacggggtttcaccatgttggtcaggctggtcttgaactcctgacctcctgatccaccggcctcggcctcccaaagtgctgggattacaagcgtgagccactgcgcccggccaagacctactcttatttctaacttctcagtatgaaaacattgcaaagatatccagaagtagttttgaagttccatggattcatcactcagattcaccacttacaaatgactcacctgtcttctttcccccaaatctgcaaccccaagtgtggatctctttggaaattgtctctttcactaggggtctataccaggatttggtgtcttgagtgacccttcatagagtgagttcaaatccaggtctctccctttgtcactgtcactttgagcaaggtacttaacctcgtggagctgctgtgaatgtagaacgaagtaaaacttgtgtatgacacttctctgatgtagttctttaaaacaaaattcaaatgtcatatcatttcatctgtaaatggcaaaaaccacaattacttttgcaccaatctaatacttcagtgttcagtatgcatctctcataaataaggaatttaaagaaaaacaacttcagcattaatgatcatacccaagaaaattaacagaatttatttagtatcacttatt

SEQ ID NO: 47271 - DNA, 1112 bp, Homo sapiens
atgagatcgtgccactgcactccaacctgggcaacagagtgagactccatctcaaaaaataaaaataaaataaaatagttagaagaaactagcttgcaccaggtagcaatttttttataacagcaggaatggactaagtcatccacagagaaaattgttagagctaatgaattaaccaaagttgcaggatacaaagtaaacacacaaaaatctgttgtatttctgtacatttgcaatgaactatctgaacaggaaatttaaaaaaattataacagcatcaaaaagaataaaatacttagtgataaatttaaccgaggatgtaaaagataaagaaaactgcaaaatattgctgaaagaaattacagaagacctaaataaatggaaagactttccatgcttggaatgaattagaagatttaatattgttaagatggcagtactacccaaaatgatctatagatttagttcaatcagaattccaatggtgtttttttttcagaaatagactcatactgatatttatatggaatctcatggtaccctgaatagccaaaacaatcttgaaaaagaaaacaaagttggaggactcacactgcctgagtttaatacttactgcaaagctatcataatcaaaatagtgtcatactggcataaggatggatacatgtagatcagtggaatagaattggcagtcctgaaaaaaaatctcacatatatggtcaattgatttttttacaagggtggatgtcgagatccttccatcagaaaagggcagtgtatacaaatgatacttggaaaactggatatccacagccaaaagaacacgcttgagataaatgaaagaattagaatgcctcagcaaggaaataaaaggttttaagaataagtatatggaaattttagaactgaaataaaaagctacgggatagacttaccagtatattagcggtaacaaagaaatgagtgaactagaagatagaacagagagaaaatggagtggaaagaaaaatgaatagagcctcaagaattgtgggagtacaacaaaagatataatatttatatctttggaggttggaaggggaaacaaaggagggaagggctgaaaaagtact

SEQ ID NO: 47272 - DNA, 1018 bp, Homo sapiens
cctcaccctcctgagtagctgggactacaggtgcccgccatcatgcccagctaaatttttttgtatttttagtagagatggggtttcaccttattggtcaggctggtcttgaattcctgagctcaggcaatccatctgcctttgcttcccaaagtgttgggattacaggcgtgagccaccacgcccagccagtttctattcttaacctggtagcttttttgtgcatcatttctatcctgtaaattctcataactttgtttcttttatcatagattatttaagattacagcaaggtgtgaaaaactgtacaatgagtagggttggggcagccctgtaccctaagagatagcatgttataaaaccaggtaatagccccatacttttcctgattgtgtcccgttcctccgcctctgttttctgagttagcattccatgactgtctttatccttttattccatctgatgggttcttcactcatatagggtgttgttttgcatgtctgtaaacttctctgcacataatgttattaagttgtttccaactttttggctatgaaataatcttgctctgtattcttgtatgcctccttgggaacatgtccaagagtttctcttaaaatatataccggccaggtgcagtggctcacacctgtaatcccagcactctgggaggccgaggcaggtggatcacgaggtcaggaattcgagaccattctggccaacatggtgaaaccccgtctctactaaaaatagaaaaattagctgggtgtggtggcgcatgcctataatcttagctacttgggaggctgaggcaggagaattgcttgaatccgggaggcggacgttgcagtgaactgagattgcgccactgcactccagcctaggtgacagagcgagtctccatctcacaaagaaaaaaaaaaagatatatacttaggtgtgtagtagctggttcacaggcatgcatagcctcaacttatataagttatgccaacttgtgttctgaagtgggcatggc

SEQ ID NO: 47273 - DNA, 1071 bp, Homo sapiens
gccttatttttctcttaccaaatgctttgcttattcactacagcaaacaatttcagagataatgaaagcagacttctctattgagggctgtcccataatgactcataagaacttagtcctgccgagcgcagtggctcatgcctataaccccagcactttgggaggccgaggcaggcggatcacctaaggtcaggagttcgagaccagcctggccaacatggtgaaaccccgtctctcacctaaggtcaggagttcaagaccagcctggccaacatggtgaaacccgatctctactaaaaatacaaaacttagccgggcatggtggtgcacgcctgtaatcccagctgctcaggaggctgagacaggagaattgcttgaaccagaggttgcagtcagccaagatcacgccactgcactccagcctgggcaacagagcgagactctgtctcaaaaaaaaaaaaaaaaaaaagaacttagtcaataattacctaggagttacggtatcaacttacggaagctgaaagcactgccaatttccagagcctttaatttataccatcatgggaattagtgttatctccaattggcagcctatttaaacctagaaacaaaattttttgaaaaagtcaatttgtatagttttaacagtttttgtgcatggataagaatatgcttaagccgaaatatgtataatccctgaaacatctttatgctaatgagaagtcatctattattaactttcaaacgctgagcttctccttaattcaccagatttttttaaaaatcctggattattgagcaaaacagtgtacgtagtgttgtgcaatgctattcggggaatatacttggctgcagtcttcccagaggctagaggacagcaccttcatttgcccggagggcagcatcagggattcctcttcttcaagaggacttaagggtgtccatacagttcaggagacaactcacatcaggctgatatggaagctccctggcctaaagcctattccacacaggagccagtatctcttgctacagcttatctgattcgtgggtgccccttacttgagtcac

SEQ ID NO: 47274 - DNA, 1725 bp, Homo sapiens
ggatttcggctcactgcaagctccggcacccgggttcaagcaattctcctgcctcagcctcccaagtagctgggaccaagtagcctgccaccatgcctggctaatttttatattttttagtagaggtggggtttcactatgttaaccatgctggtcttgaactcctgaccttgtgatctgcccgccttggcctcccaaagtgctgagattacaagcttgagccaccacacccaaccgaaagtctgtaatcttagcaccttcccttattagggaaagtgaaggcatcaaggataacacagaatgaagttttattttaaatgacagaggtaggccctaaatttttttacacatttttacacatttttttctataccattttaagataatagatttcttatatttctttgctaattttcataataactttcttttttagctacaaggctttggccgaccaagtgtgtaccatgctgctattgtcatcttccttgaattctttgcgtggggcctgttgacaactccaatgttgactgtaagtattgctgaactgggtttgtgttttgtaagagaaagagataagttcttaggcacgtatcactgtgtatgtctagatacgtgtttgggagtagctcttgatagtgatttaaaacagcttgtttcattgttttttttttttccattgtggtttctgaaccacatgtaacacaaaacacctctttaaatattcctgggtagcactgcactcttattgaagtaaacttgggggtgctgttatacaaacgaactgtatatgtttaggaagatccttaagatactctacagcagcaactcccaaacttttttagcactagggactggtttcgtggaagacaatgtttccacagaattgggttggttgggggatggtttcaggatgaaactgttccacctcagaccatcaggcattattagttagattctcataatgagcgcaacttagacccctaacatgcacagttcagagtagggtttgcacccctatgagaatctaatgccgctgctgatctgacaggaggcagaactcaggtggtaatgctcgctcgcctgctgctctgtgtggctgggttcataacaggccacggactcatagggtcctgtcctacaggaaattgcagagcattgttgaagtctgtaacttctttaggaggatattaatggtctttgacttaagaacatagtaaatagcagattggtgagtactttgtaacaatgagtaataattgtaggagtgtctaaatttcagtttttcgtagcttatctatagccatttcttcagaggtggtattgaatatcttagcaagaacttgtatgtttcatctatgatgcggttagaaggaagagagatgccaaagaaaagatgacgggggcagatattaggtggcttacaactatttaacacttaattttaataaaatattttaaactggagttaagtttcagttgtcttaattattctttaaaaattattgatgggccgggtacagtagcatatgcctttaggcccagctattcagtaagctgaggcaggaggattgcttgagctcaggagttcaagtctagcctgggcaacatagcaagaccccatctctaaaaaaacaaaaattaaaaaaaaaattggagcttaactcttcctaatcatcattttgccttactaaagaatccctctgggtacggataatctttgtt

SEQ ID NO: 47275 - DNA, 1197 bp, Homo sapiens
aagttttggaacacattgtattaggctgaattatatactaccatttttgatttacagaaacattcatttcatacagttcaagctaactttttacttgctatgttagaaagcagagatatttaggaatttggcacttctgggtttttcagtgtaggtctctagggagataggctggaatacacctgtgaagatgaagtctgcctactggggactggtctgtattcctgacaccagggctgccagaggtgaagggcaagtttttgttgtgaaagcaccagtaaatgaccagagcagggaaatctcagttgacagaaaagtggacattgcctgaaatgggaagatattaaagttttggattgtatatgtttttatgattttatatgttttatatggttttattagttttggattttattttataatggataaagtcttcctaatctactttcattagcatgctttctcttttcctcagtcttgccgaattagtgtatcatggttatgagaaagtactgtgcagctccaaatcttgagatgcctttctgagaagactggcattattttctttgttctgatttaggagttgcccaggggatcataactggaataagaggactatgcaatggcctggggccagcactgtatggcttcatattctacatgttccatgtggaactgactgagttgggcccgaaattgaattctaacaacgttcccctgcaggtaatttggtcataagtctagttttgtaacaacaattatgtatgattatagcaaaatcttgtgaccttaaatttggagagcattctttcttgtatgttactatattttatttggcagcaataagtattgtgttcattgcttctcgggatcagggaggggtcattttagtgatttaatatcttatgtaaaagatatgtcttaactttgttcagattctgttttcacctacacaatcactacactattctctggataagcccaggctagttaaaatttgaaatgacctaaaaatccagctaaaaattgaggtagggtactttttgtactatttatttgaaatttcttcccttgttccctctaagccatatctatacaaagctggaattaatgttcatgtacaaaggtgcatgatctgaagtcataggatgggattataggtaaacagctgttgcttacaagcttacagttttgctt

SEQ ID NO: 47276 - DNA, 1035 bp, Homo sapiens
tccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggtttt

SEQ ID NO: 47277 - DNA, 1066 bp, Homo sapiens
tattgttccatattcgtttttaacatatacatatgtacaatgttaattgggaactaattacagtatactctagaggatgtaagcaacttctagaatatgccttttaatattctccccatgtttgataatccatgctttcagtcaactttttttttttttaccttatctttatgagcataacctacattattcatcaagtaagaatgggtactaattcccatctcttttacaaagcattaaaaacacaactgtcttatccacagatacaagctgatgtaggttttgttgttacatcattagtcttgtcactgaaaaacagtaagtaggtggcattaaaagccttggagttttaacttgattctcatacaaatttttcaggaatctagtctatttgatagggtataagaagtgtcttctatcaaggaatttcctatgataggcagtaaattccctattggtgtttaataatgatattttattaccttattcacatacttaaatatgaggatttctaagaaaaagatattacctcaagaaagagtgatgactaggatttcatacggacctgatttgttttggtgtttaggatctggcacatcaaaggagaaatgggttgttctctccagaccatgaaaatggacatttatactaaatacagaatataaactcaagagcatgacagaagactatgttttatcaaataacttaacactttaaaaagcagcagcattacattctggcagttgctctctagtggcagatagcacagatctgtctgtgtcctatctgcagcagtctctgtgctgtctgcaatcttggccaagtcaagatccttcagtggtcatgtttgagcaagtggatgcccaaggactttgacagttagtttataacaaatttttttttgttttggaacatggcataacatcttttctaataagagagtatttcaggttctggaaatatcatggttactgtatatgctgtgtttaatcattttctttctctttttttttttttttttttgagacagtgtctcactctgttgcccaggctggagtgcagtggc

SEQ ID NO: 47278 - DNA, 1035 bp, Homo sapiens
acagagtacccatgaaaacttttttttttttttttttttttgagaaagggtctcgctgtgttgctcaggctggagtacagtgacacaatcacgactcactgtagtcttggcctctcaggctcaagcaatcctcccacctcagtctccttagtaactggactataggcgtgtacaccaccatgtctggctaactgttatttgtggagagaggtcttcctatgttacccgggcttgtcttgaactcctgggctcaagtgatcctcccgccttggccttccaaagtgctggaattacgagcatgagctactgcacccagcctcatgaaaacttcttcaccaaaaggaattgtgggtctggaccattaagtggtatatcatagtctgtgggcttctggccaatgtgatcaactgaagtgtaaggaaatctcccttccacttcaggtatttagaaacaacaacacacatacagacacacaagtctctctctctctcacacacacacacacacacacacacaccccacatgcatgtaccagggagaaagaacacatacgtatcagtaaatgcatgctaataacaaaattctttcttatcagcaaaaagatatgccaggttacagtggaatcttgtattcaaagtgttaattaaaaataactatcaacaaaagttctacacttagttaagtggtcattcagtagagaggatgtaatacagacattttcaaacatacaactgttaaaagagtttgttacccatggactcctcctaaaataattactaaagataaacttaagtaaaaaggaaattgtggcagattgtattttccaaaaatggccataacaatatctaccatcttccatgcttttctacagtataccttgctactcccccatcaaaagatggagtctaatcccctctccttgaatctggattggccttatgagtttgcacctgaaagcaatagactatggtagcaataataaccatgttgactttgaggctcggtcagaaaaggccatgcagttttcaactggta

SEQ ID NO: 47279 - DNA, 1022 bp, Homo sapiens
agcacttaggtcttatttggaattttatctaattgtgctttccttttttgccaggagactgaaaggaaccataatttgtgacatcagttgttttctttgataagcagctatttatgattctggaagattaaggcagataggaaaccccatctgagattttaataaatccctcaaacaataaaccacatcatggacatacagctggaccctgccagagatgacctgcctctcatggccaacaccagccacatacttgtgaagcactatgtactggatttggatgtggattttgaaagtcaagtcattgaggggaccatagtgcttttcctcgaggatggaaacagattcaagaaacagaatagctctattgaggaagcctgccaatcagaatcaaacaaagcctgcaaatttgggatgcctgaaccctgccatattcccgtgacaaatgcaaggaccttctcatctgaaatggaatataatgattttgcaatctgtagtaaaggtgaaaaagatacttctgataaagatggtaaccatgacaaccaggaacatgcttctgggatttctagctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggtaggttatccaagcacttcaaagccctgtgcctgt

SEQ ID NO: 47280 - DNA, 1046 bp, Homo sapiens
ggctgatgaggtgaaaccccgtctctactaaaatacaaaaaattagccgggcgtggtggcgggcgcccgttgtcccagctacttgggaggctgaggcaggggaatggcgtgaacccaggaggcggagcttgcagtgagctgagatcgcgccactgcactccagcctgggcgacagagcgagactccatctcaaaacaaaacaaaacaaactgaagcattctctttgataacccattctctttttcgttagaatcattataatagttgtggaagcagtcaagtggtttaggaggtctgagcttaagctgatgacatcactgaatttgaattgaatggaggaaaattcggttatgtataggaaatttattagaaaaactatagctatttggatttttgttaaagataagagagctaactgggaaaatacattataagataaagtaatattaacatttaaacttttgtaaaacattgtgatttttttgtttgtttgttttagacaagactgggatgaagttagcaaaatcctaaggagaactacttttttctgtaatatttcttgctcagctattgggccagggaagatgtagactttgggagtatttttagtttggagtatcaaaaccagatgttaaaacatgttcttcctcccccctccccccactgaattaatttcattattttatatctcactctaaaggaaagttttaaaattaaaagaatgagcagaagatgttttgggagagatttcaggtctaagaggaacatttccacaattagcacctttttttccccttactttcttcaagaaaccaatgcaaaatttatgagaactaaagtggaatacacattaattctatgatattgtatgactgcagagtcggaatcatgagtgaaaatgcttggaagggtcgtgttttagcttctttctctctttgctgcccaggctgtgcatatgtctatttcccagaatcccagttgagtcaccatggaagaaaatacaaggatggactgtatcagtctcaacaagtaaccaacataaccaa

SEQ ID NO: 47281 - DNA, 1049 bp, Homo sapiens
aggccctgggcaagggctttgctttacagcagtgaggaagcacaggtcctgccctcttgggactcacagtttggtgcaggaggcccccatgcttttctgtttatagacctctttttgagcaattacccaattcatatatctatatttatttatttataagttatatgcatttagtacaatgttaatatattaggtacactataaaacacatacacaaaatagaaaatgtaaaaggatgagaaaaaaacaattatgaaagtaaattctgtcacttttatcccaaagaattggcacgtgccctgggctcccttcagctgcctgggccctaccctggagactgactcagtgaattgagccgcagtcttggtatctggaaggctaacaggtcttcccagctgattgtgctgcaggtgttggagagcagtgtgtgttgcctggggactgtgtggactggtatcacccagacagcttgcactgactccagaccctgccgtcatgtcacaggtaagaaggtcaggaagaggctggagcgtgccggtgaatgggtgagaaagctccctggtgaggcttcctgcttttctgttgctcagaaggaggccgtgcttcctaggaactgcatccagtcacaggcggggactttgggcaagtcactgggcctccctggcctaattttcttctctggaaaagtaagggggtgatttagaataacccgcagaatgtcttagggcccctacatttgatttaatcagggtttttttgtttttttttttttgagacagagtctcgctctgtcacccaggctgtagtgcagtggcgcaatctcggatcattgcatactctacctcccaggttcaagcgattctcctgcctcagcctcccgagtagatgagattacaggtgcgcgccaccacacctggctcgtttttgtatttttaatagagatgaggtttcaccatgttggccaagctggtcttgaactcctcacctcaaatgatccacccacctcagccccccaaagtgctgggattacaggcgtcagccactgcgcc

SEQ ID NO: 47282 - DNA, 1032 bp, Homo sapiens
agcagcaagcatgccaatatccatccgaatatttatcctcaagtaaaagttgggaacagaagtgatttagcatggccaataaaccaaggaccttgaaggggccccttaagaactttaggcctagatttggcattccggagggcagtatctaagatgcctatcttgctgggtccaaagagttccctaagctttcatgtgaagtatgaggaagaagcatgagaagagaaaatctcaggagctgagtttaaagaaaatgggaaagagaaaacagttcccagccagggtcagtgttttggcacagctggtcccttgggagaatggaagcctcttcctgggcaaaagtcatcatgctccttggaagccatccagccactgcacagtacaagctataggatgttaccctaccaccctaccatggtgcctcagacctgccacctctgcttgtcgcccaagatgatggagagagagctctgctttgcagtcagtgctctatccccagctctgccgttgactgctgtgtcctgttactccctggtaaggtgccatagaccactcatctccagaactcttgtggataagattatgtgtagatgccgttacatcttaggtcctcagcagatactggttccttgcttcagtaggcttaggaaaatttggtagttttatgggtcaataaacacataagttttgtggcttattagtgtgaatcacagattctacagttcctatcaacccaatgtctaaaataattctctaaaataatagctccagggagaaaataaaaataggtatggtgacttagcatggtagtatgacaatatgaaaggtttgttacagagttgttggtccacattccttacattgtacacattggaatttctccgtttcagaaggagcatttagagcagcacctacatttttgttaggttttccttcaaggctgtagcttgaacttttaatatacatactcacttttcttccccccaaaaagaagggtaaagaaggcagtaaaggtaaagaaaccagacatta

SEQ ID NO: 47283 - DNA, 1041 bp, Homo sapiens
aaacacctccctgcacagcctaattccaacagcagagtatctgattacctcatgctgaataatgcactgttgtttatttgctttgctaccttccagatttttcttttctgggctagataatcccaacagctttgagttccgtttttataacttctattttcctattctttagtcatctcagttgctttctgctggagcattttctgattctcttcattgctcggaaattaagaagtctgaaaccagacacaacaagctggaaagatgtctccatagctgatgataggaactgtttatcgagctctgaactctgtgcctcgtgttgcgctgagtacatgtcatgtatcatcccatttaagacttgcatcctctatggaatagattccatttgggcattttgtagatgaggaaactgagaaaagagtaattctgtatctcgcccgtctcctaagtgatagtgccgaaattctacccagttccctgcctgtggagcctgcagtctgaaccattatccctggtgccacaatttcactcacctgtcccctaatctttttttttttttcttttgtgagatggagtttcgctcttgttgcccaggctggagtgcaatggcgcaatctcggctcatcgcaacttccgcctcttgggttcaagtgattctcctgccttagcctcctgagtagctgggattacaggcatgtgccaccacacccagctaattttgtatttttagtagggacggggtttctccgtgttggtcagtctggtcttcaactcctgacctcaggtgatctgcccacctcagcctcccaaagtgctgggattacaggcgtgagccaccgtgcctggcttatatgaaatgctaacagctgtactgggcagttgactcgctttctatttaaaggtcagtatacctctctaccttttactcctttattaacacatggttagtcatgccttccttcagactagtctgcatgtccttctggaaattcattttgttgaaccacttttccagattctttgaatctcactgaattc

SEQ ID NO: 47284 - DNA, 1101 bp, Homo sapiens
aattttttttttcctatcttgcatctcattcatcaaagtaacaagaaatatgggctgggcatggtggttcacgcctgtaatcccagcactttcagaggctgaggccagtggatcacttgagcccaggagtttgaaaccagcctaggcaacatggcaaaaccctgtctctatacaaaatactaaagttaaccaggcatgtttgtgtgtgcttgtagtcccagctactcgggaggctgaggtgggaggatcatctgagcttggggaggtcgaagcagcagtgagccctgattgtgccactgcactccagcctgggcaacagagggagaccctgtctcaaagaagaaaaaaaagacgaaattttcctcctagttttttctagctcagcaagacacctataggaaacatatggttctagagtcagcaaaagtagtgtctagaatttccgtgtcactttcctcccccaggtctttttgggatgagtttttctgggtatatgaataagtgatcctacaagtgaggcgtgtgtttaaaatggatcgatggcagggcgaaccatcacgcactctggcagagatctaaacgggggcagtagtcattcttcagtcgtgtttttcttttggttggttggtttttaaaggtcatctgtctaacccctcattttacagaggcggaaacaggccaagaaaggttgccttacatcgctactcagagaattacatggcaaaaatgggcccaaacccggggctcatgagtgcatgttctcagaacccctaggagggatttcaaaacccaagtcccacatgattctggatcattaactcaacaagcagcagacatgcctctttaaggcaaaagttctatgttccatcagtgagcttctcataccaccgtgtctcctatattcttcagtaaaagactttaatatctaaaactcctttaacctcaaatcctgttatccccaaatgaggcaataacttactcggtgagatgtgtgcaccatcctgctcagtttgtgaatgcttcattacatttatatggatggtatattttccaagagctagataaaatatttcctcttctcaagtagctgcctactcattt

SEQ ID NO: 47285 - DNA, 1046 bp, Homo sapiens
tacttcacttccagttaaagaatggtatgaaagtactgtttatatgtcttgttaaaataaaaacttagacaaattaaatttaacagagtttaattgagcaagaaaaaaaaaaaaaaaaaaaaaaaaagactcatgaaatcaggcagctcccagagtcaaaatggattcagagacttgggctgccacatggtcagataagatttatggaccagaaaaaggaaagtgatacacagaaaacagaagtaaggtagagaaacagctgaattggtttatacctcgacctttgccttatttgaagacagtttgaatagttggccacctgtgagtggttgaagtaaggctggagtggttggctgagccattgttatagaagcacactcctcagttacgttttcagtttgttatgtactaagattgtagttcatttctaagaactgaagtaggtgagtacgtatgctttctcaggctaaattttagtttgatttcagaattccacctgtttggtcggcctctcagttttgagagattaacctaaattctgagcatgggcaccactctcattacagttgtaaatgactcctttgttctgagtatggaattcacagatgacaatgtgaaactagctgaataattctttcttacttacctagttgaagtgagaccattcaacactcaatagatagctgcatacaaaacatttaagacgtgagaagacacaaggcaccagagttactattatgatgacttccaagaggatgatatcaaaagagcaaggagttcacaagcattcttatgaaacaaaccaaaccaaatgaaacaagtcacaattgaggcaatataggcagttcaacagtatttgagtctaattggtcatagtccttgttcagggtctgatggtgattaaggaccacagttgcttgtataatggcctgattgaaagaggtattcattttcattgttagcctggtaacacaagtcataataacccggagacatacctagaatatatttaaagatgacaaaaccttggaaaacccaagcttgcc

SEQ ID NO: 47286 - DNA, 1076 bp, Homo sapiens
ctatacaactgataccccactactgccaaaagtgagcccccaggagccccaccggagtttcttcttagttgaaaatagtttatctattttaaggttgggggtaatttcagttattgattattttggcctctgatcctaggagctgttatgggaatttgtaggggaagctatttgaatggccggagtgagccaggctaaatagcaacatccaaaccagacaggaagcagattttcctcagacccaatagaagcccatggggattggaaaagagggttacctagttgcatttgtgcaagggtcagttaaatttatttgtctgtaaatctgcatagctcctgaacaaagttcagtgggtaatgtacttttttgggttcgtttatagcatgcggtaagggtgtatagccacatttagtaaaaaaatgaccctactggatttttttttcttttctttttttttttttttgagacagttttgctgtgtcgcccaggctggagtgcagtggtgcgatctcggcttactgcaacctctgcctctgggctcaagcgattctctgccccaggctctggagtaactgggactacaggcgcccagcaccatacctggctaacttttgtatttttagtagagacagggtttcaccatgttggccaggctggtctggaactcctgacctcaagtgatctgcccaccttggcctcctaaagtgctagaattacaggcatgagccactgttcccaacctcctactggatttaatctggtaacattatacaagcaattacttgtatccatatagctaattcccaggtctcaagtgcgtgatgtctagaagcacaatataccttttgcaggcatcacttggataggttttctatgtttggtaacaaccaggttattcattggaaaagttaaagtgctgtttctagcgagtgcaggaaagcaaatgaagcagtcatttttagaatatcaaggataggtttccactccctcctcctttggagtttgaatcactgccattgggaacatggagaggcatcaatggaattgttttctgattttttggcatttgcccaca

SEQ ID NO: 47287 - DNA, 1048 bp, Homo sapiens
tcttccttttggcctccatagtttcagatgggacaaccactgtctttcaaattagtatttacttatagataatgtgtaatttccctgtgttttcaagattttttttctttgtcttttgttttcagaagtttaatcctaatttatcttggcatgggtttctttgggtttatcctatttgggacttactcagcttcttgaaactgtaggtttatgtcttttgccaaacttgagaagttttcaaatctactcccttcctcctctctttctgagacctttatgatatgaatttagatcttttattattttcccacagaaccctgaagcagtgttcatttttttctattttctcactgttgttcaaattgagtaaattttattgatctgctgtcagattcattgattctatctccactatgctatcaagttcactcaaaacacccagaagttggctacatagagctcgctggaagaagcaggcccagaaaggggcagattaagagacagacatgttagtgacagccataaattctctgagtggagcaagaaggaagagtgagggctgaggatagtttctgtgagatggcctcatttggagggtgaagagaaaagaaaccatggagcaggtgctgacttctgtgtagagtgaaggtgctattgtcctgttgtcatttggctaactagaatgttttatgctgttttctttttctttctattattttttaaagagggagggtcttgctctgtcactgagcctggagtgtattggtaccagaatggctcactggagtcttgaactcctaggctcaagcaatcctcctgcctcagcctgtcaagtaggtaggactagagatacaggccacgtcacctgactaattgtttcttgctaggttgcccaggcttgtcttgaacacctgacctcaagcaatcttcccacttcagcctcccaaagtgctgggattccaggggttagctacctcacttggatgttttatgctattttcttgatatagtgcctctctctgctttgtataatcaaatatatgacaga

SEQ ID NO: 47288 - DNA, 1051 bp, Homo sapiens
taaaagattattttctatttattaaaataaaaacttcaagtatagatcttacttgttactcattatcatcaagttccaagaaagttaaatattgttcttgtttgtttcatgttctgtatttatccaaagtatacaaagtatatcttattaaatcttcagatgaggaaaggttgacactaggattacacacttagcaaataaaaatacagaacagaaaaatcagtaaaattcaaatttcagtttaatagcgaataattttttaatgtagttatgcccccaattttactgggcatctcttcttatttgacaaccctagttaagaacaaatcaagattccagaatgaaatgggctggaaaagggggtcacaatattcacagtacaaattaaatataaacgaacattcatattcgaattttttaggtctttatgcttttgtggtatgttttaagagtaaataagagatatttactaaaacctttattgatgaaattatgtaatgtttgggacttggttctatataacacaggaagagggaaagtggatagggcgggatgggctgtgcattgatgggtatgtgaaagttttgtctacttttgattgtgcttgaaattttccatagtaaaggaaaataaaatgtgcgtgtgtgtatgtgtgtgtaagccatgcctttaggtttaaaaaacttatcatctaaacatctcaaatgtccagtgaccgaggacttgtacaagggcatgagaagaggctacagatggaggcaggggcttgtgagccatgcttggagttgtggacatctttgttccttgatggcatatttatcatcttgatatttatctttaccatttggtagagcaacgcaagagagttgcagttagttcctagactctaggagtacaggaatctctagggaaggttcaggaattggaggcgatgggggagtagagagggataatgctttacttgatggccagccttttgaaaatggctaaacacaaaacaaaatagactgttggattaggtcagaataataaacattccactttttaatgt

SEQ ID NO: 47289 - DNA, 1031 bp, Homo sapiens
cctagagaggtagtcccctccccttctcttgcctgctaatcacacagagggccatcatctttcatatgaactcaaagccctttttctgcataagccctctttccctccatgaactttttctgttttgaaatagcaattgcctttttaagcagcctttcattttgcccttggctagggaggacgaggggcaccagtgagcgaccaatagggggaaagaaaggaagagaaaatcagtcagtccccttttcctccagccctcccaaagccaacccctccttccctccctacctcactacttccccgtctgcaacaccacccacccacagggtcgcagaggggtgcacttggccttccagctccttaacagtgtgtgtaacactgtatcttttcataacttctagaattccaaaagggagggagagagcaggtatatagttacatacttttacatatgatgtagtgtataatacattaaaatttaaaagaggcagagcttaacaacttggaagtatcttggtggaaaggtgaatattatctttaaaaggaatgattttaatgagtctacaattaaatgtgcgttcattcattcaaaaaaaaaatgaggatcctctttcataccagggatcagatctcagatggtttcaatccaacgaggagacagtaactaagtctagtagtcgaacaaatagtcacaaactcgggtggaggctgtgaggcagagaacagggcgtgtgacagatgttatggcactggggaggccttgcttcagtctgggaggaggtcaagaaaggcctctctgtaagcagagatcctgggtatgagcaagagttacctggaagaggttgaggggatgggtgtgctttaagctgcattagccaaggaagacaaaaggacacagccggagatctggtgatcctaaatatactgaagacttagtgattttaaggagtactcaagtcagcggggcatgaaagcaaaataatttcagctgactttagattggacatatcaagcaatgataacacctcaaa

SEQ ID NO: 47290 - DNA, 1063 bp, Homo sapiens
agcaaagtcgcatttcagatcccctgctcccctatcaacttcaggctgctccaggctctgggtccaggctggaactcacagtagaactaagattatgtctaaactcatagcagtaaagtgacgttttgccataaaagaacatttttataacgctatttcagtctacttgtttccttggaaatagtttctgtcgtgatgggcagtatctaaattaatgaattattcagctatttgtgcaaaatgtgtaacttaagggcaaacagactcgatgttgttcgcatcacctctcacacattggcaaggcagccttttctgtcctatgtaatgtaggaaaattaaacatttcttgaaatctgagacttctgcccttgttctcctgaaattaaatccattttattttcagtagcatgaatttccttacatgtccaagaggctgttaaggaattaatcctttgctctattcctcataacacttttcacagttaatctagtgtgtaaactgtgtggacgagaatccaaaactgcagaatttggaggaaatgtgactcctatgccttgtagacattaaatcattctgtgaaataaaactgaaactttggataggagattgtacagtactctccacacatttttattaaatgaaaacaacttccattatttttccagcaatccttcatgtagttggactcacctcaccacctcccccctgctccttagttgtggtcggctctccttacaaatggacaggttgctttgtcaacttggtggcagaaaccacctgacaaattgtagacatgtggctaaaatttatgcttagtttggatttggtagaaaataaagaatattagaaaataaaatgtgaccaaaaaaatatttatgttgtcttgactgtgtgtctatgcacaagaaaggacaggaactgggagtaatggaatgttagtgtttccgactccagaataaatacccaagagtgaaaataatttataaattatgtttcctgcttcagaatttgctaagagtgtatgtgtgtgtccatacttgaatcacttgcctcacctgagga

SEQ ID NO: 47291 - DNA, 1049 bp, Homo sapiens
ttgcccagtgtttggccccttcctgtagttgggtgatgcttttggtggtatccaaggtacccaataacgttaaagaagctgaagccagatgcgtgatttcctagcatccctggcaggcctttgacccaggctcctccatctgatgcacctgggcaggggtgtggaaaggagtgggcacaagggcctttctcccggctggagtggggtccggaagggctgggcagcacgactggccttgccagagcatctgaagcaaggctgggactgctgctggccggctcacaccaggcctcatcagcccaatacctttttcatcagttcccctttactttcagcattcagtgcacgtttctgttgcttgcaaccaaaagtcctgggtgaacaaattccctgcccagaacagcaagtgcagtaagacaccatgacaggagcgggagggaaggcctttgctatgagctctccattaccagtttgggcttgaggggtgtgatttggacccatggtataaaccaattgtggaactggattttaggaggaggcttgaagacatgttatgtacttactgtatcttaatttttgttctttggttgtaaaatggcttagcgatgattaatgacttaggatttttcgacaaaatctacggatttcccaacatttggcagagggaagaactttagcacccgagcccccgggctgggggaggtggtcctgggctggaaacagaggaagaaaaaggcgaggggagaagcacggggaactgtttctcttcttccttggaaagcaaaaaaattttggattccttgttgaataaggagaacattcctcacatttgctcccactgtgcaaatcctccagtgcatccgccgtcctctgggcagcgtaaggccaggctcggttttgacttcccagcattttgggtggattcactctgccaggctcaccaaggtcccttcttctctggcttccctgtcaagaccccattcgtaacttctccacttcaacagaaaactcggcttcctcccatcccctggactagctcccatttctgt

SEQ ID NO: 47292 - DNA, 1132 bp, Homo sapiens
aaaatgtcctactctttaaataatctatgctccctcatccttcactgatgtgcatttttatctaaaaggaaccaacttgatattcttacagataaattcattatctatgcaagaaaataatttggcaggaccaccgttcaagagaggagaggcaggttatttcgtggcttcgaacttaggcatgtcagttaatctcctgatgcccagtctcactgtaaataataaaagttattaagaggtcaccggatataagcacggaaaatataaaagtttctatgtattcataatgaaaaaataaaacaagggaaaagcaaccgtatgtcttgaagaaatgtgattcatctaagtttgccagagcaattttcaaagtttgtacaacaacatgcctattgaataagagtgtttaagatcaaatagcactgttatgtgcccacaggcagacagataagagcttggaaatgcgttgatagaaagtaagatgaaacttgaaaatggtaaaattaaatttcttttttctaaatggtcaaactatcccagagccattctataggtttgatgctagtagagaatcattcaatactaattatagggatttccaaacagcaaagaaaatgatgatcagatgtagattagggctactatgaaaaccactgggggagcaaggaagacagctcttactcagtttgttagaagagagtgagagcttagatctgctcctcttctgtgcgctgttttctagcaaaatcgctcaatccaatgttttaaatgcctgctggctgtgtggaatctgcttgttcttccccatacagatggactctcctcttagatttctttctttccaaatatttcagacccttggctactctcagcctgcttccacaacccattttagcttttaaaacaggtaagaggccaggaggcaggggaacctgcagaaacagcaacggcagagattttgatttgaaaaccagtctccttttttttttttttgagacagggtctcattctgttgccaggctggagtgcagtggtgatcttggctcactgcaacctccaactcctgggttcaaaagattctcctgccttagcctcctgagtagctgggattacaggcacgtgccaccacacctgg

SEQ ID NO: 47293 - DNA, 1035 bp, Homo sapiens
aactactgattttaatttctgccacttataggtgagtttaagctattacggagcatgtcaatggtattatacaggaagcacccttttgtgtgtgtcgcatcttttgttcagcatgttttttgagattcattcatgttgaggagtgtatcagtgattgttctttcttaatgttgcattgtattccatttcatcaatattcacattttgttacccattcatttgaggatggatttttgggtttttccagttttggattattatagataaaacttcaaggcatatttgtatgtaagccttttttggacatatgttttcatttctcttggagtagaattactgtattatatggttaactgtaggtttagctttagaagaaactcccaaaccattttccacagtggttttactccagctagcaatgtgtgagagttcagttgcttcgtattctcagcaacgtttggtattgtcagtctttttgttttagctgttttagtagatgtgtagtagtatcttgtagtgtaatttgcatttttctgatccatgtgcacttggaaaacaatgttctatagttattggatgtagtgtttataaatatcaataagactagattggccaagatgttgcttaggtgttttctatctttgctgatttccttttcgattggcttacagtatctgagagaggagagttgaaatcttcagttgtaattgtagatatgtttatttctcctttcacctctgtcagcatttaatttagtattttgaagctcttttatgaggtgcacatgcatttatgattgttattttttcctgatgaattgatccttttatctttaaaaaatatacctatttatttctaataatatctcttatcttgatgttttatctgatatgagcatagccatattgtggtacatttcagtagtttgttcctttttattgccgatggtactattatatagctatcccatattttgtccattcaccagttgatggacatttgaattgtttccagtttttgactgtatgactaatg

SEQ ID NO: 47294 - DNA, 1062 bp, Homo sapiens
aaagtaatgtttacccgatccataacatttttatttaccatttgataaataaatttggttatctgagtagaagttttttttaactccatagctttttttgagggactagggggaggtagaggtcaaagttagcacaatagcttctcttgattgagtaagtgttatattgagtattttttttatttaaaagcttaaatgtttatcattaaataaattgttttagtgtttgtttcatctttcagaagaatttagactttgtatagaaaatttctttttcccctctgtggattgcttttccacattgttctggagctgtcattgccagatgtggaaataaaagtaacagtgtgactgttatacacaaggctttggactgtttgtttcctccctgaaagcactgtgtgtgggggcagattactggcattttgaggtcaaaatcaaatctggaagtcagagcttactgtaaatagagaaacaaaggggagaaaatgagaagaggtgtgtatctgactgattattctaagaaaataaatatcaagacttttagaacctagatgtaattgaacacatttcattacatccatctagggacaatttaaatacttcctaaaaggaatgctgctctataatttagtttcttagcatattgtaggtataaagaaagtgtattttggaaattaaattaatccatttaaatgcatcccataatccaaaatgcttcctttttattaaaaccagatgagatgaaataaaagtctttgggaactttacctccttattgacaatatgatgatgaataacatttgatgtaatagctaatactttatttctctaacttggaaaaaatgaaaggaattagaaaaaatgaatgaggttagtattgtatgaaaataattttaaagaaattctcaagtgatgtttatatgtataaagtgtacttttagttggaactggttcactgattttctgtggttcattttcaggtccttcagcagcttttaaatcattgcaggaaaaacagagataaagttcttctcttttctttttccaccaaggtgagtt

SEQ ID NO: 47295 - DNA, 1026 bp, Homo sapiens
ggagattctgcctgctccagctaaagctgtgtatatacagggaatgccaggaaattctgacatattgttggagcaaacacttcaaaaatgtcttgtgttttttctgttttagcaacttcactgtgtggtggttggaagtgaaaatgccaaacgatattttgaagcagttcaaggatctaaagagcatcaaggagagctttttgggatccataacctcttcaaatttaggtcccaagggtcttgtcttacgaaggacatcctggaggtgtgaacttcttctctgaccttttcaataatattttaaatacagtttttcttcctcaggaaatctgaaatacaattgctgttgccttttcagagaaacttttggttttctttatcaaaaatgccttggaatttttacttttagagaataagaaatgaattattgtacctctaaactaagattttcccatgcataattacaaataatgcacacacacaaatgtatatgctgggtagtatgaactccaaggcaattttaaataggcagagagaagtttatagttttgaaaacagctgctgaagtcaggaactaaaaaaagaggttttcctaaataaacaaaaatataaaatgtgttttaattaaaagttaccaaatactccctgagatgtactctcatgtctcatggagatttttgttttctgttcccaataaaaattccacaccagtattttaaactctccctgttgtgttcatcctcagcatacagatgtttcttattcctcaaacaaaatattttatatccttttttaaaaaaatctttaagttcttttatataccggaatactaaggatattaacctattttctaattgatattcatataggtatcataaaatcctggagtatcatctttttcaacctcctcatggtatagatgaggaaactgagtcttagagaacttcaggatatttctcttgacttccaggactttgtagtaaaatcttaatgtacttcatttattcagtaagtaccataaaggca

SEQ ID NO: 47296 - DNA, 1033 bp, Homo sapiens
caaaaactatatgaaagaagctgagatataagcaaggacattttgctatagaaatcttaatttttgtgtttgattatatacaaatgaggctttctttgtggctattagcattctcgtttaagagttaattatgatttatatcttggtgtcattataaataagtactgaattaccctttggttggtgtgctacagttagattttaggtttgaggaattattgcataaacttttttaaataatcaactcagttttttgtttgtttgtttttactgtgtaaaaggtgtcagtagttaatttggaactaatgctattttgaataatggtaacgtgtcatcaaaattaagaaacatctgagtaaattttctgccatgaaggttttgaaactgtgtgccatgtatagtacctggtattctgaaatgaaggagaatgttatgctagttactgtctcatcatattatttaacaatgttttgtgtttgcatgattggcaatttctgattgaagaggttcaggactaaaacagcacaattgttgaaggtcatacctgaggttcattgccagagctgttgcagggagcttttacaggccttggttctagctttctcttttatgatcacaattcaaaaatgaattataggtgcctagaagcaaagcaataaaaattgtagccattttttaaacctctttcagataaaagccatgagttaatttttttcatttcctaaaaagctctcatcttgacattctctgggcatatgtacaaaaaagacaaaatacaaacagtaaaactgagcaaagccaatcaaacgaaactccctggtcataaaccccatgctctcattccatcactgtaatcaagtacatgtttaaaggaacagataaggttagtttcattctttaaattagtgaacatctttttttttttttaattaacaatgaaaacaaattcatagagaggaccctactcaaccctgacttttcttttggccaaaacctccatttcaggtttaaagattgttacctatcagtagtt

SEQ ID NO: 47297 - DNA, 1047 bp, Homo sapiens
ttcatcaaaggtttttaaaaaatattttcttgtgtttggcttattattctttattattttctaagagctaagtgcctcaggagtaattttactattactttatgggcaagagttcagaatgcatactgtatataataccaatattttatttcaacttagtgctattatacttttaagaatgaaggtgagggtagaattcctctgaactatcaagggaattaatttattcgtacctcactggtttgacaaaggaattaaattaccttaacaataaaaccagagtacaaaatgaaatttaggaccagagaaaatgcaaattaaactgaaagtttaagacagggagaaagttagaatgcaaatgcatagaacataatatgttctacccagatattatattaaaatggctaattttattgactttcctggtagaaaaacaaaggaggtaagctatctatgtagtgatatctcagctagtgcatgtggaaatgtgtgtgggcagtttgggtggtcacaatgactgaatgcctagctggcattaatgtctggaagccagggattccaaatggctatcctggacaggggactgggttgagggggccaatggggaggcactcccatatgcaaagaattgttctgcccaaaatgccataacaccctgctgagaaaggctgagtgaaatgtttgtccttaaggaaaaagaaaaaaataacactggttctaggagaagcaaagcttttcctagcactcactttgaaggaaatttgtcacttggtgttttttggggaccgcagaacgatatagtgaagagtcagttgtcttataatatccctagaataaatctaataacagactttgaaaggctatcctttctagcatttttcagtgtaatccataggcccagtgccagactacaactcgtgaaagcattctttcatgacccaaatatgctttttatactcatcttctcatttgatccaggaatataccatctctcaaccaacactttaaacagcatttctacagtttgactgccttgtatgtgccatc

SEQ ID NO: 47298 - DNA, 1051 bp, Homo sapiens
tgtgggataaagtcaggttttcagtttttgtcagggtacaatgaaccccacctttatgttctgagaattttaaagatgatttattccatgaacaactttcatagtttctctggaaattatctggagatgacattgttcattgttcattgattaaatatattacgaacatagttaatcagtcaggggaatgatctctttctctcagtgagaagtgttttcaggtttgcctggcaatcatggtgttggatggattaacttatcctacacctccagccatatcaactcctatctgatgttccactccaatttgacccaattcaagttccgttttttccacaaagcctcagtcttcagggatcactcagtttcaggttcctttagtgcccattctctatgccagtcatcactgtagatgtggtatacctgtcactgttgttacttacctcatgtggattcgttttttcctcatgtatgttacaagctacttaagaatcaggaccatgggacactctcatatactcctgtaaacactaccacttagccgtgggcagcacagagtgggagtttagaaaatgtttgtgataattcccgcatggaagtactgcgtgaggccagtccctacaaccattttcacaagttaagtctcctcaactctttgcaccacaagttaatgttaaagtgagtatactggctggcagctaatgtaaagttatgagtcacctttgagcagcataaatgctggtgttcttcattgtcattatatgtcatctgttggccataatgctggtataggaaatccattcaagaagagagaacatgaagaatgatgtcagaaagatattcctggaacccatgcatcctcatatagcaataataaatctagagagtcattgtgtggcttccagagtcactttgtatcttccaaagctgtcaagtgtcttattgtgtcctttccgtagtatacgaggcctgtctcaattgggccctagtgtgcttttctagtctcattccaagacactcacctaatcaagattattgacatgaattatgt

SEQ ID NO: 47299 - DNA, 1026 bp, Homo sapiens
caaaatatctacattaacagaagtttggaagaagttgattccagccctcatggatgactttgagagattcaagactttagtgggggaactaactgtagatgtggtggaagcagcaagagaactagaattagaaatggagcctgaagatgggactgaactgctgcaatctcatgataaaactttaacaggtaaggaattgcttcttatggattagcaaagagcgatttcttaagatggactctatcctagtgaagatgctgtgaacattgttgaaatagcaacaaagaatttagaatgttacataaacttagttgataaagcagtggcataatgtatgcacacctaatagactacaatatagtgtaagcataacttttatatgtactgacaaaccaaaaaatttgtggtggtggtccaggaccaaatctgcagtatatcagaggtatgcttgtattatcttttaaattcctattccaaatcattttactgaatcttttattacttgaatcttcattactattgctgtttcatcgtgttgccacagtgtcatgacttcacagctttgatataattggtaatgaacaagtttgagttaagttcacgtaatctagaatcttttcatcctagccttgtatgttgttttataataagttataattgtcactacaatagcaactgcaatgcagcattatttatcttgtaccatttattgtgaaagatttactattttagtgaaaccaacttttctaacgagcaccaaaatgtttataaagtagatattgtttttcaaaagacaagaatattcgaaaagtataccaatggtgctgctgcttaaaacagcggtttttcaactctttctggccatatacaccttttctggccatatacacctttaagaacatgattaaagccatgggctctttttttttgaaaaacgtgttcatgctcaaatgtgcaaatacagcttcaggagattcatagatatccctttctgaagtccctgaaacccatctacagaacctttgg

SEQ ID NO: 47300 - DNA, 1048 bp, Homo sapiens
caaaggaggagtagcatgctgggcctccataattcccaggaaatacctaatataatagcataaatcaaaataacttacaaagctggtgattttgtgagctaaaatacttttctcagtagcataagggtagaggcctcactctactaggataaaatgcgttttcattgtggaattcagcagacgtatgctaaaggaacaagattaccttctgtggactctacatttcctcttactggtgatgagttctttcaaaataaaatgtaatgaaaataaccactagttttgttcatttaatctttagaaaacaatttgaagaaatggcctcttattttaactcgtcttctgtaaacgaatttgctaaacatataaccaatgccacatcagaagaacgacagaaaatgctaagagacttttatgcttctcaatatccagaggtaaaagaattttttgtggattctgtgtcacaattcaacaattcttcctttgagaaaggagagcagcgcacccggaagaaatctgataaaagagaatctcttataaaaccaaggctgtcagattctgaaaccttgtcatttaaagattctaccaacaaaatttctcaagtttgcagcctaaaaacatataaaagaaaatcagttaagtttcagaatcatatttcctatagagaagaggtgttttttaatgatgcagaaactaagaaatcacctgttagttctactcaagagattgacagtgggaaaaacagccaggcatccgaagatactgtgacatcccgttctctgaacagtgagtctgaaacacgtgagagaaggttagaaaataccatgaaagaccaacaggacctcacaagaacgggcatttcaagaaaagaaccccttctcaaattggaaaacaaaaagatagaaaatccagtgctggaaaatacttctgtgataagcttacttggtgatacctctattcttgatgacctttttaaaagtcatgggaacagtcccacacaactgccaaagaaagttctttcagggcccatggaaaaagcaaaacagag

SEQ ID NO: 47301 - DNA, 1064 bp, Homo sapiens
ccatctttggctcatttatacaagaagaaggaagtgctggtgtgtgctacaatggatgaccccaaccaaattgtgctaagtgaaagaagccagacatggaagaccgcatacaatatgattccacaccaaacgtacagatgaggcaggcaaatctatagcgcagacaggaaatgagtggctgccagagctgggagcagagtggggatgctaggggtgatagctagagggtacagcatttctttttagggtgatgagtgttctaaagttgattgtggtgatgagtgcacaactctgtgaatatattaaaaaccattgaattgtgcactttaaatatgtgaattgtatggtattcaatcaaagctgttccaaagagaaaaatagatgaaaactgaaaaacaaaggctcaacccacaggctgctttctctagtgctgaggtttcaatattaaatgagcagactggcccttcgtaagtgagaacacaaaagctgcttaaacaggtacccctttgagtggagacacactcctgctccccagccggagtccccaggtctggatttttggatgacgtgagccttgtacccaggctgacaagtaatattagaccacgtgtattcttttttttttatagctcaaatgtacagacattacagaaaatttgcagaaatagtattaatacaaagaacaccaatataaccttcacccaggttcacccattgttaacattttgccgcatttgctatatcactctctctgttatctatctatttatatctatcatctatgtatctgtcatctttctttttttctggtttttttttttttttttttttttttttagatggtgtctcactctgtcacccaggctggagtgcagtggcacgatctcggctcactgcaacctctgcctcccgggttcaagcgattctcctgcctcagcctcacgagtagctgggattacaggcatgtgccaccatgcctggctgatattttgtatttttagtagagacagggtttcaccatgttagtcaggatggtctcaatctcctgacctcgtgatccacct

SEQ ID NO: 47302 - DNA, 1072 bp, Homo sapiens
atgtgtgtaatcccagcactttggcaggtcgaggcaggtgggtcacctgaggtcaggagttcaagaccagcctggccaacatggtgaaaccctgtctgtagtaaaaatacagaaaattacctgagcgtggtggcacaggcctgtaatcccagctacctgggaggctgagacttgagaattgcttgaacctgggtaacagaggttgcagtgagctgagattgtgccactgcactccagcctggcagtctgggtgacggagtgagactgtctcaaaaaaaaaaaaaaaaaaaaaagtggccaggcacagtgactcacacctgtaatcccactactttgggaggctgaggcgggtggatcacctgaggtctggagttcgagaccagcctggccaacatggtgaacccccatctctattaaaactacaaaaaaatgacctgggtgtggtggcaggcacctgtaatcccagctactcaggaggccgaggcagtagaatcacttgaaccagggagttggaggtagcagtgagccgagatggtgccatggcagtccagcctgggtgatagagtgagacttggtctaaaaaaaaaggcaggtgtagtggctcatgcctgtaatcccagcattttgggaggccgagaccggtggatcacttgaggtcaggagttcgagaccagcctggccaacatggtgaaaccccatctctactaaaaatacaaaacttagcccggtatggtggcacatgtctgtaatcccagctacttggaaggccgaggcaggagaaatgctttaacctgggaggcggaggttgcagtgagccaagatcacaccattgtactccagcctgggtgacagagcgagactctgtctcaaaaaataaataaataaataaatgaaacattatgctccacttatgataacatctttcccatatcctaaacatatcacaagcctcagattatgacctcactacaggatatgaattgaatttaaatatttctaggttatgggaaattaaaattatagtaggttgaatttagatctgttgtgcagctttcacacttgaaaaaaatac

SEQ ID NO: 47303 - DNA, 1869 bp, Homo sapiens
tcaagccaccattctttccagtatactataaccatgattttcttttagaatttttttctggagagaccttagacctttaatttaccagtttttattatatccactccttcctagaccaggtgataggtttgatcgagacagaccgttgagaggacgtggaggcccgagagggggtatgcgcggcagaggcagaggtggccctgggaacagagtttttgacgcttttgaccagagaggaaagcgagaatttgaaagatatggtgggaatgacaaaatgtaagtttctttgtaaatgctattttcactttaagatggtgtcagcacgtggtatgaatctattatgtgttaatatttagttaactttatagtactgtgctgttattcttgtgagaagctgatcctgggacttttatgaaccactctttctgatttggagattgactggagactagcttctggtttaagggactattctttctttccgtagagcagtcagaactgaagacaacatgggtggatgtggagttcgaacctggggatcgggtaaagataccaggtacggtgtaagtgtgtgccctctgagaacctgcaattaagtggaaatctctggatctttgcttttcttgaaaatgatgtcttctgtattgtgctttatacttgtgtgcccctaagtagagattgattttaggcttttgtttcgtgagataagtttttaaaacaggtttgctatgttgcagttagatttaaactgcttttaaaattctattactttagccaaacaaatttgtgacagatgaccatgtatttgctgatgcctcaaacatatggcactgtacatttgcacatgcctcaaaatgctttttgttggctgcacacggtgactcacgcctgtaatcccagtactttggaagccaaggtggacggatcacttgaggtcgggagtttgagaccagcctgtccaacatggtgaaaccccgtttctactaaaaatacaaaacctagcagagcatggtggcaggcacctgtagtcccagctacccaggaggctgaggcagaagaattgcttgaacctgggaggcagaggttgcagtgagccgagatggcaccactgctctccagcccgagtgacagagcgagacacagcatctcaaaaaaacaaaaaaaagctttttgttttgttcattattttttaaaatggtgacaagatctcactatgttgcccacactggtcttgaactcctgggctcaggcagtcctcttgcctcagcctcccaaagtgctaggattacaggcatgagctaccacatctggcctaaaatgctttttaaattcctggatattctatatgtttttacctttcaaagttcatgtggatccttgacacatcttcatttcataaaatcatttgtagattgaagcttagtgacaggtttcacctgaggctcaagttggacatttctctgaggcttcatggtgccttagatctgtgccaattcttctgctagttagagtggatacatggttctgctctgttttatttcacagctggagggatgatgccttcctggtgtctgcagaagaagaggtagggcatgctgcaggcagtgcagtgtgagcagtgctacagggcaggcttcccgctagtgcagaggcttgaggggatccaggcttccacttttcttcttttgaagaatataagcttttttttttttttttttgagacggagtcttgctctgtcacccaggctggagtgcaatggcgcgatctcggctcactgcaacctccgctgcccaggttcaagtgattctcctgcctcagcctcccaggtaggtgggactacaggtgcacgccaccatgcctggctaatt

SEQ ID NO: 47304 - DNA, 1032 bp, Homo sapiens
cctggcctccaagttcttaaatacccatgcgccttcaactctctggccctttggacctgctgctgtaacttgctagcaaaacccctcctgggtgactccactatctgccttctctctgcctgttcccacaagctgagcactacaagtcacatcgtgggcctggttggaaccccagtaaattcccggtcactgatattctgaaaccaggccttggcgatccccggttcttgggttcactctttctctcaccttctctaatgactgttttaatttctcctcaaaaccctgacactgcctcccactgtacccttccgccatcgtcctctttcattttctggatgcaacatttccttctatatcacagagtaattatgatccattaggtggcaacttcatcatcctcccactgccaaagatacaagactgctacacctgcacgcctcctgggctccttccctcgtgctaaccatcgggctgccatcccccccgacctcttcacgcttcagatctttcctactgacttcatgaaaacttcatactgttagttagctccttccttttttggtatattcatctccttcctcccaaccctagtcttccagtcagcatttaaacatgctcagtctctcctgcgtaagtgtcctctggaccccacattctccgtcagctgcctctttcagagttgcatgtggccttcttcacttcctcccctccacttattcctccctttagtccaggcctggcttctgtcctcactgtccttctgaaacagtcaccatgtctccagatctaatggatgctgcagtctgcgtctttcttgacctctcagaagcatttgactttattgatttcttcgtaaacgtgctctcctgttggtttctgtgatcactctgctcttcttttccttctgcctctcagcatctcctttgcaggctcatccttgtctttcgggtcttttaaaatgttaagttcttcagggccctgccttaggccttctctttctgtagagtttctttataggatcttatgcac

SEQ ID NO: 47305 - DNA, 1631 bp, Homo sapiens
tttttagagcatttgctgtatgccaagaactgctgtaaatgctaccatgtcttaattcattcagttctttgccactccatgaaggaggagctactgctattctcacactgggacagaggttcaatacctgcctaaggtcacctggctcatgtgcagagccggaatttgaaccaggcagatgcataggcattcatactcctctagtgagtggtaggaatagcaaaaagtgctgttcagaacacctgctggtaactcaggagagggcaaaagatgttggccctggaaggtaagagctgccaggatctctgagcgtttccctactcaggaatatggagcatcaactcccatccttcctgaaaaatactttattaaaagaaactgtgagcaaacagtaatacaaactatctgcaataaattatttttattgtaatcggtttcctagtgtatttgcttaaacaatgaagattttcttatgttttaggttaaattcatttgtcccagttaaatatccgattagtaaagctttatttctggaacctactttctttgattcactgcactctttcatatattcaggtgaaaaggtattgcatgaatggaaatgtggacatttgaattgatgttttgtatctttcttctgcgcatatcatgactgttttccatctaggtatttttctgtgcccccttattccctgaatctcagtggagcacagaggttgagtgtgggctttggaaacgcaatgacaggattggaacttgcctcttctatttatttgctcactatgtgacctctctctgcctcgatattcttatctgtaaaatgggatattaattatatctaactattgatatcatgaaataatataaagcattttgaacagcatctggcacatggtaagcatacagtgttagctagtctcatccatttctaaataaagggaactgtggttaaagcagtatgatttctataatttcacgtttagaaacaaatatataactatcaaatttgtatatagcattattcacattaccatagatttgaccaccttatatccataagtcattttgatggaaaattccctcccaaaagttttttataacaaaccaagaattgtgaaggtctttgaattactcaaaaatgggggtgttaaagcaatagcagttatgaggctctcagttgttagaaatatacttgcatgagtccttcctagaatcgaaggatacatctcttcctgttgaatatttagtcattgctaaaactgccggtaaaactgtactcagaaccaatcaaatgggaaatggggtatgcgtcacaggattgtcatagtgtgtgtttgctaataacttttagtgggtagggaataaggttaaggagcctgtccttggtgatactatgctgctttcaacgtggcttgttgaaactgcagctgataagcagggcattcgtgcctctgatatggggcatttgtgcctctattcttgaatgaggtgcattccagtcaacagcttcaagctgatactgctgaaggaggctgtaacttgtaactaatctgaattacactatatgctttactttatgtgtctatacacagtttcaagcttgcatttcatatataccttgtccttttttg

SEQ ID NO: 47306 - DNA, 1029 bp, Homo sapiens
ttgatgctgtaattgtgtttcagatggtaaaagatgactatgaggacgattcccatgttttccggaaacccgccaatgacatcacatcccagctggagattaattttggtaacctccctcgtcctgggcgtggagccagaggaggcacccggggaggccggggaaggatcaggagggcagagaactatggacccagagcagaagtggtggtaggtgtctgtattgacggtttggcgaaagaagttaataaggacagtgccctgggcccaggatggtctaatttcagagggtcatgagtttctgcagtcacttctttctgtagctagtgtgggactgatgttggggcatttggacggtgttgtagcatcatggacatcttgcctagagaccgttctgtagccctggcttccagggtctgctgtgaaggcactcccgggatcagagagaaactcactgtcacccgcattagacaagatccccaggcttgggattgaactggagcacctgacgttttgcttactgtggcctgattgtgtgccttgggctcaggtgatgctgtcagagtggacagaatcctccctaagatctcaagccctttgtgaggggaccttcctcaacccctccccggctcacctgcctcacaccgtcctcagccaaggctgcctgattctagctctcaacacagcacgctccttacccctggcctctgcctgctggcctccattcatccttccagcctcacttcctcacaggtttctttgatcacatctcctagaccgatcaaggtctcggagcaaaggagtttcttttcattgaagcctgatctccgtgtgcggctgtattctcactggtgtggctatcggtcagcggctgcttttgctcattaccggtttacgcagtgccacgcagtgcctggcatgtagtaggtgcttcctaatgtggtatggacacttattcattggaaatcagccccgaggccccatggcacagaccccttctctgtggctggtcttggcaatgctcctcctg

SEQ ID NO: 47307 - DNA, 1032 bp, Homo sapiens
ctggatagggaaaaactgaattttttttttagatggagttttgctcttattgcctaagctgtagtgcagtggcacgatctcagctcactacagcctctgcctcctgggttcaagtgattctcctgcttcaacctcccaggtagctgggactacaggtgcatgccaccatggctggctaattttgtatttttagcagagacggggtttcaccatgttggccaggctggtctcaaactcctgaccgcaggtgatccgcccacctcagcctctcagagtgctgggattacaggcgggagccaccgcacccggccaaattacgtaaatgatgctaatgagaaaaggagatgaattttgtcacacagctttattcactgaccgaagagctttaagaaggaagctaaatgttaagccaaaaggaaggtacaagagtaatatttatttgaattctgtgttggattagcttttcctaatttaaaaccatctggtgtttctatcaactcgaaaacttagaaatctaaaactgatccgtattccgtgtatgtttgctagaatctgtaaataactgacaaaaaaccatctttttctttttttcttttttgtttttgtttttttttgaaacggagtctcgctctgttgcccaggctggagtacagtggcacaatcttggctcactgcaacctctgcctcccaggttcaagcgattctcctgcctcagcctcctgagtagctgggactacaggcatgtgccaccatgcccagctaatttttgtatttttagtagaggtggggtttcacaatgttggccaggatggtctcgatctcttgacctcgtgaaccacctgcctcggcctcccaaagtgctggaattacaggtgtgagccaccagcacctggcctggctttgttttttctaatggagaaatgagagtttgatttgctttcttggtcagaagtctgttcattttaagttattaagaatgctgagatgggaaatcttaacaataaggtttttatggagaagtgaagtgtacat

SEQ ID NO: 47308 - DNA, 1032 bp, Homo sapiens; identical to SEQ ID NO: 47307

SEQ ID NO: 47309 - DNA, 1102 bp, Homo sapiens
gtagcacacagggtattatataaaagtcaataaatgttactagtactatttctattattttattttggttatttagatttttattcaggctgtaaaagcagtaaatgcatattataacatatcacagaaaatctggaaaagataaaggagcttaggaagtaatcactcagactcacgactgatgacattttagcctgtttccctcgggataactcattatttcctgatacataggtcgatcactacacatgacacgtactggaatctttttacttatgggaatgtctcttctgattaactactttaagaagaaaagaggctgtgtcctcatgtaccagcactgtttctagctcagagtgggtactcagcaaatatttgaaatgagctgttagaagcttgagagaagacttttcaggtcttcgccattcgttgccattttttgcatttaaaaaatgattataaaaagattttagtttaaaaacaaagaaggtagatgtactagtttgagctcaggaagactgagctattatcagacaaaggaatttgatgtaacaatgaaacgtgcaaagagctcagtaagagtatgttgggaaggttgcattctgaagatcggggaacaattatttaatgagtacagtcttgaagtatatgtttctcaaaagtttgccaataaattgccccagctctttagtctctgggaaagatctcttcatgttagtcagtagtggtaagtggaatcttcccacttaagatggtggtgtctggatatcatgattgtgtaagagtaatgacatctctttaattttgaagtttctttcattggaaaaaattaaactctgtgctatgcagaggagactttagaggtggatggatggtaatacgtataatgttgagaactaatgatccagcacagtagggattcttattgataacccgtgaatactcttttgggatattaacacctcgagaactttcccggtacatatgagagcaacattcaagcaaactaccaaagttttaagttaacttttaaagtatttttgacttaaatgaaaatggaatggtttcttaatggttgcaataaaaacctctgaaattggac

SEQ ID NO: 47310 - DNA, 1102 bp, Homo sapiens; identical to SEQ ID NO: 47309

SEQ ID NO: 47311 - DNA, 1033 bp, Homo sapiens
tgcaattgtgaatagtactgtgattaacatatgtgtgcatgtgtctttatggtagaatgatttctattctttcgggtatatactcagtaatagtattactgagtctcagggtaattctcaggttctttgagaaatcaccaaactactttttacaatggctgaactgatttacatacctaccagtagtgtataagcattccctttcctctgcaacattgccagcatctattttttggctttttaataatagtcattctgactggtatgaaacggtatctcattgtagttttgatttgcatttctctagtgattagtgatgttgaacattttttcatgtttgttagctgtgtgtatgtcttttgagaagtatctgttcgtgtcctttgccctttttctttttaaatgaggttgtttgttttttgcttgtacatttgtttaagttccttatagattctggatattagacgtttgtcagatgcataattttcaaacatttttttcccattctgtaggctgtctatttagtctgttgatagtttcttttgctatgcagaagctctttagtttaattaggttccactagtctgtttttgattttgttgcaattgcttttggcatcttcatcatgaaatctttccaaggtcctgtgtcagaatggtatttcctaggattttatagtgtttttttttttttttcttttgagacagagtcctcctctgctgcccaggctggagtgcaatggcataatcagggctcactgcaacatccacctcctgggttcaagcgattctcttgcctcagcctccccagtagctgggattacagatgcacactaccacgcctggctaatttttatatttttagtagagacggggtttcaccatgttggccaggctggtctcgaactcctgacctcatgatccccctgccttggcctcccaaagtgcagggattacaggcatgagccaccacacctgccctcttccagagattttatagttttaggttttacacttaagtcttttatccatca

SEQ ID NO: 47312 - DNA, 1033 bp, Homo sapiens; identical to SEQ ID NO: 47311

SEQ ID NO: 47313 - DNA, 1035 bp, Homo sapiens
catggtgaaaccccacctctactaaaaatacaagaattagccagatgtggtggcaggtccctgtaatcccagctactcaggaggctgaggcaggagaatcacttgaacccaggagacggaggttgcagtgagaggagatcatgccattgcacttcagcctgggtgacagagtgagactctgtctcaaaaacaaaaaaaaatttaaacatgtacattcttgttaaagggggaaaaagaagttaaccactgcaaacatatagagatttttttccctcattcctgcccacttttccttttttatgggcatatacatttatatatatgaatatatacacatacatagtgtttttaaaataaaggttggattataccgtgcaaattgttccataactacagatatacttccttttttaaatgccttgtagcattcattaatgtagatacttcataatggtttagcaatccctcaattgattagctgttttctattggttccaatttctcaatatgacaagcagttctctgtgaactttcttgcatctttgtgactttgtacagctgattctgtaaggactgttcacagaaatagaacgacactgccaattgattgcagtacttagattcagaaggcaattctgattactttaggcaagtacgtaaccctatgagccttggtctacttctctgagaaatagaagtctggaccttggggcatttgcgagtttgatggaataatgtaggtaccgtcaagttcgaggacagcattaagaccaaagacagagttaggaccctggacagggaaagggagctcatgttacaagcagaaaagtctcttgtgtgtgttttccaaactttctacaaaaagtatgtatttctcgtatgatcagaaaaatagcatagccaaggactgctgctataaaagagcagccacacagcagctctacacagagttgtgtgccagattgcagcccatctccttggggtcaggggtgtggttcctagctggggtctcctgtcttacctacctacctccca

SEQ ID NO: 47314 - DNA, 1035 bp, Homo sapiens; identical to SEQ ID NO: 47313

SEQ ID NO: 47315 - DNA, 1055 bp, Homo sapiens
ctgataagcaacttcagcaaagtcttaggatacaaaaccaacatgcaaaaatcacaagcatttctttacaccaacaataggcaagcagagagccaaatcatgaatgaactcccattggcgatcgctacaaagagaataaaatacctaggaacacagctaacaaaggacatgaaggacctcttcaaagacaactacaaaccactgctcaaggaaataagagaggacacaaacaaatggaaaaatattccatcctcatggataggaagaatcaatatcatgaaaatggccatactgcccaaagtgatttctagattaaatgctattctcatcaaactaccattgacattcttcacagaattagaaaaaactatgttaaatttcatatggaatcaaagaagaccccttatagccaagacaatcctagcaaaaaaagcaaagctggaggcatcacactatctgacttcagactgactatactacaaggctagagaaaccaaaacaagttggtactggtaccaaagcagacaaatagaccaatggagcagaacagagacctcagaaataacaccacacatctacaaccatctgatttcaacaaacctgacaaaagcaatggggaaaggatctcctattcagtaaatgatgctgggaaaactggctagccatattcagaaaactgaaactggaccccttccttacaccttatacaaaaaataactcaggatgaattaaagacttaaatgtaaaaccccaaaccataaaaaccctagaagaaaacctacgcaacaccattcaggacataggcctgggcaaaaacttcatgacaaaaacaccaaaagcaattgcaacaaaagccaaaattcacaaatggtgttaaactaaagtgcttctgcacagcaaaagaagctatcatcagagtgaacaggcaccctacagaatgggagaaaatttttgcaaactacccatctgacaaaggtctaataattatctaaaatttacaaggaacttaaacatatgtacaagaaaaaaacaaccccatcaaaaagtgggcaaag

SEQ ID NO: 47316 - DNA, 1033 bp, Homo sapiens
tggtacagggcttgctgttctggtgggcttctggctggcaaacctgttccagagaatgactgaccatgccacctgaactagaggccaatttccaccatttagcagcagagaccacctccatagacactttctttcagctgttaggaacaatcttcctttccttcatgtagtaatactttttaatcatgtatttgagactataggactttaaagtgatctttcattattaaccttgaagtctgggtttttctcattttaatgatgttgatgtagcttctgtaggggtaagtagattcctgtggatttccttctggtgccttgagctccagatctgaagccatactccacctccctcatactcctctaccttttccaggttctttattttaggtggtgggttgaatcttgtgttttgttctttttttaatgaccttgtcataattaaaattgcaaactttttttgtacaaaactgatttgatctgtccccagcgtgccttcctagtctgacttctcttccattcttccacacattccactctctaactatactggaaggtttgctctgctccaaaacactatgccctctccagtcctctgtgcttttcttctcaagcatttcttcatccccagctggtcctgcttgcctctctctttccatcgtccaagcatgtaccatatccaaacatgtggccatcttctgtccaccctccttcagtgaagggatcccctggctttgtcctggtcatcctccatggtgtttgtttcttctaattaatgatggttgacagtttatatgtctctttccttcactaactccaggggcttataaaagtctcttgaatgagcaaattctatcaaataagacagtggcaaagcagagaatagtaagctttggaaaaaggagcaggaaatgcttttaaaacttttttgaaaatatagttttaaattttgataaacataatttgcattaatttttctttttatcataaaatatttcttgcccttaaagcaggtactgagtttatgtgtttt

SEQ ID NO: 47317 - DNA, 1050 bp, Homo sapiens
ctctgcctcctgagttcaaacaaatttcatgtctcagcctcctgagtagctgggattacaggcatgcaccaccacgcccggctaatttttgtatttttagtggagacagggtttcaccatgttggccaggctggtctcaaactcctgacctcaggtgacccacccaccttggcctcccaaagtgctgggattacaggtgtgagtcaccacgcctggcccatttttaaattgggttatttgtcatatattattgagttgtaagagatttttatgtattctagatatgaaactcttatgagatacatgatttacaaatatttcctcccaatctgtggtttgtcttctcactagtgtccttcgcagcacaaatgtttttaattttaatgaagtccaagtaatctacttttttattttgttgcttattgctttgatatcttatctaagaaaccattgcctaatccagaatcagaaggatttatgcctatgttttcttccaaatgttttatagtgtagttcttatatctaggtctttgattcactttgagtttttatatataatgggagatcacatgctgtttttgaaaacgagttaaagtggtaaacaatcaggagtttaaaaatatgcatctatctttggttttactgacaatcatgtgatattttgttaaacataccatttaatagaaagaaaacaaactttaacctctaatgaggctgatattctcaatatttactttaaaaatgtgataagcttagagttattagaaaaggcctttgacatttttgtttttacaaatcaactgctttcaataaagacttgaataaatgaagccatatttttatgttatgtaaataatatttttgaaatacattaaaaaatctgtattatataacatgttataattatatggctttttgtttaatgcagtggctctcaatcaggggcaattttgcccctcaaaggaaatttggtggctgggcatggaggctaatgcctataattccagcactttgggaggccgaggctggtggatcacctgaggtcaggag

SEQ ID NO: 47318 - DNA, 1039 bp, Homo sapiens
atcaattatgctttttttcaataagtgaatcctggaaatgaaagacctttgtgtgaaatttggcactttgggtggtggaaccttgataggtcctgtgacttaggtttgatctatacttaagaatcaaggtccctgaacctctgtgccacacatgtctacaactttacacaggcagatatctccaggaataaatacatctcagctctcatgctgcatgcgtattatactttttgtggcattatcctttcaaaattatagtcagtggacattcagtcaggttatcatggtaattaatgggttgggaagttgacgtacagagtgtcttaccctgtaacctttataataccccccctcagatcctatgtggatagtaatagattcgttttattcagcttcagttcatgtggtatctgaagatcatttcagtcattcaatagatttaacattccaagcttagaatagccaggtgctgtgttttatgagaatcaccatacatcattttcaagccaagtgttccataggcaagtaagtgattatgaactttgtaacaataattcctttggctgttcagatctgaagattgaagttatatgtaacttgctactgtgtaaccatatatccaactgcagattttcattattaataccgattccctgcacagttacaggctcttgctttcttgtccatatgccgaccaaataattgaatcaatggaagtcgaaaattggattgtattagactagccaaagtgtttagcagcagcatcaggttccatacttaacactattattttaattttttaagctttatgttataccacaaaaggacttaggtgagtgtgttaaggctttaaacaaagtggtaagagatacaaacagcaagggtcttaatagacaggtgtttgaggttaatttttagcacaccttcattcaacttgaattgttgagcaatcaaaaagacagatgcttggtaatgattttagaatggtagatttaaaaaacatagagattattcgaatgatatggtttttaaataaagc

SEQ ID NO: 47319 - DNA, 1009 bp, Homo sapiens
aaaaattaccagtatgtgacacagagacaagaagcaagcagatgccattggaaaaatggtgccagtagacttgcttgttgcagggttgccacaaaccttcagttaaaaaaaaaaaaaagaagcaatttctgctaagcacaatgaaacaatgtatgcctgtgcgtatggaggggcatggggaaatttgggaggtgatgaaaatattatcttgatttcacgagtgtatgcaggtcagattcattatacatcactgatatttcaaagctgtaagaaaaaacaaaaacaagattgattgtgtgaaaagatgttcagcattattaatcattataaagacttgaaatgttttatttctattcttgtctattacaacttatttgggataaaagtggagaatagttttccttatcctaaattcacagcttgcacaggcaactgaaatgctatacatgcgtttggacacaatgaacactacctgtgtagacaggtacagtaatcgctttactgctgagctgagttagcagcttttacttcctgtacttcataaaggaatttgagaaagacatttttaagaatttccatgtttagtttttttcttgcctcccaaaataacctttgtataataaccagactcatacttaatgtaacattacgttttttgatgtccatgctatgattttctttaatttcattctctagtcaagtatcaaagactatactttggctctgccatttataaaatgttttatctgcaatttcttttttttatttgagacagggtcttgctctgtcacccaggctggagtgcagtgggatgagcatagctcattgtaaccttgaacttatgggctcaagcaatcctcctgccttagtctccatcccgagtagctgggattacaggcatgagccactgcacctggcctacaatttcataaaatttttttttttcttgcttcagtttcatcatcttttatatggagaaaataatatgtaccttggaagttgtgagaat

SEQ ID NO: 47320 - DNA, 1029 bp, Homo sapiens
tttaggagccaagatctgggcacttgatatgctcattgccattggggtgtcattggttctaagcctcttggtggacacacatccatccatccataactgtttttatgtccacctgtgtgtatatatgcctccaattccaactcaataccttatttctacacttcttctctaccatgatttgtaaacaccttctcaggcagtaacaaacttggcttccattatcctcaatatttatttatttgatagaatatagccagtttccaaagcgtgcagtcatctccaccatgccccatcatcaccccacatacttggccaccaggctcatgagctcactcacccgcacctcagtgcaagccagtgagttttgcagtatgcctgagatttggtgtgctggcttagacaaaaactcaaaggatttttttttccctttcacttcttggttgtcagctgagttcaagttgttggagatcatgactttccaggtaagtcgggtgttaccgaagaatgggactgataaaagatattttctgaggctgttatttgtattgtaggttgtcttaccatcagcgtatattagatattgttcctcctaccttctcagctctgtgtcctgcaaacccaacctgcatttacaagtatggagatgaaagtagcagtaagtaatgaaactaatccctctgtctttaaaaggtaccagttcaagtatatctgaagttagttgtttaaagtggagaaattgaactttttcttttcttggggtttatatttcctgtatttgaaaggtggtctatcattagccactgttttatttgccctgtcatcattttgaggatttggttgtgataaaattaattactactggcttatcattttttctcttttgaatgtgttaagtatagcaagatgaatttatagttagaacttactaaactgaaaacgtgtatttgtcatggtgatggaggttacttgaattcattatcttgttcaggtgtggtattgagaacatagatgcacatatttgtggcagta

SEQ ID NO: 47321 - DNA, 1026 bp, Homo sapiens
gaggtgaggggcgcctctgcccggccacccctactgggaagtgaggagctcctctgcccagccaccaccccgtctgggaggtgtacccaacagctcactgagaacgggccatgatgacaatggcggttttgtggaatagaaagaggggaaaggtggggaaaagattgagaaatcggatggttgccgtgtctgtgtagaaagaggtagatatgggagacttttcattttgttctgtactaagagaaattcttctgccttgggatcctgttgatcggtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccactccctaatctcaagtacccagggacacaaacactgtggaaggccgcagggtcctctgcctaggaaaaccagagacctttgttcacttgtttgtctgctgaccttcccttcactattgtcctgtgaccctgccaaatccccctctgtgagaaacacgcaagaatgatcaattaaaaaaaaaaatccacaaaattgataaattcatggctaatccagaaataatgagagaaagaaaatgcatattataaatatcaacattgaaagaaaattgtcactacagatccttaaagacagtaaaaggacgatgaagaaatattttgaataaacatatgccaacaattggggctacttgctaatcatctattgtgaagagctgtttaaaaacataatacatataggcaaggcgctgtggctcatgcctgtaatcccagtattttggggggctaaggcgggtggatcacctgaggtcaggagttcatgactagcttggccaacatggtgaaaccccatctctactaagaatacaaaaattagccaggcgtggtggtgggcgcctataagcccagctactcgggaggctgaggcaggaggattgcttgaacctggcaggcagagg

SEQ ID NO: 47322 - DNA, 1079 bp, Homo sapiens
gtagaagatttgaatactggttaactcagaagaatggaaattgcaaggatggcaggaattactttctatattttgggattatttcacttaccataataaccagtattgttctaattaaaagaattgacaactcagaaagatctttaattcctccataccctttcctccttttatggcagagacagctggtataattggagagcatcgccccaccagttaggtaaagttgatcttttttcataatagctaggggagtggcaaatgagcaaattgaagagaatgaaaggaaaaaaaatgtttccatctcctgtggcccccagctccaatccccagggatattcccatgacctagactcatcataacttaaagaaggacctcataggcattttgccatttagaacttaaaatgtgttttgtttttcatagaggtagtgttataaatcattgttatatcctccagtcagatctgaaaaggtatttggctgcaatatagttcaaatttttcaatgaaaaagtagtaggaaactactgtttgctggtaactgtagaaaacaaatatgagttaagtaggaggtagtatggatttttcatttttaagtgtttaccttaaatttgtgtttgagaaaaggcaagtttaattggagcatgagggaagaagaggagtgaatttggccccaaaagttaaactgtccatcttcaagcagaaggccagttaactcttggatcaaatagatccctcagatttaagcacaaatgaacaagtgcctgcctaactttcttcattagatagcagctctgggaggatttgagatataagaagaaactagggccttttctcctttgattaggacctctggtttattctgaatctagattgggaagctgtgggatcatcttgaccccagctccactcactgtctcaactacactcttccaaagctgttatctcctttgcaaggcagtctagatctctatacccaggaaggaatgaaaagagatgaggcttagttacctctgtggagatccactgagaaccccagagttgatataaagattgttttaaactgaagagatttga

SEQ ID NO: 47323 - DNA, 1054 bp, Homo sapiens
tcagaaaacttgacttgggccaactttttatagcttaactgtttttagatagatgaaactgatggttccaaagaaatgaggtattgcaacaaaatttcaaggtatggtaaataaaatcagaagaactttacatcataaaagtctggtaacatgtcagtcttttccccaaatactaaaaaagaagagtgcaatgtttctccgtatttccgaagtttcaactctgcgcccctctgctttttcctcagcccatattgactcctgtcttccctgaaagtagctgcattgccacactttatattttattatatttcatcctctagtgtttcatgtctgtgccctaactaaaattgtaagcaccctaagattgtgttataaatctctgaatttttccctatactgccaccctagaacattaaagaccgcttgatacccaggaagttcttaatggccatttgattactcaaatgttaacatttgtttcagctaaatttattaaactgtttgattgtctcatactgtgaaaatacctggatttaataaaaattattttcaatttatatttctttagactactatgctgccagaaaaacacatagttctctgggagagtagataaaggaagagagggactaaagtctagtaacctaatataaaggttgcaaaagacttgatgtatttttctatatatgaggctgagtgggtagtggaaattgaatatagagcctagaattttacctcttcaagagatggatttgttacttatattcctttggtttaggagttgtggtttttgatccttttcttcagaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaaggtgagtaggctcagcatctggtgaacctgatgtctgcctttcaaagcctctgataaa

SEQ ID NO: 47324 - DNA, 1061 bp, Homo sapiens
atacccaagagaaggtacatgatttttttttttttaactttttactgtcaaaaatttcagacagtgacaaagggtaaaaataatagcaaaatgaacccccatgttcttatcactcagcttcagcaattattggtcatagctgatcttattttattcctgcatacccttaccttcttccccactccatataattttgaagcaaatcttagccattgtatcatttcatcagcgagaattatagtgtttgtcttatctaccaggacttctagctctctgattttatgggactctatcggacaaagggactgagctgtagcacatagtagaaagaaagtgactgcagttcgtggccttacagcatttgttctgtgagccagcccacagatcctcaacactttgtcccctgtggagcgtcgaggatatttaatgaatcccttttggactatttttagaaggagaagatgaggaagacgaggacgatgaggatggtgaagaagaggagtttgatgaagaagatgatgaagatgaagatgtagaaggggatgaggacgacgatgaagtcagtgaggaggtcagtgcagctgttttctaccctgcttcctatttgtaattacaacaaaagtgggggtttcaaaaagatgacaaaagaaaagaaaaaacaccttttgaagaaattagtatacctgtgaatacatttacaatatgaatctggttaatttagtgtttgtctggctttaaataactactaaatagaatgcctactgaactcaaactagtacggttcctggctgtgcaaggtaagttctggccctctgggggaaggaatgaattgagtattcagtgtggtgagaaaactggacatgttgagaattgatggtatgtctgttccttcattgaattgtagggaagtttatgtttaccaagtctaaactttttcttgtatattcagtgtaattcagtaaatatatatctgctatgttaaagagttgggagtacaaaatgaaatgagattgtggtcctgccctgaaagagcacagtctggtttatgaaatacccaataa

SEQ ID NO: 47325 - DNA, 1020 bp, Homo sapiens
tgagagcaggacatagactatgccctgcgcaggcagccgtccgcctcctgcagggaatgcttgctcctgggtgcacgcacggataccgcgatggtccgagaccacgctctgggacagcaagcctcaagcctcgcacaggagagggccgcggagcttcctcgacccgccccgccgcccttcccgcgggaggccccgcccccgccccccgccccgattggctgtcgggagagaggcggggcctaggggattggctgcccggcgaccgcgggctgacgtggcggggctggcgtgtgggtctcgcagcgttgctcacagaacagagtagaggcggcggcggcggcggccggacccagactggtagtgaggctttggaccccgagccgctgcaatgccgctggagctggagctgtgtcccgggcgctgggtgggcgggcaacacccgtgcttcatcattgccgagatcggccagaaccaccagggcgacctggacgtagccaagcgcatgatccgcatggccaaggtgaggcggcagctcccgggacccgggattcgggcgccgggaggggcggggcggggccgcggggagccagggccacacggcctccgcggctgggtaccctggtccggcctcttcccgcccgccagttccgttttcggaatccttcggatccctcttcctcaccgtgtccgccaccctcgtgacctttctgcattacagcagctgcctcctaacccgacctgtttcctccccgttctggtgccagaataatctttctaaaagtcagacttgatcagaccatcccccctgcctggcaccttctgtggctccctcctgcccgcgggtagagtcgaaaccctttaacatagccttcaagattttaatgactgggccccttccagcccgtcataattcttctctgacattcttcagcgacacagagttactttcaggaatgacagttcctggaagttgctgtggtctctctcacccgccattccctgtatatgaaatatgaagtg

SEQ ID NO: 47326 - DNA, 1054 bp, Homo sapiens
aacaaccttttcttcctttcagactttcttgccttttctgttcctcttccttggaggtccttaaggtctctgtcagtctatgttgtttttaaagatggtgatgtcggctgggcgcagtgactcatgcctgtaatcccagcactttgggaggccaaggcgtttggatcacctgaggtcaggagttcaagaccagcctggccaatgtggcgaaaccttgtctttactaaaaataacaaaaattagccgggtgtcgtggtgggtgcctgtaatcccagctacttgggaggctgaggcaggagaatggcttgaacccgggaggcattggttgtagtgagccgagatcacaccttctgcactccagcctgggtgaaagagcgaaactctgtctctaaataaataaataaataaagatggtgatgtcatagtggttgctccagaattttttcctttttttgagaatctacgacagtcactgaaagatgtcctaatgtgtgttgtaggagtgtggggctgattgtgctaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgaggtgagtcctctgctgctctgtcatttgtcactttagcagaccaagggtcagcaggcagcctggtgacttccggcttagggccacctccagcccttgctcatcctttctgttcccagctactggagaggctagcaggcgccaaagcccagtgagaatctgtgggaaggatgccattgttttaaaaacacattgtctctggccgggcttgatggctcacacctgtaatcccggcactttgggagactgagggggatggatcacctgaggtcaggagttcgagaccagcctggccaacatggtgaaaccccatctctactaaaaatacaaaaattagctgg

SEQ ID NO: 47327 - DNA, 1021 bp, Homo sapiens
tttttttgggagtgcgagaagttctcagccctgacttcctgtgctggtttagttcttgaattctttgtcttccagaactctgcaacacttaacagtttgtgttgtccatttctactgcctgtgctgctacttaactctacttgaatgcgttataggtacccagaggacaagattcatgccatttctttcttttgtggcctcagaacttagcactgtgttttatattctattccacataaatgcttgttgatttctatttgagcattcctttaatatttatactgttttatgtaagtccagtttatgcaatattaacttgtaattccgtataaataatcaggaaaagttgtatggcgtgttgaaagcaattggttatttgtcctaccttcaccagcagttatgcagaaaatggggcaatacctacttttgcctaattcatgagattgtgaagatcacatgagaaagtggtatttgagtttgaggttgctattctgtgttgttgctaaagagcaggactgatgttcaataagcagttcccactgggccatgtgtgttttggttaaacatcctttctgattggttggtacccttgtagtgccagttgttaaatatttttaatatcatttctatagggaggcattagtattcaaaaagggaaatgattagtgtaagctggaatgattgggggaggcttcttggacactttaggacttacactgactttgaagggtgggtagaattcagagggggatttgatgagtgtgaaagttcttttgaagttgtgtccccaactgtcctggggcctactccaagggaggaaacaaggcttttactgactgactggcaagttactcttcagagttaggttccttattctgtactgtggaatttggatgtattaacctctatcattttttccccaatcctaaaagctatagtacatagctggaaacaaaacataaaagtaatcaaagtggaatgagtgagggagaataacattatgggatgcccagtaggacta

SEQ ID NO: 47328 - DNA, 1064 bp, Homo sapiens
aggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatg

SEQ ID NO: 47329 - DNA, 1039 bp, Homo sapiens
gaaccaagtgtgtaactggttagttttgaaaaccattgtgttgaggtatagaagggagagacagttacacagtggccagaaagaaagggtaaaatagcccccaaatacaaatttgagagattcaatgtgttttattaacctttacctagctacccctagggaatgggaagtattttgagtacactttagtatttctaggggctctggttttcaaatactcttctatgttccatgcgccagcagaaataagaaatcttaagagaagccagcctgactcctctggggctcctgtaattccaggaaactttgaagtcaggaactggaggtgtgatattgtggaaatagtaggaagtgcatgcgtccaagtcctggctcagtccatgactataatatgttcacactgggtttatcttctagcttaaaatccttttcaatgaacaaggaggaagatttcagctgcataccccacagatggaatgacatatatctgtgtgtgtgaaaccttttctaagggcatgaatctttctgtaaatccctgtacagttatgttttgccatttacaatcagttttcccataggaatggtcacacaatgaagttttaagttcccaggctaccacgtagtccataattaatgtgtctgaaatataatccttgtagtacaatagacccaaatcatggtttggcactgattgctttcaaagttctggcatgaacacagctcttcctgttagaaccaggactgcactctcccactccgtcatgtagcagggcaggctccccgtgctgtagacagtgcttcctgcattcagaatgtggagtaaagaccgtggttgggtaaaggaggcatgaggaccagaatggggaggaaagcaagaagagatggtagggatagggttttcacttctcttcttttccgtatatgcccttccctttttcaaaaatccagaatcatcagcccacagatactggaatgagattttgagggagggtatactgggatttgatgctgaatggtgcaggcagcaatgagataggct

SEQ ID NO: 47330 - DNA, 1046 bp, Homo sapiens
gagggataatattgttgagtatggaatggcaaattatagattactgtgtataatgtaatccattttttaataaaaagggagaagccttatatatgttaaatgtgtgcatgagccgtgagaaatgtgtgggagtattgagttaagagggggtgggataggtgaagtgagaatatcatttttatttcatatgcttctgtagtgtttgatttattgtgaagagcatttatttttgtataaccacatttaatgaaggaaaaatgctaaataaattcaaagtatgagcatgtgggttccaaagatgctgcatttggccagccagagacatggaaaatgtaaaagtattatgctacaccttctattgtggagatatttgttataatttccatccacaactattataacattacttctgaaaagaaagatatcttatactaagaaatggtggcattaatgatttttttcttttatagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggtaatgtattgtgctaagtcttattctcagtcacagtagtgcagttaattaaagatcacctccttgagtagatactgaattatctataggtcttcagagaccattcactatcccaatatgctgaatccttggaccctgatcagtgttcctggaaatgtgtaccctggatattttgcagaataaaaaatttaaggctatgcttatggagtgggacttcagggaaagtacccgtttgtctatttattgaagagaaatttaaatatatttcctaaggataatgtcattcttgtctgcaaagtactctttactcctttccaggtgcaggggtgacctcttcaggcatgcttttt

SEQ ID NO: 47331 - DNA, 1027 bp, Homo sapiens
tctcaaactcctgacctcatgatccacccgcctcagcctcccaaagttctgggattacaggcatgagccaccacgccctgctgcctttgagcattctacagtgagtggagataggcctggaccccagaaactgagctttcaagcatgatggctaaatgcaaaagcaagaatgaagagaggtattatcagctccaaggaaaagcatttaattccaaaggaaggaggcaggagtcataaggtagaaagaagcattaaggatagcttcacacaggtagacagtatttgtatgagccttgaaaaatgagtaaatatccactgggggaagttatggagtatatttgagaagctgaacaaagacatggagtagagaagtgtatggcctgttccagattgacaagtactgcagtataaccaaagcataaggtaccatgggcaagcaaggagggtgagggccagattgtgatggctttgaatgccatgctaaagaatttgaactttactttgtgggcattagaaagcctaatactgattcttgagcaggttagagtcatgcaattcagtctgtgcttcagaaagatcactgttggctttgtgaataatggcctaagagaggaggaggtcatggaaaggaagactggttaggaatcaattgcaagagttcacctggagcaatggcaataccagtgtaaaggtaaaggacagctgagagatatttctgggggacttaacagaaattggaggaagatggagccaaagataaggaacattgtctttattctgcataattgggtgtcagtgatactgttaacatagattaggaagcacaaagtcaatttgttgggaaagatagattttccaccatttttctaaattgttctttttgtctttctcaggagttatgggaaggtaggatgtatgaatacgtgtgtatgtatatttatgtatgtgtgtccacacaggcatacctgtttctgcttgcagttctgtctaggtttagttctttgtttctgatctaaccatgattttg

SEQ ID NO: 47332 - DNA, 1069 bp, Homo sapiens
caacatatgacggctgatggtagagttttaagcctgtgatttatctgctagcatagactgtttcaggcaagagtggaaagtgttgggggtgtcctaaatagaaacaatgatagggtgtcagaaatctagacaagttgtatattattagtgctggaactttttcttctatgggtcagaaaaagaaagctgacttaaataagttttgctattgaggaaaataaaaattgaatgattgaatgaatgctaaaagatacctgaagttttagtgtcctagaattttcaagcaccgaaagaaaaagttaaatatattttttgatagagagatgagagttaacacttccttggggaaattaggataaatttttctatttttcccccctcacactttgcaaacacattttatccccacttcaactctatgaaggtataagtatcactattcttacttgataaatgagaataccaacacctagagagcttgagtaatttgtctaagagcacatagtggcgtttgctgagatttgaacacagattatctgactaaaggtggtgcccttgatctgagcacatataatagtggttcttaaagtgtgagaattgtggactggcagcatcagcatcacctgggagcttactagctcaggcttcatcccaggcctactggatcagaaactccggggattaggcccagcaatctgtgttttaagaagcctccaggtggaagactgagaaccattgttaaagttgtctctcacagagacattcaaaggaaaactgataagggactttcttaggcattgttttagagatgtcaagatagtggtggagaatattggaatgaagggataccacaatggcgaagatagacatattttgtgtatgagaagggaagtaatatcagtaatgctaagaggaaacaaacatggggaaaaagtagctgtgtggtttgggcttcatgttttcaaatgaaataatggttggaattagaaaagtgttgtatgtgtctgcctcaatataaatgaataggccaattatataagggcaatcaaacacttcaggattaaagttg

SEQ ID NO: 47333 - DNA, 1033 bp, Homo sapiens
cctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataacctttt

SEQ ID NO: 47334 - DNA, 3507 bp, Homo sapiens
ctcttaagttgcttacaaagatcatggatgaagatattaaatgataattaaagctgattgatctaccttgtaatacataagtgttttataaaatatctatagccataatagtcattgttattattgacatgagaagaccaaacattctcatacattatttattatgtttctagtttttgtgtgtgtgtgatagtgaactgtattatgttatcttttcttgggttcattagtgggaaaagctcatattcccaaagcattttgctcacatctctattagagccccattaccttatattgtaattattgcttacttgtctcttttctactaggctggagctccaggcaagtagctctttttgtttgtttttgaatctctctgaatctagtaagttctgacatgtcttggttgaatgaattttattttacttttatagaaagtcattactaatacaaatacgagaccttttgtttattggaaacatttatctactttaaaaatatatatgtttgtggaaaaacttattgaactgtgctgcttggcttagttattttggcacatgttcacttctctggaaacaaattactgttagtccaagaaactgaagaaatggtacccatgagaataaaattaatctcaatatactgaacatctgcacctaatttgtttttcatttagaaccatcagtttaatccaagaaagcaattggtcataccttttctgggcttctcacaaaagatatctaattgttagaaatgttttgctccagggaggctactatttctctgacttctactgatacatttgttaataaggataaaaaagctttagaaatattagtatatgttaatagttatgcatgtttaatcttccaggaggttatttatttggcttcaagaagcttaagactacccactttgacaaattatatcacagtaaacacaaaaattaaagaaccttctggttgtggctgcattgtcctttttttaaattcataaataattctcagttcatctatgaaaattgaatgtttattttcagttttcaaggtacgctgtttccatgttactgatttacaaaaaggagaaagaatacctctgaaacttttcaggaacacttataccaggtaacactattaggttttcttattttgcagatgcacacacaaacacaacaaacaatccacgccccagtccccttcagctctgtattccccctcagtacatatatagctctaccataactcatcaccacagtttattggagattttgtttatctaggtctcacgcccagtaaagctatttgaaggcagtgaccatgtcttatttgatttcatagttacagtcctagcatagcttctgccacttaataaagacagtaatttatttaaggaatacatgaatgaatgaatgaatgaatgaatgaatgaatgaatcagtaaatgtgaatatcaaatagatttaatatgaagggcatggccttcaagactgttgaaatttaaatgaataattatatttattccttttcactatccactccctgcccttacaattttgcaatcaggattttttaagattttctgtgagcttaatttcttaataaacaatgctcttgtatgcctcaatttcttcatctataaaatggaataatacatcctatcttctatgtagggatgatgagtccttagatataaagcattctgtttgttggagaaatttattctcaaggactacattatcaatattattgctattagtcacactacaatgtaggtgcaaacatcaaattactgtttagagatcagcagatgtcagagatagaaaggctctttgggatcttcttgtccaatttgtccttggatgaggaaactgaactctactccttttacatctcttctctttaaaaattactgtactcacattctctttgcctttgcatatgcctggaattttttttttttaattatcttaagcatagagataagaaagaacagggcctggtgccatggctcacgcctgtaatctcagcaatttgggaggatgaggcaggaggatcacctgaggtcaggaatttgagaccagcctggccaacatggtgaaaccccatctctactaaaaatacaaaacttagctgggcgtgatggtgcgtgcctataatcccagctactcaggaggctgaggcaggagaatcgcttgaacctgggaggcggaagttgcagtgagcggatattgcaccactgcactccagcctgggcaacagagtgagactccatctcaaaaaaacaaaaacaaacaaaaaacaatggagaactgagaaaacattaggtacctaatacctcgaagagatcaaactcagtatttcttatttttgcttcagaatttttaaacaaaactatagattcacttgaagtcttccatttatcttccaaaacccttctttccctgtctcctcagtctgtcttgattttgttggtttcaattcccatgcatatgtttctacctttactttatgtgtgtgtgtgtgtgtgtgtgtgtacatgtgcacatacactattatgggtaaaccatattattttgcatctttaaattaatggtattatactgtgtgacatttaccaacttgctttttcaacttaatattatgtatttgaaacttcttcatgttgaaacatgtagccctatttcataaaagattatatccagatgcctaaaagacacatgagatggtacacaacatcattactaattagaagcaaattaaaactccaatgagatactactacatgaccagtggaatgtataaagtaaaaaagtctggcaatcaatattgattgatggtgaagatatggagcaactggagctccccaacatttttgttgagaatgtatattggtacattcactctcgcaaactatctgactatatctgccaaagctacacacacacacacacacacacacacacacacacacacacatacacacatccctcatctcaattcatgctcccagccccggtaatacctaagaaaaataagtgcctctttctactagaagacatgtatgagaattacatgatagttttatttagaaaagcaaacattcctttttttaacttctatttttccataagttattgggggtaaaagtggtatttggttacatgagtaagttctctagtggagatttgtgagaacctggtacacccatcgcccgagcagtatatgccgcaccatatttgttgtcttttatcccttgcccccattccactcttccccccaagtccccaaagtccactgtatcattcttaggcctttgcatcctcatagcttagctcccacatatcagtgagaacatatgatgtttggttttccattcctgagttactttacttagaataatagtctctaatctcatccaggtcattgcaaatgctgttaattcattcctttttaaggctgagtagtattccattgtgtatatctatacaccagagtttctttatccact

SEQ ID NO: 47335 - DNA, 1046 bp, Homo sapiens
tgagaggaagttatcgagttcagttgtgaaaaatggaattttaggcttcggtgataatgactagtatgaattgtgatagtttgcatctccaaagtaaggtcttggctggagttattagtatacatatagaaaccatagaagtagttgaagggctcaggtatggtttatagatgggaagaggactagaaatagaaaacaccaatatttaaggtttatttacagaaaataaacttacaaaggagacagtacaagataggagaagaactagatcagagtggtgttatggagccagagggacaggtttcaagcagaagaggatccatttgtttcatcttttttactatgatgctaagatttgaatagttccttttccactaaatgactcaataaatggatggatataaatatgataagaattaaaaggcttccactggatttttcagttagaaagtgaccttagcaagagcaatggtatttagtggacacacaagctagatatatatcactgttgagtaaacaggaaatgaggatatggagacagtacgagtgattgattaatggggttattgatcaggaaaagtatggacggaagaaattgtggtgggaaaatttttaataaataataatctctcccagtataaccgtcacccactttcaataaatattaattcataaacttgtttctgtagacttcaaactgttttattatatattctattatttcatccataaatatttcagtatatttataattcatatatccccacgatatcattgtaccaaaaagaaattagtgataattctgtaatattattaaatacctaatcagtgttcaaattttcctgattatatctcaaacatttttttacagttgatttattcaaatcaggacctaaacaaggtctatacattgtatttggttgataagtcttttaagtctcttgtaatctaatagatgagagatatttgaacacgtttaaatgttaaggaaaaggagacatcaaaaatttaggagaaagaatggattattgatggatcaaagtcgc

SEQ ID NO: 47336 - DNA, 1040 bp, Homo sapiens
cacacctccccagaccctaacacccttggttccattaaactcctaaacttgggcttcaggaacagaggaagtgagaaagctagtgtttaatgataacttgttttttcactgcataacaaggaccttgttattttctggtgctctgcagagtaaatatagcataatgaaaaagaaatggtatctggtatcagaatttataagatctatattcgagtcataattcaaagacatttggtactctgtgaccttgagcaggtagtttaactctctaagcctctgtaaaatggagataatatttctaacatacttacatcataagattgtaagtatgaaaatacattgaaatactgattgatgtgtatgccaaagaccctgaaaggcagcaaagttatacatagtgtttacaaatatatatgagtatgaaacatctgaaaaccatataaataatctcttttgcaaatataggtactttttccaattgtatttaaaagttgatgtgattaattgatgtgattaagaaaatggcatttcatttaaaattgtagctgaattcaattctcatattttttcaatgaaccaacaaatactaaatttaaacattaaggttctactgaattttttgtaggatttttttgctgttttttaactttaaaaagagttaaactttaaaagactgagagtcaacgtaataatatatgtgtataaagtgctttatttataagtaactttaattgagaataacagcaagtaggtatagccatctagtgactttaactttctttttaaaatatatgtaactcctcagccaggcatggtggctcatgtctgtaatcccaatactttgggaggctgaggcaggtggatcacctgaggtgaggagttcgagaccagcctggccaatgtggtgaaaccccatctctactaaaaatacaaaaattagctgggcgtggtggcacgtgcctataatcccagctactcgggaggctgaggcaggagaatcgcttgaacccagtgggtagaagttgcagtgagccgagatc

SEQ ID NO: 47337 - DNA, 1034 bp, Homo sapiens
tccggtattcctttataaaaatacaaatggactaagacaatctacaaagaattcaagtataaggtagaatgcatatgtgctagagaagaatacaaacaaaatggtatggaaagatagaggaagggaatattcaatgagaagttttagggaaggtttcatgaaggagagagaatttgaactagatattgaaaaatcagaattaattttcaaaggcttggagataaatagtatattctgcagagataaccaagtaaatgacatacagatagtcaatggctctgagtggctctactagctacatctttttatgttaataggttttttacttttttcagagaaaattatatccagcatttttaatctttagactaataacaccaggtagacacaaagctattcctggaacattgctttattatagataggaattccataaccaattacctcctatttgctagaacacactaacacaaatacataaaaaatacagactaaactataatagaaggcagttttctctggtgtttgtagcacctctcttctactaatttaaaatatcttcatcactgaggatgcctcctattaaaatgttatatctgagttatactaataactatgaaattaccaggtgtctctgcttgagtagttggaattaatttttttgcctcataactctggagacttctcagaaagtgtagctaaaggtttattcatcaaaatccccttctaatgaatcgactctgatgattctgctgttgtcagaatggatgttctaggaagttgtcatcacacttgaccgtaatgaaaatgctgccctggaccatctccccaaactatgtgtcctcagtattgtgggaagaacccacttcatgatttctaaccagggtagcctctggaagtacaaatgattgctgtaaaattatgaacagagcagcatcaggctttgctctgatgtatcttatgaagcctttctacttccaaatgaagactatgaagagaaccttgaaacaatgcccttctgggagctcattcag

SEQ ID NO: 47338 - DNA, 1778 bp, Homo sapiens
cttttataacagggcctactcagttcttcaaagaggatgaaaactgagtagaaatctgcattcttactttttgaagaatcaaaggacagcatttggggcaatggctgtaagtcagaagagatgtttcaggctgggtgcagtggctcacacctgtaatcccagcactttgggaggccaaggcaggtggatcacttgaggtagggagttcgagactagcctggccaacatggtgaaaccccgtctctactaaaaatacaaaaaattagctgggcatggtggtgcatgcctataatcccagctactcaggaggctgagacaggagaatcgcttgaacccgggaggcagaggttgcggtgagccaagatcatgtccttgcactccagcctgggagacagagtgagacttcatctcaaaaaagaagaaaaatgaaaaacagaagagattttccagaacagagaaattcatataagggaaggcctaacctctacatataaactgccaaaatctctgactaacccctaacctaaacatagatggggaaaaattcaggcagccaagctaaggctaaaataactcatcagcgatttagctgctgcctgcctatgcaggaaaaacataatttagagtttgggttcagccaaggtatctgcctgctaaaacaaaaaatgaatagtcttcagcataacataacagaatccagaatctttacaacacatcattttcagtgtctaagatattctcaaatattgctagacatgaggacaaacagtaaactgtgttccatactcatgagaaaaagtaacaatggagaacaactatctttgttgttccagattttaatgagcagacaaggaatttaaagcaggtcttttaactctgcttaaggatgcaaagaaaaatatgttcgtaatgaataaacagataggatgtcttgcagaaaaatagaaactctataaaaagaactaatggaaattctagaactgaaaactacaatatctaaagattcactagaagggcttatcagcagattggagatgaagagtcagtgaacttaaagatagatcaatagaaattaaccaatctttaaaaaaaaaaagaagcgaatatactaagaaaaaagtgagtctcagtgatttgtaggacaatattgaaagaccaaactgtttgtaattacaaagataggagagagagaatggggcagaaaaataattaagaaaatgatggccaaaaattgcccaaacttggtgaaagacatacatttaaatattcaagaaacgtaatgaactccaataagataaatacaaagaaaatcttggccaggcatggtagctcatgcctgtaatcctgcactttgggaggctgaggcaggcagaccacctgaggtcaggagttggagatcagcctggctaacatggtgaaaccccatctctactaaaaatacaaaattagctgggcatggtggtgcgtgcctgtaatcccagctactcgggaggctgaggcaggagaatcacttgaacccaggaggaggaggttgcagtgagccagaatcatgccactgcactccagcctgggcgacagagtgagatgctgtctccgaaaaaaagaaaatctcacctgaaaataccataatcaaattgctgaaaaccaaagatgaagagaaactcttaaaagcagccaaagggctgaactgagctggttgccttctgttactgtgggagaactcacttcatcccaacttcttcatactttcacttctggagctcatattcctctgacat

SEQ ID NO: 47339 - DNA, 1005 bp, Homo sapiens
aactggacagagaatgagtttgatgaattgacagaagtaggcttcagaaggtgggcaataataaactcctctgagctttttctgtaaaggagcatgttctaacccaatgcaagaaagctaagaaccttgaaaaaaggttagaggaattgctaactagaataaccagtttagagaagaacataaataacctgatggagctaaaaaaacacagcaggagaactttgtgaagcacacgcaagtatcaatagctgaatcaatcaaatcgaagaaagaatatcagagactgaagatcaacttaatgaaataaagtgtgaagacaagattagagaaaaaaagaatgaaaaggaatgcacaaagactccaagaaatataggactatgtgaaaagaccaaatctatgtttgattggtgtacctgaaagtgacggggagaatggaaccaaattggaaaacactcttcaggatattatccgggagaactttccccacctagcaagagaccaacattcaaattcaggaaatactgagaacaccactaggatactcctcaagaagaggaactccaagaaacataatcgtcagattcaccaagagtgaaatgaagggaaaaatgttaagggcagccagagagaaaggtcaggttacccacaagggaagcccatcagactaacggtggatctctctacagaaaccctacaagccagaagagagtgagggtcaatattcaacattcttgaagaaaagaattttcaacacagaatttcatatccagccaaactaagcttcataagcgaaggagaaataaaatcctttacagagaagcaaatgcagagagattttgtcaccaccaggcctggcttacaagagttcctgaaggaggcactaactatggaaaggaaaaactggttgcagccactgcaaaaacataccaaattgtaaagaccatcgacactgtgaagaaactgcatcaacgaataggcaaaataaccaggtagcatcacaatgac

SEQ ID NO: 47340 - DNA, 1051 bp, Homo sapiens
tatttaaagcaaaaattataaaactattatggaatttatagtaaatataggtataatacatatatatgatatctacagcataaagtatggggtggggataatgcaactatacaattgcaagggtcttgcattttgtataaagtgatacaacattaactctaaatagactttgtaaagttatggatatgaactataatacttggaggaaatactaaaataataatgcaatgaagtatcgctttttttaattcaagagaaaaaattttaaaggaattcttaaaaattgcttgagtttcacttcccaagattctaattcaattggtctgaggtagaaaccagacagtaatgctttttaaaagctcctcacctgattctaatatgtttaaaatgccagtgttgggaatgtttctagcagtgctaaatcaaagttattggatgtagttgtataagagagaagtatatgttgcatgtaacagagagtatatgttgctggaaaaccatgcagatcaccagagcactgttttacctcactgaaaagcattagttcctgtgaatccatagaccacttgcttcgtgttgatgacaaagtcctcaccattttgtaaaaaaatgaagaaaagatcattgtagtatttaacatatataggtttgtgtagtatttaacatataggtttgtgcatgtctgtgcacctatagtctgtatgtaataagtctgtcttcctgttactacagttcttgaaaatagttgggtggccttttgctacattgggaagacatatttagaataatatgacttcgtatataggctacatggtatacaaaaaaatgcatgtgggggaaagtaaggggagcactcaaagagatctttcagagcatctcaagcagagattcaataagaggcctatttaagaggtcattggaagggagatgccataattcttaaagacattgcatgcaggaaaaaacagtgattttgaatatttgccacaaatggaaaatgacaggagtagatactcaagttacaattaatttgtgatcctttgctataaag

SEQ ID NO: 47341 - DNA, 1048 bp, Homo sapiens
gttttttttttcaaatctttatgcccttctttcctcccttctttcctttcttccttcttttctttttttcagccttatttaactggctaacacctccattacaaatttaaatagaagtgattagagtagacatccttgccttatttctgatcttaggaagaaagcatgtagtatttcaccactaaacatgaaattaacttcaatttttaaaagatgtccttgagctaaagaatacaggaataacaaatgtagggggaagctactacctctgaggcttagggagagtatccaagggaggagcaaacttggaagctgagattcaggcctggtaggaatgagtgtggctgtgcccctggttggtgaagttcactggaatgccaagggccagagctagagagctggggctgatgagcagaaagttgcccactggggtagtggtgaaacttactggaatgtgagacccactgagtctcctatagacctccgacatctgcatcataggagcaaaaagagcacattggaaccagtgtgaagagccccttcctctgctattatttgtagtgtccctgctgcgcctgctacagataaagtcaaatattgtggcaactgcaaaggagaaattttcacagggtctagtctcacaaaacatggtaaagaagctgatttggagctgagaggcaaaaaactgataaatgatacactgattgaggaaactttcttttgattctagttcgctgagaatttaaaccaagagttggtgttgaatattgtcaaatgccttttctacatctattggaattatcatatagttgttgttctttatttattttgctcattatatcaattgtttaaaaaaatatatagagatggagtctcactgtgttgcccaggctacacttgaactcctaggctcaagcaatactcccacctcagcctctcgagtagctgggactacaggcacacaccccaccacacgcaacacatcaattgatttttttttttgagacgggagtctcgctttgttgctcaagctggagtgcagtgatgt

SEQ ID NO: 47342 - DNA, 1027 bp, Homo sapiens
atgacattgaactttttaaagaatacaagccatttattttatagaatttgactcaatttgtgttagtcttatgttccctcataattagattcaggtttcacatttttggttggaatattacataagtaatatgaatccttctaagggtattacctctggagatatatgatgccccttatcacagccttaattggccaggcatgttggctcacgcctgtaatcccagcactttgggaggctgaggcgggtggatcacctgaggtcaggagtttgagaccagcctggttaacatgacaaaaccctgtctctactaaaaatacaaaaattagctgggcatggcggcgggcacctgtaatcccagctacttgggaggctgaggcaggagaattgcttgcacctgggaggtggaggttgcagtgagctgagatctcaccattgcactccagcctgagcgacgagagcgaaactccgtctcaaaaaaaaaaaaaaaatagtgttaattatgagctcttggatcaaatatcatttgctttctccactgtatatttaatattttccctttttgtaaataagcaatttggaaaaatgattgcttatattaattttgaattagcataaataaccacatatccaaaaatacttactccagatgtacttgatttttgtttatgcttatagggaagaacagctttgcattggtcctgcaacaatggataccttgatgccattaaattactgctagactttgctgctttccctaatcagatggaaaacaatgaagagaggtaagttgttgttgacttttttttttttttttgagatggcttctcgccctgtcactcaggttgggttgcagtggcacgatcttggctcactgcaaccttcgcctcctgggttcaagcaattcttctccttcagcctcctgagtacctgggattacaggcatgcacgatcacacctggccaatttttttgtatttttagtagagatggggtttcaccatgttagctagggaggtctcgaactc

SEQ ID NO: 47343 - DNA, 1041 bp, Homo sapiens
gcagtgataaggtttgccccggggctggctacagagaggcttcttggaattgaacaagagagctgttgggtttcctaaaaagaaagaggagactgctcaaataacaaagtctaatttatcacctcagagtcccccttaatggcagtgagatccatataggtgccaacccagacagccacccacatgtgtctgtctaaagagccaatatcattctcttaaaacagccctgctcatcggtgctgataaaaagctcagcacttcctctgccttcctggagcaaggctattaaatctattagcagcacttcagccacccagatgcttccaccttcttctgaaaagcagccttgtcccagagagatcacactgaaatggcacctgcttgcatccgtatgaatctcaggctccgagatgacaggctgtccggctggcctgtagaccacagtcattagcaggtggcaaagatgtcacaaaaccagagtcaaataaaaacactagagctgtacaggagttagcacgacccatctggccatgttctcggtaatgggactcagtagaaaactattatataagcaagcttggaccccagatcaggggctactccatacaggaagaaagagtttcagaaggggaatttaacaagttgacaaggttgtaaatcaaaatgtaacccagatgtatgtcagctggggctttcctgtcgcttgagatctaaataagctttgcttcaaatgccgtagtccatagcagtctggattctatgactgcttggaggcttagggtctccgccttgtctcatgcttctgtgtctgatccttagctctgcaatttgtcaggttgcctataaagaaggcatgctcatgtgtgagcaaggtgggccttacaaaaaattggtgtcattgtggagaatcacatttcatattgtatgtttcattccatctagtggtatagtgaacagtccatattagactttcctgtgctcttaagcctggctactcaaggtgtggccagagggccagcaacacctggatcacctgggtgc

SEQ ID NO: 47344 - DNA, 1106 bp, Homo sapiens
ggcctgtggcttgatcactgtgttttaggaagatccctgtagttgtgtggaagagggtatggaagtttgggagaccattttagagattagctctgtccacagacatgggcagtgagaatgggagaggagggaacagatgtttgggtaaaatgtaccataggtcttgttaattagttgcatgtgattgaagattacatttctgctttgggaagccaagttgatgtggctgacatcatcagaaatcaggagattttggtgtatggggaataattagtttggttttggctatggagagttggagttttctgaggtacccatagtggggcacagaggtggctgatagataattggaaatgtgtttgatgctaaggagagaggttgaggcttggaagagaggttcttccatcactgccactttattctttttctttttttctttttttttttgtttttgagatggagttttgctcttgttgcccaggctggagtgcaacggcgcaatctcggctcaccgcaacttccacctcccgggttcaagcaattctcctgcctcagcctcctgaatagctgggattacaggcatgcaccatgatacctggctaattttgtatttttagtagagacggggtttttccatgttggtcaggctggtctcgaactcccgacctcaggtgctcctcccacctcggcctcccaaagtgctgggattacaggcgtgagccaccatgcctagcctttttttttttttttttttaaagagacagcgttttactctttcacctaggttggagtgcagtggtgcaatcattgttcactgcaacctcagattcctgggctcaggtggtcctcccacttcagcctcccaagtagctgggattacagatgctcatgcctggctaattttttaatttttatttttagagatggagtatcactgtgttgcccaggctggtctcaaacttctggcatcaagcagtactcccccactgccttccaaagtgctgggattacaggtgtgagccactgtgcctgcgtccccactcccaactttttttttaaaacaaacacttactgtgaatctactatgtgctgaagatagatataaa

SEQ ID NO: 47345 - DNA, 2019 bp, Homo sapiens
acagtcttgtttccccattttcaaattctggggtgggatctagggaagttcatcccacagagttttttctctttctctttggaagaaatgatgtaattcatttactcataaacgtaatttataaattttcagcaagaagggaataaaggtacattctcagtgtttttcttatagtaacatttaatagtgactcaagtataaacggatttattttaaattggatgtttgtacatagatgacactggggacttccctttttgctggtgattattaaagcatagccaaatgctccttgctcctgtgtccaggtcccatctggagggtggtggagaaccttggtgctttgtcatttgggaagtgtgtccaaaggtaatctgttaatactagtaggtagggtactggtactctttctatacagtaaaacaactttgagttcatttcactcattttgcatttcagttttctttcaagaaagaaaaagaagcctggaattgtcaatcatcctttctgggacttggtaggaaaaaggtggaaaatctgctatagagttatggccctcattacatcttgtgtatttgacataaggaatgtgtgtgtgtgatctttctatttctaacactgtgctgtctaatacagttgtcacaagccacatgaggctcataggcacttgaaatgtgggtagaccacattaggatgtgctataattgtgcacaccacattttgaagacttagtacctaaaaatgtaaaaaaactcattaaataatttttatattgttacatgttgaaacaataatattttagatatgttggattaaaaaatatattaccaaaataaaatttcacctttttttatttttctaatgttgctctgaggatatttaaaattatataaatagcttatattgtatttctgttggacaatactgttccaacaccttacagggtacctgttacagaattaggtactcagaaatttattggaatttatgataaaactgttaaacaggatggactctaatagtattccactagaggcctccctgcaactactttttggtatgagatagtttcaactgtgtcatcttgatcactgtcccttggatatacttagctttgtcaacaactttctgaaaatgtccatctgcattcgaacacactagtcttaaaatttaagtataacacttaggaatatattgatatttgccaaaaaaccccagtatttcctccttaaatatattaaaacaatttacaccctgcagattttatgatgtgtgataatttggctttgacacttatcttccattattttgagggcaactgtgtacagaaccaactaagggagccaataaaattcgctaggagtggctgggaggctaggatgaccaaaggtcaaatacatttaagaaaactaagctttagtgtagcacctagatgtcttaggataatttatatttaatttcacattctatgctctaaagtgatacttgataactgtgaacatttcttaataaatgccattattattactgttcaatcctaatctttgggggtgagatctctggtaccagagggctgagttacacttccagtcatggcaccccagcctcactggtctgtgaaaagcctttcttttgttagttacgtgtttgttctatttttattccattctttcattctcttctcctgcatctgaatcattctaacgcgcttgcatatccttttacatgtgttttgtgtgcatctattttaaatttatgtagatttaaatttgtgctagggataccattttctctcttttttcacttagaatactgtttttaagatcaattcctaggccgggcacagtggttcacacctgtaatcctagcactttgggaggccaaggcagaccgatcacctgaggtcaggagttcaagaccatcctggccaacatggcaaaactcctatctttactaaaactacaaaaattagctgggcctggtggcgcacacctgtaatcccagctacttgggaggctg

SEQ ID NO: 47346 - DNA, 1034 bp, Homo sapiens
catgaacacacatgaaactagcatggatttgatagcaagatatgcataaaataaaatatgactaataaccagagtaatcagaatttcatgacttttacccttacctattaatgatataggacctctagcaccctcataaatgcctccctccaagatttattccgggagtcaccaaattgtgtttgatgtgtgcccactaatgcattccactgctacatgacacctgtctttttcttcctgtgctgtttgctgcctctgcagttgcacgttggtacctcctgtcagatatcagaggtctgcctctttgcccgacactaccatctccttggtcttatgctatcctgctagatacattgctgatattcagggactgttgatgtgtcccagctcctttctccccatgtattatgtcttgtgtgagcatcaaagcagagcttatcacttcgtttttagtgaaaatcattctttagtttctttgttgtagctcctctgtctctgttatgagttcttggagctgggctggaggagcaaaccaagtctttagaagggactgtgctcaggatcacttctcttgttcaaggctgtgtttatgccaagttcttttttttgagacagagtcttgctctttcactcaggctggagtgcagtggcacgatctcctcactgcagcctcctcctcctgggttcaagtgatcctcccacctcagcctcccaagtagctgggactacaggcatgtaccaccatgcccagctaatttttgtatttttagtagaaacaaggtttcattatgttggccaagctggtcttgaactcctgacctcaggtgatccacctggctcagcctcccaaagtgctgggattacaggcgtgagccaccaggcccagccagtgggaccaagcttttctgcctcacattagcagggatgattattcccctaaagtattctgtagtccctcatacaaacattccttggggttaccaaatgtgactcctggtggcagggatggtttaggttctagcttgcaatccact

SEQ ID NO: 47347 - DNA, 1034 bp, Homo sapiens; identical to SEQ ID NO: 47346

SEQ ID NO: 47348 - DNA, 1034 bp, Homo sapiens; identical to SEQ ID NO: 47346

SEQ ID NO: 47349 - DNA, 1034 bp, Homo sapiens; identical to SEQ ID NO: 47346

SEQ ID NO: 47350 - DNA, 1044 bp, Homo sapiens
caccagtcacccaaagtcttaactcatttcagcattaactcaaaagtccacagtccaacatctcatctgagacaaggcaagtcctttctgcctataagcctgtaaaatcaaaagcaagttagttacttcctagatacaaagggagtacaggcattgggtaagtacagccattccaagtggcagaaattggccaaaacaaaggggctataggccccatgcagggcagtcaaatcttaaagttctaaaatgatctcctttgactccacatcttgtatctgggtcatgccgatgcaaaaggtgggttcccatggtcttgggcagctgcacctttgtggctctgcagggtacaggtggctctgcagggtacagcctccatcttggctgctttcatgggctggcattgagtgtctgtggcttttccagatgcacagtgcgagctgtcagtagatctgtcattctggggtctggaggtggccctctcctcacagctccactaggcgacgcctcagtagagactctgtgtggcggctctgaccccacatttcccttccacgctgccctagcagaggttctccatgagggccccacccctgcagcaaacttctgcctgggcatccaggcatttccatacatcctctgaaatctaggtggaggttcccaaaccccatttcttgacttctctgtacctgcaggcttaacaccatgtggaagctgccaaggcttggggcttgtaccctctgaagccacagcccaagctctacattggtccctttcagccatggctggagcagctgagatgcagggcaccaagtccctaggctgcacagagcacggggatcctgggccctacccaggaaaccatgttttcctcctacaatgggaggggctgccatgaagacctctgacatgccctggagacattttccccattgttttggggattaacattcgactgcttgtaacttatgcaaatttctgcagctagcttgaatttcttctcaaaaaatgggattttcttttctatcacattgtcaggctacaaat

SEQ ID NO: 47351 - DNA, 1044 bp, Homo sapiens; identical to SEQ ID NO: 47350

SEQ ID NO: 47352 - DNA, 1044 bp, Homo sapiens; identical to SEQ ID NO: 47350

SEQ ID NO: 47353 - DNA, 1044 bp, Homo sapiens; identical to SEQ ID NO: 47350

SEQ ID NO: 47354 - DNA, 1032 bp, Homo sapiens
tgatgaattctgttcacagaactaaggatattaggtaggtaaaggtgtttggaataaagtaagggaggagttgatggtggagatgattgattgtattttagagtttgaggtgcttgtggaactcatccaggtcactttgttcagtataaatttgtgagtcagtctttggatatagaggtgataactgaagccacaagaatgaatgagagagagtattgtctgttataatagctactggccacatgtagctatttaaatttaaattaaaatgaaatcagcttggacaacatggtgagaccttgtctctaaacaaaattaacccgtggtggtggtacgcgatgtggtcgcagctgcttgggaggctgacgtgggagaatggctagagcctaggaggttgaggctgcagtcaactgagatcgcaccactacacttaagcctgggcgacaaagcaagacactgttttggaaaaaaaaaaaaaagcattctagccctatttcagatgttcaatagccagatatgaccagtgactaccatatgggacagcacagatatagaacattttcagagttgaagaaagttctgttggatgcactattatttagaaaggagagaaggcccaacttgggatgaagcagaaagaggactgagaggaagaaaatcaagaagagtacacagaagctacaagggaaaggatggccaatagcttaaaaaactacagaaaggtatgagaagacaaggactaaactatgcttgaatttgaaggcaaggggatcattgacaatcttggaccaagtttcttccatgaaggatgaaagacgaaacccaaattgtaaaaatgttctcataggaaatagaggttaaaaggtaactctatttttattgtgtttatttttacctcatttacttttatttatttatttattttgttctcacagcatttataggaggcccttagtaaatatccacgtctgcaacacacagccaagattgggtaggtaaggcagtgatctggggatggaggctacaaaatga

SEQ ID NO: 47355 - DNA, 1032 bp, Homo sapiens; identical to SEQ ID NO: 47354

SEQ ID NO: 47356 - DNA, 1032 bp, Homo sapiens; identical to SEQ ID NO: 47354

SEQ ID NO: 47357 - DNA, 1032 bp, Homo sapiens; identical to SEQ ID NO: 47354

SEQ ID NO: 47358 - DNA, 1061 bp, Homo sapiens
tgttctttacccatggaatgtaatatttttgcaaagatggactacttcacaaatggttataaagtcatatccacttcttccacaatgaccacagcaaatgaccaagcatgaactaaaggtaaagatgtttacagattacttttcttacaaaaaaaatctagaagacactgtgtttaaatagatatttaaatgtttttgagatttagtaactgattttttagacactgcctatcgcatgaactgtaaagctgtgtgtattaggtgtaaaatatttataagatatatggactggggaatttgattattcctccctttgaaaaaatagtcctaataatttgaacaaatatgttagtaatgatggaacagatcaatgaaaagtagatatagatattgtgaaaataggctgtttaacaaacagattggaataaagcctattctaccagttaaactactttaatacacattcatttttaaagaaaatgtttgttttaacataaataaacaaatcgtatcagtgtttgtgaataaaatacaaaaatgattgttaatgattggtgctcttaaagtgagcttaaaatttatccaagacgtatatccaaatttgtcctgtagtaatagattaatattcatagattgttggtgtttaaagatctgaagtgtgagtagaatgtattcagctgtttaacatgtagtttagatattcaaaagtatgcatgtagaatttaaagaatatgttaaaaattattaattttaatattttgtttggaaaagcatgttataatataatgttttcactatatggcctctgttttggtgtgtttatttaccaaattttttgatattggtgtttcagtatatttaatatgtgaaattagtagaaaaagcagatttcggttcagaattcccctttactgttacaaatactgattgaaattatctaaaggcaaaagctttacccaacatttggagtttgcttttttgatcatttggcttctaggtttaatattagttacatggtggctttagtgaacttttttaaaaagctttactcttctacccac

SEQ ID NO: 47359 - DNA, 1024 bp, Homo sapiens
ttcctcctagcctacttggccacaataagtgattgcctctgtcacttttagtggtagaattgtccttgagacaacaggaactgactacagaaatcatactatttcaggggttgctgacatttgaggatgtggctgtgttttttacccaggaggagtgggattatctggacccagctcagagaagcctgtataaagatgtcatgatggagaattatggaaacctggtctcactgggtaagaatctgctgtttctctaattaaaatatctaagaaggtagagagaaatcagactaacagaacatttggacggaaaccagtaccaaaactgctttgttccaaagttctgattcaaaccttttagccattaattgtttccataactctcatccctagcttccttgaggtgaccaaactgcaagcctttcgggcatcctgtcttcataatctcattcccatattgttctgtactttccgtcctggctcatcctcccacagctttcctcccaccccttttcactctgcgttctggaacccctgttcgtcttcacataatgttccttccctcctggccttaactgaaacctggcactatcccaaggacaacgtttctctggcagtttttcaagtgggggctgcttattctcccacatcctcctccttccccatcctttgtctcaatgttggaagggggaagttattgttcactcagcttttaaatgctgtccccaaagcattagttttccaccttcaaacaaaatctctccttctttgaggtctcagcagtcttgctttttccactcaattccttttcactatctgtcaacttttagtttggtccttcacacataactttgtcacatgtttcatagtctattttaactcgtgccatggatgacccagttaatacttcagcctcagtggatcttcagggaccctgctttccacttttactcagcaccttacatcattgatcataccagttttgtcataacaggcaaatcgtaaatcccaataccctattctc

SEQ ID NO: 47360 - DNA, 1086 bp, Homo sapiens
cattgtcaaatgcagtagactcttttgggaccttattttagtctacctctctatgaatatgtgaaactctttattgtttccctccattggcttgcattctcagacttcccctcagtctgtactctttccttgggggaccttacctacactcaggtcatcagctaccgctctgtgaaaataagtcccattttttttttcaagtcatagcctcattctgttgcccaggctggagtgcagtggtgcaatctcagctcactgcagcctccacctcctgggttcaagagattctcctgcctcagcctcctgagtagccgagacaaacaggcatgcaccgccacacccagctaatttttgtatttttagtagagaaggggtttcactgtgttggccgggctggtctcgaactcccgatctcaggtgatccgcccaccttggcctcccaaagtgctgggattacaggcgtgagccaccgtgcgtggcccaaatctttatttccacctaagaaaggtaatgtggagcctaactgcctaggtttaaatccttgttccaccacttacttagcctggtgagtatagtgatttaatctctctttgcctcaatttatttttttataaaatggaaataataatagcacctacctcatagggttattgtgagcattgactgaattaatgtatgtaaaacacttgacacactaacatgtagttaagaacaatataaatgttgacttatattgttgtcatcatcttctctgttgagtttccaattcctagtcatcttttgaagaccacatgagtaattcaaacctggcaagtttcaatccattaaaatcaagggccttctctttctttgttttaccagagctaagcactcctttctttgttttaccttgtatatactcctgctattgaatttatcatactatactacaatcattctatatatgttacttttctaacctcactgattactgtgaggatggtagatatacctgttgcatttgatttctccagcacttagcacagagccaggcctatattatatgcttcttaaatatttatatgactgagtaagtacagttaactt

SEQ ID NO: 47361 - DNA, 1048 bp, Homo sapiens
cttcagccatatcagctgctgatatgtgtgtgtgtgtgtgtgtgtgtgtgttttaatataccatgttgtctctcagtcactgccagcttatccatacatatggtattctggttgatagaaccaagtaagtgcctggccctgccttctcctagaactgcagcatgtaaataccatatggacaaggtgtgacagtgtgcccacagatgatcttctacttgtaggctgtcttctttatttcagcttaaatacagctttccatattcatcatttctcctcccacagtcttttcatcctcctcaataaacactatctccatccctttggtgagagctcccttgatgagagatcactattactctactgttgcaatgcagtattctcttctacatcatcttaactgcttttcataatgcaactcttgtctagctttatagttttggcttttcattcatacttttccttttcaagcttatttttaaaaaaactttaatagctacatcgatgatacagttgatagcttaatttctcagatctttgacatcttcaattttaatgactctttccgcaatgacttgcagattgccaccttattactgtgtcttcacatggcagaaggggagagagatagagcaaacgttctggtctttgttcctctttttataagaacactaatcccatcatgggggcccaaccttcatgacctcatctaaatttaattacttcccaaaggccccgcctccaaatatcatcacattgtggattagggcttcaccatatgaatatttggtgggaacacaaacattcagtctataacactgtcttatctcttttttctccttgacggtttagtcttttctccttatgttcacattcttctgtccttttggcttctggtttgataggttacaattctagctaccttccgaataactagcgatttcagttttaattccaggttctttggcgaaacccactttgagacaactatctgtgtagaaaaattggccatgaccacaggatgggaagatattgcataagcattgccaag

SEQ ID NO: 47362 - DNA, 1050 bp, Homo sapiens
attatctaatatctattccagcaagagatggaaaatcaggaagatgtccgaagcgggcctagatgtactatatgacactctgttatatcatagaccactgtgctgtcttttcttcaacacatgcaagattttcatttctcagatgtcatgcagcctctcagttggaacaagatggtgaaccttgggtcttatattgttagagggtttagaatcacatgtacttgaggtatgatttgtggtaggtaaagtcataagctaccacagactgccctttttggttgttgctcccatgaactctgaccatgtttcttaatacttattttattctgcatctcgatatcatagactctctgtcacctaaccctttattattgtttttaaaagccattttgtctctttatacaggagctgctttttacttaatattttctttatcatattattttctttccccattttttacttaacatccattccatttggcaggggggcttcatgtcttatctctgaatcctggctgattacaatgtttctggagtgcttttgatgggcagtgagtaaatgcttgttaatgaatgaattattgtttcccctggatctttgtcttttatccttcttagcatctttttttatttttatttttatttttttgagattaggtctcactctattgcctaggctggtgtgcagcgacgcaaacacagcttgctgcagcctcaacctgttgggcttaagtgatcaatcctcccacctcagctacctgagtagctgggactacaggtgtgtaccaccatgtctggctaattaaaaaaaaattttttttttgtagagatgaagtctcactgttgcccaggctggtctcaaactcctgagctcaagtgatcctcccacctcactctcccaaaatgctgggattacaggcatgagccactatgcctggccattagcatctggtcccttctgttaattatttggtctgatcatattccaataatgctttctcatccttaattttcttgaacttagtggagttttttttcatcctaccct

SEQ ID NO: 47363 - DNA, 1047 bp, Homo sapiens
gaacttggtgtaataagttctatggatttacctacctgctttgtaaatagtagtgtacattttggtttttaagcttcagaagtgcccctaacatagtatttcagaatatatgatatgagaatatgtgataagagcatatgattcttgctttgttattcaggctggtcttgaactcctggcctcaagtgatcggcctgccttggcttcccaaggtgctaggattacagcgtgagctgctatacctggccaaggatacacagttttaaaatttgacactataggccaggcacggtggctcacacctgtaatcccagcactttgggaggctgaggtgggtggatcacctgaggtcaggagtttgagaccagcctgtccgacatggtgaaaccccatctctactaaaaatacaaaaatcatccgggtgtggtggcatgtgcctgtaatcccagctactctggaggctgaggcaggagaatcggctcgaaccctggaggcagaggttgcagtgagccgagatcgcgccactgtactccagcctgggcgatagagcaagactccgtcttaaaaaaaaaaaaaaaatgacactctagatgctaaattaaagtatagttcttcttccccagataatctgatagtggaggaagcagtgcaggagctgaactctttcctcgcacaggagaatatgaggctacaggaattgacagatcttcttcaggaaaagcatcgcaccatgtctcaggaggtacttaaccaaaaaggagagatggctgtgtctagtgggctgtggcagatgttgacttacaattctgagcacctcaaagattaccttactctagaaggcctatcatatcataggggattttgtaaaacacaacacaactccaaacctccaaataatgaattaccctaaatataaaagactgtatagtgttattgaggaatggcgtggtagaaattccacagggaatggggaagtagaaactactgtattgatgatgtcctaggaatttgaggaatgtcaattttcagtctaaacttgggtgcaaa

SEQ ID NO: 47364 - DNA, 1027 bp, Homo sapiens
gattttgacagcactctctgcattcctctaacctggaaactgcttagtggctcatcaacatggcactgcccatgttgctgtgaagatgcttctctctccctgtttcttgggattcttgagcccccatttcttttaagcttgggcgaccatcttttagggttgaaattgtacttaatttgccacattagctctgttgtgcagttttttgaaaaatttattattaaaacgactcagaaaaatatttttaaaaactaaatgtgagattacccataatccttgtactataaaacaattactttcaatgctccattttctcttctgaacaatgaccatatgcacacatattcttcagagttctaaacataggatataacaagtttgcattatgcttttaaaagaacttattttctaacaaactattttaatatttctaaaaatattattttctaaatattattttatttattaactttagttgcctaatactatcacctattgtttttgttataattgacttgactactcccaaactgtggttgtttaattttttaaatattataatttatggtatatacgacaaatattgctacaataaaaattttgtgtatagtatttttttttctttttttgagatggcgtttcactgtgactcccagggcagaatgtagtggagcgatctcaactcactgcaacctccgcctttctggttcaaatgattctcctgtttctgcctcccaagtagctgggactaaaggcatgtgccaccacgcctggctgatttttgtatttttttaatagagatggggtttcagcatgttgaccaggctggtcttgaactcctgacctcaagcgatccacctgcctcggcctcccaaagtgctgggattaaagacgtgagcctctgcacctggccatgtatagcattttaaaatatttttatttctttgagatatacattgcaatgagtgagattacctggtcaaaggatacaactgttctgatgacttgtgatgtgtaaaatgaccca

SEQ ID NO: 47365 - DNA, 1050 bp, Homo sapiens
atttcaaagactgaaaagagctgtagaagcctgtagaggttcagggacacattccctaaaagggaaaatagacttagggttgcttctcagtcataaaatatgttagagaagggtggaacagtgttttggagaaaaataagttctccctcagtaagaacttttttttcaatttaaaagctgatcacctctgcaactttcaaggagaaaaaaatcaaaaatttttgtagacatattccaaataatcaaggggaaaaccaaaataatgaactcataaaatggggaaattgagatataaaaggactaaatagttacctgttttaaatccattttcacaacaaattacatctaaaatatatggccttacagaagtatacaaagctatgcataccaagaggttcatatgtgactattttaaatcaaaacaacctatttagcactatttctcattctgttattattcatttagatttaactatgtattttataagaacaattgcaccatcgtattgtcttgttttcatatttatcttgaagtctctcattctgaatcgttggaagtttggatatgatctgttctacgttggtttcctcaggtgtgattcttcacatgtgggagtttattttcttcattgctgcatttacgcaggtgaataatatcttacctaggtagaaaattcttatattgcaatcttttttcttaaaagtctgtagaagttgttagctcactaaattctatcttctagtttttcagatgagacatccagtgcttttactccttgctagaaatttctcctttccactggcattgggtagaggtttatctttggagacgttttttttttttttttttttctttttaaccaggatatttatgctgtagtgcatgtctattttagtcaatactgaaattcagtgatgcctttcaatctgaaggctcaaaaatttcttaaactcaaatttttgtttactagttttctaattatttctttcttctgtttgtatataaggtcttctgaatttgttatcagtattagtttccaaaggctgctg

SEQ ID NO: 47366 - DNA, 1022 bp, Homo sapiens
atgtgtctttatagcagcatgatttataatcctttgggtatatacccagtaatgggatcgctgggacaaatgatatttctgattctagatccttgatcgagaatcacactgtcttcgacaatggttgaactaatttacactcccaccaacagtgtaaaagcattcctatttctccacctcctctccagcattttttttttaatgctgccattaaatgaagcattgactttttaaggatcaccattctaactggcatgagatggtatctccctgtggttttgatttgcatttgtttaatgacaactgatgatgagattttattcatatgtttgttatctgcataaatgtcttcttttgagaagtgtctgttcatatccttcgcccactttttgatggggttattttcttcttgtaaatttgtttaagttctttgtagattctggatattagccctttgtcagatggatagattgcaaaaattttctcccattctgtaggttgcctgttcactctgatatagtttcttttgctgtgcagatactccttagtttaattagatctcatttgtcaattttgtcatttgttgtcattgcttttggtgttttagtcatgaattctttgcccatgcctatgtcctgaatggtattgcctagattttcttctagagtttttatggtgctaagtcttacatttaagtctttaatccatcttgagttaatttttgtagaaagtgtaaggaagtggtccagtttctgttttctgcatgtggctagtcagttttcccaacaccatttattaaatagggtatcctttccccattgcttctttgtttcagatttgtctaaggtcagatgcttgtagatgtgtggtgttatttctgaggcctctgttctgttcatttggtctatatatctgttttgataccagtaccatgctgttttggttactctagccttgtagtatagtttgaagtcaggtagcttgatgcttccagctttgttctttttgctcaggattgtctt

SEQ ID NO: 47367 - DNA, 1039 bp, Homo sapiens
agcaagaagttggagaatatgagatacatctcatctctagtaaatacttaaatgacttcccctcctcccggagtcaagcacaattcggggatgcaatgacggacgtaggtgaagacactgcgggaacttacagacaagtaatgaccgtctaatatcagctttaagtaccatgaaggaaaaagaaagccgagtgaaggattgtggagaggtgacatagggaggtcagggaggactccagtaaggtgacatttgagcaaagacgtgagtgcagtagagagtaagctatgtcagtatcagagaaaagcacattataggcaaagataatgggatatgtaataatccatagtctttgtttaggtagagtatgataaaagtagaaggcaagcctggaaaaacgggtagaagaaatagttaagacttcccagttgaatggtttaatttccagatagtggctaactctggtatatttttgagtagatgaacgatgtctttacatcagacaagatagtttgtcaagtggctgttttatttctatcaccctatcgttgctgtttttgcctcgtgttcattatgattccaggtttacattccacttaggtggtggtatttctgtttcgtacagaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggtaaagtgtaaactttctgatttatttgaatttaagttggcaggagaatcctcactgaactttggagacgtcccgatattctcttcatttgtgtttttatactttttgtaaattacacctcactgcaaccttttaaggaaagtaatattactcctttagatgagaaaatagaaacttagagatgttta

SEQ ID NO: 47368 - DNA, 1075 bp, Homo sapiens
ttacaactggaccaaatggtcaaaaatccttgccttgtggaccttcattccattgggggaaatgataataaagaaaataaataaaacatgtaacatgttatagagtgataactgatgtggagaaaaagcagggaaggggattaggagtgtaggggaaaaagagtacaatttgggattttaagttggatagccactgaagtaagtggagaataggaagaacgggtttgataagcttaagaaatacagtatgaatataataggcttgaggagcctgttagacatcttgagtagtgatgttgattaggtacttaactatatgaatattgaatccaggcaaaaatacagatttggaggcatcatcaatgtataggtgttatttaaatccatgagactagataaaatgatcaaggctgtaagttcatataagaaggttggagccctgggatactttcaacgtttgaatgttaggatagttcaacattcaaaagagattgagtagtgtgaggaaaattaggccagtaaattgtcctggagtccaggtaaaaaagatgtttcaaggagaagtggccatgagtacctgattagattgtgttcatactctcacagaatgaaggcagaaaaaagaaaagtgaatatagataactttttgagaagttttctgaaagagggataaatagggaggtaactggagggtaatacagaagagagtttttggcttgatttgacatgggataaataaattctatattgacagaaaagatccagtagaaaagtcgtcatttgtgattcaggagagagagatgggagagttgttaaaatagggccccttagtagctgcaagtaggataggaactagtgtatagaggaggtcgccttcgcgagaactaggaataggtcatccatggtaacagaagagtcaagtatatagtctcacatgtaggtagatgagtaggtgtgtttttggagcttatggcatttcttttgagggtgattctgttgtcccagtgaaggtatacatttgccttttcactgaaaaaaaattaactttgtgaaaataatttctttatactgccct

SEQ ID NO: 47369 - DNA, 1050 bp, Homo sapiens
tttaggataaaggatactcaatctgtactataattaaagttgtgtccagtcaacgttggtgaaggacacttagaaacatggtaatggctccttattgatagaaactttcataatgctccatactagctattaataaatattttacttagcaataaatctttcagtatttaaacctgcagtttttttttcctgaaactttgagttttacatagctttttagaaaattcagaaagagttttaatgctaggtaagtattatttaagtttctattacagcagtttttactggtttataaaatcatatctgaaaggaaaagtagtagtatgtactgtggcatatctgttgttgtcccacaggttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtaagttttatatccttttctcctcacaattctttgtggtaaataggaagatgccttttttaagtacatttttagcccaactacccacttcttcaggaaacatgttaacttctcatttgtgtgtttgccagtgccacctacctcctgtcaaaagtaaaacaaaaaattaaacctgcccttgaaatggtaccttaatgccttaaaggaattcttagacagtgatcatattcttcttggtctagtatttgccacactgagtttgcagatctttgtcaagacaatagaataacaaacactgaataatatttactgtataccagacagtgttctacactatgctgtccaatacagtagccactagccatatgtgactttttacatttaattaagttaaaagtaatttccttggttgcattagtcacatttcaagagcccataatcacaaatggttaatggataattcgacaatgcagatatagaacatgtcta

SEQ ID NO: 47370 - DNA, 1030 bp, Homo sapiens
agaccatatccatggaattaatacaagtcaataaattaacaaggattggattctgccagtgagaatgaatcataattctagtagaagaaagtcttctttaggcactataatttgaactgtataatcagttgtattacatgaaaaattattatacagtgcctttttcaatatactgtgcctttttcaaaaggtggggagcaggatagagtcaatgtttagggcagtttcttagaatatatttctgagagaaaaattattaggtctcagtcagcattaggcttccatgatttttaccaaatctatgacttaagtattaaaagagttttagcttctcataagttgtgttttgaagcaatagattgaatttggtaaattctgaaggagttctacctgacttacatttcattctaatggaggtgctttgcgtatacttcgtaaaaatttctctgtgagttggctcttctaatgccaaagtaataggaagatcttttgctatacagtgtcttgtttctgtagtctgtgttccaggtaaaaatattcatctttattcttgtcagtaatgaaactcatttttaaaaatgagtcgcctaggcacggtggctcacgcctgtaatcccagcactttgggaggccgaggttggcagatcacctgaggtcgggagttccagatcagcctgaccaacatggagaaaccccgtctctactaaaaatacaaaattagctgggcgtggtggtacatacctgtgatcccagttactcaggaggctgaggcagcagaatcacttgaacctgggaggtgtaagttgcggtcagccaagatcgcgccattgcactccagcttgggcaacaagagtgaaactccatctcaaaaaaaaaaaaaaaattagtcattgaaggttttttcctcttcagtatttgattcaaaagtattaaatagttaagaaactggcttatacatattggtttgtaaacattcatagatctcccatctatttttatatgtggctaggtatccaaaatgttgaaagat

SEQ ID NO: 47371 - DNA, 1341 bp, Homo sapiens
tataaacaggaaagggaattggttgatgtgaaacccatttagatttgttaactggctctaatgccaaggtaggctcttaccctcccacagagactgggactctaccttcaagtgttggttggaagaaacagtaaactcagcaaccttgagttttctcaggagttgactttcaggaggaggatagtcaacctatggatgtggctttgagctgttagaaactgctagtgtttttttcagatctttacaggcaaaggtttatttagacgtagaaagggctcagaagaacctggctagaacttcatcaaagagaatctttgtgaaaaagacaagcagtttgcagtttaccataataaaattaaattgtgatttgaactgccacctgcaagaccgttctccaggtgaccttggactgacccacttctccccacttctcactagttgtcaaaaagaacagccttgctatctggtcaggtgaatgacaaccaagtggaaaaagatctgtgtggttacaaggagtatggcaaaaggttgctaactggcaaggacaaatacatgtcacctgtggatgctgggaataccatagccaccttttagggaaacttaaattatgtttttggataccctgtaaaactttgctctgacaaggaacctcctttactgcccaaggaacatgacagcaggcacactcatggaatacaatgggttttccatgcaccctgtcatcctcagtccaatagagctgttgaacaatggaaagccagctcacaatgagtgaaggaaggacaccaagatagcctacaagtggggtggtaccaccccatccgaatatggcagtatggacactgagcactgccctccagggcaagggaaccacatgattgcagcacatgttgagaagcactgagcttggaggaggtacaggtggaccagatgacggcctctgcctgtgaaatccaaattccagtgttcccagccattttctctttttagagtgcacatcctgtgggtggtttgcagttcaggctgccacagtaccccaaaaggcccccctaactcttaatctggagtcagcgtttccctcaggtgcactccctgtgggatccctcaagggtggaaacaggaccaagaaataccaggatgctagagtccctctgatagtgccagggacatctgatccttccatttggctgggcaatgttgtcagacatgtcatcattcaagaagtgacttcccttcctggactggatggctgaggctgaaatgtctgaggcatttcaagggtagtaccacaggatatggtaatgtttatagtatacagtgtgatgttttgatatttgtata

SEQ ID NO: 47372 - DNA, 1050 bp, Homo sapiens
ttggtctcagctactcaggaggctgaggtgggaggaagatctcttgagtctgggaggttgaggctgcattgagctatgatcgtgcctgtattccggcctgggtggcagagccagaccctgtctttatttttttttgagacagagtctcgctctgttgcccaggctggagtgcagtgacacaatctcagctcactgcaatctccgcctcccgggtttaagcgattctcctgcctcagcctccaagtagcttggactacaggtacccgccaccacacctggctaattttatgtatttttagtagagatgaggtttctatgttggccaggctggtctcgaactcctgaccttgtgatctgcctgcctcggcctcccaaagtgctgggattataggcgtgagccactgtgcctggctgagaccctgtcttaaacaaagaaacaaacaaataataataataaaaaaaacccttaaatccaaatagctaaaacattaaggaaaattgattatctcctataggtcaaggggtagggtagctttcaggttggttagttcagtggcttgatgtcagcaaggacgtaagttctctccttgtttcttttttgtcattttacggaaggtagctttttcttaattagctcccctcaagatcccaagatggctatggctcttcttaccgtcttttgctgagctgacaatctccagtggttttcctttcatgggaattagagagggctgcacacttatccctaaacaagctctaacaagaggaaggcaaaggactctgcaattgatttagagtaaccaggacttccctctgagtcaagtgaggggcagggcaacaccggaacaaaaggaggactttgccagcaaggtggcggcagggatgcaggattgggcgtggtgactgggtaggcagccaatactatctgctatggttttgccattttcttttgtctttaaatcagacttctatagtgtttcctaacattttacttatagccccattatgaacttcacagttcgtagttcaaagtcacacagttagttatct

SEQ ID NO: 47373 - DNA, 1090 bp, Homo sapiens
gtagactatccaaatctctttcattgatctgagttctattttaacgatcttcttttttttttgagacggagtttcgctcttgttgcccaggctggaatgcagtggcgcgatctctgctcactgcaacctccacctcctgggttcaagcaattctgcctcagcctcccgagcagctgggattacaggcaagcaccaccacgcccagctaattttttgtatttagtagagacaaggtttcaccaagttaatcaggctggtctcgaactccaacctcaggtgatccgcccgccttggcctccaaagtgctgggattacaggcgggtgccaccgtacctggccaacaattttcttaaagtggggtatgcaaaaagcaactcactaaagtagatataggtagtcctttcttctggattcttaatgttgccttatgttgaattcgctttttcaacaacttcacttacgttaccttgccgttcaccaaaagctcttaagaaagccagctttcccttttgtgctcttgtttcttgtagaattttaaaaacataagtatgaagttggaattttccccaagaaatttaaagctgttgatttttgcccagctttatagactgtcatgagcttttatttttattatccagtgtatgtgctcttcctttcccaggtttctattatctgattaatattaataaatttatgtctgcatattaatttagggaacacctcctaattgtggcattcactatagggtggcctggctggcctgtttgcttgagaaacccctaatggcaatatcttttggccttgatattatttatcattttgtttttatttttaaacatttcctttcagatcctctctttagacactctttttaactggtcacctcttttctcaagaccattctggcagtttcctatacagctgacctgtactttagtccatttcctcccatgttatcccctgaaatattactagagttaggattaataaattttaataaaattcaggtatatcatgtatttcccaatctccattcttctatcaaaaaaggacaagactttagccaggaatggcttactcaggtgcatgt

SEQ ID NO: 47374 - DNA, 1035 bp, Homo sapiens
cagtctgtatgtttatcaaaacatcatgttgtacaccttagatatatatactttttactactcaattatacctcagtaaagctaggtggaaaatttaagctataaaaaaggcatttcagtttttctcattgtattgtcatttgaaagttactattaatttgtttcttacacaattgtctataaaactgtgtactcattcgttgcttctggttgtatttcccttacaactagtttttcagttttcaaacacacattttataatatgtacagtatgggaacaacttaaagatgtttgagatgaatatttgtgggaactcactttttttaatgcttcatagggaagattttcctgtatcccactaggaaaggacataacaatgatttagggcttagtcctaggaacttaaaatcatttatcctgaaaacaatgcatgctatagagtagttgtccttaccttgcaggtggggaggtcagttcagctgatcatctactgtttagaagactagctagaattcaagcccaggtttgtgttcctttccctctccatacctgtttacctctctaaattgccagttttcctgcattcttcaggagaaatcttgctcctacctgggtcattctcagcatacagctttctaaggaaatttgaagtgttctaatctcccatcaataagtgttaggttaaatgacttaaacattttctggtggttttgatatataggtgatataatgaggaagtagaaaaagcataatctggataaatgggagcatatattatatataatgtatgttatttctttcataattaaatagcattaatggaaatcagaatgggaaaaatgcattataaatcaaattacttaaaaattgcatcatccctttctaatgcttacatatttgcatattctcctttgcatatttgtataatcagagcatagatgcaatttcaaaccatgtttctaacacaactgtttattataatcatttttatatgttactatacagtcttcatagttatttttatgactttaata

SEQ ID NO: 47375 - DNA, 1022 bp, Homo sapiens
cattgtacaaagaccattctgatggttatatgcagaatggagatgagaaacactttacagtattttaactgacacagtaggaggtcatgaaggtctgagataacataggaaggtctaatgtcaggatgtagtatctcttgaatggtataggaaaacagtagataaaaaaatgtaggataacttgtatgtttcacggatgttggaaccattagccaggacagaaaatataaaatcagaaagtacctggtggaactaatttttctccaaagatgttctttttgaggtatctgtagaacgtatgttttttggcccaggagtttattgaatacttgcccaattatgagtattagcaatggcacaaaggaagcatggcagcttaaggggcaaagaattccacttctaaatatgccagtgattgtgtttaaggccttggaaatattactttttttttcatctgtaatgtttggagtgtggtgatggaaacatacctcttaggggagttgatataactgatactgagctaaagaataataaattaagactaaataattgactattatacagcatttgaaaaattgtagtagttaaacattttgggggccatagcaaccatttaccatgataaatgtttatacactaaagttaggttcctaagatcactcattttggtagtctttgagtaacatcggctgagttgcatggattgcctctggtgtgctttagataagcttttgttcttagttttctacttttcattactcatgtataacttttacctgcttttgcattagaaggaaaactttgtcttactggttatatccaaacctcttgtgctaagtattttttatactttcactgaaaaaaaaaaaaaaaacacatactaccttcaaaatgttaactgaaaatgccttagctaatgaacatgaaaagaaaaacagttgtaaaatgtttgctgttactgcattgttttaatgttcttcattgaggcttctctgttcatcaaccctttgagcaggaagcag

SEQ ID NO: 47376 - DNA, 1065 bp, Homo sapiens
tcccattactgtgtgctaactttgatcatttggctaaggtggatcttcctggtctctccaatgtaaatgtactgtttctccctttgtaattaataagtatcttgtggagacatattttgagactatgtaaaagtcctatttctcatcaacttttcacattatctattcacattcttctctgaaacagctattactggtgttttcatataatgatgattttctaatttcatcattcttcctatatttattagctggtgttctactgtaaggaaaatctcttctcacccacttagtttttcatcaaataaatatttattcatcaaataatatatatgttaaataacgttttaattagtcatcaaatacatatttatttgttgaataaatattgattattcatcaaataaataaatatcaaatcccagattgttacttttttctgttatcctcatttatttttatgcccacattgtctcagatttagccaatgggagcccattcaagctggctcctgtacttttgatctgtccccatcattctttgagtacttccttattcactgacgcaaccagatgttccaagctcatcttatgctttcctggtttcaactctgtaatcagccaagtcttcaagtgagccctagttccttttaatggaaactggtatttggaaaccaaggtctgggcacaatatgtgcttttgtggtagctatttgataatagcgaccacatgatatacagcaggagaaaggaaatgactgcattactttttttttttgagatggagtctcactctgtcacccaggctggagtgcagtggcgccatctcagctcactgcaacctccgccccctgggttctagcgattctcctgcctcagcctcccgagtagctaggattacagacacctgccaccacgcccggctaatttttttgtatttttagtagagaccggttttcaccatgttggccaggctgatctcgaactcctgcctcagatgatccacccgcctcggcctcccaaagttctaggattacaggcatgagtcaccacgccctgcctactc

SEQ ID NO: 47377 - DNA, 1024 bp, Homo sapiens
agtgtgtgtctttagggtcatcaacaaatatgtttaaaaagtgtttctgtgtttctgtctatgagctgcttgggaaagcatcatcactttatgcacatgagcactgtaattgtgtaacttcttattgcagataaatgcccccactgcttaatttaagtaactgaatgttttattacaacatggaaatgtagatccttacttaagggatatgtttagtataaaaatgtaaaaagtagagcaagaagcctgctaatgttttaacttagatcctggtgtttaagtgattgtaaattgtaaattgtaattttttttttaagtagggtcattttaaatgattaccattttgtcaaatcaaaactcagaaatgtagaatatattttaaaatgatgtgaaaagatttggaaattaagctatataattagcaaaaattactgtgtagttatcaagataaaatttgagtttgatgttatttacttcacctttgtggagtatgtagtgagctgcattgtgttagaaaggtagctttataactgatttatgcctagtgattgttttcattttatgattttctgtgaacttgaaggtagaaaaaacttccttgagaaggtaacatttgccaccttacatctttggatattaaaattgaactttaattgatttcttcttttaaacacatgaatcaaaacaaaagttcttttgctgtaagccaatgcatgaattaattctttaaatttggaggtgagttgtaaagaagcttactaatgcacataggtggacttattatataaaggaattacaagggaaatgtactatatttaaaagtactttaaaagtatgatatgttggccaggtatggtggctcatgcctgtaatcccagcactatgggaagccaaggtgggtggtttgcttgagcccaggagtttgaggccagcttgggcaacatgatgagatcctgcctgtacaaaatacacaaaaaaattagccgggcatggtgatgtgcacctgtagtcccagctactcgaa

SEQ ID NO: 47378 - DNA, 1003 bp, Homo sapiens
tcagtatttgtgggggactggttctagcaccttcgttgaattaccaaaatccacagatgctcaagtccctaaaaaatggttatttgcatgtaacctatgcacatcctcccatatactttaagtcatctctagattacttataatacctaatacaatgtaaccactatgtcaatagttgttatactgtagttttaaacttttttattgttgtattgttatttttattttttccgaatattttttgatccaaggctgattgaatccgtggatacagagggccaactttgctttgttttttagaacagggttatatttgtggagaattgagcatgataatacagaaagttaccataaacccactacctcctccatatacaatttcccctgttattactattctgcattagtggggtacatttgatataactgatgaatcaacagtgatacattattagctaaagttcatattttatattagcatttactctttgtgttaaacagttctgtgggttctgataaatgtatagtgtcttatatctaccattatattaccatatagaataatttcactgccctaaagttcctttctgttccgcttattcatctcttatatcctgcaacccttctgtgatcacttgttagttccaggaattttattctttgttgtttttttgttgttgttgttttgttctttttgagacggagtctcgctctgttgcccaggctggagtgtagtggcacgatctcggctcactgcaatctctgcctcctgggttcaagcaattcttctgcctcagcctcatgagtagctgggattactggcgcatgccaccacacctggctaatttttgtgtttttagtagagacggggtttcactatgttggtcaggctggtctcgaactcctgacctcgtgatctgcctgccttggcctcccaaagtgctgggattacaggtgtgagccactgcgcctggcctgttttttgaattttctacataggcag

SEQ ID NO: 47379 - DNA, 1037 bp, Homo sapiens
tactgaactttctcctgaactctttgagagtccaaatatccagttctttgtgttaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttccagtttaaaagatttagagaaactgtaccaacttgggatacaataagagatgaagaagatgctcttgatgaactcttgcagtatttgggtgttactagtcctgaatgcttacagagaactggaatctcacttaatattcctgctccacaacctgtgtgcatttctgaaaaacaagaaagtgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggtttggaggtaaatcttacaaaccattgtggttttatgggaggactacaaaaaaacaaaagcactggattgaccactccatattttgctacctctacagtagaagtaatatttcacatgtcaacaagaatgccttctgattctgat

SEQ ID NO: 47380 - DNA, 1046 bp, Homo sapiens
aagctacagagcattgttgtagtggtgagggccctctgttgcaggggcatggggaaatgcatatattaatcaggggctggaggagtatacatgattcttgtgttcatgttgtcatttgaaactcttcacataaaattttctaatattcatttggaaaacctctccactggagaggtttcatctctgagaggttttgtaataatagtgtaagttcagtaaatccagtccaaattctcatcacatgtattatttgatactaaattttcaattattacttcaaaataagagtctgaggatttcttcttactggcgttcttaaaggtctctaaaattaaagaacaagatgtggttttttgtttaagacgtttttagtttatttgttgttaagttaaactggagaaagtttgtcatcctcattttcaaactgaaaactaatcaaatatagtgcctatttagtctcaaaataaggtaactattaacttgattatactatataatattctcaattacatttgaatttaaaaatattgagctcttgattacaatttaatacattgtaaaaagtattaaatcctttgaaacatcttttgttgcttatttagtttttgtttctacaggtcaaacatgattgctttctataaaagaaatgcttgagaggttgactataatggatatgtcacaggtataaaacagttgttttctaaaaacatgcatttagtatggcattctcttttagcaactgaattcccaacgagttttattaagctggatatcgaaatgaaggagctgccttaagcactttagaaaaagaatttttttacaattcattttgactctcatggctgaccatgtcattatgtctttaaattttggtaaatatgtagataccaagcattaataactaatgcacacagaaatttaatatacagcaattctttgaatgttccaggtgtacgtaaactaactgaaagtattaaggacatgcctgtctatacatgggtttcattgatggtatctgtatcatcttgacaaatcgtgaactgctg

SEQ ID NO: 47381 - DNA, 1030 bp, Homo sapiens
gcaagatggtgaggacgccctcccccccacccccgccacaccccgccctgctagcccccaacgtctctacaaaaaaagaaaagaaaaaagttaatcaggtacaaaattgtatccagccttaaactggagggcaacaggtcgctaaatcttgaatgtcataaaggcacctcaacttcatgaggaatagtgaacgcagctgctattttccactctatcccctagctctactaattgtatccaaaccaaacttcagggagttatgctgaatccctctagcaaagcacacgcactaaaaaaaccactcgtttatcagaagttcacatttaacgggcttggaaaacggctcagctgctgcctccagttcatcttccgctgtcgaaagcgtttcagaacttaaactctcagattgcctcagtgcgctgctgtagttgtcaattaggcaagagataaaaaagggctttggctaagtggctagattataaaagcgaggaatcgccagggctcagtgaacttctggcggtgaggatgcgacaagagtcacaggaaagccgaggctggggctggaccgtgggaacgtcccagcaggaaccaagccagcctccgccgctcagcacttgacggcggcttttgcggcggttgctgtgagtgccgtaaagcggagcggctgcagcctgctgttgagtgaggtaaggtacgggaggctcaggtcggtacccggggatgggtgggcgccttcagacaggtaccgctggcgactcgggtgcccttaccgggcatcctccagcattctgggcacctgcctaccccttggtgaggaggccggccacaggctgagcgcgctccgggctgggtactcctcagtcagtccacgagcatcgcgtggtagacttccacttggccagtccttcccgcacttctgggcgtgtcatcaggtgaaatcttaatcctgggacagatgaaaggttggaggacgatcgagactcttgtagtagccgggttagggtagtgacccctgacctcaggttatccg

SEQ ID NO: 47382 - DNA, 1050 bp, Homo sapiens
ggccatgttccttgactaaaaacggtctcagtttctcctttggaagtggttctcagcattgtcagcagcaccagcatcatttgggaacttgtcagaaatgaaaattctgaggtctcataccggatttactgaatcagaaactggaggagaaaagcacctctcaaccttgttggtcagtttttataaatatcctatttatgttttcagttatttacagttataaaaaaaagtgataataaacatttttgttttttcatcattggtctcatatttgattatttctttagcatagacaatgaccagatcaaagaatgcctgtggaaatttaattttttctttgttctattgttggttattacaggtacaaaattaaagaggtttttgtttctttaaaaatatcttttttgttcacagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaaggtaattttattccttctttcttatcattcctcctttcttatcattgtatattttctgatcacacttctctttgcaatacataatattaatcatgggtattcaaattcttgcatctttgcgaggtgtggcaaacaattaaaaattcagttaaatatacttgtaatagcacactaaagacaggtgctaagtttcaaggatgtttaatctattggaatttcctgagctagttatttaaaaattattattttgttaaacagattatccttcatttaaatgaactcaatgataaataattttgataaaatgtcaaaattagtttattttagtacagcatatattttaatttagtacctactggggaagtataatggtatgacttacctttatctgtatgtataggaataaagtagagacaatgatgtggaaatcaatagcttctgaag

SEQ ID NO: 47383 - DNA, 1049 bp, Homo sapiens
aaatcacccgtcttctgcgtcgctcatgctgggagctgtagaccggagctgttcctattcggccatcttggctcctacccgaaacttttctttttttaagagaggatctcgcttcgtcacccaggctgaagtacagtggcataatcatagctcactgtaaccttgaatctggggctcaagcagtactcctgcctcaatctcctgagttgttaggaggactacaggcacatgccatcacgcctgactaattaaaaaaaattttttgtagagacggggtctcgctgtgttgcccaggctggtcttgaactcctggcctcaggcagttctgtcacctcaggctcccaaagtgctgggattacaagtatgggctactgcaactggcctggaaaaccaaaattgttaacagagatgtgaaataatttacccatacaaaccacccaatatctaatgtgtatagctgacctctaatgtccctagctccattttttccaggctatataattttaaaaataacagactatactgattctacttttgatcttggctgtttatccaatgaatgtctttctgtgacatcttcaaccctttcctcattattttcttaggataaagtcctagagtagaaattctagatctaatatgcacattttagatttttgttatatattacaaagttatccttcataaggataagcagtatacctgatttctcatatcttttcataaataggaataacaataataatggcatctgtttcagttagagatggctggctaatagtagcttaaacaaatagaggaattatctgtccatatctataagtctagagcctctaaaattctcttggtatttcctgtgttacagtcaaggctagaaggaataatagtgtgatctagcaggcttctagttttgtgacagtggccagcagattcccaaatataagagaatctggggaagtaaggttttactattgttatttagcttttctagcctctataatagagattgcaaaagagaaggggtttgggaatgggtgtcaggtcagctt

SEQ ID NO: 47384 - DNA, 1632 bp, Homo sapiens
tttaaaactaaatttagaaagaaaaacattgctgggttactaataaaacacaacatttattctgttagcatacattatgggaatgaccagatatttcttgatacacttcaatctttggcttctctataactagagatgtggaacactttaaattagaagtggattttcagatcaccaagcagtggtcattttagatcattgctaacaccaagtagattttgaactactgtttaaaagtaaagtctgggatatcctattatcaggctccccagctctctagtctataagtgtcaatgtaaacttttaatttattaaaaatagcaattgttttgctctgtgaatttagggtattctgaggataaaggtaagcatgatatacttggaagttatactacccagtcacagttataaagattttagattaaattaaaaagaggtattttgtatgcttctctgtaacacttctctacctccatcccacccttaggaaacacatacacctaatacttggacctgatttatcatcttgtggttgaagtaatttgctgagatttaaaattcagtattttaacagccaaaggcaacaggggtgatctttcatacattttaacattataagatgtgatgatacttagagaaacatatatttttcagatttgccatttattaggagtcttcatctgtacactgtaaagcaatttcagcaaaaaatttaaagccgtagtagcttcagttggataaaaggttttcctttatcggtattaaccaacaacattctgacaacattcccaaaccttttagtaaatagagagagcagtcagagaaagtacaggttcactgatacattttaaaatggaatttgtgaaaaatttaaagcttaaaataatagaaaaaagtagcgtgactctatccttttcattcaagaaatgatccttgaggtgggagaaaataatggatttttttcaaagtctttacttccacggtacgcaagcaaaaagttgaagagcagcttaccacattcagtgagttctctttatactcttttacattgaggggactaaaaaaaattgtaaatgtggtcactgaatgactatatttgcaaaatcacaggaaaggagaagtactaacatacttctaaacttttagaaggaataaaaggtgaaatctcatcaatagtgtgatattgagccctggtaaaattctagggctcaatgtttatggagttattaaacagatgacttgggagcacttagaaaagaaaatgatcataattaggaactaggcttttactaagaacaagtcctgccaagactttttaggttttaataaaattttaatacacaggcagatgaatgggctattatggtctcagcataatctcttttcaacaagatgtttttcagtcttataaacaaaatgagttactgaaggtcagatgataatagtgatttagaattaattggatttagaatcaactggacacgtttccaaggagcgttaatgattgtattgataacaacttggaggatgtgtttagaaggtgagttatagaatctctgcttgaccctgacctaatctgtatttatattaataatggtaatgaagctataagtgtgttcatcatatttgtat

SEQ ID NO: 47385 - DNA, 1213 bp, Homo sapiens
aagtatataactgtcaagtgcccaagacccacaaatctgaggtttctctaatacagtgtactggcacctaaagctgaggcctgacagcccaagtgggccttcgtagccctatttccttaagtcattgtggagctgtgaaatttatgcagccagcctcatgaataaaaagctgaaaaaccacatgtgtggatgggcctactctagtagaaaagtgctgcctgacatatgcctaccacataataacaggaagtagaagagatggagttttgtgcttaaacttgaccgctcttcctgtcctaagggagtttgctgtggttgtcatctctattatagcaattatcacagtgaattatgaatatctgtcttgtcctcttatcaaattttatgaacttcttgataacaggagtgttcttttatttacctgtgttggcccagtatctactgtacctggcataaagaaaagatccagtagggtcagttttcaaattaaagtgaacatacatgtatttgaacacttgatggcgccaaacagtcttaaatgtaatgcttggtgtaaagcaataaattaatctaatagacctcatcaagcagccgcctttctttttttaaaataatttttaaaaagcaattttaaatacataaaagctgcaagtacagtaccgataacttttttttttctgaaccacttgggagtaagatgttgaccacaacttcaaaaaatttagtatttttttaaaaataggaacattctctacatgtcctaatatgaaagttaggaaattagcacatacatttttaccatttaatccctattcaatttttgtcagttgtcccaataataacctttgtaataaaaagattcgattcagaatcacatgttgtcttaattttcctgtctctttagtcttcttcagtctgggacagtttctcagttcttttattactttcatgactaatactttggaagattacaagccagatgttttgtgcagtgtccctcatttggggtttgtccgggggttcctcatgttagatttaggttatacttctttagaaggtatagaagtggtgctgtgttctcattacatctcactgggcactgcataattttgatttatcccattactgttgatattcacattgttcacctgattaaagtgctgtctgaaacttcgtatctttaccactatgaagtttctgtttttccctttat

SEQ ID NO: 47386 - DNA, 1048 bp, Homo sapiens
aaccatgattactcatttcttatgtatcctttccgagacaaacatatgctcgtatacatatagtatttacgttcatctctccccctttacacaaatagtattatggcatattacacactgtctgtatgttcttttcctcacatagctatgtatcttggaaaatgttccaaatgagtatgtatagaaatagctgcattttattccattgtatggcaataccataatttattcaaccaattccctattgatgaatatttaggctgtttccagtagtttactgtgaccctcagttctgcagtcactatctctgtccatatgtctttatgcacacgtgtgaaaccctgtgcaggataaagtattagactcaaattttggggctaaagggaatataagcatatttcaattttgatagatattgccaaattgccctccaaagatgtttccccaatttatattctcaaccacatggtttgagaatatgggtttattttttaaaagtgcactatctgtaaagagaggtaaacttgctcaatatttgccactaatcagtaacttatcaattacttgtaatcagtaactaaatctaccatacaccaaatataattgggagcacattagaattactgttcaaactagtcagtataatgtatcatctcaccttctccaaaggtctttttgtctttataataacctattttttattttatatatagttcattctgagaaaagcttaataatatagaatgcttactattttttaaaaggcagaagaggaactcaagaaggaagaaaaaagattttctttctaaactactctgcaggactatagaatgatatctttggtcctaagatttaacagtatattaagagtaataaaaaagataaagcttccaggatatctgctacctatcaggcactgtgataggtagttcatatatatatttatatatataatctggttaatcctcatactatccctgtgggttcggtattctcacctccagttagacattaggaaactaaagctcagagtgaagtaacttactcg

SEQ ID NO: 47387 - DNA, 1103 bp, Homo sapiens
ttttttaagagaagattgcctccagatgaataagcagtaaatctttcatttatgtgaagtaagttatgttttttaaaactgtcgaatagtttgttgtttgaacataattctataagatattatataggatagtattctaagagaaataaaagcatattttcagtaaaagacttgtacacagatgtttatagcagtcttactcatactagcaagaaatggaagcaacccaaatgcccatcttctggtgactagttataaaattatgatatattcaaacaatggactaccactgaacaatgaatagcaatgaactactgataaatgcaataacatggatgaatttctaaaacatgatgctaagtgaaagaagtcagataggaagagtatatactgtgtacttgctgttatttgaaattgcacaggaaaaaccaaccaacagtgtaataagattagtggttgcctaggaccagggtgggttgattgcttgactgacaaggggcacagggaactttggacgaggggttggtagaaatgttctatatcttgattattgtggttacacaggtatatacatttatcaaaactcatcacttaagatagatgcatttcattatacttaacttatacctcaaaagaagttaccttaaaagtttaagactgggcacagtaacccatcagcatttggggaagacccggtgagaggatcacttgagcccaggagttcaagataagcctgggcaacatagggagaccccatgtctacaaaaaaataaaaactaaacttaaaaaaggttaaaaagataaaaaacagtttgtgacttagaaaactgatgctaagagaaaaagggtctgagatcacaggttgaaacagagggatatatgggaccaaaagcaatgaatttggtcagggcagacctaattgcaatgataaactttgagactttcacatatgattaaacaaattgtgtaatctgatagtaaagccttttgtattgagtatgaaaattgaaactataatttaattcttttaaaaattatccattatatacaaggagaaatcctgtaaaagtctgaaggaaagcaagcacaactggagtctaact

SEQ ID NO: 47388 - DNA, 1044 bp, Homo sapiens
ccagaatttctagtttaagtcattatctgtgttctggaggaactgactcttggggaaattcctggattctttggagctgttctagacttgaaagttctcctcccagatttattttggcattagcctaatttcttgagtatatctaaacatctgtgaacactgtgcattttgccacataaaggaataggagcactctctaccccttgaggtcttggttcctttatataaaaatatatgtggaaaaaattgggggacattctacaatctgttgagggtagcattctgcaagtcactaaaagtctgtgactttagatgatgatagtcagtgtatttagtaatcgaactcagaatctggatattgcaaacttctttaccacttattagctttgtgattttgggcaagttatttaacctctcagagccttggttccacatctcaatgatgagggtaataatagaatagttgttgggttaaagttaaagagaacgacaatgtaaagcacttatcttcgttctgacacatgttaaatgcatagtgatgttgatattttatcttacttcctttgaatactaaatgcatttttgtgaaagtggttattctactcatttggcaccccaaaatatggtaccttgtattatttttaatgagttgtgttattttccattaagtagaatctcatggagaacagagattttaccagaatctagcttagattgcttcccctgcagattacattaataatgcattttgattttttttccttttgtttctctctcttgagaaacagaaatcatttgtatttaaattcaaaattaaacttttttcccccagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatga

SEQ ID NO: 47389 - DNA, 1027 bp, Homo sapiens
aaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaaccta

SEQ ID NO: 47390 - DNA, 1023 bp, Homo sapiens
taaaggaaaagattacttttaggagtttattacaataagacatcatagccatagagtcacagtaagacccttaaaaatgactttattactgccttaataaatgctgaaaaaagtgataaaacataaaatacataaatattattcttgttttactagaaaacttagcattatcaagagtatcttgcctttgacaaaaacgtagttggtgatgatcagttatggtaatctagttttcattaattttataaaatcaggggaagcatttacaattccccaaatagagaattcaattgggtcagtttgctcctgcttatatggaatgcacctcttaagtagtgtgtgtatcaagctatcttaaacgttccctgtctccttcataccttcgcttccctggtgccatcatctgtggctccagtggtaacgttgttcacacattacacacatggctccagccagggcgaatatgtgggaaagacctacttgggatttcttttttctggaggaaagtgaactagaaggcatttctttgacttcctttgcgtctttgtgtacagttcacgggtgtcactttctgagccatacagcatctgtgatagagaagactcactcaggagcaagagtttggaatgaaagataagatagtatgaacacacttctccactgcaggaaaccttaaaaatattgctaatggccttttggtatgggaagcagcagagctgagccatcagcaccctccctgtgctctccttgcccactctgtggctctccgccctctgggctgccatgacagatcaggccacctcctttgcccaggacttcctggctggatgcctcactgcagccatctccatgatgctgtggcccccagcgagtgggtcaagctgctgctgcaggtgcaacgtgccagtgagcagatcatgcctgacaagtgggtcaatggcatcatggactgcatggtccgtatacccaaggagcagggtgtgctgttcttctgggtgggcaatctggccaatgccattcgct

SEQ ID NO: 47391 - DNA, 1034 bp, Homo sapiens
tctctttcaccagccaattcagaaaattttgtaactttatttggtcattcaatattatcattttccctccaggttgtatatttttcccagagtgccataaatattaccattctgccattgacaaaaatattcttgaaatagactcatgagcataccactagagctctcctagctggttgacaacagtgcaatgattggcatcctttgggcatcctttctagataatcatttgattatctagatcagcaaaggtacttttgctcttagatttttgggaaggagagactttgttacatactttggtgaaatgcagagcattgcatgtattctattttcctattatacctttctaaaacccctgcacaggaaggaattaagctagtcttgtgtgacttgtccttgatgagctcaggttggcatcatagcatcttttcatttctttccaattctgcataagctgcctatttgctaatcggttctagactttgtgtaaaaaatgatacagatgacttatgacattcaaattcttgcaattttgaaaaaataggacattgaaaaaacaagaaacagtgacttggtcacaaatagtccataataaagcacaatgttgattgacacagcacttgtgggagaatagcagggcacagggcaatcaagaaagtcttcttggaagaggtaaactttggaggatgcctagaattgagttaggaagtgagaagattacagagaattccaaatgatggaaacaggatgagcaaagatatagaagtttcagatatgaatgagtttgatgtgtttgtgggtccagacattgttggtgtggctggaatagtgagtacttgctgaaaaatattgtgaatacagcaggataggcagggtggatcttgcttgtgggatggccagagaatgctggctttgaataccatggtaggataaaaagcactgaaggtttttgagcagaggagtgacctggcaaagagtagcatgacagtggatgctgctagcagctgtgtgcaggattgcaccgtgtggag

SEQ ID NO: 47392 - DNA, 1035 bp, Homo sapiens
gaacattaaatatgttcacattgaattaagaagagcagtgtgtgttctcaggtgtgttgagaattcactcttcactcacctgtctagttggaataaatcgttcatggggctttggctacaacctgaagaactcacttctaggattctctgggtgtggagttaatgtcatccagacacctatttctgccttatttgaagacactgggatccgaatgaggcagagcactcttcagagaggggatttttaccattgtacatctgtttccactgcctgcagtggtcaaatctccccattccctaccaagccagaggggtcatggagctctgggctcagatatagtaccctgggaaatagcccacccacatgtggatgtgataagagaggcagcatctggcgcagaaactgaaatccaggtttggaaaccatccaatgggtcactcacctgaaggggctgccaagagaagttgaattcccagtgaaaacaggagcaatgggaagaaagtgaagcattagagcaggatattagagatggacatggaggacttcctggattcagagaaggcggctgcagggattttctaaggctcatttggccttgggtttggacaaggagagatcataggacatcaatttttcctagaatgaaatgttccctaaagccttcactcacttggaaaactcttacgcatattgttctctctcattcactttgagcaattcggttttgggacaatgcagtcttatttgctgtacttccatccagctcaaggcatgtttattgaccccattataaatttaaaaatatagttattttgttctgcccaattttgctgtgaacctaaaactactttaaaaaatagtctatttttcaaaaagatcatttaaaaaatgagattagttcgaatatcagctcttacaagctcagagtgcatgggcaaaatcatattttggagcctggaaagctgagtggacccactgaatccccttaggccctggcccccgtgaagtccagctgatgtcatcagtctcactct

SEQ ID NO: 47393 - DNA, 1003 bp, Homo sapiens
cagctttgcagataatagctgcatgctcttggacaagtcatttttgttttgcatctgtaatatggggaaaataatatagataatataatactaacagtttccatatataattattaatatgtgtcaggtatgtattttagctccagatccctctataatcctgcaaagtatgtttgatgccccctgttttaaagaaaagaataatgaaggctgagggaactgatatgacttgttcaaatgagcccatataagcacaggaatggcagaacatagatttttatggcttttcccataatgccaggacatctctaggaagaagggaggacccagatgaatccgattctgttcattgtttgtttttcatgcttatggagaggtggtcaatgagcatagctccttagtgaagggatagccacttagtagtgggacactggggctgctgagccccgcctcagtttggtttacattttataagcttgctgtagctgcatagcttggttcttacttgtgcaactcaagaaagaaacgtctgtgatagaataatctcggttcaagtctagctctgcctgcgttagttatctaaacatagtggcttgaaacaacacacatttattatcttgtagtttctataggtcagcagtctaagcatggctgagttgggtcctctgctcagggtctcaaaggctgaaatcacagtgtctagctggctgcattctcatctggaggcttggctgaagaagaacacacttccaagctcattcaggttatgggcagaattcatttcttggtggtctacgggagctgggggcctcagtttctctctggctattggctgaaggacatctgcaggtcctacagttcacctgtggttccccaccatgttgccctctaccttggcagttcacaacataacagcttccttcttcaaatccagcaggagagccagactgagtctactaacaaggtggagtcttatgtacagtatcctcatcacaggaatgac

SEQ ID NO: 47394 - DNA, 1059 bp, Homo sapiens
ctggccttaccagctgaaggcaaattgcttctggtgggccttatggacaggaatggagaaaaaggcatttgccaagtcaatggctgcataccaggtaagaggagatgtgtttatttgctcaagcgatgaagccatatctggtacagcagctccagttggagtcaccacttggttaagcttgtgataatccactcttattctccaggatccatctgtcttctgcacaggccaaatgggagagttgaatggggatgtggtgggaatcaccacccatgcatttttcaagtctttgatggtggcactaataaccatccttccagggatgcaatattgttcttgatttactatttttctaggtagagtgcagatctaatggcttccacttgacctctcccaccataatagacctcaccctaccaggtagggagccaatgttggggttctgccagctgctaagtatgtctctgccaattatgcattctggcacaggggaaatgaccacaggatgaatccagggacccactggacccactgtaagttggacctgagtgaaaactccattaattacctgtcctccatactactagaagcagagtccttagcatttttaggtctaatcatattaagtagccagctccaggaacccccaaaccaatggaagaacttaatattccttaatattctgttcctctagagccaatcctggtatgaaaatctgtattagttcaggggttctctggagaaacagaaataatagaatatatatgtgtgtgtgtgtgtgtgtgtgtgtgtgtgtgtgtgtgtgtgttcattaagtagtattaactcacatgatcacaggtcctggaataggccatctgcaagctgaggagcaaggaagcctgtctgagtcccaaagctgaagaacttggagtctgatgtttgtgggcaggaagcatccagcacaggagaggatgcaggctgggaggctaagccagtctagccttttcatgtatttctgcctgttttatattctggccacactggcaactaattagatggtgtccatccagattaagg

SEQ ID NO: 47395 - DNA, 1042 bp, Homo sapiens
gttcttcttttacaatactgttttgactcttctgagtcccttgaatttccatatgaatattgggatcagcttgtcaacttcttcaaaacagcctactaaggatttgacagagattgtgctgaacctacaggggagtctgggggaatagtgccatatcaatgcaacataaagtctttcaatctgtaaacatgaaacatctttccatttaagtctttaatttagttaattttttttgtagtacaagttttgtacttcttgttaagtttatatctaagaattttactttttcatactagtgtaagtgaaattgctttcttaatttcatttggattgtttattgctggtttattggaaatggaattaatttttacatgttgatctcataccttaacaccttgctttacttgtttgttagttctaacagtttaggtgaatttcttaggattttttaatatataaaatagttatcatctgaaaatggagattttaacgtttcttttctaacttgaatgttttttagctctttttcttgcataattgcccttggcgagatctccatttcaatgttaaatgtaaatggccagcatggacatttttgtctcgttcctgatgttaaaggaaaagctttccgtttttcgctatcacatgtatgatattagttatggattttttttttttttttttttgagacagagtctcactctgtcgcccaggttggagtgcagtggcactatctcggctcactgcaagctctgcccccccgggttcatgccattctcctgcctcagcctcccgagtagctggagctacaggcactcgcctaattttttgtatttttagttgagacggggtttcaccatgttagccaggatggtttcgacctcctgacctcgtgatccgcccgcctcggcctccacaagtgccgggattataggcatgagccaccacatcccacctagttatggattttttttatgtccataataacctttaccaggttgaaatagtttcctactattgctaattcattcaggtttcctgt

SEQ ID NO: 47396 - DNA, 1061 bp, Homo sapiens
cttgtaaggttaattcttcacatatacttttgatctgtgagacgttatgttttatatcttaacaatttttgacctttttgtgcatttaaagctatcattcagttcaaatgccattaaaatttgtcctttcatgatctctactcaacctagacaaaacagtttctcataataaaagtgtctcttggcaacagttgccattaaaacgagttaggattttttttttaattgcatcccagtttagtttattaacagtcttcaggctgctaccacaaactggttcattttggtttacttgaggacacacacaaggtaatcaggaaagttcttgtttttgacaaatttgtaaacaaattgggcagggaatgagtattcttaagaaaatataaatcataatacagtgtatggtaaaaattcttttaccatatacgtagtgtttaagtggtacctgacgcatagtaagtactcaatagatcttagccattgttattataaacactattatttttatactattttaaaatcatgttgaaattcctgatttatttccctgttgcctgtactacacagtaaaactcttcaaaaacaaggaccatatcctacttgaccttgaattcccaatgtctggctctctggtataaggaaaaaatattgaatgaattaatataatttaaagtcaaagtggaagtgataacagatttaacttggatttaggagaagagagcaagctttggattaaagtattctagggatacttcaggaagctgcttttttaaggcaagattgaagaatttaggtgaaaactctttgtacttagagattcataatttccatagagagtcataatttccatagtaggttattttgtctgtttatttttaggaataaatagtatcagtaatacagtgtgagttaaattgaaactttgggtccaagatctgcatgggagtcttagctctaacactcacaatctgtgcaggaaaacatattgtttcagacccttgactcctccatctgcaaaatgataattattaataatatctattctgtatacatcacagaag

SEQ ID NO: 47397 - DNA, 1225 bp, Homo sapiens
taaaagaatccagagtctacattataacgtttccaatgtccaaaatataaccgaaaattagcatatgaaaaaagaacaaagtgtaacccattattaaagacaatcaacaggtgctaggaaaattagatatccatatgcagaagaatgaaactagattcctatttctcaccatatacaaaaatcaactcaaattgaactgaagacaaatgtaagcccttacactgtggaagtactaaatgaaagcataggagaaatgcttcacagtatcaatacggccaaggatattttggataaaatcttaaaaacacagcaaaaatgaacaaatgagattacatcaaatgaaggagattctgaacagcaaagaaataattaacagaatgaagtctcctagcatcattatcttattcagtgtgagaaaacattattatctcctttaaaaatgagaaaattaacattcagagaattacttttgtgcccaagtatgcacagctagtgaatactgaagacgaaacttgaacccatagttgtctgatttcagaacttgcattatttctgtaatactgcttctaactgaagtccatatgtgaaaagagtctttgtttagattttaagggcaactctttttgtttatcaccaaccatgtataaatttacttttcattatttgttttatgtcagaatgtagaaggttcgttcattctatcttttatttaataccatttgtagactgtctccatgtctatcattggttagaggtgaatcagaaaataataacaaaatggcagacttaagccctataatatcaatagttaccttaaatgcaaatagtctaaatacacaagttaaagacattgtcagtgcagatttaaaactatgacccaactatgtatctaaaatgaacctcacttcaatgcagtgacatgggtatgttcaaggtaagagaataaaaaaagatatataaacatgttttctttaaaaaagcagaagctattgtagtaatattagatagtgtagattttggagcaaaggaaattatcggagatagagaatatcattacagattaataaaaggatcacttcttcagaaaggtgcaataatcctaaatatgtgcacatcaaataacagagcctcaaaatatatgaagtaaacactgacagagctaaaatggataaatccacaattatagatggggacttcaacatcccattctcagcaattgatggta

SEQ ID NO: 47398 - DNA, 1049 bp, Homo sapiens
ctgccgccctccagatgcttggcccggatgccatacacctgctcagtgtcagccagaacccaccagagcatatggcagctcacatattgccttgtctcgggatggattgggaacgctggtcacctgggctgtattttcaagtggtgtgacagcagctgtgggaagcccagagaatgacaggctctcactgctcttcttactagtgggaaaggagcacgagaggaacagaagggagatgttttcatatacccagtagctacgacttgactctcctgtaaaaggacacaccgcttgctgtcttcacccacagtgagcaggtgcaatagaagggaaattctgatttttttttatttaaaattgcaactgtggtaggcacaattatggcccctgaagatgttcatgtcctaatccctggaacctgtgaatatgttaccttacatggcaaaagggaattaggtagcagatataattcaagttgcttatcatctgaccttaaaagagggacattatcctggataacctgggtgggcccagtagaatcatgagggtccttaaatgtagaaaggaaggtaggagaagaggtcagagtgatgctatgtgagaggaagtccacctgctgttgttggctttgaagatagaggtagagcgtcacaagccaagggatatggctctgtgtctctacgtaaatctcatgttgaactgtagtccccacatgttgaaggagcgggtctggtgggaagtgattgaatcatgggggcagacttaccccttgtttttctcgtgatggagttcttacaagatctggttgtttaaaagtgtgtagcaatttccgcttcgttctctctctcctgctctgccatggtaagacgtgcttgcttcccctttgccttcccgccatgattttaagtttcctgaggcctcccagccatgcttcctgtacagcctgcagaactgtgagtcaattaaacctctttccttcagaaattactcagtctcaggtagttctttatagcagaattgactaacacaccaagcaatgcagcagcctc

SEQ ID NO: 47399 - DNA, 1020 bp, Homo sapiens
accagttaatatattctaaggaggctaattggaccttgctttcaactaagaagaaatatagaaaggtaccagcttcaacagaaataaggaacacattggtgagcaacttacaacagcatttttcttgctttgctttctcattatgtgtcagatttttttgtgtaaagttccttatgtctaaaatatttttgtacatattgaagtggttttagattccagatgtaattatattctgttgagtagctggtagcactgtcactcagtaaatgcacagtgctgtatatgacaacatcacatttttcaaaccaaactgttgtgtcattaattgagggttattgttcttctgaggggtgtgaaaggagaggggaaatacatggttctttagctgataattgtccatggtcaatgaagtaaaaccatgtttgtgcagacaaaaatgtatggtttcagttgacgtgtatgcttatttaaaaatacttctgttagatctctgctcctttatgaaaaacctaggcctctccaagagcacttaaaaaaaatcctacttggaatcataacttttattattcatttttgaacattatcttttgataccattacttttgctcttaagtgaaatttcgccaatattatatttaaatttgctaatgcataaatggatgcaccaaactgggtgtccaaactgggaagttcagttgcaatggataaagagttatttggaaaagtaattaccagataattttacatctaattaaccatgtatgtttatgtaaacataagtacattatatattgatcttgaaacaaactttcatgatatctttttttattgttattgatagcaggacaattggttcatttgctcatttcagcaggggggaaacatctgacaatctggttgtcagtccagctgtttgactctccacattttttactttgcaaccaaatgtgttggcgtcttagagttgaacttttctggaagggaaaaaataggtatttaagaggcatcttggaatttgga

SEQ ID NO: 47400 - DNA, 1046 bp, Homo sapiens
catgaaatctttgcataagccaatgtctagaaggatttttccaatgttatcttctaaaatttttatagtttcaggtcttagatttaagtctttaatccatcttgagttgatttttgtataaagtaagagatgatccagtttcattctcctacaagtggctaaccagttatcccagtaattggctaattggataatttcaacaaatttcaaccatttgttgaaaaggatgttctttccccactttatgtttttgtttgctttgttgaagatcagttggctgtaagtatttgggattatttctgggttctctattctcttccactggtatacgtgcctatttttataccagtaccatgctgttttggtgactatgcccttacagtatagtttgaaatcaggtagtgtgatgcctctagatttgttcttttgcttagtcttcctttggctatgtgggctattttttggttccatatgaattttagaattgttttttctaattctgtgaagaatgatggtggtattctgacggagattgcattgaatttgtacattgcttttggcagtatggtcattttcacaatattgattctacccatccatgagcatgggatgtgtttccttttgtttgtgtcatctataatttctttcagcaatgttttctagttttccttgtaggggtgttttgcctccttggttaggtatattcctaagtacttattttattttttgcagctattgtaaaaggggttgagttcttgatttgattctctgcttggctgctgttggtgtccagaagagctaatttgtgtacattaatgctgtatctagaaactttgctgaattcttttatcagttctaggagatttctggaggagttcttagggttttcaaggtaaacaatcctattgtcagcaaacaaacagtgacagtttggcttcctctttaccgatttggatgccttttatttctttctattgtctgattgctctcgctagaactttcaacactgtgttgaagtggagtggtgagagtggacatccttgtct

SEQ ID NO: 47401 - DNA, 1050 bp, Homo sapiens
tttatctgaagcctagttttacaacaacgctcgctctttcctaaggcagtgtgggctgtctcttggtaccattagcacttctcagccatgtcttggtcttcagtgtttgctacatgaacctaacgtctccaggagtagattttattttatcaagaagttcattaatggcgcaactatgcaacgtttcacctgcctagttgaaactggtttgaaaaccagatgacttagtggcagtgacgatgagcttctgcacagaaatcttctctactcacaagccgtaatgtatttgggtttcaaagactttgcatagtaggcagcgtgccatgatgctgacaaatttgttatataaaaatactcgcctatatctcccttggtttttaacctgctaatcggctttaaaataaagtatgttagtaaactgcaagaataaattctgacaattgagggagggctcggagtactgatggctaccactgtattttaccagccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaaggtgagaactggaaggtctggatgagcattgtgtgtgagcgattcgagttacttattaaccccattgcctaaagcagctcaggaaagagcatctcagaatgcgggcattcctgaattatgcttggattggtttggcttgttttgatttctttgcaggttggaccttcctcatctttctgttcagggaaaggtcgagtttcgatctggtttccttccacgcggatagtttggtggcagcagaaggtccaggattctcggtctaggaggcttcgggtcgtccttctattctgcgtttagtgccattagctcttcgttcttccaagttgcccgagctcttgagaggaatcaagtgggttctgttcccatcatcttctgctcctctttcttcctgacttctta

SEQ ID NO: 47402 - DNA, 1078 bp, Homo sapiens
cctgtgtctccagctaaactgtgtgctctccgaggtcagggaccatttcctattcatttctagagccctagcactgggtaggccattcaatagatatttcttaaattgttttgaattaggacagcaaaagcaaccgcacacaaggaaagccaagagaacaatttatgtgtgaacaagcctgggaatctggaaaaagccaatggaatctggctgtgtgtatagcaagatgtgccatcccatgttactgcacttttcatgcatcattcccttgtccttgagttaactaacttctcccttcctcccaccccagtggcaacaccatagccctttcaactttctgcaaatgaagcaactaattcctttttttccaagcagccacggagacaagtgggtaccttccttactttctgccacctcttcagagtacttctacttcctttgtttaatgatcctttttcaaatgcctgcttcctgcttattttcttcctctcttttggagtattcttttgtcttcctctatgaactcagtgactggctcacagccttgctttccaatccaaatgtaatcttcatgctctggaattacaatagactagactcaatggtaataactcaacagacacttcagtcgcctaagctagggaaatttgtctccttcctgactgtcctccagctgcccacctgtggccaaattcaccataacagctccgtctccagcacctcaaatttgcctttactctgaccactgtgggtggatctccttccccatccaacctagacctgaccagagggttagccgtttcaaaggggctttctccagcatcctggtttctctcgtcccctcgtcctctggtttccaacttaccagactccaaccctgaataaccttcactcctgcccttcctctgatgttagccagtctttctgattctaacctccatcttttccaatctgttttccaggatatctttgttaatcacaaatcaaatttacttttcaaaataaatttgagctgagtcagacttatccctatgtaatgtcagtttacacctaagtatttcaaggtattttcttaagt

SEQ ID NO: 47403 - DNA, 1052 bp, Homo sapiens
gctgctataaacatgcatatgcaagtatctttttcgaatagtgacttttcctctgggtagatacccagtagtggaattggtggatcaaatggcagttctacttttagttctttaaggaatcaccacactgttttccatagtggctgtactagtttatatcccaccagcagtgtagaagtgttcgctcttcgttgcatccatgccagtatctactggattttttaaattttttttattatgtccatttttgcagaagtaaggtggtattgcattgtggtttcgatttgcatttccctgatcattagtgatgctgagcatttttccatatgtctgttggccatctgtatctcttcttttgagaactgtctattcatgtccttagcccactttttcatgagattgtttttttcttactgatttgtttgatttcattgtagattctgatattagtcctttgtcagttgtatagattgtgaagattttctcccactctgtgggttgtctgtttactctgctaactattctttctgccatgcaaaagctctttagtttaagtaagtcccaactatttatctttgtatttattgcatttggttttgggttcttggtcatgaagtccttgcctaagccagtgtctagaagggtttttccaatgttatcttctagaatttttatagtttctcctcttagatttaagtccttaatccatcttgagttgatttttgtataaagtgagagatgaggatccagtttcattctcctacatgtggctagccaattatcccagcaccatttgttgaaaagggtgtcctttccccacttcatgttttgtttgctttgccaaagatcaattggctataagtatttgggtatatttctgggttctctattctgttccattggtatatatgcctatttttataccagtactatgctgttttggtgaggaacagcatagtacagtttgaaatcagatagtgtgattgtagtagtctgttttcacactactgataaagacgtacctgagactgggcaatttacaaaagcaagag

SEQ ID NO: 47404 - DNA, 1035 bp, Homo sapiens
ctaaaggaaacaaaatcagtgtctcaaagagctactgcactcccatgttccctgcaacagtattcacaatagaatagccaagacatggaagcagcctaactatccattgatggatgaattttttaaaaagtggtacataaacacacaatggaatattattcagccatggaaaacagacattctaccatttgggactgtatggacaaactttgaatatccttccttgaagcttttacaagaactctaattgaggtgctcttatctgagaattcaagatttttttacctgcacttttgaccatcttgctgtaagaaatcgtagagacaatactttgctgaatctttgtcccactgttttctttccctcattcccattctgatttttaaggacaggcaaagaagatctgtctgttgagtagaccacttggtacgttaggggttggcaaactatgatgcatggaccaaatctagtccacctccttttttatatggtccactctctaaggatggtcttgacatgttttagtgattgaaaaagtatcaaaaaaattgtaatgtgaaatatgaaattcagatttcactttccctaaataaagctttattggaatacagccatggtcatccattgacttattgtttatgggttgcttctgagctacaacagcagttgaatagttgtaacaaagactatagagtccagaaagcctaaaaatatttacttatctggccctttacacaaaaagtttaccagcctgtgttataagtcattcaaaatcttcacagcgctgcacattctttttaacatcaacatgcagtattaggtaatatgagcatcctggttgggtgcctctttttgaagctacaaatgttaagtaagaggggcaaccttagagttaaaaattctggaaacattaagtggactttctcaatctcagtctgtcctatttgatgcctgcaatgtaatctgaagacaagggttccagttccattctatcattagcaagcacattcatatcagtcttctatcagactgggt

SEQ ID NO: 47405 - DNA, 1310 bp, Homo sapiens
tattattccatcatttgtttgggcctttttcaggtaagccgtaactttgagctggttggacgggttaacttggatcagctggaacagatgaaggagaaaatggagagctccagcagcgatgatgaggacaaggaagaagaaatgaacagcaaggctgaagacagaggttagtctcatcctgccctcccaatcccagatggcatctggcatgtccgtagtgagacagaagggaggcaggaggttgttgtaggagtaacagaaggaatgatccttcttagttaagtagcagaacagactgacttagaaaacacatcaagagctgtgtctttgtaaactattaccagctatagaaacgccaaggaaaacagacattttctccctaattatagatatatgtttgttgaaaaatagatggcagtgatttgtttttaataaggaaaactggtatctagggaatcttcagaataaggacaagcagacagcaagatggatgacactgtagagctctagaggaatgagaatgaacttccagttgaatgcatatttaaaattgctgctggggcacacactgctggaactgtaggggacggtggtgcaaagaacttgagcccctaccccctgatgtccctctgcgtggcccttttcttaaccccctttgtgctctgacttgctttgtaaggagagagaaagagagaccacctctttcattcaactatgtatttacagaatacactggggaaggttttgtgggactttggtactatttttctaacttcctgtgagtctataattatttcaaaatgaaaaagttttcaaaagtatatttagttgtggatatacatttatgtgattcagagttggttttctatattgttcaacgtagaatattgtgaaaaaccccagactatacatacaagaatataggttgagatatgttactttagttattgcagatttatcagaagcacgtggataacataaacatcagaaatcaacattgcagatattgacccagagatgagaatagtactagttgccattactgagcatcattatgtgctagcctcagtgctggtcgtttttatataacatttttctttaatctcatgactagagaggactgtacatttagcctgcttgaatttggtttccagttctgctacttactgtctagatggcttggggtaaattattgtatttccttgtacattcatcatctgtgaaataatcacaatcgtaataatgagaataatatcacctccctcctaagattgttgtaaagattttttttaactttaaaacttcagatt

SEQ ID NO: 47406 - DNA, 1048 bp, Homo sapiens
tggaaagatgttgcatttgtggaataagtgcttacttgaaaagcatgttcttcttttattttcttactgttaagaatttttatttgtaggatgtttgttttaatttaatttttttaagggatgggggccatcatgtggaaaccagaaaatggggaaagtgtgaactatccagacaaagattcattttgtgtctatatttgtttttaattggcctcatttcaaatgtattaaacagttccatacctggattgggtgtttgtaatggttaccaaaaaacaaacaaaaaaagaaagaaaaaggaaaaaaaaaaagaaaataattgtgacatgcttttatcactactttatttttcaaataacatgtaaatattgtaatccattggattttgttttgctaacctgttaataaaaatatgggaccattatccttttaacaaggctagaatgtcatttttttctttttcaaacatatacctgatattttgtggccgcacattttggatgcattattataattctgttgactgtaatgacatagaatttacaacattttttgttgttgtttaatttatacagaggacatttttttcagagcttgagagaagaaaataaatagcaaaatgataacctattgactccagtaatcagtgtttcccaatacttcataagagatagggagaccctgagtccttgaagccaagggtttaaaaacaaaacaaaaacaaaaaaaaccacaagtaggttattcaagttgtttgcaacatacattttgtaatgaaatgtgagaaattaataaagaatttttttcacatgtgtctatgtgcatctgttgtaaatcatttacagatatgactacagatatgaaatctagaaatattatagcactacctttcaatgcttgtacacgagatattttaagtcattgaatctacacaggtatggaaagcaaaggtaaagctgaggtgaggttgaggttgagctgggattttcaaatgttaatatttctgcatcaggtattcatcaccaactgagggagttttagggaagga

SEQ ID NO: 47407 - DNA, 1029 bp, Homo sapiens
ccctggcggcgtacagcggagccgatcctcctgtcttggccgtgggctttgtggcaggagaatggggaagcagtggccggacgccgaaggcctggtggcagatggcgtggagcgcacgcccgcgggcctgggcctaggagctcgtgctagcggggccggagggggatgggaaggtccaggccgtctcagccgtagagcctggctttctggtatgggtgcacaggtgggggagggagacgtaggcgtcgccactacccctgtgtggacctggttagccgcttagttcccagagttggtaacccgagaagatgagccttaagaaaaaaaaaagtatcaggttccgtttgccgccgagaggtgagtggtggtgaaaatgaatttgcccctttcccctcagaattgtttacccttttatttgcaaatgaatcgttctgctgccttcctcccgccaccaaacccacacccttgcgtagattgcactttgaggcctctttggtgatggttttagctgttagagctcttcacagccatccaggctcaaactaaacttcagatttaacgggttttctgtgttagaaatcttggaattgtaggagttggaacgctgcagccaccctcccccgatgccccaaacagtagcagttcaagggggaaaaaagaaaaaaaaaacaaaaaacaacaactttgaatcctttctgcagttaaagccttaaacatttcagaagtccacattatacatttttctgtatttgtgactgcataaagagacactgttgaggtcagtacaactttatgccaagaatctaaaaacgctgtgagtgtaaatttactgcttatgttcggaaatacaccgccaagattgtcataatactaagtttaaaccagcagctttctgcccaactctatttttaaaagtagttgattctattttgggtggagatcaggggctttggtgttaagtagacctgagttccatttgtggttttgtaacttatttgctatgaccttgggcaaattacggttagtttc

SEQ ID NO: 47408 - DNA, 1076 bp, Homo sapiens
cttcttccctccctccctcccttcccccttccctctcctttcctctccttccctcctttcctcccttccttccccactcctttcccttccttccttcccttcctttttcaacaaggtcttgctctgtcacccaggatagagtacagtggcatgatcatagctcactgcagccccaaactcctgggctcaagtgatcctccaccctaagcctccccagtagctgggactacgggggcatgccaccacgcccagctaattttagtttttttttgtagggatggggtcttgatgttttatccaggctggtctccaacttctagcctcaagtgatcctcctgcctcagcctcctaaagtgctgggatgacaggcatgagccagcacacctagccaagaaatatttcttgtaggatttttaaaggttactttgatgctgtggggtgggcaagagtgaaaagcagagacatcagttagggggcttgtgcagtagttttaagtaattgcagcttgaaccagggcagtaggagtggagatgtagagaagtagatggaattaggatatgttttgagaggtacagttggctgtaccacttgctgtgtcacctcaggcaagttactcagtatgtgccttttggtcctctgctgtaaaatgagaatactagtatgaaagtactaacttattggtatatgggttttgaaataatattaacagtgcttggcaatgtggtaccactctccctccattgttcttgcttagaaagcctcaaatgtgattaaattcaactcagtgtttgtacttgcacctgagtggccagagatgcaccttgtagccacattgacttgtcttgcttaaatttatgaacattaaggaacttaagttcatgagcactaaggaacattaaggcacactaaggaaccttaattgggtccttagtatgcagcacctgacagtcttacagtttactagtccagtcactcttccactgccacaggatgctttcatatcatctagcctgcttattttcacttgatgaccctagtctttatttgattgagaatttggaaataatcgagacaga

SEQ ID NO: 47409 - DNA, 1078 bp, Homo sapiens
ctcacataattaatgttatgctatcagttattgtttcaattgtaaaaatctcctgtactaaattattttattccttgggtccagtgaggagatttttcctatttgtactgaagtcagctgacatttttaaaatcaaatttgtatttgtagaaatatcaggaacctaccttgggacagaaattccccaggaaatactctggtgcctgtaccagtttctcaagtggaaggagaagaaccgaagaaccaaaaaagaaaaagcattacctgtagtgtaaacataagaaatcctttagtacacatttggctttgggaatctcctttattttgctaattgttgattgccaaaatttaattgctgctattattttttaattaggccgtgtagtattagaactgccttagacctttttcttttaaatgaaatctctttttctctttgaaagtccagttttccctaaattactcaagtaattcaggctcattatagtaaataaagtatagtaaaatgagaatggcttttgccatcggtctaaggaaccactgtagactctgtatatccctctagtcttttcaaaaaatacatttacacataatacatgaacacaactacactatttgtttaaaaaaattaattagcaactagctttttttcctcaaacatagttataaatattcatttatattgcataatgttcaaatgaatttatgtacattaatttattttaccatttctcctttgtggatgtttagggtggttttcagtttttagtattgcaaaaagcaatgtagtgcacatactttgtacctttgtctttgaagtagttacatgagcacctctagcattgatttctagatgcgaaattatttggtcaaagtgtggcagattgcctttaaaaatgcctggtcaggctgagcgccgtggcttatgcctgtaatcccagcactttgggaggctgaggtgggcggatcacgaggtcaggagttcgagaccctcctggccaatgtgatgaaaccctgtctctactaaaaatacaaaaaattagctaggtgtggtggcgtgcacctgtagtctcagcta

SEQ ID NO: 47410 - DNA, 1238 bp, Homo sapiens
tgaactagaatagtgccagtgccacagagatgcacggtagtgctcacattagggaataattagatggtaagtttagctttgtggcggcacttttaaatacactttatgattgtcttcctttggaggaaaaaagaaaaaccatgcccatcatgtttaatattatgttgagtacgtttttatttttaaatgcacgattttttaagagagaattaagtagctagaaaaaatgtttgatttcttgaatgttaaccatgtctttgtctctagtggaattgatgataaaccaccattatttatgtagtgggaaatgcagcacaatgaaagttctagccttggttatgtactgggactgtggtgctcaggtttatattcactctgttgagatggcttactggaatgggagcattggtgtggggctcagcgcagttaaaggagtcataattgcatctgttggtgggccatatcctttccaagagaaaccttgtgctgagttcatacctcttcctttgaagcatccagaaagaaggcagtctttcttgctaatctgttttgaagtatgctcaattaggttggattagggatgatttaaacaaagtaatttagacacagttcttctacagatacattatggtttaaatacctctaggacatcccgtgaaggtgttcagtagagagttaagtgtgcataaatgaaggtcagggagagagagctgggctagaaatacagatgacatctgcatggttattgaaactaggagtagacacgatggattatcctggaagtctaagtagcacttaaagggctggccagggaggaggatttcgtgaagcagtgaatggagagataggaaaaccaaaagtgtggcatcctggaagccaagagatggcagtatgtaaaggagggacaggtcagtactgtcacacgtgacaagaggaagataggagaggattaagaagtgtggtatcattatggtgttgcagaattcagtgatgttggtaaagagcagtgttaatggaatggccagcggtgggtggggggggactaccagagaaaataagcagcagaatgagaataaatttcatgtttttgtttatcagcacagtattgctctcttttgagtagttggtttgggattatgaataagtgaggacagtggtgtgtatttaagtttttgaagaattagattgtggggggagagagtctaggaggagacgtgattgttaagtgtttgttttta

SEQ ID NO: 47411 - DNA, 1076 bp, Homo sapiens
tgcctgtggcaaattatgttgaatttaagccttgtcttccactaaaacagctaccttttgtccttgggaaagttatgaactaaacaggtagcgagcattgagaggccttaggagaagactaaaaatcatgtatgatttttacacatgtacagttgacccttgaacaccactgagcttaggagtgctggcctctcccctacagtcagaaatctgcatataccttttgacttgcccaaaacttacctactaatagcctactcttgaccagaagccttactgataacgtaaacagtggattaatacatgttttatatgttacatgtatgatatactgtattaaagtaagctagagaaactattaagaaaatcatggccaggtgtggtggctgatgcctgtaatcccatcgccttgggaggccaaggtgggcggatcgcttgagctcaggtgttggagacctgtctgggtaacatggcgaaaccttgtctctacaaaaaaaaaaaatacaaaaatttagcagggagtggtagtgtgagcccgtagtcccagctacctggtgttgggggcgggggcagtggctgaggcaggagccttgggaggttgaggctgcagtgagctgtgatcataccactgcactccagtctgggcgatagagtgagaacctctctcaaaaagaaacaaaagaaaatcacgagagagaatatttttagtgttcattaagtgtaagtggatcatcataaaggtcttcatccttgtcttcacactgaataggctgagaaagagaaagggttggtattgcggtctcaaggtggcagagatggaggaggtagaaggagaggcaggcacactcagtgtaacttatattgaaaaaaattatcatgtaagtggacccagtgcagttcaaacccttgttgttcaagggtcaactaattgtttttttgctctgtgggaagctttatggctctatttccagttcagaaagtgctgagcgtgtggaggtaacttaatttggcctttatttttctgcttaattacatatatgtctgaaagtattgtgaacctttttgtacttggatct

SEQ ID NO: 47412 - DNA, 1022 bp, Homo sapiens
ttttgggaaaatgatacggtttatatctatatatatatatatatatatctatatatctatatatatttcaaattttttattttatattaacttgatatgaagatggaaattgttgggtaaaattaattgtggttgatagttaagattaacatacgctgtcatgagctttgaaagagtaaccatgagtcagattgttaatattgatcatttattgtgtcattttacaaaattattttcaagttataggttgttattagtgctatgtttgtggcatcctgtaacggtacagtctaattagagatcaggcagtatgtagtattttattgtaattattttgtcttttaatgtgtttagcccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaagcctgcagaaaagccagcagagacaccagtggctactagcccaacagcaactgacaggtaggaactggattctaggacattctatctcaaaatccgtgtttaacaggaacttcatgcatttattttgattattgttttgatcaaaccgactatatctattacgttaagctttttttaaatgtttgactaaaacatatgctgcgtctgttttgatagcttactaaggagaatataagtacaaattttcataatcagatttctgtactctgttgatttgggcagggtggggggcagtggaaaggagaaagcaggtgaaagtcatttttttttttttgagtagaaacgttaggaaatacaaataaccaaaatgaataaggattacatcatgacattgccaccctgatcatcatttgtacttgatctgtattctttgtggtcattgtcatatatatcata

SEQ ID NO: 47413 - DNA, 1052 bp, Homo sapiens
cctggtctgtatccattagatattttttcccccaggagtcatttcagaactgtcaagtgtgcatcaaaacctctttttggattatcttaagctagagttgcaaactcaatcctttttatcactgagtaacagctgataaagatttctaagaagttaaaaagtcaactgaactaataggtagcacaaaaacctttggttgtgttcagttttaagaaggtacatgtatcaatatttttcaaatttgatgctaattacgtgtgcctggtaggtgtcttattgaacaacacagagaatatttccatcatcatggtaagttctgttggacagtgctgctttgcattattatagcaatgtgggtttttctataatgcacccaggtcatttctaatctaatttgaatccatgcagcttaataatcctttacttttaattgaagcagacatctgtttgatgcttttgaaaatcaaacaagatgttaaatagactataaatcttttactctgtataatatttaattttgcatgatgggatatcttaaagcttggaaattctattacagggaatccctggagatagagaaagtcaggctgtggttgacccccctcaagcagctagtactggggctcctcagtcttcagcagtggctgcagctgcagcaactacgacagcaacaactacaacaacaagttctggaggtaaagcggaatcttctggatggggagggaatggccctgaatttttagtgtaaaataatttaacctgaaatacttcagaaatgacgttcattcccagagcagtcgaataattcgttaagttctctcttcactaatgtttgagaaaggcccaaaagaaactttcccaagtggatgtaaaaggtatccttgctgatattaaacatcagtgttgcagttttgccgaagggcatattctgttttatttgttttaaggaaaagatgctttccagtttgtatttagtgttactttctgatgccattcagaatggtttgctcactttgtctcttactctctccataaatgttacaaagtgtatg

SEQ ID NO: 47414 - DNA, 1060 bp, Homo sapiens
gaatgcccactgctgctccttcccatctcgaggaactgtctcttctcaatgttttcttttgatttcctctgacagtcttgctgctcttccagaggcacaggaactcaaaattgggaagggtttgaaggtgacccccacgatcaagtgcagtgcctcccgcacgcgtgacttccagcctccacatgcacacttccaataactgcacacacaccctccagctcaggcctcttggatttcagacactccagtggttgaagggtcgctatgttaggatctctgatcttcctctctaaccaggctatcctcaggttctagttcacttctgggggtcaccctgagccaatgtaacccctctttcctgtgtcaatcctttaggtctttgagaagagtggttgcgttttctctgaccgtgtcccaccctctggccaagccttcagctgaaaagagtccctcagttggggcgagtgtattgagtccttcattcagatgaacccgatacttcaggaggggctgagcaataggcactacaggggagccctcacctcccttgttctgtgcataatacctctattaatacagcctaaatttggtcttgctgatttggcagccacatcacactgtgcccttagactaagtgactgtgctaataatacaccagacttttcaaggtgtctgtgcctttgggggtcatgtctgacacatgttatagaagcagaaacagcctactaaacaaatactgctgttttcataaagttatgttctggaccaagaaaattgagctatcatttacaagtccagtgtctcaccctgtgctaagtgctcgtatgaggcacttttgcaattttacaaatgggataactgaggtcagtcagggtagagctacacagctaccaagtgacagccaggtggcaaacctaagttgattgattccgaagtcaccctaagtgacactgcctccctatagcccctgctccttcacattccctgagccagtctctatcccgcctgtgatttctttctctctctgctgttttgacagttatttgttcctctggtgatt

SEQ ID NO: 47415 - DNA, 1062 bp, Homo sapiens
agtttaaactaaaaaaaacacacacattttttattttgtcatatttgttccaaatacttttctcagtttcttgactgcttttttattctgtttctggtgttctgaatttttgtatggtcagatctagaaatatttttattttttctcccccatggctcttaaatacttcttgccatgaggatggggcattaaatcatgtaaaaaaggaagattggtagtgtaagggaaagagtactagcctatattcattcaaaaagcatgtattaatgtctacttaacactgtgtgtgtgtctgtgtagggacacagagatggacagtgtatgattctctccaggaaacagggctccagttgagaaaggagcagacaaggaaggcttcctggaggagagggcatttgagctggacctgggcaactgggaaggcatggggcatgtgggtatgaggaaaggagaagacagagctgagggaattgctgaggacagaagttgtcatattcctggccggacacagtggctcagtgcctataatcccagcaatttgggaggccaaggcaggaggatcacttaagcccaggagttcaagaccagcctgggcaacagagtgagacccccgtctctatttttaaaaaacacaataaaataagttattgtcacattcctgtcagagggagcaagaaggcactgtgtgtgcactgggcaaaaaaaacttaaagtgattggcttgtggaaagagagttgtgttcaaacaagtcatcttcacatgaaggtttggaattccaaattgactttgtccacaccatatgtgcaatattaactagaataccttggggatggtgacatcgtaaaccaaagtggaaatagaatgatgggtttcctctccttcttgaaggctgctccttgaagtaatacagtttggtttttgttttgtcttttcttctttcttatcctcaatttctatggagtaatacagttgtaattcaaataacatgaggcagggactaggtaactcttgcaactttgaaggcggcctctggacactcttcaggggcttgtggaagaagc

SEQ ID NO: 47416 - DNA, 1035 bp, Homo sapiens
gtctgccctccctattcatgggttccatatccacgccttcagtcaatcttggattgaaactattggaaaaaataatagatagctgagtctgtactgaacatgtacagactttttcttgtcaccattccctaaataatacagtataatcaactgtttacgtcgcatttacagtgtattaggtattataaataatctgaaaatgattaatgtatgtgggaggatgtgagtaggttatatgcaaataccatgctattttatagggacttgagcatcctttgattttggtatccaagggggtcctgaaaccaattctctgaggatactgagggatgactgtatgatgttgtcaggacagatttgctaacagcgtgtgtttgtttgtgtgtgtgtgtgtgtgtgtgtgtgtgtgtgtatgtgtgtgtgagagagagagccaattaagagacagagggagttgggtggggggacttatggccacatcggtaaatggttttatgctatgctttggtctagtgcctactcttctgaattctgcaaaccctgactctctcatcactttcctggagttctcaggggaccctgaggagatcacaagcctgcccccagaacctagcactcctgaagtctctctggagatgtgagggaagaagacaataggtcctcacatcttcacttacttgggcttctctctcagaggcagagaatcgactgggattccagtctgcagggccttgggcagtctttagtctgggtctcagctccttcatctgtagaatgggttcatgagttctacctcctgggctggttgtaaggtttagttaggatggaggtgaagcacctggcaggtagctgtcattggatggtgttgagcagagcccttagcttttgtctgtattgctgtcttgtcctgtggggggtcagaagcaacatctctgaagtggaatgtgtattaatgacttttttttttttttagacagagtctcactctgtcacccaggctggagtgctgccatgacagctcgctgcatcctgaaa

SEQ ID NO: 47417 - DNA, 1035 bp, Homo sapiens; identical to SEQ ID NO: 47416

SEQ ID NO: 47418 - DNA, 1035 bp, Homo sapiens; identical to SEQ ID NO: 47416

SEQ ID NO: 47419 - DNA, 1035 bp, Homo sapiens; identical to SEQ ID NO: 47416

SEQ ID NO: 47420 - DNA, 1771 bp, Homo sapiens
caaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggtacccaaaagaaaaagcgctgtcaatgctgtgttgtcatgtgaccacttctttcttctcctttcttctgggcagcctgtactctccaccactcacgtagacctcactgtaccactaactgcaatactgtgaactggaagcaaacacctgccttgccttgcagttgaattgctttgatctctctcattttttttccttttcctcacctgagagacaacgtgcatgtgtgtgcttcattctctccaagaacttgcttttcctctaaacctttccttgtgtcttcaagagtgaatcacttccttcctgctcgattggaatggactcttcgtatcagccagtgatatggtagccttaactcacttgactggaattgaacccattggcactgggggtttcattttgtagtgtgttcctgtaacgtagtcacacactgccatgtctctggtttctcacttgcctcctttgctgtggatctttgtttttatatcttgtgtggcaaaatgctgttggctctagccggttgctagtgtagccaaaagtggaccttacttagtctgtccgatctagggtgatgctttttgctgccttacataagcttccagattacagtattgtgcattcatggctttctttctgttaaaactgaaatgaagtcaatgtagaagaacccagagcttgtcacagctgaaatgtagggactgattccataacctgcccatcagcggttgtctctctttctatggtttaaccgatgaaccctttatataagaagcaccattttaaaatttctaaggacatgaaacaaacattgtttgaagcatcagtagcaattgatctccaaacttaggcaaattcacaagccttgtttctattctcttaaaaaaatgtaaatttttatattgtttcttttttctggatattttctggtcatgttaatctattttcaatgaggagatcatcttgagaagtatctttgcagtgaccatatttctaaaacagtctgtccaacctacaatggttgccatgatgctcccacttcatcatggatggtgctgtaatgcattaactgttcatctcctccccagttgattacaaagccttgcatccatactcttttctttctggccccatgagaaagagaatgttttaggtaacttcaacttgtaggtttatctgccctt

SEQ ID NO: 47421 - DNA, 1025 bp, Homo sapiens
cagtttcctgaagctcttcccctacacctgctcctctgtctggctaacagagttgtcatgtctcagaaactactcaccactcttgtgagactctcttcccaagcatcatccttcctcaggatgaggcctttttctactacccaagagatcaagaccctttttctaacaagacaaggttatatctactccattttcaagagaaataacccctctggttcccatgcaaatcgcttaaattccttcatcaccagaatctctccaacaggcccaactccagcccagctgtgaacactgctgtcatggagacaactccaaaatgaaagaactatgcaattgcctgaaggtgctaatggagagccagtttactctaatctcttattactaaggaacctctcggtttcgagattaagtgggcagggagacatccagtcacttagttttgcaatgacaggtcttgatatacacagaggccaccaggcaatgcctgatccaaactattctgtatgtagctccaactccaattctgtgatatcctattctggcaggtgggaagagttctattctttgcagggttctggaacattctttcctgctctcaagctcctgacttaggagagtcaaaatcatacaggggttccagaaaatgttgtgtctgatgcagcttctcagtgaatgtaggttgttggtgaaattttcagctttagcatctcactcggggtgagtgatgtctctgtaaatactttcatttgtggttggttggtgggggtgggggtgggagcctgtcgtgcttactctgaattagcttactgggctagctgctgtactttgtaacctgaagtgtactttgactgttctgtttccttcagatgaaaaacaaaataaaaaccgacttcagaaaagacactaccagcgacagctgatgctgtacttgtagcttctctctgttcctctgtacagtattaatagacaataaactgccttttcactgcatctacctctgtgtgtctgtgccctgattctttccc

SEQ ID NO: 47422 - DNA, 1053 bp, Homo sapiens
gaaattctgggttgaaaattctttcctttaagaatgttgaatattggcccccactctctcctggcttgtagagtttctgctgagagatcaactgttagtctgctgggcttccctttgtgggtaacctgacctttctctctggctgcccttaacattttttccttcatttcaactttggtgaatctgacaattatgtgtcttggagttgctcttctcgaggagtatctttttggcattctctgtatttcctgaacctgaatgttggcctgccttgctagattggggaagttctccaggataatatcctgcagagtgttttcaaacttggttccattctccctgtcactttcaggtacaccaatcagatgtagatttggtcttttcacaagtcccatttttcttggaggctttgtttgttactttttattcttttttctctaaacttctcttgtcacttcatttcattcatttgctcttccatcactgataccctttcttccagttgatcgaattggctactggggcttgtgcattcatcacgtagttctcgtgccgtggttttcagctccatcaggtcctttaaggacttctttgcattggttattctagttagccattcatctaatattttttcaaggtttttaacttctttgccatgggttcgaatttcctcctttagctcggagtagtttgatcgtctgaagccttcttctctcaactcgtcaaagtcattctctgtccagctttgttccattgctggtgagctgcattcctttgggggaggagaggtgctctgatttttagagtttccagttcttctgctctgttttttccccatctttgtggttttatctacctttggtctttgatgatggtgatgtacagatggggttttggtgtggatgtccttgctgtttgttagttttccttctaacagtcaggaccctcagctgcaggtctgttggagtttggtgaaagtccactccagatcctgtttgcctgggtatctgcagcggaggctgcagaacagcagatattggtgaacagcaaata

SEQ ID NO: 47423 - DNA, 1033 bp, Homo sapiens
aaaatacaaaaattagctgggtgtggtggcacacacctgtaatctcagccactctggaggctgaggcacgagaatcgcttgaacccaggaggtagaggttgcagtgagccgagatcgcgccactgcactccagcctgggtaatagagcgagatgcagtctcaaaaacaaaaacaaaaacagaaaagccagtaagatggctacccctcagaaataaagtaggaagctgctacaagctagatttttaaagatattgctggttacaaaagttcctttcttctgtggcgtgaactgtccaggaccctcatactggaaatgtcttggccttatccagctggtgccttgctgcaagtcccaaatcacacctgcttggctgtgcatcattttcttgaattttgtttatccaacgactggataaaatgacatcaagtaatccatgttaaagaagtatctctaggataaaaattttgtgatttggctgtcatttccatcaaatacaccaactaaatcgtagatgctctctttatcttgccctcttgtccatatatactaagactaaaaactaagtgtttgcaaaaaagaatacaaaaaattttagcacagcagaattttcctcagaatgaagtctggtattcttatttacatgttcaatatttctcatttatgcttgaacaagaaacaaggttggtagcccttaggcaaactagagattctggctgtaaaaccgtttgaaaagggtacatttctattcaaggacatgggaaagccacatttaaaaaaggatgttgcttctctacacgtaaaacttgttggaagacagattatcctcctagaagagcagatgttctctattacaaaagaggaaaagcatttagactcttccggtggtgaatagaggccacaggttacagctttctttggcctttgcttttaaaaaaacattctgctgaaggccttttgttgccagtggtgtccagccggttgccctttgtatttgatgatgacgacattgaaaggattgttttgtgcagggac

SEQ ID NO: 47424 - DNA, 1033 bp, Homo sapiens
ccaccacgcctggggaaggggcctcttttggtgaaaaggcaagggcactactcctattcattagtgttctacgcttacgacctaatcacctcccagaggacccacctcctcattccattgtattgggaattagtcttcaaaatatgaattttagggagacacaaacattcagaccctagcagggaccctggaaaggattctcattgtgcagagtatggataaacagtgatgctagggcagtttttccagggttgtcagaaagggctgaactagaagtttccccactgtgcctggagtgccctgggttggttgagtgtagggtttcgaagataattttgtcaggactctttagtttttagtcttttatgagttagaagagtgtgcatatgtaactgccaccataccacagcaagttccagcaagagagaggattcctcaggtggccatcctatccaaactccatggctctttccagggcgtttgtgggaaacctgtggggctaggactgagctagactttttcagtagctgagactggtcctgcagacccatgaaaggtgccatgccgtcacccagtagggggcagggagggaccctcatttgcccctcttcccgcccaacagttgcctgacttcagccttaatgcatagctcatccagagtcctcctgagctcccacctggtgaggtgtgtgtagaaggtgtgaggaaggccaaaccacattttcctggcagtggttaactgaccgttttcagcccgcctcccagtgcagctgactgcgtcagcttacattaccgtgatgtcattcccatggtgggataatatagcatcttactttgtctggagtggtgcctcccataagttttttgataccgcctacaaatggagaaagacatcattgtttagccatttttatttgggtgggttggaggaatgactttcccaaaggaataaatcttagttaatattccagaaaattcaagtacttttcaaccctaattgaaaggcactctgtgtgcgtgaattaaaatcaag

SEQ ID NO: 47425 - DNA, 1025 bp, Homo sapiens
cacacgcacatacacataccatgtagcattctaatttttagaaccagaaatgagcttttaaaaagtcaccataggctgggtgtggtggttcacgcccgtaatcccagcacattgggaggctgaggcaggtggatcacctgaggtcaagagttcgagaccagcctggccaacatggtgaaaccccgtctctactagaaatacaaaaactagctgggtgtggtggcgtgtgcctgtaatcccagctacttgggaggctgagacaggagaatctcttgaacccaggaggcagatgttgcagtgagccaagattgtgccactgcactccagcctgagcgacagagtgagactccatctcaagaaaaaaaagaaaaagaaaaagaaaaaaaaaagtcactgtaagagatgaattagaagaatgtgtcttgaatgcgggcacaatttatttttgttgtcaattgacaatcttgaaaaaattctggccgaatgtcggtgtgccagctgtttcatgcaccagacctgtagttcacccctactcttttacctgtagttcatccctactcttctaaggcttgaatggaaaataatttctaatttgttgtaaaatttaccaatttggtattgctgctgtaaacaggattttatctagggtttagatgccttatcttcaaattccactatcaagctagtacataaaattgtttgaaaactgaatcagatgtttatgtaattcataaaaacatataatttccctctaatatttcatttttcctaattataaaaataatgcatgcttattatagaaatgtagacataaaaaactataaaaagaagaaaagaaaactcaatccaaatcttaccactcagaaatgacgtgccactggtaacatttagacttatttcctcctaatatgtatattttaaactgccctcattctctttttttctttctttctttttttttaacctctatagtcgctcctgtaaaagctgcccctatgcttgtaacattattctacaatggactt

SEQ ID NO: 47426 - DNA, 1060 bp, Homo sapiens
ctgtggcagaagtagaaattgctgtcagccaactgattttctgattcttctgtctataaaagctgtgcccattgttaacttaggtgataagttgaatttttagtttttttaggttttttgtttgtttgtttgtttttgaggtggagtctcactccgttgcccacgctggagtgcagtggtgcgatcttggctcaccacaacctccgcctcccgggttcaagcgattctcctgcctcagcctcccaagtagctgggattacaggcacccgccaccatgaccagctaatattttgtatttttagtagagatgaggtttcatcatgttggcaaggctggtctcaaactcccaacctcaggtgatccacccgccttgggcctcccaaagtgctgggattacagacgtgaggcactgcgcccagccaaatgttaaaagtatttttgagcttctcagaggaaaccaatgaactgaagttcaataatctgtggtttgtgttacaatattttgaatccttccggagactgaatgaaagatacatatttaaagtgaatgcagtaagtaggaagaggcactgcttcagcctggtaacatgcagttattgctttgagggtcttgcagaaagaatatgcacattgagtaagtaggagaaggtgtgtattttggaaaaatcaatcaacttagttcaacttgaaggttttcctatctgaaaagggatgtatcaaaagatattttttcttaggaggaaaaaatccacaactcgcaccagagcatttcattgagaattactgttatttacgttttggaatttacattgttaaaaagagagattttggaaaggcaggggtgggactagaattgtggcttgcatgttgcctataaacatagattcctttttttagatgtctgtgtttcttagtggattatgttcttaaaatagaacataccacattactctctggtttggcagggtgtggtgttttgtttactgcttgggtcaatgttctatgaacatgaatcttttcacagagaatcccagggctaaaagaattcttagaggtgagc

SEQ ID NO: 47427 - DNA, 1020 bp, Homo sapiens
ttacaaacatgatggaaggcaaagggggagtgagcacttcatatagccagggcaggaagaaagggagtggggaggtgctacatacttttaaacaacaagatcttgtgagaactctattatcggaatagcaccacggggcgggggggcgggtaatctgcccccatgatccaatcacttctcaccaggccccacctccaacattggggattacaattcgacatgagatttgggtggagacacagatccaaaccatatcactcctttatcttgccatgcctttgtcttctcactcttctgcaaaaagagctttggggtttactgtagcaaataatggaaaacattaaagaagtattgttagcatagttcttttgctttcaatttttacctaagttattgtccaattttacattctgaatggtgaactgggtggcctggccacactatttggctgcctctggcaaaaacttctgccctcacttctgaccattacattttccccctaccgtatgtgtagtactctggattggtaacgtttgatgggaaagaaaacaaaatcagaaagcaacgattctgagagcaggaataaggaatgttaagtcccctttttgacggctgggctttttttcttatgccaagtttaagtgcaaagcagcagttcccttgtgccctgggacttttgcctaggaacaagggactgccagaaaacctcagaaaatccccatggagatgtctctgaaaaccatgtaaacagggacattgtctaagtgggtcatcctgaatatatgatgcaggatggaaacctatttagttattgaatatttcagattaagaggacaccgcagccttgctttgcacaatcttgctagctttgtgagtttcactggggattggaggggaggcccgccttcaacttgagctgcttgtgttttggttggtggtaatgccttagaaacagaaaggagccagctccccttcagccactcaggcttctgcctgggtttccttttaaccctggaattt

SEQ ID NO: 47428 - DNA, 1188 bp, Homo sapiens
agtggctaccatactggatagcagagatacgttttcatcattgcataaagttcaattggacagcactgatctgctgcgtgtagggatctgctttatctgaaaacttgatgcagaatcacggctagttcaaagaaacttgcagaacatttcatgaaaattaaatttctctatggtgaaaactaggggtcaagtagcagatgaatactggctgtgagatgaatgcataaccagaacctcccattcccctttttccagcgtctctcctatctcccagcagtgctttatcactttctcctctcaagttgataaagagaaaggaagaaagaaacagagaagtcggtttatgttcataattaacatccatgaactctgcataattttttcccctctctttacaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaac

SEQ ID NO: 47429 - DNA, 1102 bp, Homo sapiens
taaagaaaattatggctgggcacagtggctcacgcctgtaatcctgacactttgggaggctgaggtgggtggatcgcctgaagtcaggagttcaagactagcctggccaacatggcgaaaccccgtctctactaaaaatacaaaaattagccaggcatggtggtgggcgcctataatcccagctactcaagaggctgaggtaggagaatcacttgaacccagccggggcagaggttgcagtgagccgagatcgcaccacttcactccagcctgggcaccaagagcgaaactccgtctcaaaaaaaaaaagaaagaaagttatccttttaattgagcagggcttttctaggcctttgctggtatgtgtgtggatatatttctctgaaccaaaccaagaacgatgtttttaggactaacaacagtttttttacttatttaatgccttaatatttcttcttgacagtttctgcaggactgtaaactggattcctggaacctttgatattcctggctgtgtatagtgcctgttggtggactgtactgatactcaactagagtgtgaagggactggattcctgcccctgagacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcacaacatcctgagagtagtgaggaagtggtgaccctaatagaagatttgacccagatgcttgaagaaaaaggtgagatttatagatggagggaggaagcgggagacattgcctcaaagtccgaaagtaaattcctcaaaagaaggcaatttactgctaaagaggagtctg

SEQ ID NO: 47430 - DNA, 1028 bp, Homo sapiens
agctttctttggaattcttaaaaacttgcatgctatccaaaccattctttatatcctatccaggctgggcacagtggctcaggcctgtaatcccagtgctctgggaggtagaggacagaggattacttgagcccaagagtttgagaccagcctgggcaaatagtgagacaatgcctctacaaaaaatttaaaaataagccaagcatggtggcacgtgcctgcagtcccagctactggtgggaggatcacttgagcccaggaggttgagcctgcagtgaaccatgaagcaccactgcactctaacacgggcgacagagccataatagcctgtctcaaaaaaaaaaagtacttaggttctatttgggaataatccaatacaaaagagctgtttggtgttctaggaatctataacattgaaggatgtagctgtgaacttttcaagaggagagtggaagaagctggagccttttcaaaaggagctatataaggaagtgctactggaaaacctcaggaacctagaatttctgggtaaagacaccttttcttcattacctagcgtttaaccttgggtctctttttgttcccttttattgaaaggtaagtgctgtgtgaagtacttggttttggctggggacccagggactgataggactaatcctaaaaactggttctgaaaatgtgcttttctgcagcgtatcttctagaaaaggtctttgcttcattgaattggaaatgtgaagcatcattttgatttcatcagtggaataccttttcccatttttgtctcaagttccagtatttatgtctgtgtattttggtagcatgtttttatcttccttggagaaccagaggctatatgtgaatgctgggatatctttactctatgcaaaacagcaattttctgttcttttctctatgagcagactttccagtttcaaaattagagttgatttcccagctaaagtgggttgaattgccatggctgctggaagaagtctcaaaaagctcccgactaggtgagttggtga

SEQ ID NO: 47431 - DNA, 1066 bp, Homo sapiens
acaagggaactctttttcttttgggcattggccaacaggactgagaagccagagagcttgcacctgagccatctcagccgtgagagtaacagtcctaggaaaatagatgggggctgggggtaaggaaatgtgctgaagacagagctattctggatggattttggtttgcaaaaattctactttaaaacaattttgcctgtagcaagtacatttttttgcaattggagtgtaaacattctgtgtggcaacagttaaaagctgttataacaatttgcttgggtgtgtgtgcatgtgtgtgtgtgtgtgtgtgtgtgtatacattgttgccactatctaaaattagggcatttcatactaaaaacaaagcttgtcttaaaaaaaattataagggctaacaacactgggcttttatttatgtaaagcactcagctggtcctgggtagcagctgccaccttttgatggggaatcaactttctgacttagctagttctctcatgtatgtcacctgactttcccactgtatgaatgttctattataacccctaccatttggagaatagataccctaaaatctaaagagactgcactgatagcaagtaaagttcagggaatgaatgtagaattgatacagaaaaaattttcagttaagttttcttttgtgaaattagacctcagaggaatggaatatacgggtattggtggattattccttataaatttcattggtggagtctgaataataatttccaactgaaaaaggaacttaaggccctgaatgagtgaggttttggcttcaggtcatagggttctggaggaaccccatggactcaacagtggtctagaaataagttcctaaagttgaaattgtgggcacctcctataaaaagagagctaaaccagaaaactcttcacttatggaagtaaagcgatccttaatgctaatcttagactcaggaacatttactgtgactaatgtatgtaggtgtgaaatgctacctctgggagaaggtttttggtgcctccccaaccccaagcctgcagtttaaatattgccgtgtgataaat

SEQ ID NO: 47432 - DNA, 1033 bp, Homo sapiens
aactctgttggataatatttatcaaagtcttgatttcagtagttaagtctgtataattgcctgcaggacattcagtctggcccatcacccaaatatttaaattcacttttggattaagtcagattatcaaaaggctttaaacgtcttttgattcattataggattgcttttatgaagagcactgtgacacattttactttaaaatgaagtccttgctttaaataatgtttcctcttaatgagcgtgtataaatttttttcatgtcacaggacaaggcaaggttttggtcaataaagtcattttatttattttagaattattttttaatgtagtaagatacatatagcttaaaatgaaccatttaaacactttttggttatacagctcaatagcatttagatagatgcacattttgtgcagtcatcaccactatccatctccagaactttttcatcatcccaaactgaaactctgtactccttaaacagtaactccccattttctcctcctcaggctcctggtaaccactgttctacttcctgtctgtacaaatttgactgttctaattacttggtatgaatggaatcatacaatatttgccctgttgtgtttggcttattccacttagcattatgttttcaaggttcggccgtgttgtagcacatatcagaatttaattcctttttaaggctgaataatattccattttacttgtataccacattttgtttatccttttatctgccagtgaacatttaagttgtttgcaccattttggctatcaagaataacattgctataatcagtggtgctttctgttcttttaagtatatgcctagaaatagaattgctggatcttatgatgattctatatttaacttcttgaggaagtgcaactacactattttaaattcccaccagctatgtacaagggtttcagtatccccgcccttgctaacacttattttctatttcttttttataatagacatcctaatgggtttgaagtggcatcttattctagttttgtttt

SEQ ID NO: 47433 - DNA, 1097 bp, Homo sapiens
taatatatccagaatatataaagaacttttcagataaatgatttgcaaatactttcttccattctgtgtgggttgccttttcattctattcctaatgccctttgaaagaaggttttaattttggtgaagtttaatttttctattttttcttttgtttcctgtgcttttctggtcatacccaagaaaccatggccaaatccaatgtcatgaagcttttctcctattctaggagttttatagtttcaggtcttatgtttaagtcttttaaccattttgatttttatgtatggtaaagggtccatcttcattcttttgcatgcgaatatccagttttcccagccccatctgttgaagagactatcctttccacatcatgtattctttgcactcttgtcaaagatcatttgaccatatacatgcatgtttatttctggctgtctgctctgtttctttggtctatatgtttgtctttatgccagtaccatgctattttgattactccagtaatgttttgtaatcaggattacactacgtttcctgtagtatgtttttgaaatgaggaagtgtgaggcctccagctttgttctttcccaaattgttttggctatttgggggtccttaagatttcaaatgaattttaggatggtttgtttgtttttgtggaaaatggcatgaagattgggcttgcattgaatttgtagatcgctttgggtaatgtggacatactaacaataacaaacattacagtctgtgaaccccaggtgtctttccatgtatttgtgccgtctttaattttttcagcaatgtgttacagttgtcattgtacaagtcttttgcctccttggtcaagtttattcttgagtattttatgtttttgatgctgttgtaaatgggtctttgttagtgaagcataactgagttttgagtgttgattttgtatcttgcaactttgctgaatttgtttattagtcataatagtttcttgtgaaatttttgggatttttaaatataagattatggcatctgcaaatagataatttttccttcttcctaatttggatggctttaacttgccaatggctctagctaggacttcc

SEQ ID NO: 47434 - DNA, 1084 bp, Homo sapiens
cacaactacaactattgacatcacaaactactactattatgttattggaactaactacttagcaaatggaattgatagttaatgggttttttgtttgtttgcctgggagcattgtggaaaaatggccatggtactacagatcctgtaactaagaaagtcaacctctgtcttagaagtcacttctactcttccgttgcccagagatcaatcatataaccctaacctaacttaaagggaggcttgaaatacagctttcccctcattgtggtgagcacatagattatttctaccacagtctgttctttcggtcaccaaactctttcttcccacacttaatgcatacagtagcccccttatccatgggggatatgctccaagacctcgagtggatgcctgcaacctcagatagtaccaaaccctgtatgttctatgttttgtcagtctgataacccaagaaggctactaagtgactaacagacaggtagtgtagatgacatggatatgctggacaaagggataatttgtgtcctaggaggcacggagcaggatggcaagaggtttcatcaggctactcagaacatactggaattttttatttctggaattttctatttaaaattttggggccaagattgagggtaactgaaaccacggaaagtgaaactttgaataaggggagaccactgtattttacccaagggagacaatccaaagtctaatctgctcagggtctacaactgaagtccagggtctttgagttagatgctttgagtgtgacctactttttgcctttgggaccctaaatgtcagtgcctgttaatttttctttgagaagtgtaatttctccagaggtctgctctttaatttccccagagaaggatgttctagtcagcatgggggatataagcctggctaccattactggcgagcaggcagaggcacgccacatggtgggataggagttggagttcatccccttttattcagacttccacttagtatcctgtttttagtcttctatcttatttccatcctcctccaggcccagggtacccaagttaatagcctatcaagttctatttgg

SEQ ID NO: 47435 - DNA, 1083 bp, Homo sapiens
agccctggaccagtgtgtgaaatcataatgggatttactagggatagtaaaattgataggattagggatgttaatcatgttaatttgtttcaggcgcgagatggtaataaggttgtggtgcttgaatttaggttgagtgtcaggaatgcagtagttgttaggatgatatagataattaggttaaagatagtgatatttggattgtatatcagttatcccattatgatttcacacactgctttataaactaagaccatgcaatagtatttagtgtgtttgacttttggggatttagggagtttatggactttggaagttaaacaagtggacgcttaccctctgtgtcaacccatcttctggaagatggagaacttccagaagagagggcagcagaaacactgccagctgttgccttctgctgggctttgtaggagtggagatgagtagttttggcatgagaatggtgagcatgttggtaagaactttgaaaacaagtgccatgattagagggtagaaatagtgatggtagagattcctgctgggagggccaccaggagagactgatcagtgcccccatcccggaactgatctgatgaatctatatggttgcctctaaaggtttctacccctaaagtttaccactcattgtcagctaatgaaaagctagataaaataagtgatccactcaagatcaaggaacgtttaggcagttaaagaccagtatgtctggagtaggtaacacttgtactcttgactctgacgggtttgtgatagctacaaatatcttggaacaggggagtggaagtggagttgtactggtggaggagggaatgaggggagtgttctgtagctcccccagaacgcccactgtcttactgtggaaattatctgtgagacaaaagggatgtctggagatattttggaccctggaaaatcagacccagcagaactctttgaaaacttgcattttaaatttatggagatgaacatatattcatcttccaagtggagcacctccaagaactatttacctcattgaagatgctctctcttggaataaggataaggactttgacttgctgt

SEQ ID NO: 47436 - DNA, 1083 bp, Homo sapiens; identical to SEQ ID NO: 47435

SEQ ID NO: 47437 - DNA, 1083 bp, Homo sapiens; identical to SEQ ID NO: 47435

SEQ ID NO: 47438 - DNA, 1083 bp, Homo sapiens; identical to SEQ ID NO: 47435

SEQ ID NO: 47439 - DNA, 1050 bp, Homo sapiens
ttgataataaatgcatcaccaaaatggaaactataattatgtaaaacatcagtggatttatgattctgaggtggttttggtcaaataaatgcccttttgagggggttttgtttttttttttaggtggtggtggttaaaaaataagtacactaacatgacttaaatacagttggtaagacaagaagatatgacatttgatcatcactattttagcaaaaagattttacctgtgcatggagaaatggaggaaaaccaaaaaaaaagaagtgtgggtaataatggaaggcaaaggcactggcctcatgctttcaccaagtcatgcttagttcagattcccaaataaattacagttccagatctcagcaaaacttcaaaccattatgatttcacacactgctttataaactaagaccatgcagttgtatttagtgtgtttgacttttggggatttagggagtttatggactttggaagttaaacaagtggacacttaccctctgtgtcaacattggatctcatgaggtagaataatctggtcccacttacatgtttttaaagtggctatagcacttatcacactgcatttaagtactgagtaggtctctctttcctactaaaccatgctcctcattttttgtgcgtatatccatagcacctagcacagtgtctggcacatcagagcattaatgttataaaaactcttatctggaggcattcagatagaatggaaatggaaagtggatttctggcattttgacattggtatgtgcaacgccctctgccatttcactcaaattaattgcagttttaaagagtggtatagataagtaaattggacggttatgagtgaaaaattcctgcatgagagaaaaattgcacttctacttttaatgttctgagggtttttaagtgagaatgataatttttgaatgtagataaaaattggataatacatgaaatatgagaaatggcatagaaataagcagatgagagaacaacttgaaaggatgcacttagaaaaactatgattggtaaaaaatgcaaaagcgt

SEQ ID NO: 47440 - DNA, 1050 bp, Homo sapiens; identical to SEQ ID NO: 47439

SEQ ID NO: 47441 - DNA, 1050 bp, Homo sapiens; identical to SEQ ID NO: 47439

SEQ ID NO: 47442 - DNA, 1050 bp, Homo sapiens; identical to SEQ ID NO: 47439

SEQ ID NO: 47443 - DNA, 1046 bp, Homo sapiens
aaaggtaagatattaaactgttttaaggtttaagctatgttagccacagtagcatattttcataaactatgaattcaagcagtcacttctgccaaactgaagtttttatgacatcgccacccatccagccttgctggtgagatggagacctatgtagtggagagatgcatattgcaaggaaaaaccttcacaaaagttcactcgtttttgaaataatgtttactgaatgccaggcactgtactaggccttggagttaccctacctactttccagaacttctcattctaagaaaagaaaaaaactgatgattacaatgtgataagtgctataataaataggtaccaagtgtaataagaacgatccaactgtctggggcagtaatgtttacattctaaaggattaataggactcatgaggttcaaattagagagaaatagacatttgaagacataggtatgaaaaggaacattgtgttggaataacacaccaaattccagaaattgctgtctgaatgtttgctatgggtaaaagaggggaaactgataagggatgttgctaggtaggtaagtttggaccagttgtgaaggcctggtggcatgcaaaggaaattttaactttggccatgggaaagcactggagattaaaaaaaaaaaaaaaattgtgtggctaccttagttcaagatgagtacgaaaaaaataagaatgtaccttagctttctacttgagtcccagaaggatggtccttcttattatgtcttttctttgctaatattcttggtatcctcttgttcttactaggttgattctaaactttgtaggttactaaagagcagaattttgacttaggctgttgagaactcctaagttttacctatttgtgctgctcttgattctaaagtatatgcatgcctcactgatcatcatcagtatgcatgaaaactgatcattttcttcattttggagagaaagctttaagccctagaatggagataaaataagttgaataaatgctgtaacgaggaagtggccaactttttagtctaat

SEQ ID NO: 47444 - DNA, 1696 bp, Homo sapiens
tgatctcagctcactgcaacctccgcctcccaggttcaagcagttctcctgcctcagcctcccaagtagctgggattataggcatgtgccaccacgcccagctaattttttctattttttttaggagagacgggggtttcaccatgttggccaggctggttttgaactcctgacctcaggtgatccacccgccttggcctcccaatgtgctgggattacaggtgtgagccaccacgcccggccacaaaattactagttcttatacaggttgttctttcatgtttaacactgaatgttaaaatggtaaattgcaaataaataaataaataaataaataaaatgcttaattgtttagtattttaggtgaatggttatcaatacattcactggaaactttttacctaacattatgttagaaaaatgtaaatatgccataaagctaatggcaaatgttcctctttggattgtgaagtcatctagttatttatacttacaggtctacaagcaagaacaagaggaagaattaaagaaaaagttggcaaatgaccccagatggaagagatacaggagatggatgaagaatgaagggcctgggcggttaacatttgtggatgactgaagattgatggaatgctactatgccaaaccttaattgtgatattattttcataactgaattattttagaaatgtatcaattgactgctgctcagcagtaactaaaattcctcaagtatttgattaaacagaataatgtcaaaatttaaaccttcccttaaaactttatacataagacatttatgattgttcaatttttataatctatttgtggattttgttaaaagatttcacatgaagatttattagttgccatttaaaatttttatatgtttagttaaaagatttgacatgaaaatttattagataccatttaaaaattttatgtgttatgtgtttattctttgagaatgttaccttactgtttgtaatagtgctacatttttctgctttcatggcctctgtattttcacaaaacaccaaaaacagcatttaattatattatcatgagtgtgtttctggacacaaacttctgcagtagaatgacctaacatgtcgttttcattgcagtcattataggattgaaatacgttcaaaataacctctctaggaaagtcttctgctagaatttctcccctctattcattataatattctttgtttttaaagccagtcaaatataatagtcttaataagatcagaaactctccaggagagtgagtctaccctcacgtccttgtaggatgatcttgattatagtcttattataggactataactgtattctcaacatttctccagaaaggaccttgtaaaaaggtcttttgtaccacagtattggttttttcccctctctcttcacttaaaaaaaaaaatagcaaggcagaaatagtgtattgaaaagttgttcatctattatgaagtccttgagtggtgaaaaatccgttgtacatgagaacatttctatgcatttaagccagaaacgaggtacatggctgtgtgctcttctgtcaaccaatgaaatgtgttttcacatgtgtggcagtgcaagtaaataacacattatttgactgaatcaggcatgatactgcaccaaagtgttggtacatattcacggtagtaaatcagtacccctgtta

SEQ ID NO: 47445 - DNA, 1050 bp, Homo sapiens
agggaaaaaaatgtgtgacaaaatttgaaagatattctactggttacccatgcattttagctgtagtgagaaggaaagaagggtactctgtctccatccctcaccttccagagctctggaaatcacagcacatgtgggaaaggcctctggtcctctaggtaaaccttgagttctttgtttgagacggagtcttgttctgtcgcccaggcaggagtgcagtggcgcagtctcactgcaacccccacctcccgggttcaagcgatacttgtgcctcagcctcccaggaatctgggactacaggcatatgccagcacgcccggctaatttttgtattttaaattagccaggcgtggtagaaaccccgaagagacggggtttcaccatgttggccagacttgtcttgaactcctgacctcaagtgatctgcccgccttggcctcccaaagtgctgggattacaggtgtgagccaccgcgtctggcctgaattctcttgaaagctaaaatgaaattcttttccctgctcccactttctgtgatactgggcaagtcacttcactttccttagtggatctgtttcctcatctctgaaattgtagatgcgccgcactatctgatggttcccttcaactttgaagttccatgatgcaaaaataatggatgagaagtcttgtggggaaagtgtggagcatcacacagatggtcagccttcctcaagtacaagtggcgcccggcctgcttatccatggatcacagaccattcctcttgaacggtgcaaagtaacactgaggtgggcggggcagtgggtgtgtagggcatgaaggaggcagacacagcacacccctagacttttcctgctacctcgtggctgatacagtatgacatggctgacgtgtgtcccttcattgagggcaactccaaagccttcatttctaatgattttgaggtaatctcattatttcagctgccattgctgtggagacatcttcacattaacatcttggctactaaacattttcagcagcctaaaggcatgtagcaatgccatgga

SEQ ID NO: 47446 - DNA, 1027 bp, Homo sapiens
attatttctcagatgaggaagcagctactgagacgttgagtaacttgcccaaggttatataggtagtggcagagctgaatttgagtccacgcagtctggttccagaggctatactcccaaataataagctataccgcctcaaaagcaaggcggaagaactttatcacttgtttggagcagactgaataaggcttcagacttgtaaacattaagacaatttgctcatttggcaaacttggatatattgatgcatgttttatataagtaaaaatttgtaaagggaatgctagaatgagctatttctttacccgttcagtctcaaaactagatttctaaatggatcaaagatacagctttttcttgtcttcgttgaataagcaactaaaccaaaaaatatctaaattgacgttcatggaaattgtaaccttttctctttgtagttcaagtattagaactttcagcagaaagagacttttggaggtcacaaaaagttgatatttaccaagttggatgatcgttttcagaatatccttgactgccgggtggcttggctgtgagcagggtgccatgttgctgtccctttgtttcaggtctctcaggcagctgcagagcttcaacagtactgtatgcagaatgcctgcaaggatgccctgctggtgggtgttccagctggaagtaaccccttccgggagcctagatcctgtgctttactctgaagactcgtgagtaatgatacaccatgatgtcttgggcccatagcattatcacagggcttcccaaaggacttgagcaactgagttttgaatgtctcctattcttggggaaattaaaacaagagccagcaaaatgcacaactttccctgaagtgtgattctagtgtatatttaccttgcctgtagaatacatctaatcaggacagtctgaagtctctctggcactaagtcatgagatgccaacatccttctgtacttgagctctttgagttggctggtagtaatttcttcctttctttctttcttttttttga

SEQ ID NO: 47447 - DNA, 1050 bp, Homo sapiens
cataagtgagttactaagatttctatacctggaatatcatgtatgtttcatttactggatgtttacattttaggaaggaaaatagttttgtttatttaaacaactgaatacttataaactgttgttcctggaagttatttattccataaaaaatttgttcttttgtcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaattaatcatttttctatgacagcaatattttgtgtctgattttgtattaaggactcaaggatttctgtttgcctgtgagattgagtgctggaatgagagagtgaaattgttgtttttaagtctttgtagaattttgcaaatgtcctgaaaaatagataactgtataacatgaagaaaatatctctattaatggcaacatttgttctctgaaatagctatatataaactcataaataaacaaaaatatctgtgagtgtaagtagtgttacaatagagaaaatagaagttattagatgggaactcccttaacttttagctactaaacttctagatctagtgattggaatcccttccattcagtcataattcaggcatcccttttataa

SEQ ID NO: 47448 - DNA, 1028 bp, Homo sapiens
tgtttagacacacaaatacctaccattgtgtttcaattgcctacaatattcagtacagtaatgtactgtacaggtttgtagcctacaagcaataagttacaccatacagcttaggtgtgtagtgggctacccaacctaggtttgtgaattacgctctatcatgtccacagaatgatgaaatcgcctaatgatgcatttctgagaatgtattcctgtagcaagcatgcatgacggtgaaagtgtagtagaaagaggaaagtaggataggcggtgttaagtcaagttaagcttgtttaaaaaaggaagaagtatcaaatgctgaagagaggtcaattaaggtgatgtctgaatgtcctttggatctaagaaggtagaggttaattatggtagtgatagggtgataatttcagaagtcaggaaataaaggtggattatacttgtggtcttcaaacatttttgcttatatgcaacctaaatgaaataatgtcaaccctgtgtacctccattttacagtcggcatctaaatgtttatcataagtttaaatatatataatatatatcataagtttatatatatcatcgtaagtttaagtatatattttaatatataattttattaaaagtctagcattttaacatgaaattatttcattcttcttttaaatatattcaatggaatacaaataccatcatcatttgaaacctaccatcatccatttaaaaatatacaaaccgtactctcctttagtcagaaattttacatgattcttttttttctctaaaatcatacttccaatttaatttccccacaaaatttaatcctgtctcaattacccttttgttgcctctcatctccaaagtcatacttcattggttttgtgaaaatggatctggatcctttaaatatcttttctttgccaactggcataatgctgatttgttcatagaaggtgttggagagatattccaggaggaaggaatgggtatgtcttcctgggtctaacgtggttttctccaatgctaggcaa

SEQ ID NO: 47449 - DNA, 1028 bp, Homo sapiens; identical to SEQ ID NO: 47448

SEQ ID NO: 47450 - DNA, 1031 bp, Homo sapiens
ccttttctgtcctaaactttttccagctctttggtagaaataaaggctgttgaattctttttgatttgcattagaatcagaagcacgaaataaatccaaactggggacagatggtaattctctccagaaagtctcatcttttgaactttcacatgtgaggccttcagactcatctgatagacatttttgctgatcagtgaataaattacctttctgagagtacaatttgttacatgcagtctgctgtgcaccatattgtaagttgaacgggtgattctcttgttcccatatatttttcttaaagttccaatgaagaggagattgagtgccctctagtgaaaagatagggtccgatacatctttatttatgaaaccttttgcttcatgtgttctccttttctgagaatttataaaacgggggacaactgacactctcttctgagtgtcagttggtgattttatagtttcacagttcatttgtgttagacccaaagaaaagacatctgactctgaatcactgtggtttagaaaggagttataagccggtctccttgattctatattaattagaaaaggagtattctgccctatattagatttacagctggagtctttccagtagctggtctgattgtatgaagtcacaggtggtaaaaaacttgagatttcttttagttccataatggaagagttgtcattcaaaatggtggttttgtcttcctgcactgtctctcctaatcctaaatactgataatattcattatgttcttgaatgacagagtctaaatcagaagctgaactttgagaagacaaggtactaatctgattcctattttcctgaggtgacgaaatttgcggtgattttgttatggaagaagaaccaatcttgaatagggaagtgatgctacaaaaatgctaaaaaatgaattaatataatgcaaatgtcagtttagtaaatataaataatgatgcttatctatatggaaagaaggcaaaatataaataggtagtctattcatagatattacatt

SEQ ID NO: 47451 - DNA, 1031 bp, Homo sapiens; identical to SEQ ID NO: 47450

SEQ ID NO: 47452 - DNA, 1058 bp, Homo sapiens
gtgggaagctatggacagtctttgagcaagaaattcaaatcaacagcaaatttttatcaagagactactatgtacctggcattgtgctaggttccaggaataaaaaaaaagaataaatatgtttccttacctttaaggagcttatagtctagtgagtgaaatattcacagctgtatttcggaaatgtaattggtgtctatatgtgatgaagtggggaaagagtagaaaagggatattagttaggaagctactttaaaaatccaagtgtgaggtggtgaaggcctgaatttaggcctagaagaagtagaaggagagacatactctagatacactgcagagttaaaaagaagacttagctactaattaaattagaatagtgataccataaactaagcttgtgggaggatgagaagctgtgttttggacatgtagagtttgaggtacttgttggatattcacgtggagattcccagtagtctgctagaatacaggtgcagaccttaagaaatgtcaggaaaaatttaagaattatactcagaaatgaaagcaaaatctgtgggaatctctaagtttataaagaaaagaatgtaatgtgataatggaacagtgctgagccctgaacttggacaaatgtctaaatttcagagtgggacactgaaaaagggggccaagggaagagactgattagagatcaccaatatattaccctagtatatgtcttaagagttccatttacagcagatacaagcttagtacatctttcataaggaacatttttaatcaagggatatttatttttattcatatcctgctatgtttagagaacatctgagtagtaataaagagaagaaacatgattttaaattcattaaattaaagccttttggaacagaataatgataaaatgtttattaatttgaaaactattctttatttagcttttaaacagtttttaattcatttgcttaacacttttttctcattgggcacttaagtttgagtataattttggtttataaaaaatacttatgaagaaacacataggaaaagaatacctt

SEQ ID NO: 47453 - DNA, 1058 bp, Homo sapiens; identical to SEQ ID NO: 47452

SEQ ID NO: 47454 - DNA, 1032 bp, Homo sapiens
aaagcacacaaaatgttcatatttgctggtaacaaaagaaatgcaagtaaaacatgaatttaaacaaaaattaaatattatttttgtccataaaattgatattacccaaaaatataatattcaataattatgagggtgtagtatagggaaagaagtatacattgatataaactctctggaaaactattcttttgtgatataattccaggcttgaatcacagacacatggagacacatatacagcataatatttagcctatcagaatatatatacacacacacacacacacacacacacatatatatataatgtacacttttgttaaaattgtgaaatcaataacttacttggattctagcagctgaagtatgtctggagtattaagaagtccttcagatgcaaaaaacacatatggaatctgaatttccaaaagaaaacctccaaatctatccagcaaggtgcttcctaaataagagaaaatttataaatatttctcttttattctcatctcccagctctttctctttttttttttactaaacatgaggataagtaggagtagtataaaaataatattcaatgtaaaaaatcagaaacagaataaagacaggcttgaagaagaaaataaaaaccatgttatcctaccgagaaataagttaatagagtttactaataccactatacactaaaaacagagttttgcatatatttccagacttttttcagtatattttcttgcttatactcacacatgtacactcacttcaataaagagaaaaaatagggtcattctctacctgaaatgttgaaacttgctttattcacttaagtatatattgggcatgtgctgtattaaatatatactgatttacataaagattttaaattatgtgcaataacccatagggaaaacattttacagatcaataagaaaagaataaatacctcaatagatacatggtcaaaagatatacacaggtaatttataaaagaatagttacacaagatcaattccaaataaaccattatgg

SEQ ID NO: 47455 - DNA, 1032 bp, Homo sapiens; identical to SEQ ID NO: 47454

SEQ ID NO: 47456 - DNA, 1096 bp, Homo sapiens
attattttctgagttaaaaataatgagattgtataaaaacttattttaagatatttattctaaataaactaataaaaacaaacatggaattatataattttatggctatattatttatttatttattcattgagacagagtcttgctctgttgccaggctggagtgtagtggcgccatctcggctcactgcaacctccgtctcccggattcaagctattctcctgcctcagcctcctgagtagctgggactataggcgtgcaccaccacgcccagctaatttttgtttcatcatcttgtccaggatggtctcgatctcttgacctcatgatccgcccacctcggcctcccaaagtgctggaattacaggtgtgagccaccgcgcctggcctatattatttattagagaggatttattccataattaacttgacatggcaaatataaagacccatataacatgaactgcatttttttctttgccattctccactgttagcatatgatcttaagccaaacaatgaaaaattttttccagttatcactagaataacattatttaaagatttgcataatcatctagagaccaaaagaatgaaaagatacttgagaacctgggtcatatttccttactgattttaataatgaatctgatgttcttaagcaggttgttctttaggagtcaaagaatactcttctttatagcataacaaaaaaatcaatataggaatcaatagaaacttatttacatcactctgatagcaggtaagagaacagagagagcatgattagcagttcattttccagactgggcagaagagtccgaggaggtacagttgttctcagattgatatagggaagcagcagcagtttaaatgaaagaagaaataacactgagtcgcttgggtagggcaatggggagaggcaggggtagtgaacagggcattccagattgggatataacttgaaagtaggagtggaatgaagaaatatctgaaacaagtgaagaaaatgacatggaaaatgaggtatgtcctagctatctaggaaaggactttcaaactaagcaaatctgaaatgcattttaaaagcatata

SEQ ID NO: 47457 - DNA, 1096 bp, Homo sapiens; identical to SEQ ID NO: 47456

SEQ ID NO: 47458 - DNA, 1031 bp, Homo sapiens
tatctctaatatgtaatttagtgccaggcacaaagtatctaataaatgttagtttttttttctgtcctaggtattacagaggatttcttctttcctaagtattatagaggatttacacacaaacacagatatacataaaaatctagttattttaaccatatagtagtattatccatcagtaatatgattacaaaataattccagaaacacattaccatctttacatacatggttaaaaatataataatggactatattctaaactagattaaaatgctattttcaagtaatactttcaattaaccataactaattagaatagatatgatcaaataatattaattattaaaatttttgagggggtctaagaatttatagtatttcttgcctctgagttaagtgtaaaataagacaaaaagtaaaatatacaccaaaatattaaggcagggtctccctctgtcacccaggctggagtgcattggtatgatctattaaaggctaagttggggaatagaatttagtttgagagtcaaatgagcttgctaactaaacaccagaattagacagagttacccacccagtcctagggtatgctggactgggataggataccccactgggtccagggagggcgggggaggtcaggggcactgcccagaaaagagtcatgacatagaaaaaccaaggagaattcctgttcttcttgggcaaccattcccacagcttatgtccaatttattattttgacttacaattcagatcattctttccatcccctctggagagatgtataaaaaggcaaagaggccaggaacttaacacttaattgaggaaacatcaggagtacagaagcattccctcataacattaatgttcttttaattgtttagtaaatgaatggctaattttttaaataagaaaagataaaataatatttaaagatttcagaattttgtgatcttttcaatttttattcttttttacatttcctcatttcttgctgctttccctcactttctgttgataatata

SEQ ID NO: 47459 - DNA, 1031 bp, Homo sapiens; identical to SEQ ID NO: 47458

SEQ ID NO: 47460 - DNA, 1020 bp, Homo sapiens
aaaattatgtaaagtctttattgtgatatataactaatgagattaaaataaaacatatcattcatgttttatatttttgatatctaataaattatgataattctaaagttggaaatgctgttgggaaatggctgcaaaagaattgcttgatacaagattgccacaaaacttccatttgtaaaagacacaattatctgtgaagcacaataaagtgaagtacaataaaatgagatgagcctgtatttttaaaaaaaaaattatatacaaatggccaatgaacatgtaataagatgcccaacatcattagtcagcagggaaatagaattaaaaccacaatgaaataaccacaacacacccattagaatgattaaaatttaaaacactgccaataccaagtgttagcaaggatatggggtaactggatctctcacacattgctggtgaaaatgtgcaatgatgaaattactttgtaatttataaaagtaaacatacacataagactcagcaatttgactcctagatattcattcaagagaaatgataatgtgtggcctggcatggtggctcacacctgtaatcccagtactttgggtggaccagatgggaggattgcttgagaccaagagattgagaccccatctctaattaattttttaaaaataaaaaaaatttaaagagagaaataacatgtttccacaaaaagacttgcacaaaaatatttataacttttattcacaataataaaaaactgggggaaaagcccaggggaattgataaacaaactgtggtatatccatacaatgaaaaattttttaacaataaaaataaatgaactagtgatacacaacatcatgaatgaatctcagaaacattatgctcagtggaagaaggcagacacaaacaaacttatactatttcattccataagtgaaattctaggataggggaaacatataatacatagtgacagaaagtataccagtggtcgtcaaggaccaggggggtaggttagtgaggagg

SEQ ID NO: 47461 - DNA, 1020 bp, Homo sapiens; identical to SEQ ID NO: 47460

SEQ ID NO: 47462 - DNA, 1221 bp, Homo sapiens
tcacttgaacccaggaggcggaggttgcagtgagttgagattgcaccactgcactccagcctaggcgacagagcgagactctgtgtcaaaaaaaaaaaaaaaaagagagagagagagagagagatgaagcacagatacatgtgacaacacggataaaccctgaaaacattatattaagtaaaagaaaccaatcacaataaaagcacatattgtatgattccacttatgtgaaatatccagaataggcaaatcaacagacagaaagtagattctgattcagttagtccgttttggagcctgagattctgcatttccaatctatttctaggtagtgttaatgctgccagtccaaaggcctactttgagtaacaagatgcgagatgatctctaagatcttttttcaccttatgaaacaataatttagttttcaccaaactagcctaattattgcctttgctaaacacttattgcatattcctgtgtctatgcctggagacatgctgtttcctctgcccaaaatgctttctctcaagttaatttctctttgattgcccagcccaagctcaattcctacttctgtgaagctgacctctcctagttataaatgcacagctctaccaatctaactcataaggtgaaaagacatcttagagatcgtctcgcatcttgttactcaaggtaggtctttggactggcagcatcattaccacctagaaatagattagaattgcagaatctcaggctccaaaacagactaattgaaccagaatctgcattttaataagatcctcaggggattcatatgtacagtaaagtttgagaagcactgatccatcatcatcatactgataaaatgagggtcacaggtaaaatgaccagcaaagtagttagcacttgacttttccagtcaaggcttaaaagctacatattttaattcatagtgcagagcttttttcactatgcctttctgcttcctcgctgctaggagtttactcatatgatacatacttctaattggctatatgccttgtaatagactttatgttggtcatcctatattaccatttaattcttgcattgttaattttttctatgtttatctattattttcctaacctgactttaaattcctaggtgacagagatggtatattgggcttcactgtatccagagtctagacacctttcaatgtttttttgtttcttttaagcacaactaagg

SEQ ID NO: 47463 - DNA, 1221 bp, Homo sapiens; identical to SEQ ID NO: 47462

SEQ ID NO: 47464 - DNA, 1033 bp, Homo sapiens
atatatgtaacttaaattgtaaaatataatgttcacatagaaatataatgtttacacagaaactgtaccacaatgtatagttataaaaattattttaaggaaatgtccatggagcctcccctcaagtgaagaaacagagcattggaatttcagaagcccgcttttcctttctaatcacaactctccctagaggaagtctccctctagacctagagattactataattctgactttatggtaatcattgccttgcttttctttaaagtgtttcacccaagtatgcatttctaaatgacatagtttgcctatttttgaatcttggtgtttgtgttactttggttcttgcttcttctattcagtggatgtttattgtatatgatgattcaatttcatcaatttcattcgatgtattatatatgatgatttcagttatatatgatgattattaaataggatacaatagtatcctgttgtataaacatacttcaatttatccattcaactgttgatggacctttggattattctaattcttgtatattacaaagaatgctgctacaatatccttgtacatgtatcctagtacacatacatgtttctctggaatatagatttaggaaaatgttttggattattgagcatacatatcttcacatttattgactaacaccaaactgttttcctaagtgattataccgattcacccatcagtaatgtttaacagtctgtactgctctatatcctcaccaactcttagcaatttcatacttgaaaatgttgagatctagtagatgtctagttgcagcaaaggctggaagatgcagtgttcattctgaacagttatgtgcatagttactatttggaaattctattattaatataagaaaaaaacatatattgggaaatacacagcaatctctgccacattcagaatactaacttaaaaatagctgccaggctgggcaccgtggctcacgtgtgtaatcccaacaatttgggaggctgaggcaggaggatcacctgaggtcagaa

SEQ ID NO: 47465 - DNA, 1018 bp, Homo sapiens
aaagagtaataaaatgatttaaaaaaaaaaaaagggccaggtgtggtggttcacgcctgtaatcccagcactttgggaggccgaggtgggcggatcacgaggtcaggagttcaagaccagcctggccaacatggtgaaaccccgtctctacttaaagatacaaaaaattagccaggcatggtggcacactcctgtaatctcagctactcaggaggctgaggcaggggaatcgtttgaacccgggaggcggaagttgcagtgagctgagatggtgccattgccctccagcctgggggacaaagcgggactccgtctcaaaaaaaaaaaaaaaaaaaaaactgggggaaagggtcctgatatctaaataggtagaggccaagaatgttactaaatgccctgcaatgaacagaacagactccatgctcccggagaatgatgtgttccaaaataagaatagtatttactactgattaaaggaaatttaagaaatcttgatctagactaatctagtcccatactcttcacactcttctagtcgtatatatgaaacctacctcatttcctgcaggtgacctcacattctgcttgagtgggaggttgtctctttttatctcataatgtctatttagcctcatttggcattttcttactctcttctttctgttttcgttctaagatattctctttcaatctctgtgacttatcttattccccaaattatttatactgacaaaaatgcattctgtatcacagaatacaaacagataaaaaggcagagtactatttcccttagatgcaatatctcatccccactcacctcctccagaatttagttcgtaggtgttttcctgtcatgtacatcttcatttcctctcctataatggattttctgtgtctaaaacgtggttcattatattctatcctaaaatattttctaacactcttattttgaaccttctacttttaaatttttctgtattccctatgactccactacctctttcctagactactgtaa

SEQ ID NO: 47466 - DNA, 1054 bp, Homo sapiens
ctgaagtcctctgtatcttcagcctctttttcctgacataattgatgcaggttctcccctgtagacatttcccccacagtcctttccatactccatctaccacaggaccagaaataagatgagcattcatcttacatcccaatgccttctacagacccttgcttctatgccctcaagtaaaaacttttcttctgttgaatttcaggctgccacattaaaccacagccctcttccttgacctactaccatcgtactggccccgatccacctcgggtcccacaatcaccatgagtgaccacagtgtccatgtacataacccatccaacagctccttgaccttgtcaaccctatgacctccatgtaactttagtcacccccattcttggatgaatcttggatctcattgattgcctcaaattactccacctccagaaacttaaattctagtatcctatcctcttcaactttccatttctctcactcatttctgcttctagacttactctttgatcttaacaagaccttcctttgatttttccattttcttccagcctatgtgtctctcccctatccaacctaaattcttggctcttcaactcaattactgtgttgacaaaactgtctatttttttgtcccctcaaccttcatctaacccaactggaaaaacagctagaccttccatgaagcagatccctggtcatttctctctcctattcccccatagcaatgaactccttcattctctttcaactccctagttcctctgtatcccattctacctcctcttataagatgatctcatttaataccttacaaaggaaatagaaagtattgaagagtaattaccttaagtctctgttcctcaactccagtatgcaaaattaccttcatctgtccatatctttttctctttcctctcatctaaagctaatcctcttacctaaagctaatctaaaactagagccacctgtactctgaattttaccctgtctacctcatcatgggcctgattccatcagttaactctctggtatcattagtgtctctgtctct

SEQ ID NO: 47467 - DNA, 1028 bp, Homo sapiens
ctgaggccaggagttcaaaaccagcctgagcaatatagcaagaccccatcgccacagaaaaattttaaaaaattagccagaggcagtggtatgcagtgagctatgattgccactgcactccaacctgggtgacagagcaagattgtatctcaaaaaaaactagaaaaattaaactagaagccgtctgttccaccctttggccctttcactcactgtcaggtttcagtagaaactagtgtttgtttactgttatcacatttcaactcccattcatttactttttaaccgatttttagctgtctacccttatcctccatgaactgccccaattcttgccaaaagtgctcagagatagcagcaagtacatatgtaatctactggacattaccattcttaccttggtctctccagcagcattcagtgttattctttcttgaaccctttgagaaagaaaacagcctggccagataaacccttctgtcactttacttgcatcctggctgtctttctgcttctttgatccccacttttagtctccttcatgcattactctttttttttttttgagagggagtttcgatcttgtcatccaggctggagtgcagtggcacaatcttggctcactgcaacctctgcttcccaggttcaagcagttcttctgcctcagcctcccaagttgctgggattacaggcgcaccaccgtgcccggctaatttttgtatttttagtagagacggggtttcaccatattggttgggctggtctcgaactcctgacctcaggtgatccacccgcctcagcctcccaaagtgctgggattacaggcatgagccactgagcccggcctctccttcatgcattactgattcaataataatatattccttcttggccatcttctaagaatgctgtgcctcagagagcttgtgtatttaccttacggtggatggcttctgtatttttatctctaggctaaccttacctgctgagctctctgtatctgtttatttatttactcttcatttatt

SEQ ID NO: 47468 - DNA, 1056 bp, Homo sapiens
tgattgtaactgtcattcctagaacttgtgtggttcttttcatattatttgtggtcatatataatgatttccctcatttccttctcttctcttgggttttgttcaggtacacagggaggttgcattcttggcccaaacccacgtggtgaggtgttctccaagaagacttttttcttttttgtttttgtttttgtgtgagatggagtctctctctgttgcccacgctgaagtgcagtggcgcgatctctgctcattgcagcctctgcctcccaggttcaagggattctcatgcctcagccttccaagtagctgggaccacaggtgcacaccaccatgcctggccatattttgtattttttagtagagacggagtttcaccatgttgaccaggctggtctcaaactcctgacctcaagtgatccacctgcctccacctttgaaagtgctgggattgcaggcatgagccactgtgcctggccaagacttttttcttttattctatttcactgaggactgaatccaagatagagagcatccgcatcttccctctatggaccaggatttttctgcttgcctttcagggagtccagatttacccaaggctctcagaacagttgtcctgtcattcttatctcaggcttctctccatctccaggtcaccagtagatggtcaggaggcaagcatggactctagcactcagtcactgaagaggtttttttctcatttctgaccttagagactcttctttattgtcctaacggttcaattatgtattttaaaacatgcttttactacacttgtattaaaaaggaagagagacaagtttatgaatatgtacatatataattcatatataccataaatgtgtgtatatattttgacttgtatatgcatttttaaaacctctggaaggacaagaaactagtaatgctggggaagcagtaatggaaacaggcagatggggggccagtggtgacagatttcttttatcagaccctcttaatatttttagtgatttgaaccatatcagtatattaccagttcaggggctgaac

SEQ ID NO: 47469 - DNA, 1034 bp, Homo sapiens
tttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaacgttagcaatagtgtattttttgttcttctgtatttttataagtagcatgttccaccattcacatcagaattattagaagagttctgtcaagtattccttttgaaatcttccttttacctgagccataggtaaaataaataaggacataggcagtcctgtgacttaagtatggcttttctacattggttgcctgttaaaatcacctggagaacttgtaaaaaaaaaaaaaaatacacaacacacaccctgggccctgtacacaacacacacacacaccctgggccctgtacacaacacacacacacaccctgggccctgcccacatagattttggtgtaattattttgggtgaggcctgagctcttctacccgtgattctactgtgagaatgactggctc

SEQ ID NO: 47470 - DNA, 1028 bp, Homo sapiens
agaatagttgctgcagccttgatctctcaggctcaggtgatgctcccacctcagtctcttggttaggtgagactacaggtgtgcactgcctcgcctgggtaattttttgtattttttgtagagacagcatttcgccatgttgcccaggctggtctcaaactcctgggctcaagtgatccacccgcctcaaccttacaaaatgctggaattacaggcatgagccaccatgcccggcctggaagtatttttaaacaggtttttaaccttacataaaattacttttatacttctgttaatgtttcatctgtgcctttgggtaatttattttttattattaatttctaatgccccaaagctagctatcacctgaaaggtgcctttaggtgaatatactgtttccaaaaatgcatcagtgacactttcctatcctcatactttcaatattgcctcttctctgttctttttggatgtaacttcaatgattgtgttattcatgaagattttaaaatttcaacacctccaacactccttggctgtgttcacagcttctaactttatagctgtaggtatttttgaatgccagatgtctggcctgtttgatgtaaataaaatttatttataagatattaagggcaaataaataatagaactttaaattttaatctatttgtcttttaataggataattttacccatttacatttattgtcagaattgattaatttgacctctggtctttacttttatgttttgaattttttcttatgctttgtttttttccttttgttttctattttctgctatttagcttaaagttttattacttagacctttagtagtgtttggaaaataaatgtttctaactctattagtacttgtctttatttctttgcataataagaaaaaggtttttaaaattttgactagcctacctttttttcccttcactgttcagtattggttactgagcaactagtgtgtgtaagacatggagtactcaatggtaaagaaaagagacaatctcttcc

SEQ ID NO: 47471 - DNA, 1055 bp, Homo sapiens
taggctctctgcaagaagaaaaatatggctctttttgcccgatgccgcaggcagtcagaccttatggttgtcttcccttgttccctaaaaatcactgttattctgttctttttcaaggtgcactgatttcatattgttcaaacacacatgttttacaatcagtttgtacagttaacacaattatcacagtggtcctgaggtgacgtacatcctcagcttacgaagataacaggattaagagattaaagtaaagacaggcataagaaattataaaagtattatttgggaactgataaatatccatgaaattttcacaatttatgttcctcttccgcggctccagctggtccctccgttcggggtccctgacttcccgcaacaagaaggaacacaagcgaccattaacatgggaacaaaaatatattccacctcattagtaactggggaagtgcaaatgaaaatcaccttgggatatcatttcataatactgaattggtgaaaaaactttaaggtcagaaattaccaagtgttggggaggtggtggagctacgggaactcttatactcattcactgctgctggtaaggatattatcctctttgggcagggcatggtggctcacacctgtaatcccaacactttgggaggccgaggtgggcagatcatgaggtcaagagatcaagaccatcctggccaacatggtgaaaccccatctctactaaaaatacaaaaattggctgggcgtggtggcgcatgcctgtagtcccagctacttgggaggctgagtcaggagaatcgcttgaacctgggaggcggaggttgcagtgagccaagatcgtgccactgcactccatcctggtgacagagtgagactccgtctcaaacaaaacaaaacaaacagaaccacaaactggatggcttaaaacaaatggatgctctcactgttctgtaagctagaattctgaaatcaagatgtcagcagggctgtgctgttgtagttctgggtagaatccttccttgcttcttcccagcttctgggggtggccagcaatcctt

SEQ ID NO: 47472 - DNA, 1032 bp, Homo sapiens
ttccctcaggtatgttttgttgggtctgcaaaacttggcccagacagtgttaaaacaaaattgttttcattagttacctacattcaaagttttattagttagggccaggcatggcggctcatgcttgtaatcccagcactttgggaggctgagccaggcgggtcacttgagcccaggagttcgaaaccagcctagacaacatggcaaaaccctgtctctacaaaaaatagaaaaattagctggggatggtggcacacgtgcctgtagtcccagctacttaggaagctgaagtggggggattgtctgaatctgggaggtggacgttgctgtgagctgagatcaccctactgcactccagcctgggtgacagagcgagaccctgtctcaaaaactttattggttgcttatgttgaaaaaattagaagatttatacaaaagtccagatttctagcttttcttgaaatcttagaagatctggccaaatagagaagcattaccacatggcaatagttgctgtagctgagtggcagggttatcaactgcctcatcagatggggccagagctctgttgtcttctggatgctgaggacagactaacaagttatatcattgcatttacactgttgtttttcttatatgaaagaggaaagtgaaatatttctcataaccacatctctctctgaattgggaaaatgagacttatgccaagagggccgtatgttcaagcaaaatgggtgaaagcttacttgtttgtagatgtaaggcatatttctataaattcgatatgtaaggtaggtctctattgaatgaaaccatattgaatccaactgtagtaagaattatggcaaatggctgggcacagtggctcatgcttgtaatcccagcactttgggaggccaatgcaggcagatcacctgaggtcaggagtttaagactagccaggccaacatggtgaaaccctgtctctactaaaaatacaaaaaattagccaggcgtggtggtgtgcacctgttactggactattccggaggc

SEQ ID NO: 47473 - DNA, 1007 bp, Homo sapiens
cccaaagtgctgggattacaagcatgagccaccacgcccggcctgtccttgacactcttgaggtgcatcttgggtatgatagggtgagagtatgtagactgttaatactaacttcaatctgtttgttgggaaacaagttcaactttttattgtacaacataagatccttttcaatcatcttcctgccttggcttagactacatgagtgactcttcagccaatagcctttgtaggaacattgaccaccggaacactttaagaatcttttgaaggccaacaggagaagctgcacttccccaactctttctccatctttgtttctggaaactacctaaattctgcagattctcatacttttgttttctcctcacacattctaacaaatgctttttaacatttttgtattcttactggccttgtctttttcctttagaaaaagctggattatctttcctttcacatgaattcttctgaattcacagagtacctggaaccctgtgagatgacagaagaacctgtgtatgcctgggcttggtgtgcaaatttacagttatgatataacagaagttgatggcttccttgctgggcaataagatatataaaaatgagggaaagccagcaaaaatgagaaaaaaggaaagcctgtctttcttataggttcttaccctctgcttgtatatcagagtagcttaaaggaagaaaaagagacgataacatttcactacacatttttccatgtactagtgggtaatgcccatgaaaaccttaacttctttttatcttaagtgtaaatggtgccgggtgtggttacagatggctcatgccatcccaacactttgggaggccaggatgggcagatcacttgaggccaggagtttgagacaagcctgggtagcatggcaaaaccccgtgtctactaaaaataggataaattagccagttacttgggaggctgaggcatgagaatcacttgaactttggaagcagaggttgcagtgaacccagat

SEQ ID NO: 47474 - DNA, 1080 bp, Homo sapiens
ttaccatatagaatatgatgtattctaatatagccatacataggagttatatttatttgcgctaaagtatattttaaatattattcattaaactgagcttctaaatgacacaaaccacgtttatatttgtatcatccctgctcatctctgcagttcaaactaaagtaaatagcggattatagttttacaaagcactcttatatgcattatctatttagcctgcataacaattctgtacggaaagtaatgcttagtgattaagaacacgaaatttgggagaagacaacccagcttcatattgcagctctgctgctcactgctatgcagctttgagcatgtcacccagtttgtctgtctcagcctcaatttccatattggtaaacttaagagaatgatacatttcatacaagatttttgtaaaggctaaatgtgataatgtataatgtgtttggcacagtgcccagcatatagtacactcagaatatttagtagttaatatttacaagtggaaaaacaggctcagagagattgagcctttgcctaagagcagatggctaataggtggcagaacctgaccagattcaggtcttccgggtcctggtacccaggaatataattattaccttaggttttaaagacacagtgtaattgtgcgcaagttttaaaattttatttaaattaaaaatcctattaagtattgagaacttaaaatgaccagatactatgatattaggatataacaaagatgaattcattcctgccctccagaagtttgcttaaacttctgaaaaagagagagagagaggcaggagaccgaggcaggaggctcatttgagcccagaagtttgagaccagcctgggcaaaacagcaagaccccatgtcaaaaaaaaaaagagagaaaagaaaaagagaacaattgagattgttaacatctcactgtactacagttttgaaggctttgtggcctttaaatcttctagtgtgcacatgtcttggagttatcagtgtaattaaaacagttaacctatttgctaaccacaaccattagctgaaaataagacccagtggaggctgtgtgc

SEQ ID NO: 47475 - DNA, 1081 bp, Homo sapiens
ttgaggccgggtgtggtatctcatgtctgtaatcccaatcatgggtggctgaggcgggtggatcgtttgagtctaggagttcgagaccagcctggccaacatggtgaaaccccgtctctataaaaaatacaaaaaattagctgggcgtagtggcacatgcctgtggtcccagctactcaggaagcttgagctcaggaagttgaggctgcagtgaaccttgactgtaccactgcacttcagcctgggtgacagagtaagcccatctcaaaaaacagaccaaaaaaaatagataaatattggaattcatagctcaattttaaaattggcttctaaataataataccttatattaatagtaatgtgtctcattcacttacactggtgtacatttggaaaataactgggaagtggcattgctcaaataagcattgcaaaggttataaagtattaggttattgtcactgaagcatggggaatacctttttcaaattgaactggtgaagacgaactgttggccacatttatgttttcaaattgtagaataaatatgtatgtgtgtatgtatttacatattcagccttatattgtttaattcagtgtctattcaaaaactgtcttatctaaaatagtcttacattctatcccagctcttgctctttttaaagtagaacccatcacttctcgacttaatttcatgtatgtatgcatgtatatgcatttgcatattgtctgtctatactagtcagttttcttttaagtctgcgtctggcttggtgtcatggtaatactgacctcacataattaattagaaagtgttccctcctcttgcattttttttttttggaagagatttgaaggatcggcaggcatataagaatagatactgtgtgattgattccatttatttgaagataaacatgagacaaaactaatatatggtgttagcaattaggaggggttgtggagtgggcttctgggatacctgtaatatcatctttcttgacctaggtggtgatgtttgatctggatacatctgatcactgtttctgaatgtatgttacatgtcaataaaaagcagtgt

SEQ ID NO: 47476 - DNA, 1011 bp, Homo sapiens
attgaaccttgtcctcaatctgttcatcttgcagcctccttcccaatggtattttaatgttctcaattcttttctaactttaaaacagaacccagtgacaataacaaaccacacagcccatcttttttctccttttcagagccagacttattttcatctacaactcattcccctgaacacaccctgctgataccatttgtttccatttcacataattggttttcagcaaggtccttgatgacttccctgtcaccagtgggcctgtgtcattcctcccttgtgaccactctgcagcatttgatactgttgaccacactttccttctggaaatgctccttccccagtccttcattgtaacctccttgctttccttccctgcctgtgatcacaccttgtcagtctcccttgctggctgcttctcctctatccttcccttaagcaatgttcttcaggtcactggctcagcactctcgacactctattcctgacactttctctaggaaaccccaaccattcacgcggcttcaatgaccataggaaccgactgattatgtgtccctgtttctagcttagccagacttcatttgacatttttagttaactgtcacaaagatgcctcagcctgaaaacgtccaaaacaaccattcccaggaaatggtttttttgcaaccacccatgaaatctgctgagtgtctggcttgctgtgtctcttgggcagtgtcgatccacaccctctctctgcatgccttgaaaaattgtggaaatccctgggtggctcgtgcctattatcccagcactttggaaggccgaggtgggcagatcaacagaggtcaagaccagcttggccaacatggcaaaacctcatctctactaaaaaatataaaaattagccgggcttggtggcgcgtgcctgtagtcccagctacttgggaggctgaggcaggagaatcgcttgaaccccggaggcggaggttgcggtgagcccagatcgcatcactgcactccagcttg

SEQ ID NO: 47477 - DNA, 1074 bp, Homo sapiens
tttttactagagacggggtttcaccatgttggccaggctggtctcaaactcctggcctcgagtgatctacccacctcagcctcccaaagtgctgggattataggcatgagccaccgtgcccagcctcgtgtggttttaatttgtattttcttactgataatgatttaaacatattttcatgtgtttgatagctacttatattgggtgaattgtctattcagtctttgctcattttaaaattgagttgtcagccaggcatggtggctcatgcctataatcccaacactttggggggccaaagaaagaggatcacttgaggccaggagtatgagaccagcctgaataacatagtgagaccctgcttctacacacacacagacacacacacagacacacacacacacacacacacacacacacacaagtaaaattgagttgtcttttgaatattgtcagattctttataaattctggatgcatgttctttattggatatgtgatttgcaaatattttctcctagtatgtggtttctctttccattttcttaaaagtatcttctgtattacaaaagttgttttgttttgatcaagtttaatctattattttttcctgttatcattcatgcttttcccactaaatattttcttttttaccgttgtgaaatgaaattattgtcgttagtttatttccaaattgcctgtttctggtatatatagctataactaatttttgtgtattgattttgtatcatttgaattaatcagtgaagccattttgtagctgggattttttgtaggaatattttaaattagtaattcaatttctagttgtatgtcaatagctttttaaaaacagctttattgagatataattcatataccatacagttcacccacttaaagtgtaaaattcatctgttgcttttaaaacattttcgtcatctcaaaaagaaacctcccacccattagcggtcaacctcatatccctctatatccccacctctacccctaaacaaccactaatccactttctgtctctacctatcacctgtcaatgtaatatccctcaatatc

SEQ ID NO: 47478 - DNA, 1047 bp, Homo sapiens
tgctacacagctgttgtcctagaaatttaactctctcctgcactgaatctcctgtttcctggatcccatgtcttctttcttcctttacatcttcaatttggtggcacacattgtccagtagtttcatgagaaaggatacattagagataatttttgtgtgtatctgaaactactattattctaccaactctcttgattgtttgtctgggtagagatttccaggttgcaattcattttccctcagaattttgaagccattgctttatcatcttaagattatcgttgagaatttgatgttgttcgtcttaatcttttctatctacccctgtcctttctgaaagtttttgaaatcagagacatatttctctgtggtagtctgatatttcacagtgataaaaggtaaatgtcattttcccagccccttgaaaagttcttatattatttctttgatagttctctcagttttctctcttctgactttctggagaaaaagatcatctgatttaatcactcatttctcctattacacatatatttgtataattcttttcaccttctaggagatcgactcaccttctttttcctacctttctattgcattttaattttgttgactaaaattttactttctaagagctcatcttgttttctgatggtttttcttcctcctcctcaatccaacccatcccctctccttccctggcatcactgcctttccccctttccctttttctcctctctccctctccttcatcccctcttcttctcctctctccttcctgtgctcctcctcttccctctttctccacctgcatcctgttccccatcccttgctgtattattttcttttatctctgagggcagagattgtggaatttttaatttgttctccatttactctactttagttatcttttgtctgagccagcattctgtttcctccaagttgctcttatctgtgttttggttttggttatatttgatgtccattcatctctatgggcaaggctctgcaaagctcattggaagatgtgtgtgagtggggtg

SEQ ID NO: 47479 - DNA, 1064 bp, Homo sapiens
ctgggagctggcccttccagaatcagaggctaaatagagaaggtctattcctgccaaagaacacctgcaaaagccagaagagggggcggtcttcttcttctttttttttttttttttgagatggagtctctctctgttgcccaggctggagtgcagtggcacaatctcggctcactgcaagctccacctcccaggttcacgccattctcctgcctcagcctcccgagtagatgggactacaggtgcccaccaccacgcctggctaattttttgtatttttagtagagatgggatttcaccatgttagccaggacggtctcgatctcctgacctcgtgatctgcctgccttggcctcccaaagtgctgggattacaggcgtaagccaccatgcccggccaggggtggtcttaaatgctcagacaacaatgcaaggacacaaagattgcaaagaatcagtgaatcacttccaaaagacaataataaagcttcaataatgggccccaaagaaatggagatctaggaaatgacaaagaattcagaataataaagaagttcagtaaactataagaatatatggatagaaaatttaatgagatttggaaaacaatacacaagaaatttgagaaagaaatagagacaataaaaaagaaaattctagagatgaagaatacaatgactgaatggaaaaattaagtagaaggcttcgatagcagactcgatcaagcagaagaatagatcagtgagctggaaacagaacatttgaaattatccagtcggagaagcaagaagacaaaagaataaaaaagaatgaagaaagcctgtaggaattttgggacaccatccagagactaaacctttgctcaacagaaattttagaaagagtcaaagagccagaaagcatatttaaagaaataacaggccagacacggtggctcacgcctgtaatcccagcactttgggaggctgaggtaggtagatcacttgaggtaaggagtttcagaccagcctgaccaacatggagaaaccctatctctactgaaaatacaaaattagccgggcatgg

SEQ ID NO: 47480 - DNA, 1032 bp, Homo sapiens
agaggttgcagtgagccgagattgtgccactgcactccagcctgggtaacagagcgagactccgtctcaaaaaaaaaaaattattattattattttacataagaagaaacaatgcaatgattgatttttgagtgaaaagttaactttatatttctaggaaaaatcccatttagtcatattgtattacttatatattggtggattcaattttgtatttgtgtccatttgccatattggggctgtagtttttgttgtttatttgtttgtttgtttgtttgtttttgagatggagtctcgctctgtcacccaggctggagtgcagtggctcgacctcacctcactgcaagctccacctcccgggttcacgccattctcctgcctcagcttcccgagtagctgggcctacaggcgcccaccaccacacctagctaattttttgtatttttagtagagacggggtttcaccgtgttagccaggatggtctcgatttcctcccacctcaacctctcgatgacctaggaccaccagcacacaccaccatgcttggctaatatttttatttagtagaggcgaggtctcactatgttgcccaggatggtctccaactcctgggctcaagcgattcacacaccttggcctcccaaagcactgagattacaggtatgaaccacatgcctggcaatgattttttacaaaatactttatgttttcctttattttcttacttattttttttttgggcggctgggggagggtctgttttctgttttacttgatttctactatcttcattatttgttttcttctactttgtgtttaatatgtcctttcttgtagcttctgaagattaaaacttagttcattctcttgggccctctttttcttatgatacaaacttttaagccataaatttcacttttagaactgccttagcattttcccacaaacatttgatacattgtgtaatttttcattcttcgagagattttcctactttccttctgagttcttctttaatcaatgaggactat

SEQ ID NO: 47481 - DNA, 1074 bp, Homo sapiens
ctccacctcagaaaaacaaaaaaagaaagaaaagaaaaattagctgggtatgacggcacccacctgtagtccctgctactcaggaggctgatgtgggaagatcgcttaaatgtggaggtcaaggctgcagtgtgctatgatccactttactctagcctgggtgacagagtgagactgtctcaaaataaataaataaaaataatgaaagaaaggagcttgtattctgcaattgttgggagaaatgttctaacgtatcattttgttttaatgcctctttttgcttctgcttgaaagtcttatcttcctcatccgtctccttggcctgcttcttgggctgttttagggggttcttcttgctgcacatggcacctgtgccccttcctcagactctgccctctattggactcctttttcctttttttttttgagacacagtcttgctctgtcacccaagctggagtacagtggcacaaacacagcttactgcggccttgaccctcctgggaccaactgattctcccacatcagccttccaagtacctgggactacagatgtgtgccaccccacccggctaattttttgattttttttgtagcgacagggtctcactttgttgcccaggctggtcccaaacacctgggctcaagcaatcctcccaccttggcctcccaaagtgctgagatgatgggcgtgagccaccatgcctggcctacgatttgtatttcatgcttcctttttgaaacagttttattgagaaataacttacataccatacagttcacccattaaaacgtacaattcagtagctgttagtataatcagagtttcataaacatcatccaattttacaatattttcatcaccccaaaaagaaactttactccttagtagttacctcacatttccaccaaaacctctcagccctagggaactactagtctactttctttccctattgatttgtatattctagacacttcatataaatggaatcatataatatatgaccctttgtgactggctcctttcccatagctttgtaaacttttccaggtttatccatgttgaagcat

SEQ ID NO: 47482 - DNA, 1035 bp, Homo sapiens
gtttttgtttctttttaagagacaagttttcagtctaatccagggtggagtgcagtggtgtgatcactgctcactgtaaccttgaactcctgggctcaagttattcttttgccttagtctcctgagtagctaccattataggcatgtgccactatatctggttaattttttatttttttatagagatagggcctcacaatattgctcaggctggttttgaattcctggcctcaagtgatcctcttgacttggactcccaaagtgctgggattacaggccctgagcgactcactgtgcctggccagtttgattctttcgaatgggaatttttgttttgtgtgacatcaatcaaacatctatacctataagatcaaagtataaccctaaaatgctgtatctgtttttctttctctctctctctttctttctttctttctttttctttctctttctttcttttttttgagagatgaggtttcactatatttcctaggctggtcttgacttcctgggctcaagcagtcctcctgcctcagcctcccgaagtgctgagattataagtgagattctatcttttagccttatgtggtaattctaaatatttttgtgggtttttgacccctttgagaattggataaaatctttggactcctttcttattaaatacatatctatatatacaacctataattttgtatacattttaggaaatatgtggactcttggtggactatgcaaacaatctctgttttgtgtatttacattttagcatatgactttcttttaagaatagaaaccttaaaggcttgaaaaggattaggagactgagcttcggagcttccagggaaaatttacttttttgagagaggagagattaacatgctatttttccatcagaaatccatttaacttgctttttcagataaatacactactagtatgcatctagttaaatcattcttctgcaccgtaggttatgaaaaaatagtgtcttactggtgtattcacaaaggcagtctagaaaggaaaaattaa

SEQ ID NO: 47483 - DNA, 1140 bp, Homo sapiens
cccattgtgtcgaccctaacatctgacatctacctcttgggttacagcaggtgaagtagaaatttgaatccacatggcccagattgcttttagaatggatagtgggagtactctcaagttaacaggtgtaggtagcttgaattatcaagatacagggctatgcgatgacaactgggcaatgtcatttctacccacagcacagctagataccatcatagcactcatcctcacagccacccctcagaaatggatttcttgtttgcacttatgattccttatttgagaagtggtattacattcaaatgctagggattgagggtggttccattaggatgctgagatttttcagttacctggaaattggttgtgttcattttaaagtactaaccagccagcctgggcaacatggtgaaacccttcctctacaaaaaaatacaaaaattagccgggcgtggtgatgtacacctgtagtcccagctacttgtggggctgaggtgaaaggattgcttgaacctgggaggtcaaggctgcagtgaaccgagatcgtgccactgcactccagcctgagtgacaaagtgtcttattaaataaataaataaataaataaagcaccaaccggtagatatgtggttttagatttgtcctggattaaatgaaatttaaaccatttatcagatctggtctctggcctagaatttcctcaccttgttttatgcttttgaaagtcctgggaagaataatcctgaattggactcagatctcttgcttttactctttgacttcatgggtggatagacactgtttcgatggggagttatgttctcagaagttaccacatgtatcaaatatgccccaagtagagaatatacataatatgcaaaccccagaaatggtttaagacaggactcaagtatgagttgataactgagggaacacttaggtttgtaggtgatgaagcacaattgcagactgcattgtggagattttgagttattcttactttggggccatagtttcccattcccctgactctccctgcttactctctccacctccacatatacaaaaggctttagtggctcttctagccaactaatataccccttctagtcgagtttctaaagaatggtgtgtatgtgt

SEQ ID NO: 47484 - DNA, 1038 bp, Homo sapiens
agaatgggaaaaagaataagactggaaaggaagaaactgtcaagtcagggtttggcttttcttgttatatgccattctattaaaatatgtatatttttgtactttttttgaacatatgaaatgatcatattttacttgacatttatcacttatttagcagcagaaaaatacatgtaaatggaaatgctatcatccctttgaaacatgtctttttaacacttaggattcgtgctatttgccaggagggagtttttctacttacagagcatctgggagatgaattggaaaggcagacttctggtctggttagcacttttgttgttttttattttctttttgggtcccatattcatgaaagatttgtcttagcatttttagataaatatttctttagtgatacacaggtttctttgtttttttttttttttttttttagtgaatttcaaagaataatggctgccattcttggatcttggcctttattgatttggatattattgatgtatgaaatacataaacttgtcagatgctttgtgagtctctcctgatcttaaggcattttagagcatctagtagtagagtgtccttgagttagctaaatttatacttattttgaggctggcaaatttgtgtaatattgatgacctagaaatgagataggagttctgcaggactggtttcacatgatacaggtcataaagaccccactgagaaaacaggatgaggtaaagaatctggccaaaacccgccaaaaccaagatgccaatgaaagtgacctctggttgtcctcactgctcattatatgctaattataatacattagcatactagaggaaacccccactagcactctgacagtttacagtcatcatggcaatgtagggaagctaccatatatggtctgatgggggaggaaccctcagttccaagaattccctgcccctttcctagaaaacttatgaataattcaccccttgtttagcatatgattaagaaaaaccataaaaatagccaactagcagccatcacagctgctct

SEQ ID NO: 47485 - DNA, 1032 bp, Homo sapiens
ccaaatatttctcagcattgctatgggctgaatataatcatatttagagataaggtccttaaaaaggtaatttatgttaaaatgaggtctttaggctggcctctgatcaatatgaccggtgtccttataagaagtagaaatttggatagagatttgtacaggcacagagggaagaccatgtgaagacaccagaagaagacagtcatctaggaactaaggagagaggccttgggataacccagtcctgctgacagcttggtctcggacctttagcattcagaactgtgaaaaaataacttcctgttgcttaaggaatcctgtctgtggtattttgttatggcagctctagcaagctatataaacataatagcaaatatctggatgactagattatatagtgtttagttttctgacatgtcaagaaaaatatttcattcaagatggtaacgacatatgcacctttatattgcttgacagataatataaactcagtaatggcattgtggaaaaggactgtaacaaacatgtttccatatcctcatttctctttctcaataaagttcagattatttcccttgggttttataactctccgtactattacaaattatttttcataacttgtatcttgctacttcccttagcctattctagtctcaaggaaatgaaagtgtttgctgttttctgtatatccttaacttcccactttcttgtcttcactcattgtttatggactttcaacactgctttgttctattcatttagttagtccacaagtatttattgatgcctcagtgtgtgctggaaactgggctaggagctgaaagtataatgattaataaaaccataagccttctgctgaaggagctaatactctggtaggggtagacatttaaatagggtaacatagggctccagggaagcaatggaccaagccttcggtggggcgaggggaagagctgcagaaatgagtctaagtcagtggttctcaaatggggatgaaaagggaggaagcatttaacaatgtctgga

SEQ ID NO: 47486 - DNA, 1854 bp, Homo sapiens
gaaagttttgctaccaaatacacatgccctttcatattcacatcactcctacttaattcacaagctttgctctccacttttgttgtaaattgtatatagtacagccctctcttcacttagacttctttgtaaaaattataattttttgtagagatagggtcttactgtgttgcccaggctgttctccacctcctgtcctcaagcaatcttcctgtctcagcctcccaaagtgctggaattacaggcgtgagccactgagtccagcccacttaggtttctttagtgaactaggcaaaagattgtacaggctttctgagtcagtttgattgcaatgaaaacgatgcatacttgttgaaagattttaatctagggagtgttgcagttggattgttgacccctcccctctctgaatcattgctatgcttaatgtaatcctgaatgggcaggagtgccctctgttcttgtcagattgggctgggggtagtggggcagggagacacaatgctaagtagaaggttgagcgtacaggtggacagaacaggtgggtagacatatttcagatcacagtattcatgagaacccagttgcttttgttccttcagtattcattcagtgttttgtttttgtttttgttttttgagacagagtggcccaatcatggctcactgcagcctcaacctcccaggctcaagtgatcctcccacctcaccctcccgagtagctgggactaacggcacgtaccaccacacaaggctaatttttccagtcttttgtagagacagggtctcactctattacctaggctggccttgaatacccaggcttaagcagtcctccctggttggcctgctaaagtgttggaattacaggaaccaccacacccagccccattcagtgtttcttgaatgccttctgtgtgttaggctttgttcaaggtgctaaagacagtgctgggcaaaatttctaccctcctatagcctgcattcaggacttagagaaggatcacagagcacaaagatgcctggccctggcacacatctgtccagcccctaagcagtgtatttgtgtaatgatctctcaaatcctaaaaaatatttagaaatctaattctgggattcaggcctcagcagccaggaagatgtctctgccagctactgagatattaattagggaaacattagggtatatatctcagctaaccagattcacagaggtggatgaaagcatcatctcatgagacagtaccatgagaaaaggaatgccaggaccactgatgaacctagttttaaggtcaaagcaagggcgatgagccagtgacagaaactgagaagtagctgtaggaatctgaggtaggtcaacgctgagaaatctgtaaatgtaacttacgacatgaaaaacaaaaatatcatatttatacttgaccaaatacttgataaaattcaacagcttttccaactaagaaagacagaaaacatttttaacatagtataagaaaatgttataggaataaatacctaatatcatatttaatatgatatggcatactggacactttgcataaaagttaggagttagaggctgggcgcagtggctcatgcctgtaatcccagcactttgggaggccgaggcgggtggatcacgaggtcaggagatcgagaccatcctggccaacatggtgaaaccccgtctctactaaaatacaaaaaattagccgggcatcgtggtgcgcgcctgtagtcccagctactcaggaggctgaggcaggggaatcgcttgaacccgggaggcggaaattacagtgaaccgagatcgcgccactgcactccagcctggagacagagcgagactctgtct

SEQ ID NO: 47487 - DNA, 1026 bp, Homo sapiens
tcataccttttttttctgtaaagaaatttttctcaaacttttgaaagaaaaagtattttcatggacctttgtgactagtgctggcttaaatagtttttattataatgctacttaaatgtatgtaaacataaaatttatagttctgatacagctataaatcaaaatgtacttacaaattcaacttaaatctatcaaaccagataatatcaaattaacaacattaatttatagggaaccagacttgagacagtatcttcctactattgtaataccagtggccatgtaatataaataagagcatgggctctagagtaagacttaagttcagatattggctctgccatttactttgtgcaagtgacttatttatttctaaaatgaggataattaatttagtcaaattagaattattgataataattaggattcttggtgtgatgagtcataacagtgcttggcaaataagaattgtctaaaaaatattagctttagttgcaattattgttgtattattgttctactgaaacctaatgattaattttgagtttaatggtagaaaggctgattcgatatttaatgtgcttctgattttggctttcataatataaatgctaatacatagattgtctacttgcctaagttcatagcattgctaacatagtgtattatacttaacctaaactccaccagctagaactccttgaatttcaaggttttttgttttttgtttttgtagaaacggggtgttaccaccttgcctaggctggtctcaaacccctgggctcaaacaatcctccttctttggcctcccaaagtgctgggattacaggcatgagccactgcacctggcctgaatttcagtttttaatcaagtgtcacttgataactctgtaagtgtcttatccaatcattgcccatgtcagatatggggaagtgccacctgaagttattttttaattcttgaaaatgtagaagcagcattgtttttcagcatagagattatcattgactgctgatggcaatcag

SEQ ID NO: 47488 - DNA, 1054 bp, Homo sapiens
gcgccacaatgcctggctaatttttgtattttaagtagagacggggtttcaccatgttggccaggctggtctcaaacacctgacctcaagtgatccacccgctttggccccccaaagtgctgggattacaggcatgagctactgcgcctggcccagaagtatttttagagcatggcaaaaatgaaaaaaacatgctttatgccttcaaggctattttatgcttgctttaggtaagaacagtgatcagatttataatcaagtaaatctgatataatgattgatgcaccttagttggcttattgaccattatgatacacctatcagtctgcttttttagtactgccttaaaatggataggattgctttcttagacccaaagaaagcatttttattgcctttttcaattttctttatttttgtcatggtaatacatatatatggcaatcaataaaacagtaatattcctgaatagtaacaatgtctcaccttggttttcaccccaatgccagctcttcaaaggaaacttgttttcaattcttccaaaaatctgaacaaatgcatatacctctgtttcttgatttatcaacttaataaaatatccatagactctgctgtgaaagatgaggatttaactcatttttgttaactttccaatttgattgttgggttattaaaatacacaattaagcagtagaagaagttaaaataatgagagaggaaataaatatattttctccacctaaggatgaggatattagggatatcagtgtccctattcattccactgttctctcctccctgctcctgcttctcacaatcttcttattgtcacaagtttgtcaatatttttactcttaataactaacccttttctgctttatccataggttgattctaaatattcagaaccactaacaccttttatgtcactttcacagtgtaaatattgttcctagctattcatattctaagattgcatttcttttcatcccgatgagtttcacaagctctggtgcagtcagagaagaatgtttctaagggttgttgggtggat

SEQ ID NO: 47489 - DNA, 1107 bp, Homo sapiens
atagcctaactcagaagagaagcaggtaatttattatagctttgtgcatttccatttttatgtgttatctgttttccttttgctttatgtgccatacatcttttgtttcaaattgattaataatacctttttgtttttgatttgtactatgcatttttagtaaaagatgccttcatattttgatccttactgattaatatatgcaataaatgtagatatgtaaattgagtaaatttaaaggaaggaatggtttctaatcaaatgtttgtaataactatttctgttgtggtatagtaacagtatttcatctcttaaaattcatcagatgttatctctaatgttttgttagagtttgttctcagtcattgcagccataaaatttcagcaaacttgtgaaaaacacctttcagatactcagttctgactgtcatactgatgaactgttaacaaaggtgatcttatttaacttcccagactcctcttcagtctgcagagtcatatgctgttggctctctgtgattactacatgcaaaatagcaataataatagcccacacttctagtgtgcttattatctcactaattatttatgttaactcagttctcacaactctctgaagataggactataattaactccatttcacagataaagaaactaagtcacagaaagattagagttactggaggtcacacagtaagaagcacggaaagctggaattttgatccaggtggtttgattcccaaatttatgctcttaaccagtaggcccccttgccatggtgatgcttctcttacatgtctcagcatcctccctcttggctgttccaggacatgggccaactttccctgagtttgctttattcctccaaaaacttcattgccaaaacttctcctcctgctcttctttttcttgttccaatctctaactccttcgttagatggaaatcagagtgtttaacagttgagggagacacgtacagacatgcttaaaacaatgcctaccatgttgagatgctgaatatgtttttgttgaatgttgaagcaaatatgcaaatagtaaagtttctagaaatgaaaaaggagatcactttcattttctttgttt

SEQ ID NO: 47490 - DNA, 1031 bp, Homo sapiens
taatgcctgtttagaatattctgtgctgtatactaatggagtcattaaagaatgagctgaaaaggagagccatatgtgcaaagctgtggcttcatggctgaagctgtggaaaatgtaaatgtcacatctataatgaatccatgtgtcttctacaactgccttaactcaaggaaagtgagagttaaaaaacaagattctttttggaaattgtatatgatgtcttgtatatcaaagtctgatggcagcagctcactatgtattttatgtattataccagcagcagatatttcagacatatcagaagaaggttctcttgattcagtgtctctggcatataataaaaaagtgggggagaaatttctgcagtctctaataagcaatatatcaatgagtactgtcagattctgtagaaaagtccacagcatgatttattacattaattacagtcctgtgggtttcatgctgctaagccggcaaatgcagctacattctaaagttgatttaagaatatattttggccgagacgaaagtgcttcttattgtgattaatatagtacaatatttattctcttgttctactcttctttcaccttggctgtagcacagaatgcttaatttcttttctgtgacttggaactggaattcacttttagttttgaggagcttcatctagttatttatccgcacctgtcatctggtctcctttttgcctttttgtgtcttggtagattcacctaatgttgcatctcctccacgtgtgaagcctgtttgaattcactcccttctagcacagcagggctgtcctcaggcttgttaggtcacacctgcaatgttacgtctctttttgaggggaaggaaccattgaggaaaaacttcattgttgtaatttaatttttaaaaagtagcattcttaaaggggagcattctctgattctacccttgtttagaactgtactgaattcatacagtcacatagtgtctcttcttacagtgacacaattagcttatcaaatcacagaattttcagcttt

SEQ ID NO: 47491 - DNA, 1025 bp, Homo sapiens
cacagtttttacaaactatgattttttgctggggctgaggatgggttggggaaaagtgaagtggtggttgacttggatgttctcctgttccctctgcctctgacctcctgcttccactgaggtaattgaggttatggatcatttcgttttctgagaatatttcataccaggtcatctagacatcagcccagcccctgcccttcctacttacacaaagcagagtttattgaagattttcttaatatgggagaaaatgggtaggtttgtatcataacagagcaatgcaaatctgaccatgtacttttctgaccaactagttttcttaggataaaacacaaggccctgcatgacctggccccagtgggctttcaaaacctgtcctcataccattcttgctcttagtcacttcactccaggcacagtgatactctttcagtttctcaaattttgtttccattgcaggaacttctcatatgctgttccctctactgctcctccttctgctctttgcgtgactggcttttcatttttaggtcttaactaaaagatatttttagagaggacttcctagaatatccatccttaaatgtgtcacttatcctctctgataacacccattatttttcttcatagcacttctgccagtttgtccaagattttcttatttgtattcttgtctgttttccaccaccagatggtaaattccacaaatgcaagactgtttcccttatatccatctctgtagacccagcctacttaattcctgacatgtatcagttactcagtcagtgtgcttgagtgaatgaatgaggtagctcggcaggacctgattgattaggtgtagcagaaagggagagcaggtatcaaggatggtgtgcaggtttcaggcttcagcacctgggtaggtggtggaaacactgagtaggtggatgggcaagtttggggacagatcctaagttacatcttaggtctgggtacagatgttgattaggcttttgggtacataggttcacgggagccataag

SEQ ID NO: 47492 - DNA, 1136 bp, Homo sapiens
aaacattattttaaattatttctaaatatttatggtaattattttaaaccatgacaatgaagaaatgtctaattgttaaaagttgggagggtagtaagtgggaaatagtataaaacaagattcaaaagatatttaaactaataatttaaactaataattaaactaatagtgtttataaacctttgatggtataacaggtaacattagaaaaactaaataatatgattaaaagctaacaattacatagaccaagaaaaataatgtaatggaaaaatgattagttggagacagaaaaggaagcatatggtatattaattctgacattttttgtagtggagtaccaaaatatgctgtataaaaatagagaatttggctgggtgtggtggtgcacacctgtaatcccagcactttgggagtccaaggtgggtggatcacttgagctcaggagtttgagaccagcctgggcaacatggcaaaaccgttatctataccaaaaatgcaaaaagttaatcgggcatggtgtcacatgcctgtggtcccagctactatggaggctgaggtgggaggattgcttgagccctggaggtggaggttgcagtgagccgtgatcaagaggatttaagctgggtggggtggcatgcacctgtagtcccacctgctcaggaggctgaggcaggaagattgcttgagcccaggagttcaaggccagcctgggcaatgtagcaagagccccttcctcagaaaaaaagagaagagagagaatttatgatatgatgcaaagttataacaacagtgataacactagaaaaatttacagtagaatataaactggaaaaagtttctttactcctaaaaggagatactgaaatagtctcttttcagcctctggctgttgtttttctgcctgagatgaagccaacagaaggaggaggatttggccaacagaaagaggagctgagcaagagccctgatgcaacaatggaaacagagagcttgacatatattcacatatatcttatgtgtattcataaaatcacaatataactataaactctgtagagactctcagattagatcgcaagttacctgctgtgcaggtaactgctatcaaatgatatatgcgtttctgaaaacag

SEQ ID NO: 47493 - DNA, 1045 bp, Homo sapiens
ttcaatttgtgaaaattaatcacatgcacttaatgactagtctatttcattgtatgtatgttacacctattaaaaagattttaaaaggaatgggtcagaaaaatttctaaaactagaggtaaatgcagacagttgtaatagttttgtattttattatcagtcttctctagtcttacttgattttgttattaactaaaaaacttattcctattacttgactttaaaactatttctttccctcttactcatgtaaaatcaatgatggtgtctttaccctttcaacctcttcatgtagctcattcctggctattaggaaaggatatgacagtgtgacatttgtctttagttttattttcctgcagatggaatggctgtttgtcaactaagattgaggcccagtagaaaagagggaaaggcttggctgaagatgagttgaaaaggtgtgaatgtgtcagtcatctttgtgtatgttagcatggtgctgaaatgtggaggagatacagaagtaggagagcttcactcgggactgtggcaggtgacaacatccacaccagcattctggacccttccgtggttgtcttcaccagttccactaatagcagactgactaatgctgcttaattaaatccaacagacttaaacttttttgcttacatatcccttaaaagaactttgaatagtctttaccactcacttttaaattgacacccaaaggtttttcaatatgtttcaatcaatttacttttgtaaaaaaggagtagtgaatattttataaaaatgaagaggaggaggccgggcatggtggctcatgcctgtaatcccagcactttgggaggcaagacgggcagatcacctgaggtcaggagttcaagaccagcctggccaacatggtgaaaccgcatctctacaaaaatacaaaaattagccaggcatgatggcgggtgcctgtaatcccagctgcttgagaggctgaggcaggagaatagcttgaacctagaaggcggaggttgcagtgagccaagatcatgccattgcactccagcct

SEQ ID NO: 47494 - DNA, 1041 bp, Homo sapiens
ttgaacttaactattattttaaaattggtgaaaatagagtaagatttcctgcctaggacacaagcactagaactttgtttctcaaaatatattctctcaaacctcatcatgaacacagagatgctggttaagatacagattcctacacctgctacgtggtaatctgcattttgatcaagcatcctggatgattctgaagcacagcaatctgtgaagacagctattctagggcagcattacttaaccttggatgatccaaaacagaaagaggcacctcaagtccttggtagcagagtacaaataataaagtaataaaaagaaacagtggatcctggagacatacccccttttttacatcttgactataatagcctaattcaaatgtaactgtcctgtctttatagctatgatgttttatcctcattaccctccaaaataccaaatatttccattcatcacttattacaaatgccctgcaattacatgcagaatgcttataaactgtgtttacccaaattgctgtagaacaagtatttaattaactgccataaaagatctgctttgtcatttttaaatacagatttttagtgatgtgttaaaataacaaatacagatattttagtttaattcaataaaatggaaccagtacaacctctgttttcacaaatgaagtgattcggaatgagtttgtcagcgctaatggggctcttgcacgctgcagtaggataaatagcacatttctgtcccacatttttcctaaaacgaaggctgtctctaatctctctctttcgacaaaccttcatgcactaaactatgtgcccgtgacataggaagctcgttttgcttgtaatgggccatatgcttgtctagtagatcttttgtgaaactgaagttggctattataatgtgacaggtatgtaaataacatttatcagtgatctccgtaaaactgattcctcctttcccttgtcattataaaaggaaactttatttcagagtagaaagtgcattgtctgaactcatcaacaccctctctatccc

SEQ ID NO: 47495 - DNA, 1055 bp, Homo sapiens
agtgtgtatcagagctgcagcaccttgtctgaggcccagagcaaccagctcgtgctgatctgtaacaatctgagccagcaggctgcccagtcagtggccggccactccaacaatggcaatttcatcgtctccgcctcctatgactcttcctcagacaccgcttgaccaggtggcttgagcaagactccagtttggttactgtgtccggagaaactgtgattatacaccgcttctcgttccccttcctgtgccctcagtgttaattcactttataaaaatataaatatataatatatttttctttttacaaataagccaatggagataatttagtattactaacatagtatttataggcttaagacaaatgtacttgtgggcgatcaaatgtaattactgttacagactttacaaaaccatacgtggttctcaggcaacacaaagtagagagggaattctgttttttaaaaactgtcaaaaaggaaattgagagtcatcctagacttaacatgcttgcgtcctcaactcctgcttttcgttcccaccccaactccccttttttgtctccttaataaatggctttatttttttaatttttaaaattctatattaatcaagaggagacattaactttactgctgacgcaaaactgtattcagctagatccacaatatgaaaatgtataagctcaacatcaaattatttacatcttctcttttttaacttaattagagttttagctcctgtgcctcattttttacaatgtatgagaatctagatgtttagctaacatcttttctttttggggggaaagggtagaaggagggaataaaggtgccattctttttgggagatacatgattttaaaataatacccaaagtctaatattttggctaaaaagactgttacatagctcattttaactattgtgcttgaacctggaaagaatgtttctttttttgtccctaagaaatgggtataaatgaagtttgacaggaaatttaaagctaccaaagctttgaaaatgttgccaagcattagattgcctataaag

SEQ ID NO: 47496 - DNA, 1969 bp, Homo sapiens
aagcattaaacagtctcttttctcctgaggcaagggtgtgtattcgactctgtgattgagatccaaggaatattggcactcattttaggtaacaatattttgttaccagattttgctgaattcaaagcattcttgaaaatgtgcgagatttttctatagtaaatataaatgcgtttatctgtgatatcctgcaattattataataattttggttaaacatttgtggcagtttttccaaggtctttgttttcaagtcttgatgcctgtggtgaattattagttaagatatttcaaaaataaaataaatttagactttagagccacaataaagctgagctaggttcctattctgtataatcagcaacacacagaaactccaaatcttgattgttttgttggacccgtgaattctattgggaaatatttgttcttcaaggcaacctcataattcacattagctagaaaggtaggtggtattttgtacattaatttagtgtataaccaggacaaatttcattctgaattgctttgctaaatcatcacagagctgagctctcccatggtcagggaactccttccaacaccaagtcataagcacataaagacccgttcctctaagctgtgacctttcatctggctaaggagtgggaagtcagccatggactttgtgtcgtggagttaacctcatgttcatgacttttcctccatagagaaatattcatttatacatccagaaacaagaagaaagggcagagaatgtcttgctttatgtttttgtattgatagtgatgagagctgccatttttgagccagcatgcatgccagcactgtgctaagtgacttacatggatcacatatgtaagtcatagttactaatcttaaaaaaaaagaaaaaaaaaataggaaaacacagataaggataaagaaaacaaaatacgtactcgtaagtcttctagccaaagataactactgttaacattttggcaaatatttcttcagacatattgcagtacttacatatttatttctatatatattaatattttcagcaactttgaaaaggtgagttatctttattttatggtcaggtcaagataagtcaattaggtcatagctaaagaaatggtagtctgtcatttcattccagagtttttttctatttaagtttctcagtaccagctcatcattaatttccagtggtttgatccagagctggggacacagtgtcttaacatctctgaaggatgtctgatcaaaaggaatgctgagtaatcttccatggtggcagcatgtcctctagtcctctcccacacccatacatttggagccacagagcctctttctcccagttctctttacaaaaccttcctgttcgccttattctatagttagtccttacggcatcagacagcctactttaagggaactcttaaactctaatgtttaaaaaaaggtctctgtaaaacacttaaaatgttatggtgcatttaatttttaattgacgtagtttctaaatttttgatatgtttctgacagcacagtaagtttgtcttaaggaagaagagtagtcagtatgcactgtgaaagcagaactagaaaatgtcagttccctatctgtgtttattaaggtactaaaatgaaaatctttgtcctgcttaatcatattgcatcttcatttagaaaaacacaaattgggaatgtgaattatttttatttatttatatttttctgtgataactcaagccaaataggagcattgtgacttttagtttcagaaaactgttttctgaatgatggcttggtagaagcctagccaaattacagtatcagtctttgtttgtttgtttgtttgaacagagacagggtcttgctctgtcacccaggctggagtgcagaggtgcagtcatagctcactgtcaacctcaaactccagggctcaagagatcctcccacctcagcctcccaaata

SEQ ID NO: 47497 - DNA, 1023 bp, Homo sapiens
gtaattctgctttgagtattttctggagaatctttcttagagcctgttttaaaatcaataaagtgaaggcatttctgtaccatccactgtgttcatgtaggtgcacatatgcatcagagtgtacagatctgtcatcaatgactatcacctcttgagcactgacaatgtgccattgtactgagtgctttataagttgtttcacttaattctcacaatagtcccattaggtaagtattattatttcccttttataattgaggaaatccagaaaagtcaaatggcttgcccatgtcacagttaatatgtaagagcatccgtatctgaaattagatccagatcccattaagcactctctttttctgctgtagctacttgttcaagaagtgatttgctgtgcttctgtagaccctctgaagttataaattataaatgaaatcccaggtgtactaaaatcatcaaattaattcaactcattgattgagatcaatgttagcacaacattatttaggcgtcattactgtagtattttgagatgagatattaagcagtttgtttatccctggttaccagcagagagcagaagtttgtgtcactctaaaaaacacctaactttgtcatggaggcaagtgtgtatatgtgtataatttatttttaccccaattaaagccaaaaccccaatttcaagagagtcctttataattcaggcagggaagtgggagggtctaggcagagggactgcctataagccagtatcgattgccattgaccagatactaaatatgaattagaggtagactgtgaacctattcagattttttctggttcgactatctgcagtttaatgtgagacagacacttctgatcttaatcagccctcttctgactgattttctttatctataggaaaggtatattttgatccttatttctctagccaaaataaagctgtaatactaagcacctgtaaataaaaactctctcccagatgacagaagaaatagatacctaagcctagggaggaaa

SEQ ID NO: 47498 - DNA, 1049 bp, Homo sapiens
gcttttgtttttggagtgaatttttaatactctgtgttaaaagaaaaacattccatcttgtaggcagtgttcctcagtaaaaatctttgttgcattttcccatataaatgaatcacccttattaaaacaggaggagggagggatttgtggtgacctaccgctgccctccctttctaagagaagaggaggccatggggtatgataactaaatgaacatctctggaagttcctccgtctgatatgtgtattctgacataacagaatttcccaagacttctttgaggaaggctgtccacgcttcaggcaaagtttacccattattattatgattttgaatattccttgttcattacagtccagaaaatctgcagaagttctccatgttcagtggttgaccagaatctgattgttgcgctcaattaaagtgcttattatttagctaaaacaacttatatggaagttaattatttcaggaaatacataataagaccaaaaaaatcactggataatatgtagatatattttagttccattactattaatagcaattagataactctccctccccccattgaggtgagaatgggctcctagatacttggtggtcaatagaactgatttgattaactttcatttaactgtggttattgttacatctactgattttttcaaataaaaatttctagaaggctcagatttgactaagactgtgttacgtgctttctcacagctgccatatattctcatgtaatctttacaaccgctctacaaggtatgtctaattatttccattttacttattgagaatctaggctcagaggagttaaaattctgaaaatctcaccgataagttggagaatttaagtttgtaagttggagaatgcaggttttctgactccaaatctagtgctcagtccatgagacaaaactgcctcctggaggccatggaagtccattaactttaagaaagttaaacacagttttggtttgtttggcaaatatttcatctctcaagccatactgtgtcacccctccatgtattctcttac

SEQ ID NO: 47499 - DNA, 1067 bp, Homo sapiens
ctgatgaatgtattcaagaagcgtaagaccacaggaactctgaagcagttataataattgaggcaagaaatgagagtggccaggaatcaggatagcatcagtagcaatgaaggaaatggtcagatgtgagacacctttcaaagtataatcacaagagaatggtgaatgcttggagatgaaagtgaaaggaatggtaaacaactgaagttcacatttctgactttgtaactagtagatggcagcctgaaccatttactgagacaggatacacaagaatattcagtagctgattggagagcggggagaatgagttcaggttgggacatactacatttgaaatgcctgtggacatcaaagtagagacatccaggaggcagaggtggtgcttagaagaaaggacagactagagctgcaaatgcgtaagtgattagcacgtaaataacagcatgtgggaaaagatgcaactgtccagtgaaaacaggcaggctaggaagcctggtctagaacagaattcgaagggctgtcagcattcaagggacaaatagagaaatgtccacaaaagaaatcaagatagtctcctcctactgtgttttacattctccgagtgagcaaatggaagccaagagagtactttaagagagtgggccgggtgcagcggctcacgcctgtaatcccagcactttgggaggccaaggtgggtggatcacttgaggccaggagtttgagaccagcctggccaacatggcaaaaccccatctctactaaaattacaaaagtttgctgggtgtggtggggtacgcctgtaatcccagctacttgggaggctgaggcacgagaatcacttgaacatgggaggcagaggttgcagtgagccaagatcgtgccactgcattccagcctgcacagcagagaccctgtctcaaaaaaaaagaaaaaagaaaaaaaagaaaagaaagaaagtgatcagtggtgtcaaataacactaagatgtctgataagaaaaggactctggtctgccagatttaacccgggaaggttacaagagacctaggcaagaacattttctt

SEQ ID NO: 47500 - DNA, 1050 bp, Homo sapiens
ttccctgtggctggctttctcctacctcagcagcatgagggtcatcagaggggtgttaggacagttcagtgctatggtctgtctttgaaaagaagccagttttgtcttgttagatactggggttgtgatcctggatgacagggattctgcgtcagttctgggccaggggaatgaaggtttgacaggctggtcatagtacagggttattatgcaaaggggaattgctttctgagggcccaagatggtgcgatgaacagggtagcctggtgtcttggtccagctgacgcttgtgaatgaactctgtagtgcttgggtagaagagaaagactgaatatgatggactctccaccaatttctcaaattgttcaaatcatggtgtgatgcctcccttcataggctcccaaaggaggaatcctttctatctaccagaggttgccaggactaattcttttgatgcctgctaaactcactgggccttttttttttttttttttttttgagatggagtctcactctgttgcctaggctagagtgcagtggtgcagtctcactgcaacctttccctcctgggttcatgtgattctcctgcctcagcctcctgagtagctgagattacaggtgactgccaccacacctggctaatttttttatttttagtagtgatggggttttaccatgttagcctggctggtctcgaacttctgacctcagatgatctgcccacctctgcctcccaaagttctgggattacaggcgtgagcctcactggaccttatatggctatctccatctaaaatgtaaatacatcacttagccttactctccttttttaactttcatctgtaaattgctccaggctgcttctcctctgactcagcctctaacttctgtacccctcccaaaacttaatactggattcttaagccccattgtgtggctaacacctcctcccacatcctcaatctcttctctgaactcttcatctacttcctgcctccttaggtcacttagacgtcctctgaagtcttcaaaatagagaaggcttttcct

SEQ ID NO: 47501 - DNA, 1048 bp, Homo sapiens
atttcaaacagagagactataatacaaggagttagttgcataggtgatgggtggtaaattgacccagagagtagcagtagcaggaagttgctgttaccctcaggactggagggttaggggaagaggcgaagttaagtagaacccaggagcttctgtgagaactagacctgtggcagggtcattgagcaggagctgggaccttagaggaagggggccctggaggggaggcagccgctgccagtggcacgatctgaggcagagagcaggttgggacagaaataccctggcttgtctcctcatccttcccattctggtctaacatcaatatcttttattagccaaaatagcatccctggtggatgtgtgaccctaacagagccaggcagtctttcctgagatttatgagatggatgatgggggaaagaatgtcttgcctttctactagattgtgaatggtcgtgtccttcaatgcagagagtgcttggcttaagaatgaagccagagggaagtagagctaggagaggaagaggggcaagatcatttgagttcaggatccgactgtgccagctgtgcctgaagttagaacgggttcctggttatagggggtcataaattcccttttgttaatactgttttcaatttggtttgccacttgaaacttaaattaccaataccgtgaccttaaaatatgacttgaaaattgggttttacctgaggagtagggagaatggggtgtttattcctattggcagccccactagctgggggtatgtctgcagatcagctgaggtcgcagaggttgtgttttcaccaggtccgtgaagttggagggggctttcagatgtggggtgggaaaagccccaaggtgaagggcagagacaggaaagacctgtggccgctggaggaggactgaattgggtcatgcgttgggagtgggttttgagagtctagaggtggagattagtgagagacgaggtgggtagacaggtcaggaggttaatgagactgttttgagtgctgtgatgtggaggttagcttttattctttc

SEQ ID NO: 47502 - DNA, 1058 bp, Homo sapiens
gtgtcactgtgcctggctaatcttttcattccaatcaagtgttttaagcgggggaggaacagggccgtgtttggggttagagtcactgatcaagaactagctgggattgggtgggtggagcctggcggcaaggagtccaagaagaaggctgttgcagtgggaggttgggggaggcagtttcagtagggctttggctcactggattcagagagtgtactggttagtggtttgcttgcaaataatagatatctagcttgcattaacttagcaaaaaggtgagcctatagacaggcttgctttaacgtaggagtaagctggaaccaggggtctgaatgctactgagggtcggctttattctctcagactaacatcatcgacgcagggggagttgtggcagcgcgcctccctcacattgcacagctgtgcctccagaaagggagtgagtctatcttcccaggggaaaaggtcagggagacctggcttgggtcacgtgcctacctttaggctgatcaactgagctcaacctgggccaatcaacagtggcttggggaggagactgaaacagtaaggaagtcccaattccagctaccgggttcagaagcagctgtgaggtgtgcaggacaaacagtgaaagatcactgtggaagagactctagggtcactggctttaggaactggctgaatgatggcaagaatagaacaggaatttgaggaaaagtaggtcaaaaattatagattttctaaggcatgtatgccttttacaaattgtgatatacttcacataccataaaattcacccttttaaagcatacattttagtggttttgaatatattcacaagataatgcaatggtcactgctatctaattccagaacattttcatcatctcaaaaagataccccatacctgtgagcaaacactgtccattttccctattcccagcccctggcaactgctaatctgccatctgtctctggagttttcctattctggacatttcatataaatggaatcatacaatatgtgtggcctttcgtgcctggcttctttcagttaa

SEQ ID NO: 47503 - DNA, 1056 bp, Homo sapiens
ctaaggcatctctgtagcttggcatggaccaggcaccaccctggcacagacaggaagagctgaatcttcacttggcttctgggattccactcactgttggttccttatgtaccttactggctgttcctcctctgtctccttggctggttccgtctcatctccctagctctaaatgttggactgctgtaggactccattctgatatggcctctcttcatctgcatggtgtccctaagcaatctcatccagcctcacacatctacacactgataactccaggccagaaacctctctcctgaattccaaattcctgtctcccactgccttcttgatgtttaaccctgcatctccaacaggcatgtcaagctagttatctagctcactcttaattccaaggataagccttggaattagcctcggctcttccctttttcatcccatacctaagccatcagcaagtgcttctgaaataccatgtccagaatctcatcacttctcactctctccactgctgctaccctgactgctgtcatcccctcttgcctgcattactgtaccagccgcctgactcgtcttcctgcttccaccttcccaccttcagtcatatatccaggcagcaaccggagggattatttaaaacataagaaacatcagtcgcatcatgtctcttgctttttaaatttaattaattaattaattaatttttgagatggagtctcactctgttggccaggctggagtgttgtggtgcggtttcgactcactgcaacctctgtttcctgggtgcaagcaattctcctgcctcagcctcccgagtagctgggattacaggcacctgccaccacacccgactaattttttgtatttttagtagagatggggtttcaccatgttggccaggctggtctcgaactcccgaccttgtgatctgcccacctcgtccccccaaagtgctgggattacaggtatgagccaccgcgcctggcctcttttttgcttttgcttgaaaccatccagagacttctcagttctcacacattcccctcaaatcctcca

SEQ ID NO: 47504 - DNA, 1084 bp, Homo sapiens
tcatttgctaggcagacattgttttggttatgtactattgcttaaccaccccaaaactaagtaggttaaaacacaaatgtactgtgatcttttagggttctgtgggttgactaccctcaagtatgtgttttttgctctaggtgtctcttgtatttggagtcagaagttggctggggctgcagtcaactggaggttcattggactggttgcctaaggtgactcacttgtggccacagttgactggagtgcctatgtgtgacatcaccatgtggcttgggctactcaaagtgttgtggatgggtacctggagggcatgtcccaagaatgagcattctaagagtcagggaagtggaaattgctgggccatataagggctatgcctgaaattggcacaggatcagtttggccatattccttttttttttttttttttttgagatggagtcttgctctgtcacccgggctggagtacagtggtgcgatcccggctcactgcaacctacgcctcccgggttcaagtgattctcctgcctcagcctctcgagtagctgggatttcgggcacctgccaccagcccagcacatttttgtatttttagtagagagggggtttcgccatgttggccaggctggtcgcgaactcctgaccttaggtgatccgccagcctcggcctcccaaaatgctgggattataggcgtgagccactgcgcccggcccggccatattcttttggtcaaaatagtcagagggtctacccagattcaccaggatgggttgatagacatcatctcttgatggggaagtggccaggtcacatgacagataagcatgtaagaccagagatatagttaggaccttcctttgaaaaataccaactgccacagataccatgctggagatagaataacagctaccaggtccatgctttctcacaccttatggttcagtgccagaggcaggtggatgaacaggcaatgacagcacagatcataagtgttatgaaagagctaggtacaggggcatgatgagagaacttgggggggggggatttgcacagcccagactgggcaagtactggtgggtg

SEQ ID NO: 47505 - DNA, 1055 bp, Homo sapiens
agaagatgttgtccccctacaaatccccagacactggggtgtggacgccgtgtgtcccgtggtaccagtacattgaaaaggcagtcccatcagtggctgctgctgtagttggactctgcagtcacgtccacactgagaggggctgttgaaggtatgacgtcccagctgatgagcttgtccatctgccctgtagtcagaagcataacggaagagaagcggaggggggaggtctattgccatgagtaccttctgtgaaaaatggtacccttttagtaattacagtttttttgatattgcgtaggtatgtgattaaatgatctgtggtcagcagaaatgggagttgaaggtgctttttctgtgtactttccattaccccccaagttgggtgacattgcccttgaccccaggccacacttcttcactccgccgtgtcccattgcccttcccagatgtcccgtcatcagctagagctcatggatgtgactgctaggttaacctctaatttcctgtacgttctcttgcatgggggctaggtcataactcacctgcaaaactccaagaggagagaatatagggaaagcaccccctcctccccagcctgtgatctgatggcccacaggtcacccaggctcttcccatggtgtcatgtcactttcttgccatattctttagtctctgtttcccagttattccaaagcgatattcagaggccttcacatctgctgctaggcagggctctgttctgttaccaaacctccaaaccaaacaagataactaactaggccttcttagtttcacagccattttttgaatactgtagggacataatttattcattggcttcttaccaagaccaaagagcgaggtctgcaatttaaaaaatctatctttcccttcctttcctggcatttgtcccactgactaccctcctacccactactctcttttaaaaacgtcatagaaaattttaagcatatagaaaagggaagagaattgtataatgaacctgcaggtaccagcttcaatggtgatcagcttgggcatcttgtatcatt

SEQ ID NO: 47506 - DNA, 1070 bp, Homo sapiens
atctttttatcaccccaaaaagaaacctcacatcccttagctgtcacttacaaacactgtatatctcccagcccctggcaaccactcatgtactttctacagatttgcctattctggacatttcatgtaagtgaaatgatacacaacgtgattttttttgttactgggttttttcacttagcatattttcaaggttcatccatgttgtagcatatattaatatttaattcctttttattgccatataatattctagtttatggataataccacattttgtctattcacccttgatggacgttttggttgtttcaccttttggctattatgagtaatgctgctgtgagcgttcatgtacaagtttttctgtggacatgttcccattttggggggggtgtattcttaggaatgtaattgttgaatcatacataactctataattggccttttgaggaactgccagactgttttcaaaagtgatgacagcaacttacatttccacacgcgatgtataggagtttctccacatctccatcaatgctgttactgtctgtcttttggattgtagccattctactggatgtgcagtgctatctcattgtgattttaatttgtatttccctaatgatgttgagcatcttttcatgtgcttttgggcatttgcatatcttccttggagaaatatcaattaagatccattgcccatttaaaaattggggtgccttttcatccttaaattttcatagttcttttttcaaattttatatatatgtgtgtatatatatatgtgtgtttgtatatatgtgtatatatgtgtgtgtgtatatgtgtgtatatatatgtgtgtgtatataattttttttttgaggcggagtctcgccctgtcacccaggctggagtgcagtggtgtgatctcggctcactgcaagctccgtctcccgggttcacgtcattctcctgcctcagcctccctagtacctgggactacaggcgcccgccaccatgcctggctaattttttgtatttttagtagaaacagggtttcaccatgttagccaggatggtctcca

SEQ ID NO: 47507 - DNA, 1020 bp, Homo sapiens
tgccttctttcttttctttttctttttcttcttttcttttcttcttgccataacttttccatcatatcacgtgtacatcaagcaatgtaaaaattactgttgaatttactggataaatatctacttttctgtatttcagagactataatttagtgttttattccttgcattataaaattgacagggtatttactccatgtgtatttttcagaagtctttatattaatgactacatgaagatctgcctgattaagaaatacttttcttggatagaggggtaatagaactgtgtgctagcctggttgtttttccttgcaccatctcatcaattactctggtttttttcttcatgtcttcatagcctcttcccgagaagtttgtggtaaaaggtgttgtggatcgtttttcagaagagtttgtggagaccagaagaaaagctttggataaatttctaaaaagaattacggaccatcctgtgctgtctttcaatgaacactttaatattttccttactgctaaggtaagggcagaaatttacatcctcttcgtccatattaccattcttggggctctttcctaaaagctgttttgagcaggactcggtctctacaaaaacttttaacaaatagccgagtgtgatgttgtgcgcctgtagtcccagctacctgggaggctaaggcaggaggtagcttgagcccaggagtttgaggcttcagtgagctatgatcgtgccactgcactgcagcctgggtgacagagtgagaccctatctctttaaaaaaaaaaaaaaaaaaagcggttttgatctttcagaagccaccttcatgagcaaatggttcactgtaacagggttgtcataaaattggtctttttttgggtgcctgtgtccattagcatgcttttttgcattagcaaatccatatagatggattctatgttagaatttaggagatctgtccccaccccatccggggccccacccacttgcagcagcagaggaagttagaatatttgctctgc

SEQ ID NO: 47508 - DNA, 1098 bp, Homo sapiens
ttacagcatccatcctaggcctgagttttctagcaatgtttttctgccactgtttcctgctttccaccctttactccccttatatggctttagttggggtataaataaatgagtgatggatctcggaacctctgctcttcagttttgcttgtaaagacaatatagggtactttgtatgggagaaacagatacttaaaaaaaattatgttagaaacagcattgtgtttaaagggcagtgtgctcaggtgagtgaatttgattaaggattggcgttcagctctgctgaaagggatttaagtgtcaacctacaggagcctgagtctggtggttatgacgtccaggccaggttcctcctgtgaatgtgattagagcctctaactcagctccttgtttcccgagttctccatttccaaactgaagctgcttttagaagctgttttatttagtcctgcccatgtgagtgagtgagtgctttgagcttattcacatatcatcctcaggacctgaacgcctacaagaagcaagggatagcattgctgaccagaatgggcgagtcagtcaagcacgtcactggcggctacaagctgaggactcggccgcttgagtttgctgccataggtgactacttagatacatttgcactcaaactgggaaccattgatcgaatagcccagcggatcatcaaagaagaaataggtgagctgtctgttgaggtctcgattatgccctgcagccacattggcagaaatgccattcatgtgtgctacagagaatcaaactgcaaaatgctggagtgacagaactaggccatcttttgcttatcaaagaaatacaaggaggggaggagttacttgtgactggaatgtcactttgcaccccgtcctttgtcctgctgtgtcagccttgtgtttgcttttcccatggccagcactgctgattcgccaggtgtttcctcttttatgctctcttaactttagctttaaaagtggagacatagactcaactgcccttcatccatagggaacaataatttagtaaacaaacttagataccttttctggcagaaagatggttcagaaagatagcatggagacctgt

SEQ ID NO: 47509 - DNA, 1059 bp, Homo sapiens
atgacgaacacctttcctgtggaagggacagaggttactccggagtgccttgctgtccctgcctcactccccattagctgagtctctggagagttcttaggggacccttccttcttactctctctctctctctctttttttagagacagagtcttactctgttgcccaggctggagtgtagtgccacaatcctggctcactgcagccttaaactcctgggctcaggcaatcctcctgcctcagcctcccgagtagctgggactacaggcatgtgccaccatgccctgctaatttttaattttttttgtttagagatgggggtctcactatgttgtccaggctggtcttgaactcccagcctcatgcgatcctctcacctcggcctcccaaagcactgggattacaggaattgagccactgcacctggtgccttctcagtctttgtgtggctcaattcactaggaatcctgcctctatctagttgaatcttcccaaggcctgtggacgatagaatccttctttgactgtggcttttcagtgcctgactttctaagtcactcctatacccgtctccactctctgtgccctggatggaaaccagtgtttctagtgtcttcaaagatgcttctggaactgtctcaagtgccttctgcaggtctgtgcctcatgcttagcagctctgaaacagcccgggcagaagattccagagagattctgttcactactcaccataagaggagccctttatgagtttggacatagctgatcggatggttgtgacggggatgagagcaaacagcatgacggctcgagctgaaagagatcacacaagaacactccttgctgtagcccagcctgggccaaggaggaaattatcaaaagcctctcttagaacccccatctccccacaatccgaatgtggcttgacctggaggaagtcatttctctgctggcacactagcgccctcccttgaccagtctgtgaccctctgagctctgatgctgctgtgtatgctgcatatcagtctgcaaggtggctgggcacagttgacatggtga

SEQ ID NO: 47510 - DNA, 1020 bp, Homo sapiens
tccgtgcgccgggagcgcgccggccagtggcgagcagagccagggcacgcagcgcctgtgacagcagcccgcccagcagccgagtgacctcccgagtgactcctcctcaggccagaaaaggccgcgctccaccctgccctcgccacctcaggcagagtaggactggcgacagtccagggaagccaggcgcgggggagcgcaccgcgagtgctggctcctggcgccagcacccccggggccgacgggtcacgctgctcctgtgagcgcggccgcctgacggggccgaatttccccacagccaggcgtgcgtgcccggacctcccgcggatctctgcggaccccccaccaccggggcaggggctggaaggaagctccccaggactggctcagggagcgtttccaaattctcccatcccaggaaggcaggtttgcgcgaggggtgggacgcctaggattctgcctaggataagtattggggtgtgaagttttatttatagatttaatgcaacaggggcccatgtgctataggcagctgggtagcactttgagagaagtaaaaacttgggagccgccaggtccaggctcttctccaagccaaaggcctcttagagaagagtcctgtttggtacacctgcattggtgggcctagtgcctgggccttgtctagaaggctcctgccccaaaccccagggccaagggagagacggcaagatcctgccagccctagatgtccccctagatgataaaactggactcttgggcaggggcttgagcccactggaaggggcagagtcaccagggtcctcatctgaatcaagtgcccaggtccctttctgcttgttagtagtcactcttcttctgtctgtgggctcactcccctgggctgggctgagacctccacttcccaggtggcctcgcttcttgtttaggtacatacttctgcaaagaaaaccagggtgatggatggtgcaggggccaaaatgtaccacagagcatgacctgttccatggtcagccccag

SEQ ID NO: 47511 - DNA, 1050 bp, Homo sapiens
tccaaacctttaaggatctctggcatttgttaagtaaaggccagctgttgaatcgaattaatgcataacactatgatataataaagcatcttcttagagcaactattatatacccggcactaccctgaactgtttctgccagttcaagtccatttgatacacagtgggaaaagatggctattgaagttatcctttcccctttgatataatcactaaatgattgatctttttctcacaaatagtggcaatttggggaaatctcagaacaggcaggccttccaaatcaacgatgctagataacgttttgctttataaatacgaagttgtcccaggttgactgtgggaagagcaacactggttcattgcataaaacattacacaatgtttgttgatctaacttgacttgcaagctatcctgtgagttttatgataatttatgccaattggtggtatgatgcttgagttatggtaccttatgatgttgcttataagtgaaatgaagtatactccaatgtagaaacacctacaatctgattaaattgtagggtgcatctaataaatggtttctacagacatacttaaagtggacagaaaagcaaaatatgtgtctaaacagaaatgttaaaggggaatattctgattactgagttttcagcaacccttctgcccacaatctttcctgaagtttgggtaaattcatggctgggtcttcagccatagaaagtctgtcctcatcctttcttttttctttcttgaatttcatttcattgtggtaagaggacttggtaagagatctaccctcttaaaattttaaatgtataataccttcttattgactaaagctgccatgactgtagatatggcagaggaccgacaagctatagagatctgccctcatccattctctctggactcttgtgtcaggttgcagtaggtcccccacattaaaatttcccactaaacccaaatgtaatgcatctaactagtttcccccaagccagatggcaaaaaacccttctagccttgtcttaaaatccttagcattatata

SEQ ID NO: 47512 - DNA, 1047 bp, Homo sapiens
aatcaggagaaaacacatacaaaggaagcaaataatcactagaggcctagcaagtggttgaccaccctgtcttggaaagaagggctgggatgaggtttgggggtctggagctgaaggacagactttgagtcttatgtcaaatgattgttctatagtttgtaacttgcaaacttctgggttacatgcaaacctcttgtattgtccattaacttgggtcatggttaagatagattatcaataaatatgtatgggttcaaaaaaattaagttgtcctattgtatctagcttatttcatttaacataatgttttcaaggtctgtccatgttgagtatggtcagaactttactcctttttagggctgaatccatttcattgtgtgcttgtacctcattttatttatccattcatctgttcatggacacttgggttgtttccacattttggctgctgtgaacaatgctgtaatgaacatgagtggaccaatatttgtatgatttcctgttttaactctttggggtgtataccctggagtagaatttctgggttgtgcagaaattctatgttggggcttttgggggaattgccaaattgtttttcacctcgacttcaccattgtacattcacagcagcaatgtgcaagagtttcactttctctgtatcctcaccaacacttgttattttctattttttcccttctgaggtttgctgacttagaaggtgtgaattcatattattttttaggttaaataaaaatcatgtttcagaataagatatagtggtgtatcctaccagagatgatgtattactagagattaagtttgtaggtcctcttcccccaccaatcttctgttacaatgaaccaatcattccactccttgtatttattagaggtagcttctgaagaagctccctaagaaagagtaggtcccttagaaaaattacttagggtatccttccttagaaggtaagacaggggttcccctggagtccctgagtgtagcctccttttggggagggggacaagtgagtagccccattgtctgggg

SEQ ID NO: 47513 - DNA, 1047 bp, Homo sapiens
actcattcactcatcactcattcactcagcactaattaagcagagaagagagagaacacaggaacttattaaacattccttgcattgcatgaatgatgaagagaaattctattacagagaaaaatgatgaagaaatagttctgaccctgtattctaacttatgttgtataccagaaaagggggagggaggatgttgagtaaatgacttttgcttttttgctattgctaatgccatcttaaccttctctcagctgaatacatgaaaaagagaaaggaagtaataaagggtcccaggtttgtttctgccatcttcaacatcagaagttttgaagaatttttgataaattgaggaataatggcaaaatctgtagatatctcttattaaatatttgctttatgcaagctgctaagactttcacatacattatctgaaagccccacgataaatctaaggtagttgagaaaactcaagatctattttccaggtttgtggaaaatgggaagacagttccattcccaggttagacgtcaaggacatacagagtacagaagaagaaatgtggattataagttggagggtgagatggcctcctgggagttggtccacaaacacagaaacatatttgagtttcatacaacctactactttttccatttcgaacgtgaaatcctagtgatttttagcacatcttcaattactgggcccttttcgcaagcattatatctacacagcaactctgtaaactaggcatcattgtttcctcttcttttttttttctccctttcatggagaatggtatctcattatgttgcccaggctggtcttgggctcctgggctcaagcgatcctcctgccactgcctccctaagtgctgggattacaggtgtgagccactgtacctggcccattgtctcctttttaagtcttaggttatttgctcaaagcttatgggagaattgggtcctctatccaggtcttccaactccagatttcaagattttcccacaagctttcctaccaaattatttttatggtatctttgggtg

SEQ ID NO: 47514 - DNA, 1164 bp, Homo sapiens
gtgagaccctacctctatgaaaaactttaaaattagccctgtgttgtgatgggcaccggtagtctcagctattcaggaggctgaagtgggaggaccacttgagcccagaagattcagtgagttccctccactccatgatggcaccactgcactcaaacctgggtaacagagtgagaccctgtctcaaaaaaaagagatgttgaagaaataatttctggtatagtttgtatatttgtccccaccaaaatctcatgttcaattgtaatcctcaatgttggaggtgaggtttggtgggaggtgattggatcatgaggacagatccctcatgaatggcttgggccatccccttggtgagaagtgagctctcactctgagttcacaccagatttggtgatttaatgtgtgtggcacctccccctcactctcgcgctctctctctttcttgctcctgtttttgccatatgatgtgcctgttcttgcttcttcttctgccatgcataaaagctccctgaggcttccccagaagctgatgccagcactgttttcctatacagcctgtagaaccacaagccaattaaacctctttatttataaattacccagtctcaggtatttcttcatagcaatgcaagaatggtctaatacaatttccccactaaaaagtctgcacaaacttataccttcagcaatagcatataagtctggtttgcaaattcccaaaccaaaaagaatattactgtcttttaggaagggggaaagtttaaatgatattttattatttatatttttaaattagaactattatatatctctacacactaaccagaatgacaaaaacacacaaaaacctcacaacatgaaatattagaagaatgtggagcaaccagaattgtcatacattgttgatagaatgtaaaatgatacaaccactgatttatatattagtgaatgaaaaagccaaaagcaaggcacatcacacttaaatttagaagactcaagaaaaagaaccagctgggcgtggtggctcatgcctgtaatctcagctctgtgggaggctgaggcaggaggaacacctgaggtcaggagttcgagaccagcctggccaacatggagaacttcgtctccactgaaaatataaaaattacctgggtgtaatggtgtgtg

SEQ ID NO: 47515 - DNA, 1050 bp, Homo sapiens
ggccaggatttgaattcttgtgctgaggcttcctagatatgtaactttgggcaaattactttacctctctaagtctcagttttctcctctataaaatggtgataacactgtcttctgcagtggttgctggagataagccagtctgtgaaagtgccaaacagcaccgccttttgttaagcaacaaagaaataattagttctcactgcctcccaggtccgcacacgggagacatatccaaagcctgcaaggatgatgccaggccagatgaagtggaattttgggtcctatcttttaaaacatttaaaatcaagaaacattttttattaaaattaattattctgtttttttaaagactgattgcataatctttggaagatcctggaatcaagaaaatgaccacaagtattttctcactactgttctctgcataagtcctggtcccatgagttctaagggaatggaagctgctctcaaagtgaagaatccctcaggtgccatgaacaatggaaagaagggaccctctcaccttctttgcatggcttcctagactgcaggactaagcctgcaggagcaagaggatgactggactggtcctcacagaaccatcatgccccagggatgagctaggactacagtggtgactttctttgaaagcctaaaagttccagggttaggtatcaaagggagtaaatatgccacaacgttttgtgcacattaactgacccagatctgtaagactcctacccttagattcccaaaagagcacagacagcccttggaaccaaactcaatttttctccaagggcttgggtcaagtttcattatagacatttattttagttttattttcaaagtcattgacctcttgtatcagatttaaggcaaagaagaagatacatgtcccaggactataggccaggctgttgactgcactgggatttagatggtgtaatctcccttagttctaccagggagacctcagcccaggtcttgttgccggggcacagttgagcactggattcaggtagaggagggctcccaggtcagtct

SEQ ID NO: 47516 - DNA, 1024 bp, Homo sapiens
acagctgcccacctgccatttgccccatcactgacactttgagcatggtctttattttattgtgtattgtattttttagtgtttactctaaaaacattgtagacaaagactctgttttatatctttttatacctctgatgtaatctctttatggtaatggtatcaataataccagattgtcgagctctgtaattttttttttttttttttttgaaatggagtcttgctctgctgaccaggctggagtgcagtggcatgatctctgctcaccacaacctccgcctcccaggtttgagcaattctctgcctcagcctcccgagtagctgggattacaggcgcgtgccaccaagcccagctaatttttgtatttttagtaaagacggggtttcactgttgagctctataattataaaataatgtagtgtctggcatgaaagtggatctttgattatgcctacctgatgctttgccttatccttcactagaaataagaacctatttcttaagccagctgtcatagaactatggggtaggagttaacaaggagaaaataaatagatggctccctgaatctatataaatttcctacccacagtctttttttttttttttttttgagatagtctcctgtcacctaggctggagtgcggtagtccaaccttgactcactgaaacctccacctcccaggttcaagtgattctcatgcctcagccacccgagtaactgggattacaggtgcatgccaccacacctggctaatttttttgttttagtagagatggggtttcatcatgttggccaggctggtctcgaactcctggcctcaagtgatctgcctgcctcagcctcccaaagtgctgggataacaggcatgagccaccgcgcctggccaatttattctttacctcttggtaattgtgtcttatttctcagcttatttccttcacagcatgaaattatatttattgtttctctccctatcaggaaccttgtcttattcattgttgaattattagcaccta

SEQ ID NO: 47517 - DNA, 2818 bp, Homo sapiens
gacagccctgtgctgtttcatttccatggaccaatcaaagaacattcaagtacccatgagttgccagagtggctgtccagttccagctgagctcatggcaagaactcttccctctttctcctgatctgcagaactcctaggagtccctgattgttgtgtccctgtttactctccaggcaacagatgctgagctttcctcacctcctgcaaacagtgctgcacatcatccaggtggtcataagctacttcctcatgctcatcttcatgacctacaacgggtacctctgcattgcagtagcagcaggggccggtacaggatacttcctcttcagctggaagaaggcagtggtagtggatatcacagagcattgccattgacatcaaactctatggcgtggccttatcgattgcagtgggaagttgttgaagacttgaagacgtgattcctgctccaatcatcccttcttgctcctctttgtgcacgtacacacacacacacacacacacacacacacacccctgctcaacagaggtttagtttacagtctctgaactaaagtagtaacctcccaaattgttttttctaataagctgagattcccatttctcttaaggagaagccacccatgagatgtcttttccttctccatcatcttagagccaagttatatgttcttgtctaatccatgtagctttttgttcaatgacttgatcatctgcttcctttttgaatttttaacagatagtaagtaaatttggtggttttttcccctgggtcagtgatggaaaggggttaacttcagccaggattgatggcagctgagggaaattcttgcccaactaaacccagaactcaaacttaacattagaaaataaggtccagggccggacacagtggcccatgcctgtaatcccagcactttggggggccaaggcaggctggatcacctgaggacaggagttcgagaccagtctggccaacatggggaaaccccgtctctactaaaaatacaaaaattagccgggcatggtggtgggcgcctgtaatcccagctactcagaaggctgaggcaggagaatcacttgaacctaggaggcggaggttgcagtgagccaagatggcgccattgcactccagcctgggtgacaagagtgaaactccatctcaaaaaaaaagaaaagaaggtccagcttttggattcaatgagtgggaaatacattgtgcctttctctagatgtgatacgttataccaaaatctttgtagtgtgcagagcggtggtttgagactaaatacaggcttagaacttgcagagtgtgtattcttggatggctgatgcatcgacttgcattcccacttaacactttgattagcatgaacttgccaatcaaaaaatgacaatcaatttgagaaaatagaaatagatatttttaaataaaaccattcacagtttactttgtcttgataccttggtttgtcccagctgaagtgaagcaagagagtttgaattaatttttccattataatgttttcgcatgtctgcctctaaaactgtgattttcaagctttagcgtgcatcagaatcacctgtagggcttgttaaaacactaattgctgggcctcaacccaaaagcccccaaagtggcacttctgagttcctgctgatgttacaagggaccacacttttgagaatctgtgctttaagctaaggaaatattgcctggtgggttggctgcctggtattgggcatggaaatttgaattgctgattggtagatggtgtgtctggacttaactcacgtagtaaatactgctgatcaatacctaatcattccacatttattgagctccacctgtgtgtatgtgtacccaagcacacatgtgtgaagggctatagccaaagtatttttactagcctgtatgaaatcactagtccttatttttaaaggtctatggtttcttggaagtagtttgattgttgagagagacctttgatctgcagtgtaaatctaccagtcatgggccagaagggcaaaagcccagctttctctttggaaagactcaggctgtggtttgttgatggccaggttttcctcaggctccaacaactgtgcttataccaagcagatcctcatcctccatataatcatctttgttattcgtgggggtttaattacattacaagtggccaaaacccctgttctcagtgaagaaccacattggatttgtattctgttcagttgtagtctacactgcagtcttattcctggttcaaactacctctttaaattgatttgtcttgtgctggtctgttaaatcctgccctccttggtgctagatccagttgtgcctcagggcagaggaaacaaaacacagctatcctgttggcctgtgttgtggttttgaagtttgtactttctctgtgggtgccagttaaatattggagagcaaggaatgtggacttgtatggctttgaaccaagagagggttatgagcctactggattgaggttaaaatccaagaaccaacatttagagctttgtgcttttctctcattccatcactttgtaatgatgatacttaacatgagcagggtgaatgacaggtactgacgaagtccaacacaaaggtataatacagcctgttgtctaaagccaaggagtcataaaaccatgagaaataaataggaatcaatagttagtagtgacattggtgctctctagaaatctcagcatgagctgctatagaataccctcccagcaacaaaacctaatcagtaaggccagctagacccaatggctcatgcctgtaatcccaaca

SEQ ID NO: 47518 - DNA, 1900 bp, Homo sapiens
agccaggcatggtggtgcatacctatagtcctggctatttgggaggctgaggcaggaggattgctttagccctggaggtcgaggctgcagtaagccatgattgcgccactgcactcagcccgggtgacaaagcaagaccctgtctcagaaaaaaagaaaattcaaggccagttaagacaaaatgctatgactttgaaattcacagaaagaaataacagtttagattaggtcttcaggtattcaggatagagataatctcctgaaaaacctgaatttcagagattcttagactggctgccaaaggatgaagctagtgaaggagaaaaagcttaaattccatcttgagctcttggattgtgataatacaatgatttcattaacttttcatttctgtatacctgttcatttggaatttaatgcttgacttctttgttcattttggatctaaacttctcttttcttccttccccattcacatctattagaagactgcatcaccatttctttggcccccttactctgttgtcctttcccttttctttcagtttttttaatcgcatgtctagtatattaagtctccatagccctcctgatgcagtagacagtgctatgctgtggatataataccaaccagaaattggcatttataaacctgttaagagactttaagcatgcttcaagaggcagttgacccactggaatttctataaggctggtacccttcccagagttacagaatcttaggtgccgtctctagtctgtgagggaggaactcccagcatccccattgcccacaaatggaatcctcactgtatccactaggagattagaaattaaggtttcttcactacttctatggtagggttgtctgaaattccctttcaggctgtgggtactggtcttgggttctagtcataaggggttccttataaggagcaggcggaggggagtacactttcatgtgatttaattttgatcctgccctctccagctgctccttcaaaagatacatcaaaagatagaaactctgggctgggcacagtggctcacacactttgggaggccaagcgggggtgcagatcacctgaggtcaggagtttgagaccagcctggccaatgtggtgaaaccccatctctactaaaaatacaaaaattagctgggcgtggtggtgcatgcctgtaatcccagctactcgggaggctgaggcaggagaatcgcttgaacccaggaggcggaggttgcagtgagccaagatggcgccattgcactccagcctgggcgacaagagcaaaactccgtctcaaaaaaaaaaaaaagatacaaagtctgcatttgatataatgccttaattactgggtctacaattaatgttgactgttttagattgtaagctcctggagagcagtattgctgtagtaggaatgttttaacagtgtcatatgaaaaagaacaaaataaatattttgattttgtgattctatgcaagtctttctgcccagagtgataatgcaataagctagtcttttcatagtctgcatagagtctggccattaccatcagtttttaagatgtccatattgtggccgggcgcggtggctcacgcctggtaatcccagcactttgggaggctgaggcaggtggatcatgaggtcaggagatcgagaccatcctggctaacacggtgaaacccgtctctactaaaaaaaatattaaaaaattagccaggcctggtggtgggcgcctgtagtcccagctacttgggaggctgaggcaggagaatggtgtgaacccggaagtcagaggttgcagtgagccaagattgcacctgggcaacacagcgagactccgtctcaaaaaaaaaaaaaaaaaaagatgtccgtattttaggtggtatgatcc

SEQ ID NO: 47519 - DNA, 1048 bp, Homo sapiens
aaagacggttacttagcgcaggactgtaacagtggagatgaaaaggtatgggtggattccagacatattctgaaggtagaatcaaagggtctacagacagatcgaatataaagcgtaagagaaagggaggactcaggaatgactgctaggtttctggcctgaggaactgaatcaatactgagatgggaaacactggggaagaatggaagggacgactggttcaagggagaaatcaagagtttttctctcttctttttttaacatgttaagtgtagtaggctgaaaaatggcccccaaagctagcaggtcctaatcctggaacctataaatgccttatatgggaaaagggcctttgcaggtgtgactaaattaaggatcttgagaaggggggattatcctgggttagtcaggtgggccctaaacacaatcacacatatcataagaaggaggcagaggaagttttcacagacagaaaagaagacaatatgactctggaggcagagactggagtgatacagtcatgagtcaaggaatgccagcagccaccagaagctagaagagccaaggaatggattcttccctagatcctccatagggaatgtggccctcctgacacctaaatttcagcccagcaatactaatttttggcctataaaactgtgaaataataaatttctgttgtcttaagcgatgaagtttgtggtactttgttacagcagccacaggagacatacatgaagtttgagatgcctgtaaagcatccaaacagagatttcaaataagctgttggcttaagagtctgcagttcagaagttaaagttattgtgtatgtatgtgtgtgtatatacatatttatgtatgacagagagtctcactgttgcccagtgtggagtacagtggagccatcatagcacactgtaacctcaaactcctgggctcaagcaatcctcccgcctccgcctcctgagtagctcaggcatgcgccaccctgcccaacatagagacaaggtctcactatgttgcccaggctggtctcaaactcctggcc

SEQ ID NO: 47520 - DNA, 1046 bp, Homo sapiens
tcaggaactgagtgctggataatgactatggttgttaaatgaaattgaggggtagagtagggatacatgtgggtccttgtttacaaccctgttgctcctggtgatggtgtttctgtgtcgcagggcaatgaaacgcttggaagaggcccgactccataaggagattcctgagacaacaaggacctcccagatgcaagagctgcacaagtctctccgggtaagatgctcccagcaattgtcccacatcttaaaggttcttcatgtttatttgatttttctactttggctcacctctgggaaggtagaggcaactagagtgattcctccctgcttaagttgagctgctgtgacatggaaggagccatcagttaatgtggcaggagcttactgtgctttgtattcagcagaggcctatggttctattctttatttctccccgttaatatgtcagagtttctctggggttttctgtttatatttagctgactcagaagttgtgatcctaagactgtagaaaacatctgggcacagtggctcagtcctgtaatcccagcattttgggaggcagaggcaggcggatgacttgagcctcaggagtttgagaccagcctggtcaacatggtgaaaccctgtctctactaaaaatacaaaaatttgccaggtgtgatagcatgtgcctataatcccaggtacttgggaggctgagacgggaggattgcttgaacccgggaggcggaggttgcagtgagccaagatcacgccactacactccaccctgggcaacacagcaagactctgtctcaaaaaaaaaaaaaaaaaaagactatagaaaacagcatgctggagtttcatataacttcatttatcaatgtatgtgtcttctaacagcagcaacaaaaccatagaagaatcttgggatgggttaaaactgaaaagctgctttgttgttctttttatggtggaaaagcaaaggagctcttagattaacctattaatgatcaccgtgtgtgtattttttttctttttaagtctttgaataatttttg

SEQ ID NO: 47521 - DNA, 1045 bp, Homo sapiens
taagctgggaagaaggtggaagttaggatcagccccaggtaaagacaccacacttccactgttcttacccaaagttcaatagtttttcaaacataaatgcttctggaattgttgtgtgccattagttgatttcaagaggagtgaaagggttgttttatcaattttgtccagctttatgggtattttttggggaaaatatttgctggtctccttactagaccgtagccagaagtttgaaatttcaggctataattttatacccaggttaactaactctggtcatgtgttcttactatgccgtgtggcctcccttatgttgctttagcatctgaaaatttacaaagttttttttcacaagtattacctagtacccgggacaattccataacatttttgtttctgtttttgttttttctagttttagagctgaagctattgaagtataagagatactggagataaatatttacaaagagaaaacttgagtttggagagaaggacattaatcaagaatgtaaaacgaatcaacgactgtgccagaataggaacctaggtcttccatttcccagctgagggtctttgtgcatcacccacttgctttcttttggaagaggactggggataaaaatattcctcatccctcctccaccccacctccatcatgaccttactggtatgaggaaaaagcccaagtcaaagggcaatagaccattggcactccctgcccctagagggtgctactctttctataacatggacacaggttgcctagaaaggtgatttaagtgtgaaagcatttttgattatggcaattgcatacattctttcaatcgaattctagctggattaacctgtctttagtatatggctatgaataatttatattattatctttcataatataattctgtttaaagtgtccattaacattgctttttctcagggactttccctcaactcctgagttttagttgtagtttgtagcagcctgttgaagcattcatgagtgaggatttaatcaggcaatttttgcaaaaatgatcag

SEQ ID NO: 47522 - DNA, 1079 bp, Homo sapiens
tccaccagttaatcattttgtggtgtttgccaaagtacttcatttccttgcaccgtattttccttacctgtaaaggtgagatgataatatattgatgatgatgattgaagatgatgatgcatagggttcttgtgaaagttgtgagagatgtaagaaaaaagttttgtaaagggcaaagttcttttcacttgcagcatgttatttgtgcatcatctagtccaaggatggtaaataagtagcatacatgctgccattccccatcctctagcctgtggcagacatcactaattgaccatggtagtcctttccattgagtatggccagcggcctcagagtccttagtattatataatgctacccatcagttgggcttagatgggacatgaagccagtttgtccttccttatcgacacacacacacacgcaccccatgggacatgaagccagtttttccttccttatcgagacacaaacacacagagagagagagagagagagagagagagagagagagagacagagaaactgaggccttgggaagaaggtggagtgacttacccaagacctcagtgaacaagcggaagtgggactaaaagcctcagatttcttcactcctcaaccagtgcttttcctgccctgtgtgtatacactgtatcaaaaggaattaaaattaatttggtcttgagaaatagcgagagaatcctgactcctcccttccctgttataattagatacccttggggttgtcatcaaagcagggctggatgacctgcttctctgcctgatcctggagtgatcaggtttcaaaggggagacgcctgtggctaggcagctggattggatggtgtctctcagcagtgtaagtgacgtggcagtggggcaaggcaggccctggggttcctggatgatgacctgggtttgggacaggtttgctgcttacacactttcaagtccacagacaagttctttagtccttccgtatcttaatttctgcatctgagaaatgggctggtaatgattcttcacaggaatgacataagataacaagtttgaaaatgctttgtaaactcttgacatac

SEQ ID NO: 47523 - DNA, 1025 bp, Homo sapiens
ggtcacaaaaagacacatgctgtgtgatcccactcataagagaaattgaagtcaaacgcagaaatggaaagtgaaatggtagttgccagcagctggtgcaaggacaatgggcagttgttaaataggtgagagtttcagttttgtaaaatgaaaaagttgtagagatctgttgcacgacagtgtgaacatggttgtcccttagtatccgtgggggattggttccatgccccgcccccccaatataaaaatccatggatgcccaagtccctgccatcaaatggtgtatttgcatagaactacgaacatcctcctctatatttcagattatctctagattatgtatagtacctaatacaatgtaaatgctgtgtgagttctgtatatttagggaatatgacaaggaaaaagtctgtacatgttctgtacggatgcagcagttcattttaatccaaggttggttgaatccatggatgtggaacccatgaagacagagggctgcctgtatacttaacactgctggattgtacatttcaaaatggttcagatggtcaaagaaaaaagttaaacacgtccataacctaacacatcaacagtttatcttgtaggaacatgcaagaaatatttatgtctttataccatgcaatatatgcataagtggtcacagtagaattgggtttataaataatatgaaataactggaaacaagcagaaaagcatttacagaaattatacatttcttctatttttttatataggttttgttgtacttaaatggtttatctatttggaatatatttggtttaaaggagggacatagggatcaggctctattttttcccaaatggtgagcccttgctataacgccaataattgaatgatccatcttttcctgcctgatttgaaatgctgtctttatcttacgttaaacttctatgtacttaggactgtttctggactgtctgttgtgttctcttgatgtacagatgtacaggtatcacactgtttatcactttaaagtaaacgtt

SEQ ID NO: 47524 - DNA, 1273 bp, Homo sapiens
gtttctaggtaggcaataatatcatatgcaaataatattcatttcccttcatcttttacaatattgtacttttttctcttatattatgcattgactagacctcctggaacaatttgaataataacagggataacaagtattcttgtattatcttatttcttttcttagtgagaaggattctagcgttttgtaatcaagtatgatattttattttggtttcagaaatgtatattttttatcactaagcatccttctgagttgctaagagttttttatttttaaaatttgtgaagatggaggtgagtgatacgatagaggagtgattttcaattttctgtatttgaatttttcttttgcaatggaggttgaatcattcccctcccccactataaagctatttagtaataagagggggtaaaaggatgatgaatttttaacaaatgcctttttattatgtacccagatggccatatggttttttccctttgatctgccgatgtgatgaattatattaatagattttctaatattaaactatcctggaaggaacccattttgtttatggtgtttttattcttttaatgcatcctgggtccaatttgcagcgttttgtgtctatatccattagtgagattgccctgcagttttatttttagtgtgctgtttttgtcattttttaagggggttatgctagtataggggttataaattagaaagctttccagtgatctgaaacatggaggataaatacatttaagattatgtacttattggtagtggtcgctgagattgctgtgttgagaaggattctgaggccttgtcatgtgtaaacaatttagtgttttgtaagagtgtaggaaatgagggtttaagtgtgcatgccagatgtttatttgtagtccctgcttggaatgatttatattgcacgggaattatcttttcagagtttaaaataacttgccattaaactctgtcttgtcaggtttttggagataattattttctactgtaatcctttcttcaataacattttggcttttgctcttttcatgcccgttttgaccatttatattttctgagaaatgtattcatttcatcaagaatttgaactgtatttgcatagaacagaatataatgttattttaagaatgtcctctgtatggttctatttcctaaactgattttttttgtagttgtattattttttttctttattccttggttgaatgactggtattcagggagtattttgttgatttctattgttttattc

SEQ ID NO: 47525 - DNA, 1083 bp, Homo sapiens
gccagagtccccattctagctgagtggaagctccagccaggggacagggttatcacggggtctcgtagctcataaacgccactgcttcgtggctgaactaaggcttacagcttcttaagtggcctggtggctgggtcccaaacctgcaagcaagttttgttctctctcctgctgcctccttggtccctaatcctctgagtcttttattccaaactcctgttctccggactatttctgttttgttttgtttttcctctgcgtgtctaactggtcttgaagctgggatactaagtgtgtcgcagtgggggggacatcgcgctgagcatctgtggccttgaggtgcctcttcatgcctttttgggcctgtttttgcatctgcataaaggggtccaatgcagtgcaatacagactctctttctgactttctgtgattctgagaagaaatggcagtgcttccattttctcagctaagtagggtaagaacaatcagaagctgcctacgtgagggtggagagtgcagacaccggagttcgccagcctggattcaagtcttgcctctgctccttcctccctgtgtggctctgagcagtttgctaaacctctctgtttcgtctttgtaaattgcagggtcaggggctggttcagagaaccccatgtggagttagttatgaagattaaatgaattaatacatgtaaacactcagcacatagtaagaactcagatgctacctgttttctttccctcccttttaaaagtcatgtgccacaagttaattttgctcagtttagggtgtgtggctatctttgcttgtgtagggtcctttctagctttgtttagtttttatccccattttctccaacttctctgctcctcccctacctccaagccgcttattctaatgtatttaacatgcatctttttgtttatgtgtttttagagacatgcactattgttttgtgtgcatgctttaaaaatttacataaataatacagtgtttgaatctcattctgtttctcacttttgtgcctctgctctgtttttgagatctgtccacattacttccagctgcttggtgcagccac

SEQ ID NO: 47526 - DNA, 1048 bp, Homo sapiens
ccccatttccagtgtgtaagtcctggtgacagtggagtatatcaccctaggtctttttcttatacatttacagatacaactgggagccattcatactgttttacagcttagcttttctcacttaatagggtgttcgcaaggtcattctatgttagccccaataaatctgcctctgttttttttttttaatcaacactcagtatttcattgtaagcatctatcatagtttatgtaactagtcttctggtgggtattttgatattcccagttttctggctgttataaccggagaaccagtgcttcctatgtaggtctgctgctgatgaattccttttggttttgtacgtctttattttgcttttgtttttgaaagatatttttgctagctatagaattcgaggttgacagggttttttgtttgtttctttctttctttcagtactttaaagatgttgcttcactgtttcctggcttgtttctgatggaaagttggctgttattctttgttcctctgtgtgtaatgtcttcaaaatttttttcttactacttttaggattttctccttatctctcattttaagcagtttgattaatgatgtgtctgtttcttctgcttgggatttattgagcttctgggttcacaccaaactagaaaactttcggccattatttcttcaaatatctttctcttctccccttcttcacccctccttttttttttttttccaaggattccaattgcatgtatattaagccttttgaatctgtcccatagctcattgatgccctattttttccatcttttatttttctgtttcattgttaataattattgctgtcttcaagttcatcaatcttttcttctttaatatctaacctcttctttttttttttctaacctattcttaatactacccagtgtatttttttaatcccaggcattgtatttttcatctctagaagtttggtttgggtctttttatatctcctgtgtccctataaggtgattatgttttttttcctctaccttcctggacatatggagtata

SEQ ID NO: 47527 - DNA, 1049 bp, Homo sapiens
catttatctttatggcagcagctatataaggagatagtattatctctttgtgctgacaaaggtgggccattctgagacatgcgcgtgtgtctgtgtgtgtgtgtgtgtgtgtgtctgtgtgactgtgtgtgtgtattgcagtgttggagagaagggcaggaacacccgaaagctttttttgcaacagctctgtgaaatattgatcaatttgattccattgtatgacccagggacaattttactagcagaaaatatgaccgtgttatatggctgcaataaaaaatcacagccatgagctcaggcccagaaaacgaaacaagctgatgatgtagcctggaccggtggattccgcatctttctgctagagttcatttgctgtttgtgccttcgtggtcctgatgataaggttacaggtctcagccaaaaacttaagaagagcctaaaactgatttcagtttgacccctcataagcttctcttgcagttaggaaatgcccactgttgttctgttgtagaggtaagtgtaccagtctaggttgggagctgtcccgtggaaagggaagggcactgaaggttttgaagcagagacatgattgatcaatgagtatcatggcacttaaccgtggagagttaagaatcatgcaggtggcagttaccctggtgtgagcgtgcctagaagatgagaactgatgagcttttggtccctctcagaatgagaacatgtcacccacctaactgtgattctcgtgttgcaaggtgtgtatccttcacccaacatggtcccttaacacatcttcgtctggtgctcaatcagaaaaacattgctctgtcccaattctggaggacaaactggttattgggcttctagaaaactgggaagacagtctccagcaatggtaccttcttaagagattgttcaagtgaaatttaaactttatttactggctcgaggactgaatctttcctaagatgctactctgccaagcctttgggcggctaatctggcatcttgttcagaaggaagaggggcatggagagggtggaatgggg

SEQ ID NO: 47528 - DNA, 1984 bp, Homo sapiens
ctgttcttctcaggggaaatgggactttctgaacttcatcattctgaagtgtcccacagatcaaatcctttttttgactactccttacataaaatatttttatgacaaagctttctacaaagcaaaagatgccttctataaagtgaatcatcacttcggatgcttcctttgtataaacctggcctttcttatgttgtagggagggtttttttttcctgttatttgtattatccaaagcaatacatgttcgctgttgaacagttaggaagttccaatgagcaaaaaggaataaaaaaatcaaaatcacccataactttcccatgcagagataatcactttggatgttgatttttgatgtatcgatactttgatgtatgtactgaaaacacatatgacatgtacataacttaaaagcttgttcattcaagaagtatttattgaactcctactctgtgtgtgatcctggggataaaccagggaacaaaaaataaacacaatttctccaggggacaatttatgcagataaaaggaagagaagaaattggaacagaaatgggactgaggaaaggcctgaaactgatagtgaaagtcgtcatgggctctgagagttttgatctcactgtggagtggttaggtatgaaatggagggctggacggggcagagggaagataagttggcagctgcccagagggccaataccttctatccaaagaaagtggttgtggttggtgtcctaagttatgtacactggcagacaggggcaggccggagagggttttgttttggtttgtttttttttttttttttttgcatgcggatgcccagttccagcaacatttgttgaaaagagtatccttactcctttgaattacctttgtgcctttgtcaaatatcagttgactatattagtttgggtatatttttgggctttctattctgcttattctgtctgttctgtttattgtgatctacttgtttattctttcaccaacactacactgtcttgtttactgtacctttatagtaagtctcgaagctgggtagtgtcaatcctccaactttattgttgttctttgggattgtattggctattctgggtcttttgcctttcagtatatacactttagaatcagtttgttgatatgcacagaacaacttctggacttgtgattgggattgtatcaaatctttagataaagttggaaagaaatgaaatcttaacaatacggagtcttccctccatgaacatggaatatctctttatttatttagatcttctttgatttttttcatcagagttttgtagttttccgtggatatcctgtacatgttttgttaagtatttatacctacgtttttatttttttggcactaataaaaatggcattgtgtttttaatttcagatcccagttcttcattgctgggatatgtgaaagcaattgactctagtatcctgcaagcttcctataatcacttattagttccagtttttaaaatggattatttgggattttctatatggacaatcatattatctgtgaataaagaaattttttttgttttgttttgtttttacaatctgtataccttttatttccttttcttgtcttactgcattagctacgacttccactatgacattgaataggaattatgagagaggacatctttgccttgttcccgatcttagggggaagacatttagtttctctccgttaaatatgatgttagctgtaggttttttgtagatgttcttgatcaagttgaggaagttaccctcttttcctagcttgctaagagtttttattatgaatgagtgtcaaatcttgttaaatgcacatctatgatatgatcctgtgactattcttttttagcctgttgatgtgatgggttacactattgattttcaagtggtaaaccagtcttgaactctaagaataaatcccatttggtcagggcatacactttttaaaacattttta

SEQ ID NO: 47529 - DNA, 1044 bp, Homo sapiens
tggagggtgtgctgggcttgatggacttagacttcaggctgctgctgtttggaaggaagttagagggtccatgctgtagagatggcaaggagtggtgagggggatactcaccctctggggtgccccaggcccagcctcaggtctgccacccactggttgatcttgggcaggtgactcttcctcatctgcagagtgtagatgacaattacacgaacctcctctgtggattgtgaggagtaaatggacaaaacacatggaacgcgctgaagcccgtgttcggtttatggaaagcaccacagactggtcgctcttttcaccaaagcacatctgtccttacatggggaagattcatttctagagagagatttgcaaatgtgttccccaaaatgggattgttggagtgagaatatagcctcccaagggcactttgagagaaatgtacccggttggttatgagcattctggcctgttggttaagcattggtctttaggcacatcgtgaagaaacagctaatgatacaaactggattaaattaattccggaactctgtgtgactcgaggcagacgtgtggagtcagggaaggccttgggcgtgaggatgtgcctggccgtggcccgagcatggagaggctggggaccgccagagtatcctatttgtacagcctttatgctttctaagctcatttgctacagcaactccatgaaggagccgtgcaggatgaggaggggcgtggggctcagcatggttaggtcatgcccagggtccctcacaagcctggctgtccccaggtgcaagcccaaggggcataagacccagggcctgatttaatgcagggccacaaggctggtcaggggtgagagggacctcagtggcctggctgaagcccctgggctggcatggggctgccgacgagggtcccctaacctggcaggaagctgctttatggcccaggccctaggaaggagaggctcaccatgccatttagagtggccccctcctgatgacctctctgggtagtgcccctgtgggagcagatggacat

SEQ ID NO: 47530 - DNA, 1030 bp, Homo sapiens
caaatatttgacctccaagggcatttacattttcctcattctccttccatagtttgtttttagtaaatatgacatggaattttatttccaacttaaaacttctttttctgcattgtttttgggggttatgtaagagcttccttgagattcacagctcttatttccagttactgtttagacttaatctgttttgttgggttactttctctttctttaaaaattctgtctgatgtcttctttcttggatttattttccttaatgtttttcagaaaatgtgcccaggtgacctgaatgtctctgcatatctgaagaggccattatttttttctcacatttgagtgatgagttggtttgcatttgaattctagatccagagtcccctttctcaggatcttgtagctgctgcagtcttgtcttctgcctcttgatcttgcagatgagaagtctaatactagactgagtcttacttctctaggggatttttttcgtctatgaaagcatttaggatttcctctttgtttttggagttgggaaacttttatcaggatgtgtctagatgtcttgttttattcttctttagtacttgcaccttttgtaatgaaaatttcagccttttgtactgttcttttctctgccatgcagagctgagtgaatattgggtcttcaggatagagagaccatgagacgctggcagccagattgcctaggatgccaggtgcagctggacagctggtcaaccctctccagactcactttcctcctctggaaaaggcaggtgaacagctcctaccacatagtgctgttgggagacgaaataggacacaacggacaaaacatttaggacaatgtctggtatggaggaagtggtcaatacgggaactgttttttctgtaattcctcgtgggtatcagagacggaggaagaagtgggcttttgagcaggactttgaaggtggacaaggtaagaccttctctgagcctcaatctccccactgaaaatgatggagcttgataggtttttaggtaatag

SEQ ID NO: 47531 - DNA, 1023 bp, Homo sapiens
tcactgccaataatagtgcgaagcctccaaatctgagggcctttctaggatcgtttcctgattaattaggtcagcatctccaaaatcaatttccagcgaagtcgcgccacctggtagcgccgttccctgcccagccaggcgagggagttggcacgggaggcaattccctggcctctggtgcagttcaggtcttgtctctacctcatctcttctgtgattatcctgactttttattttatctgcccccctcaaatcttccattaaacccccgtagatcctgcttcaaacaggcaattagactaacaacgtaattatatccctcaattctaattgtaactggtttagaggaaaaacaaagagaaagaggcttcaaaatctctggaaactaaaagcagcggttatggtttccaggtatttttcttccctgtgtgtttctttgagagccctggttgctggcaggctggcatctctgtagcttgcccaatgccataaggaccaccgtatctgttcccctcttctgagcatgtgctagttgacacccccacctctgtccttctctgggttcctggctctgctggctgtgtctctcattgtctctccctgtctcaaccactttcaccctattagatgtggtcagcttgccggtgttggaagaagtagcatttcttctggctcttgctagcactccatcatcgccagtaaccatgggttgatgatccatgtgagtctgtcttggggagattggaagccaggcaagctggacctggtcttggggtttgagcccagccaggcttatgtgacgaggctgccacagggagacgtcttgcgccacctgcctatactcagcattttccgagtctgttttttgagcaaggcctgcactctgtgaataagccttggtctctgcctccaggctgccctcggcctggggaaagaggcattcaaatcattgaatggtgggaccgctgggaagagtagacatcagaggggctccaacccggcctcaggtggcagggtgagatg

SEQ ID NO: 47532 - DNA, 1039 bp, Homo sapiens
agtagccatggtgatacctaaatttgcccataaatggccatagtttgtcaacccctagtctaaactgacccctacctgagagcttctgcaactgctgttccctgtgtctggaatgttctttctctgatcttcccatgatgaatgccctttcatctttcagatctggagtcagttctaccctcagggaagctttccctgaccctccgtatcaaggtacctgcaccccagtatgtggtgtgtggccttcatagcctgtttatgctctttaattatttcattttcattattcgttatttcattcccttccctgtgttcctttttttctgtctctctgagaatgccagctccattggcagagaacatgtctgtcttgttcactgctgtgggcctggcccctagcaggctctcagtacgtgtttatgggatgggcacactagatgagatggaagaagatgtgccagtgatgtggagacagggagtgtgggagaggagcaggtagagctcagagacggtgcacttaggcctgtggtcattgggggtgacccaagtagccagcagctgcccagcgttttgtgtttctctcctgggtccctaggagtggaatttgtgtaagaacaatgtgtgaggttgtggcctgcggggcagtagcagttgtcagaccggtgcctggaagtgtttcttggatcaggaaatcaggactgaaaggggcattaagtttgtctagaccaccctgtcattgtgcaatggggagatcgaggcctttgggaggaaaggccctgcttaggggcgtataatgagtcagtggctgtgttgggccttgaacctgccaaagctggtgctttctccactcctcagtgctatgcccaagtgagggtctagccagcctctcccactttcctcccactttcactaagcacctgctctggtaggcccagtgctgtatgctgtgaactcaggctggttaggtgctaatttattcacccagccagacattctagtgtctcctgcatggcaggcactgttcgaagtacttcgtgaa

SEQ ID NO: 47533 - DNA, 1072 bp, Homo sapiens
tccctggccccatcacaaaggggaacctgaagcccagagtcgggctgagcgaggcgcaggtgggggccctgggctttaggctgtgcgaggggcaggcggggccctgggttttaggctgatcgaggggcaggcggggccctgggttttaggctgagctaggggcaggcggggccctgggttttaggctgagcgaggggcaggtggggccctgggctttaggctgagcgaggcgcaggcggggccctgggttttacgctgcatgaggggcaggctcagggtccctcctaccagcacacagtgctcagtccagagactccgtgtgccagacaggctgcctcactctgcactgggggtcaggagccagccgaggagaggctgaggagccatcatgccccccatgactccttctgtggggtgacacctgcaggcaaggctgcatgtgcccacagctctcccacagcttggggtgaactccatactgcctgccaatcaggccttgacttggctgtaaacagtatctactccactgacttgggccccccactgcagttgggccagggtcctgcctctgtgcccccaggccctgcacttgctgccctaacgccatcatcgtgcgttgtccctgtgccagctggcctgtctgcttcctattagatggaggacagggagcacaccttgctcattgctggggcctcagtgcccggcacattgcaggcactcgtaaattcttcactggttgaaggggaattggcagaaactgctgaagagtgggtggaggcagcaggaagagagttggaggcattattactcagtgacagatgagtacaacagcaagacaccatggatttatggagccctcgctgtgtgccaatcacagggctaaatacaaagaaatatgcaatctcatctttgtcctccacgtgattgtatttttccctgtgtgacaagggtaatacacatacaaaccactaaataacagactcctaaatcccacgctggtgttaggatgacagcggcccttggagtgacccacagtagtaccagtggcaccggctcctgttcctcagtacct

SEQ ID NO: 47534 - DNA, 1031 bp, Homo sapiens
ttataactataggaaatgaagaacctctcattcccattttacagatgaggaaaccgaggtgcagaggttaggcagcatgtctgaggtctgccgcacttatacctggtagagttgggtttgattaggcagcatgaatccagagcctgcctccctgaacggattcacagtggcatctaagagacaccgagctctcgtgtctgaaaatgcagcggttctgaaaacgtgctttcactgacaaaaaaatgattctgctctcctttttggggataaccctcttggcctaatcatttcctgactgacgaagacctgggagcgggctccccatccatgtcaaagagatgtcacggtgtcagagcagggtgggggtattctcagcagcagaaacctgggggctcacgttttattggaggtaacagatgtggccctgaagtgaggggtcaggcccagctggccagggaggctgggtagagacaagcaagtgggcaggtggcggcagatggcgggtagcagtggtcagcttaggagaggaatgtcaaggcagagcccagtctggaaccagaccccaggtggccttgacttctctgtctctgttcctgggcaggtgtcctgcacagaaggcagggttgcaaaagagacactggggaccatggtctggacgggacctgatggggaagttgtctaagttgattgctggctacatgaaaggattaaagcctgggccaggcacagaatcctagaaccaccatcctgggagaggccccaggaatcagctcatctacatccctttcccagctccccaaattatgggggaaaacaaggaagcaggaccagcctctcctgccccacaccttgccacctctttcttggatgattctggtatccagcatcctcagaatgtctccaaggaacctgtggctccttgctcagggaccagtttgtgtctggggctctggcacctgctaaggcattttcagagaatacgaagaggtgaagctggtggtgggagggagaggtggctaatgccatttgtg

SEQ ID NO: 47535 - DNA, 1083 bp, Homo sapiens
ccacatgccctgactcagccttagcttggagttagtgaatgtttgaatcctagctctcccttcccctccccacaccgggcagccttgagcatatcaccaagcctccctgtgcctggggtgatgggattgataggccctccctacatcagcccaaggaacacacacatgaggttcgtgccagtgcaaacgttagagtgtgccattgtggagggggtaatgtcctgtgtccagcctcagcctcagatgttgggtagacccaggggatcatccaaactccaacctcatgttagttacctattgctgtgtaacagatgtccctaaaacttaatgactggaagcaacaagcattgattatccctcagtttctagggtcaagaatttggatatggctttgctgggtcctttggcgctgggtctttccctggctgcaggcatggacttggccagggctgtggtctcatctcaaggctcaactggggaaagaactgcttttaaactcactcatgtggttgctagcaggtttaacaaccctgctagggttctgtccttcccacactcttagactgaaggcctcactggctgttcaccagaggccaccctcagctcctggtcacctgtgtctctcatggggcagctcacaacccagcagccagcaggtgtgacctggacagagaaggtatgcttgagacagaagtcccagtcttttgtaagctaccctcagaagtgatattctgtcacttttactgcattctgttcattagaagtcagttaccaggtctagtccagactcacagggaaggggtgatgtagggcatgagcatcaagaggcaaggagccctgggtgctgtccccaaggctgctcatcaccggccctcccggctgtgcccttggggcaaatcccttctgatcctcagtttcctcatgtgtaaaatgagagactgcttcctccctccgctagccagactgggctagtttcatctttggtttctgagatgatctggccagaaaaaccccaccccacaagactgaagccctggtaaccaggtgtgtgttttcatcccatgcagacaatttcaggtacac

SEQ ID NO: 47536 - DNA, 1027 bp, Homo sapiens
tgtatgtggattccataagattttctatatacacaatcatgtcatctgcagttagagatcattttacttcttccattccaatctggatgtttttctttttttacctaatcgtctagctagaacttctaatacagtcatgcaccacatgatgtacatgatggactgcatatatgacagtggtcccataaaactataatatcctatctttactataccttttttatgttcagatacacaaatatttaccattgtggtacagttgcctgaagtattcagtacagtaacgcactgtacaggtttgtagcctagaagcagtaggctataccgtatagcctaggtgtataataggatataccatctaggtttgtgtaagtacactttatgatgtttgcacaatgacaaaatctcctaacaacacatttctcagaatatatgtccaacatgactctacatgttgaatagaagaaatgagagtgagagtgaacattcttaccttgttcctgatcttagggagaaagctttcagtgtttcatcattaagcatgatgttcgctgtgggggttctggtagatgctctttattaggttggaaaacttcccttcgattcctagtttattgagtgtttttatcatgaaaaaggtgttagattttgtcaaatgctttttccgcatctattgagatgaccatgtgatttttgtcttttactctattagcgtggtgtattacatttatttgtgtatgtttaatcaactatattcctggagtaaatcccacttggtcatggtatggaatcctttatctatgttgctggattattacatcacaggatcacaattaggcagccaggttcatagcagaacagtaatattgaaaacagcagagccagaaacctaggacttgggagtgtggttaagcaagctgtgatatatcgtatatgatagaagtgcatgtggccatgggtagtgacaagaatgtgactcagaccatttcctatttagaaatgatcccataaacatgtcaaggagtaa

SEQ ID NO: 47537 - DNA, 1437 bp, Homo sapiens
agcaggcagtcatcgagctgagcaacgagagccagcccaccctgcagctggtgctgcccacctacgtcaggctggagaagctgttcacggccaaggccaacgacgcaggcactgtcagcaagctctgccacctcttcctggaggcgctcaaggagaacttcaaggtgcacccggcccacaaggtggccatgatcctggacccgcagcagaagctgcggcctgtgccaccctaccagcacgaggagatcatcggcaaggtctgtgagctcatcaacgaggtgaaggagtcctgggccgaggaggccgacttcgagcccgctgccaagaagccccgctctgctgccgtcgagaaccccgcagctcaggaagatgatcggctaggcaaaaatgaagtgtacgattacctgcaggagcccctcttccaggctacccctgatctcttccagtactggtcgtgcgttacccaaaagcacacaaaactcgccaagctcgccttctggctcctggcggttccggccgtgggcgccagaagcgggtgtgtaaatatgtgtgaacaagcgcttctaatcaaacggaggcggctgctcagtccagaagatatgaataaactcatgtttctgaaatccaacatgctttaagacttgacttcgggggaaaaaaaaagaaaaagagaagataacattagaaaaaaaccacacaacactgtcacaaagaaaaggaatttaagttctaaacactgtggacctcattataaatgccccctggaaacttaagtgctttttttatatgtgtgtgtgtgcgtgtatgtacacagccacacgtgtgtgcacgtgtctgaacacgtgctgtggttgtgggggtgtgggggggtctctgtgctcatctccatggccagagaaactttgcacacacgcacacacacacacacacacacacacacacacacgaccctggtgcgtgtacatacgcctgtgcttggacgggtgtgcattgaactgggcgtgtcaggaaagctgagcgattgggaaagagggagatgtttcacctccttttctcagtaagggggctttagaagactccgctttcaggtgtgcagattggcagaaagctgatgttgtgaaatgttcaggcagctgagatctgaagtgacttgacgctctctgtccttcaccccggtcctccttttccctctttgaccctcttccagccctcctaccctcctgatcccattgtgcacccccccacacactcggctgctctgctgtggactctccacactgcatcagatggacggtttctgcactggactttgtttcttgttcaccttcagggcattgagctgctgcctttgagataccccttgggtgtcccggggcagccgccttagaaacacacctatctatctccccaaatcaggaaaggagacttaaagagtat

SEQ ID NO: 47538 - DNA, 1055 bp, Homo sapiens
gcagggagtaaagttgattgcaaacctcatgaaggcttaggatcatggacctggaacatagtgtttgggggccaagcctgcacactttgcctcatgagaactcacccagctctccccttgaaacttggacacactgaaatggatcaaagtgggccatttccacatttgctccagcaaactgtggtctcaggaactaccatgccatttcctctcctggagaagttctaggtattacctccacaacatttccaactgggggactgagcccacttatcagagaagagccgccatccacactggagcaggaacagggagaaatccagacaggaacctcatgtcacttcctagggaatatgggaagaaacatcagcagactttatgatgtcagttgggcctttggaggcattctggaaggtggcctcagcatcactgatgattgacagatgctacagcaaaaggtccctctagcgttgcttgactgctggggaagggacagtgaccggcactttgacccacacaaggataggagctgcctactttgtgtggtaggtgagagcagagcctgggagcccatcctccctctacttggagcaaagttgtgctggtgatgccccattattgggccagttgattagaaaataggcatttcactttcttggaaagccatcggactaagcccagatgtgcatttagagcactcagcattcttctctttgaagcatgggatgtctgtcctccaggaagagatttgatcttaggttgttacctccctttcacttcttttccacctcaattcaatacttaggggttggcttgcctctgcaggtttgatgtgaatgccactgggtactcagaaagctgtcctctggggctgccttgtccagttagataacaagatagcagatgattgtttcttgcaacctctggttccctccggaaactggtgtcaccaacaggaaaggctgtaccaaggtgccctcttctcagacaggctgttctcagagtgcaaatcctgctgcaactaacagcttaataaaacccaaagatctcacagg

SEQ ID NO: 47539 - DNA, 1777 bp, Homo sapiens
tcacactgtcctttggaactcttggtggctctttggcctgcgtctcactgcccctgaggtctcgggtttgctgtgtgtcctcaggttcttccctccccctctctggcacccatatttggctttatccatttggagtggacttagggctctcaagggtgctatatggacagatatggcatggaacagcaatgacctcttgtaggtctcagttgtccattggggatatcaccctttgcagcctggggtggggaaggggctccagaagatcacatcccttcggctggtgagcttcagtgtttggccaggaaaactgccttggggaatatatgacccttgcatccctcttcctgtttctgcagggctctcctggagtaggggtgcggacataggtacctggaggggccatgcggggaggagttgagttcctcctgctggagagaggctgggggacagcttggcaggctgcggtggctgactgagctagcccaagcccgagagggaaaatagctcctatgtgatgtgcctggcaccttcttttatgctgccttatttgacctctcatgcccaccccaagttcccatgggacagtgagatcattctcattttagagatgaggaaactgagtaggaaatggcaaaaccaggactggaacccaggctcttacccatatactggaacccttggagatccccttagagggaaacctacctgcttcccttagagggctgagaccaacagcacccggcatctgtgcccaggctgaatcagcctttcccacgctgggtgcctggtgaggccctggcagaggtagctgcctggggcatatttttagctctgagcccagcgagtggttctggttatgcaattacccaagccctagttccctccagacctggccctgtgctccctgggcccagggctctggaatctgccatctgaagcggcatttcctcctggcttcagagccttcatgaagcacgtgccctctggggaccacatagatatcacagacgctgctagcccatgggaccttgcagcctgggaccaggatgaggccgttgacctaggcagcctactcccttccccaacctcctgagcccccaagcctctgcggttttgctctggctgtcctcctttgtaaacttgtcctccattcatgtctaagagcaaatgccacctttatttctgatgaccactcccttcttggaactcccgcagtggttcccctgtcccctctggatggcatgggccactttctcaaagctctcattgaccactaaactctgtttgctgagccacatgtgcaggatctcattccaccttcccagccattctgagaaacaggtttcaatctattcccattttacagatgaggaaactgaggctcagaaaggtttagttacttcagataaagtcaaagagagtaaatggcagagccaggattgaacccaggcagtctgcctccagagcctaccatcttttttttttttttttttttttttttgccagagtctcgctgtgtctcccaggctggagtgcaatggagcaatctgggctcactgcagcctccacctcccaggttcaagggattctcctgcctcagcctcccaagtagctgggattacaagcacacgcccccgggcccagctattttttcgtatttttagtagacatggggtttcaccatgttagccaggctggtctcaaactgctgacctcaagtgatccacctgcctcggcctcccaaagtgctgggattatgagtgtgagccactgc

SEQ ID NO: 47540 - DNA, 1030 bp, Homo sapiens
gttgctagggcttggcttggggagaagataaaccagtgggtggagggaaggtgccaggcattgctgtcagaggcgagatggcccctgttttttgtcacctttttttgtttttgttccttgtctctttcagggtcctcctgggccttatggaaatccaggtctccccggccctcctggagccaaagtgagtatttgctggagatgtggccatggagtgggtgctggggttggagccatgtttgcagtgcttcccaggggtgcctggtgggagggcttcaggggaactgagggggattcccgcctaagccaggggcaccctctgggcccctttccagggctgggccctgtgcctggtccggagacacagtgcttccgtctgggagagacttgggagagtcgggcagttggaacccagagccttcaggggagtgggcagagaggtgatttcttgctaaatagggaaggctggccttgaatgtcagactaagaacataaggcttaccgggttgtaagatgcatcctggggagggatgtggaaagatgacgttttagaaagctcactggatgccctgaggaggatgaatgcggggtggggaaccagagccaaggccgggagaccaggggtgatatgggggagaaaggaggctagtccgggccaacttaggggtgtgggaggaggtagggtggaaaggatggtggtgggtgcaaggtgagagacagttacaaacaccagacagtttttacctccctgatgttagccttggggactgaactgggtcccaggaggaggagtaagatgatgttgcacgcaggaacatgtagcccggtcaagtgatcattcatggacagatattctggaactcaggattgctctgagctggagacagagccagggggaggctggcgcagagatgccacctcccccagggagtcttcttggaatactcgaattcacttttaatgagaccttagtggctgatgctttgatgatatgggaacaccacttgctgagctcttcagtctgttcccg

SEQ ID NO: 47541 - DNA, 1025 bp, Homo sapiens
tcctatttggttgaatttttacaatgtctcttagtaaactttaatggtttttattacataagccctgcacatttcttattaggtttatacttagaaattttatatatttttttgctgtcctgaatggaatattctccccattatattttctagatagctctcatctagtgaaaataactattgatttttgtatttttttactttttgtatttaatttataaccatccccttactgaatcaccttattaattctattagtatttctgttgggtctcctggattttatagataggcattcacattatttgcagaaaagaacatattgttgtctcattttcctcaaaggttagtagttcttatttatttttcctgccttattgcattgtccagaacttctagacccatgaaaatagtcgtactgatagtgagaggcctagtgaaaattcagagacagttctggggcaggagccagatttgacccattcctatccctaccattgtctcttgagactctgttcactcatttgctcatttgtgaaacattttatgttgacttctctgggccaggccctgtgccagatactgagaccaaggatgacatatataggaggcttccagctcagaatttctcaatatttattcatttatttgtttgtttgagacagggtcttggtctgtcatccaggctggagtgcagtggtgctatcatagctcactgcagccttgacctcctggactccagcagtcctcccacccagcctcccaagtagctgggactacaggtgtgcaccaccacacccagctaaattttttgcttttgtggagacgggctcactttgttgcccaggctggtccagaactcctgggctcaagtgatcctccttccttggcctcttaaagtgttgggattacaggcatgagccaccatgcctggccagaatttccaaatcttttgtgatttattcctcccttgtctcaccccatctctgggcctcagccacccaagccttctgttctatttccca

SEQ ID NO: 47542 - DNA, 1066 bp, Homo sapiens
ggcctatacacgaggaggtgggaggcgatctgacctgactccatccaggtggtgtaggcctcgaggagtggttctagccaaagccagggcccctgctgcgctttcagtggaatgagtgttaaccttgggcccagccgcaggggccagtgagaggtcagagcctgggaaatgacactccaagtgtccccataatctgatgccccctccgccctgtccattgggtcattcctcatggggtttgagtttgggggcccgtggagggacacaagtaaactatctgctagcttgacaaatgagcttccagctttaccactccagcaactgtactgagaaattctgctcagagggaggctggaggaggtccctgagggaggcagggaaccccatcgctcagggaaggccagtcctgggaagaaggcccagatgtccccgtggccatctgtgcctgctcaggtgagtgggagcagaacctgggtggggtgggcaggaggtgagagctctctgtgtctgaatcctgactttgctacctcctgactgaacttcaccttggcctcacttccctgagcctcagggatcccctctgtgaaatgggatcattgtatccactcttattagaaccacagaaacacacagtccattccagtccagtggctaagagaacagtttctggaaccagaccacctaggttcaaatcctagctctaccactcatgtaatcacaatcctgagcaaaatttttaaccaccctatgcctcggtttcttcatctgtaaaatgggaacaatagtggtacctaacttggaggattgttgtgagtgaggatgtagataaattaatatgtgaagtgcctagtatgtagtaagcactcaagaagtactagttatgataataatagctattgttggtgttattatattacacacacgtgatattttacacctggtagcagctatccgggttactgaattgacaaaaatttcacagtcacattggaacttggtgggagagagtgctgcaattgataagtgatgtctgccttggctggggttgaggaagtgtcaacacatg

SEQ ID NO: 47543 - DNA, 1014 bp, Homo sapiens
ctggacccgaggtatgtgatgccccatttctccgtgtctggctgctgctgggactcggtcttgtccttgggaaactgaggcccagggatggggaaagacttgctttaggtcacacaggatatgagagatgaggctgagaggagaaactcctagatcagcaatcatttattttccccttctgctcttctgctcttactcaggggctctcaaaagtcaacagggccaaaaggtggcctcagagtcctctgccaactttgtggccaccgcagctttgtgattcatgaaagccctctgtgcgccactgtctggtccctcacaggagcttcccacattctccactcagagttccctctccaagccctggaactttcctagccacccacagccactctggaacggttcagggctcagagcttccgggtatggggagcaagaggtaaatgcaaaattcgggcttttgaatgaagaatgagaaataaggatagatttagcaattaatataataactctagttgagtcaggagagagcctcagggtttctgatgtgtgtgatcattggcataggtaggctacacctgaatgatcaactcggaattcacatgtaatgttgcgaagcaagctggctgggttctttttgacgcccccgtctttaacaggggtctcgtgtctagagagctgggctgagcaggagccagggctgccgtccctctcaggatcattggcacccaggccaacctcagttggagccccccacccacaactccctagcctccaggtcttgctcacccatgaggtctctgcatccaagacaaaagtgtggctctgtggataggccggaccctgccaaagatcacttctgctatcactcggatggatgaggaaatgtttcctaaaagctacaagttctgactttccactctgttgactttggccatgacacagtcctatctttagacaaatggacttggcctctcctccatggccccaattccctcctctggtcgctggaaaaag

SEQ ID NO: 47544 - DNA, 1054 bp, Homo sapiens
caggcgtgagccaccgcacctggcccagaatgtgcatttcaaccgggcagaccaaggtttcggttctagccctacctctggctcactgtgtgacctcaggcaggtcacttcacctctctgggcctcattttccacctccacaaaatgcaatgggcttctgaaggacctagatgagacatacacatccaggtgctgagtaagccaaggccccctcagagggaatgggtgactagagtcatgtctgcctgaggttctgtccaagtacccctttgactctgcccatttgttgggggtctccaaggccacacactggagataagatccctggttcatccccactaatggcagctaaggccagcaggcctgggacttccccaggaggtctagactttcatctcccatcccaatccatcctcctctttgtctctttgcagggggaaccaggggatcctggtcggccggggcctgtgggagagcaggttagttagcaacggtctctgaatgagtggctccatttattgggcccttactctgtgccaagccctttgcccagcaccctccatgcaccacctcgtgtaattctcagaacaactccagaggtaggttcagtcctctacccctttcacgaatgtggacggtgaccctcagaacggggaagtctgtaaatgagaaagctgtggatcatagtcacgacagcttttccccacagcctgactctacacacaggtttttggtgcatttgcccaaagaggttatgtgactgctcccccaggacattaaaactggaggagcccttggcagtcgttgctcgtgttcccatcagcttatagatcaggaagccaaaggccagagaagtgttaccacttgccaaggtcccttggtctaggcatccctaaattatatagaagatgaaatccaaaccagtggctctggctggttgagaagctgggtcaaggtctgaagaagagaagaggttgcaactagtcattaaaatgaaggtttgaggatcacgaccttcaattaaagtccagagaaacagctctgagggatgggc

SEQ ID NO: 47545 - DNA, 1038 bp, Homo sapiens
gaaaaaaaaaaaaaaggcaatttgatcagcaaattcagtttcatagttatgctaatggtagggccctcgggaaatagatatgcagggtcttggaagtcagagcacaaagatccttggaaatcactgtatctaagagccctaaccatattttgtgccttggatttctttgccaggctggaaaggcccagggatccccttctcagaatagagtttataaatgcataaaattaaaaacaaaggaaactgattatatagaaatgcaattatgaaaatatgttaaaatataatatattcatatatatgcttctttggcaatgcattaaataatgagttctagtagcaggtgtaacagcggcctcaattttgaagtaatgccaagccttagtgatgtattttgagatctctgcagcaatgattgtaatgtgccatgtcactttctgggacagtcccaggtcctggtagtactactgtggtttgttgcctacactcatattcgaggcaaatgctaaatttcaattagaggttcatgaaaatgaaagagttttaatttttttccattcaagttgatataccctctgagttccattcatagagactgacagagaccccgggtttagaaccctcagattctagtccatgttggcaatctgggatttatggaggagaagcacgtttgaccaagatcaccaagtgggatagtggtagaactaggcccaggaggggtgggaaccttgcctggagcagcccagtctcatttggtcagcagaacacccggcttgctgcccaggcagcttggacagtagcgggaaggaggcagagctggaaccctgtggctgctataaggcacatggaggtaccatgccagccgttcccttggcccccaccccatgtggtcacagtgaaaggggaggcattttctgttcactgcaggatcagaggatccctgggaaagttctgaagctcacaccacaggacctccttgtaatcatagtactgggtcggtgcaaaagtaatcacagtttttagcattataatggc

SEQ ID NO: 47546 - DNA, 1031 bp, Homo sapiens
ccaggatgttctgggacagtaccccgggggggtcccaggggtgcgggtcgggggatggggcacttgctgtatggctcttattcattaggatcttgtttggtttcttgttagaggtttatgacccgcttgccttccaggacccaacatctcataaatttaaagtagctatgaaatttctgtttctctgggccagtcaggcaggggccttttaacagagcagtttttattcccttcattcggcatcctctaaatgtctgactgctcccttgtgggaagcccaggcctctgtcttacccctgtgcccttgtaaaataaattaagaggggatgggaaagagcgaacatgtatgaagtacctctacgcatcgtgcaccatctcccgtattcggaacagtgccaggaagtagggaggtacctttattgtctcccattctgcagatgaggctcagagagactgatttgcccagaacccacacacctgaagactgaatgacagttacatagataaagtgccaggtacagggcttggcacacaggaagtgctcaatacgttgaagccgttgttataatattgctatcacttagaaaatgctctaattaatttttaaaaataagttgttgcaaaaatcaagtatttggttattttctgtgaaatgttagctgtgaccttatacctagtgcctcatccctcttaccttatacttcagaaagttctctgaacccagggaaccaggggcaggtgcaggatccaccatgcgtagtgccagcgtggtgctgggatgtacgggagatccgggccctgttcacagccacatgctttggaggccttgggctggaggggaaggtgcgtggtctttggagccacacaaccagagcggacatcccaggctgcagcagcaagacacgtgtggccctcgctgaagtgaccactttaaaactgtctttagataagaaagtgtggatcccagaggtaaccctctcatggtagttaactgacagctgggccggccttattgactgagtacacaaact

SEQ ID NO: 47547 - DNA, 1043 bp, Homo sapiens
acagtaaagaggcctccgcctccccgattccaatcagttctcttggcggaggctgttacggtatttctgtcccagccagcgggtttgtttcactctttgaaacagccccagagccccgaaagatgggcacagatggcctcttcccagctcagcttaagccaccccccgcccaaccccagctctccaaacgtggcagcctcccagcctgcttctggcgcgggaagaatgtgtggcgctcccagggatgttggcagcggccccgctgcttggcttcaaaatcagaaccatctggtggagtgagggaagtcagaacggtgcccagagagaggcagcgctctccccggcacaaccccatgctggctgggtgaccaggcacgggtgggagacacctgggagatgagcttcaggggaaggagcgggagggctgggtccccggattcacgttgtttctcttgctttcgggaatgtgtctcatagggatttatgggattcattggtctggtcggggagccaggaatcgtgggagaaaaggtaagtggtgttgaggggaaaagataaacaattagagcttgtgttttgaaattgtaaaaaggtgaagaggccctttgacctggggatttcagaataccctcccctagcctctctcctgacctggcattctgagtctgccaagagacattgttccctttcctggcatcccttggggttctatccctgccctactgtcatcagcctcaagcacagttagacttttgtgtgacaaccagcagatgcatgtgacctgggctcctcacagctgcctactggccctgcacaggggtcggcgagagcagggaggaaaagactcatctttacaaagaggaaagatgaggttgccttgctaagcctctgttttagatgagataacagaggctcaaataggggaggtgacttactccaggtcacccagataataagtggcagtgctgagatttgaaccaggttcattgccaaaggttagctacactttgctcactaagacactctgcctcatgttggctccc

SEQ ID NO: 47548 - DNA, 1034 bp, Homo sapiens
gggttcaagagattctcgtgcctcagcctccctagtagctgggatcacaagcgtgtgccaccacacccagctaatttttgtatttttagtagagatggggttttggcagttccaggagctggggatgtggcagcaagaaaggtagaaagtggtcccttcctttggagcatgtagtctggtatgggggggcagggtagatagaacccagtaagtgatgtctgttctggaagagcaggcacaaagatgggaaatgctggacaaacagggctgagggtcctcaggggcctgggcttctcatgatgactgaggaagcagggttggtgggaggctctcaaggcagagtggtgggagaggctgggagagctgggggaagggtgcggccaggagcactcaagttcaagagccccttctccttcccaggggtgatgatgtgcagggggtgggggtgggcttgctctcatttggagcaggtagaacttgcttcagatccctgtttctgccaatggaggatggaaactaggaaagggcactcgcttcagccaaagccaggggtcagggctgggagcccagtccgaggtgggcttggggaagttggggagggtgtgggggtagagggaccagcccaggcacagatccggaggtagggctgaggggcgatgagctcaggttgcctgggtgtctccaaagtccagactgaggagttccctggggtctgatgaggaagggccctgaagcctttcatggtttgaacccaggggaagctcgcataaacctgttctctactgtgattagggaagcaaggccaactcagctcctacactttttcatgcacctgctgtgtgctagcataagctcctccctggaggtacaaaaatggtaagaaagagttccagctcttaagactctcactgtctggtggggctgtcaagtataaacattctctccatcattaacagacttttatcgagcacctactctgtgccaggccatgccaggggccgaggaggtagaggggtggactagtccaagggtga

SEQ ID NO: 47549 - DNA, 1042 bp, Homo sapiens
agggaaccatggaagggcttgaagcagaaagggcgatcagcttgccttccagaagatgtccctgggaggacaggtgtggggggacagtccaggaaccccatgaggaggctggagagtggtgctacaagagatggcagagagaggacagaatctccagggggctagaaggatgactcctgcacagggcaggggaggacaggaggctcccatcctcaaggccgctgctgcattcccacatcttgaggcccaaggagtcacccttttgaacagtgggttggctgggggtgggggtttccagacatggatccgaggtggaagagcgttccaggcaggggcaacagatgagcaagactcaagagctaggaggtttctgatcagggagggccccctgggctttaggtgggtggataggagagtgtgcagctgtgttggagggagtatgacagataccagtgatgaagaggggctgcagacaccaggaccctcggtgtggctggggcggactaggggtgtgcttcagagtccccagttctgggggtcagctccctcattcacccctccagatcccaaagagggcccaggctgacctctcccaactgtctgtgtgtctgtctgtcttccagggccctcagggaccccaggggccaattgggcctccaggagagatgggacccaaggtgagtgtgagagacccttattcgtcccatgatgctgctggggatgtatcagcccttcccttccctcctccccaggagcctctttctgccattccctgtcctggcccagggagatggtcatgtaccgtgtagttcagagaagggtggacgccctggcagagagggtagatccatcctggtggcataggttgaggagctggctcctagtccaggggcattgggtgggacacagaggtaccaggacccttgtgggggttggcattgcctctttgggcatcactggaagcatggatgcttcccaaccttgaccttgctgggactttgccccagcagaggtttgactgtccatccagcccccaagggtc

SEQ ID NO: 47550 - DNA, 1059 bp, Homo sapiens
ctgccccagagctcaggcctcagcaggcccagcttgaagcaatgagcaatcatgagttgctttcttgagcctctcttctaggcagggccaagccccaggctccagcttcatgccctctgcttcctgtgctctctctcctctggatgcacaccagtttatcagtgtccctcgtaaaccttggcactgggggacagaactggtaaagacacactatgcttttccaagcctgctcttctcgcccatcccttcctgatggacgccgcccctcagcagccatgcccgtgctgcactccacacctgctctgctcacggtgatgagggtgacagcccacgccccatcctggaatcctgcatgccccatcctggaaccccacctgcccccaatctctctcagagtacgcaaagattaccgtgatgagataaggcaagcttagagtgacactgattgcttcaaaaccataaaaagcccatgccagcctggtgcagtggctcacacctgtaatcccagcactttggaaggccaaagtgagtggatcatctgaggtcaggagttcgagaccagcctagccaacatggtgaaaccctgtctctactaaaaatacaaaaattagccaggcatggtggcgcgtgcctgcagtcccagctagttgggaggcgggggcacttgaacctgggaggtggaggttgcagtgagttgagatcatgccactgcactccagcctgggcaacagaatgagatccgtctaaaaaaaaaaaaaaaaagcccatgccaagggttgcctttccaaggaaataacctcaggtgccccaaaggtccgaagccccaagaagaccttggttacagccctatcactgtaaagaggatacgctcaggatcctgcttcaaagtccagctccaccgctagccagttgtgggcctctgggccagaccacttgatttagctctgcctcagtttcctcttctgtaaaatgggactaaaagcggaccagccttagaaagcttttgtggggattaagtcagttaatagatgttaaaggactcagactatggtcctgaca

SEQ ID NO: 47551 - DNA, 1021 bp, Homo sapiens
tgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaatgacacgcctgtggtcccgtgctgcttctcaaagctcaggggggcagtttctggctgggctgggatagggagtgggaggagatgctcagaggatgtcctccttacgctgtaacaaataccacaaacttggtggctgcaaacaacacagaaccgtctctctcgcagttctggaggccagaagttcacacaggcagtgttggcagggccacactccctccaaagcctcaaggggaggatctttccttgcctcttcccgctcctggtagcc

SEQ ID NO: 47552 - DNA, 1078 bp, Homo sapiens
acccatggccttcaggccctgtaggatctcccataggtctctcctctctacccctctcttcctttactgctcaacactccaccccctcacactagaggatctggctgaccgtttagctcctccaaggtgatgggcactctctcacctttaggactttgcacatgccattccctccactgaagatactcttctatctctcttccttctgatgtctgctgagataccacttcctccaggaagccctccctgaagcctctaaccggaccagatgctccttcgctgtgctcccacagtcctttagtcctctgccatcatggtatttatcacaatggagggcactactgcctgtttctttgtctgttcatcctacaagatggtaagctttaagaggcctaggatagagtcttgtccactattgtattcccaaggcctggcataccctagacaaacaagcctctaattcctccactgatgtcaggggaggctgcaggggtagacttactaaactcagacaaggaagccaaacaccagcagctggacacaactttgcacgtaggcaacatgacagcctcatgcctgttcgagccaaagaaaccttggctgggccaccaccgagcagtctccccagcgcatcccgggacagacacccactccagcaagggtgtgtaagtgatcactggccaaaagcaactaagaggaggtgtgagagaactgaccaagcgattttaccatttctgttcaaccaaggaagtggaactttcttagtagaaaaaatgcacacgaaccaaaaaaagaaaagaaaaactcagaaggcagtagcttcttggtccatacaatcaatggtcaaattgcagaaaagatagccctagaaaggacaggcttttctcggaaaagagatgatggagagagagggcataagtgtcagcaccagaaaggtgaatctttaggtcatattccactggctggagaagtgtgtcctcgatgtctagatcaatgaggtcccacagaaacgctgggaactgggaggcaggacacctgggtccgtctgctcctaccaccaccatctgtgtgagctggg

SEQ ID NO: 47553 - DNA, 2628 bp, Homo sapiens
ctctgctgcttagaactgtggacacgtatggaaagactggacccccattgctttcattgttcagagaacccaggagacatgaagatgaccagactgggcaaattatgtgtccaaaacttggcctcagatgatgtttccatctccaaccccttcatgccagatggggaaactgaggctcagagaggatactgctctatgtggcattgccttgaacccctaaaattatcagacttcctttttccaatataaagaaaaaaagtaagttttcagaattctctcaatttttaagtttttctcccccatattttgtgaaaagcagtggtatgtgtacgtgttgtctaccagtacacaggctgcagaagacagagacagaagaaagagatcaagggcagataactgttgataggaatatttgagaaagattgatcctgtttgacttgaggacttattttgttcacaggcatgcacgcttgtggttgtggttttatattacagatgtagaacaatggttatgtttcccgacatgaacattgtcctggaatgaagtgtgatcagccacttgtggaattctttgaagagctcagaggcttccaagtgatctgctcctgaacaagtttgaagacctattgtttcatagacccaagaccaaacgcatctaaaggatccccagcccccaagacctagcctttgtctgcgattttggcttcatctcccacaaaacccctttatgagttcacgctctttcctggactgacatacctattcctttccatttgttggactcctattcatgcttcaaagtccagctttcttaagcccttctttaggaagccttcccacacagccaaccctgctgctctctgcctcctttaaattcttgatacagctgctgcttgttctgatgttttatggtattgattctgttttcctgtgtatatgccagtttttctagctagactgtaaactccttaaggacagagactacaccttgtactttttgtgcatgacctggacctgctaaggaaaaaaaaatcttgtggattgattgctttgccatccccacagcagcttttgcaaattgctttccaaactcacttgaatgatgacattgctgtggacctgggttctggacctgatctgccacttcaagctgtgtaatttttggcaagttgctttctttgcctggtcctcagtttgcccatcaatataatgggtggattggatgatttttttttttttaattgagatggagtcttgcactgtcacccaggctggagtgcagtggcgcgatcttggctcactgcaacccccgccacctaggttcaagtgattctcatgcctcagcctcccaagtagctgggactacaggtgtgcaccactactcctggatatttttttgtgtttttagtagagatggggtttcgccatgttggccaagctggtcttgaactcctgacctcaggtgatccacccgcctcgggctcccaaagtgctgggattacagacgtgaggcaccacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaagaaatgtaataaacacgtggcttgccattcaagagatgagtctgaccattcactttctgtgtgccagagaagagagatcatgggtatagaccagcccctggaaaggctgctttggtcaaggctgagagcagctttgctcaaggaaattattcacgaaggtgaccactgtctttctgacctggcacagaggaaatgttggctgtgaatgtgaccaatagaaagaagcccgtatttctcagtcagtcctagaaccccggtaagtaattaacagagaataaaaatgtgtttgttaaatgacaaagcagcagtttttcaattgtaaggtctgcttgagagcctttgatgtgtgtttcttttcctgacttttcctttctttagaatttttgatggtctcacctggtgggtggggctttcagggtatgcccacaatgtacatttctcggcatctgtgcctcagtttcctcatttataaaatccctatgatctctgtctcacctactttacagggttgctgtgaagatcgcatactacacacaggaatgctcatcagtttttaaattttatttaatttttatttatttttttttaaatgtaattttttcagagagataaggtcttgctatgttacccagcctagtcttgaactcctggcctcaagtgatcctcctgccttggcctcccatgctgctgggattacaggtgtgaactaccatgcccagccagctcctaagtcttaaggctctgtgttagtgatagatgtggccatggtgtaggcagtgcaatgtcttcgagtgagagtgaaggtggtaac

SEQ ID NO: 47554 - DNA, 1704 bp, Homo sapiens
accttttcctgctaaatattgccaaccttcttaatatggtcatctggatgtcccataggcccctccagcttggaatagcccaaaattaagtgatctgctgttgttgtcaacttggcctcaataccacaaggacctcattccctagaatcttctttcctgtatggttctgagttagaattggccagctttgcctgagaaatatgactcaaggtcctcttattcatcctgactgctgctgccctactttaggcctgtatcactgtctgtcctgattgcctaggcagtcgcttaatttgttttgttttgttttggtagagatcgggtcttgctgtgttgcccaggctgatctcaaactcctggcctcaagtgatactcctgcctctgcctcctgtatttctggggccacagacataagcccagcctcttaatttgatttctgcattagtcatgatccacttgggagacagaaaccacataacaatttgaatatgagaagattaatataagtactaactagaacaggggattggagtaatgaaggagtggtaagaagtcaggagagctttaaagaatataggaataatggacataaggagcagccagcacccctagaactaagaaagaacacccccaggctctatccccagctgagatccagatgttgctgggaagggcatggctgtgcctcacaatggcagagaagtctgggagaatgttctagaagtctgcccttgggtgccagggaaagctgtcatggaacagtgtctgattagaggcacacctatttgtgggggcactaggagaagctgctagttgccaagtgctactgaccaccatcctctgcaggattcctgttctggaaaagttgcctgcactgcgggagggtgatgttggagaagctgtgagctctgtgctgttaagatgagcccagcacaaccagaaaggaaggcctcttcctcctccaatgtctctagctccccctcctgacagagcctagcattgcaccaactaccaaaagaaaaatatttaaagggccagctccatttttgaagagcaggcgatgaacagtaaatttggggtccagagtaataactgaatgtcattctaccattatcgaggggccgcataaccaagttgttaagagtgtggactctgcagttgggtttcttgagttaaagtcttagctctggcacttaatgtgagttagtgtaaaccttaaaagatttatttaacctgtgtctcacttccctaatctgtaaaatcaggtagtaacagttctaaccttgttgggttattgtgctgattgggttgatatttatgaagcacttggaagaggatctggcacagagtaagcaaggaaccaggctgtctattgtgattactattacactcaaatcgtggtggcatgcgcctgtagtcctagctacttgggaggctgaggcaggagaatcgcttgaacccgagaggtggaggttgcagtgagctgagatcgcaccactgcactccagcctggatgacagagcgagactccgtctcaaaaaacaaaacaaaacaaaacaaaatccatccttcacattatagccaggatgggcttttcattgaaggtatgaattttactccacattgccatggcatagacatcatattcctttattcttctcttttctgaggtggggaaggcataaggagtgctaattaataaat

SEQ ID NO: 47555 - DNA, 1048 bp, Homo sapiens
actttttcacatgcccttttataatttactaagtgtcatcaagtcattaggctgaggggtcacaaaaactggacagcagtagctgcaccagagcctggccactatctctcaggcctgctgggtcatgtccagtggtggaaagcaatactgatcacattgcttgggggcatgtgtttatttcctattcacaggtgaccaaccatcctggtttgccagggactgcgggatttcctaggtgtggaacttctggtgctaaaactgagacagtaccaggcaagcggggacaagttggtcaacttacctcatcatttgtgagcaccaccccctcttctgaaccaagccccttgtttgccctgaatctacaatctccatggttcccatgaactatacctgattcattttaggtgcaacaccatctttcctgactcagaagagtttgctcacagggactatttaagaattaaagagtaaaaagaataaacccaacatccctcctccccatcagttccccacccctacctgtgctctgtcctcaaaaagacctctcttagttggttaccataactgaatgaaaattttcagaggctccaggcacagacgctggtgcctgctcatattgtcactgagagcaaaacaataccaaaccataaaatatgaaacttacctatacctggaaattgaaattacacaattatttctagagtagctcattacaaaatggaggggttcattgaaaagcactctctctttctccagtctcttacttatatttgattttactttctggcagctgtagtttgctggtgctctaaacaagtgtttaatctgtcaactgggtacattagcactgatggttgccaaacaagaaaacatttctgttttatttatttatttattttttatttttatttttttgagacagagcctccctctctcacccaggctggagtgcagtggtgcgatctcggctcactgcagcctccgcctcccaggttcaagcagctctcctgcctcagcctgccgagtagctgggactacaggcatgcac

SEQ ID NO: 47556 - DNA, 1042 bp, Homo sapiens
ctcagcatgacagctttgctttaataagggggcacctgaagtggaagggctgcagtctactgagtagctgggtccagaaagagggaagatgggtgtggtgggatcccaggctatacaaagactggaggcagattcagtatctcaactacccttagcacatctaagttctgacttctacagctggagataggctggaggcttggagaattattgcattcagttccttgcgtttacaacagtgattctccgtcacttgatgattcaagccccaacatctcacctcagagcctcctgccatctactgctcactccacccaaccattttagcgaaacgtttccacttcctttggtataccgtgaatttcagtctaaatgaactgttcttaatctagaaaaatttacctctgtcttgttttatgctgtttctactgctcagagcactatacttatcactcacattttttgatatgtgtgctttctcaaactattaattcattcaacagatattgctgagaacttattctgtgctaggcactgcaccaggcacagagatacagcaaggaagggctaatattctctgtccttgaagcacttaacatacaccaaggtagtcaggcattcaacatgtgattgcaaaatgtgtgctcacttttgtaataaagtatgggacactaaggatacctgtggaaggaaaccaacataacccagctatcaaaaaaaaaagcctccctaagcctttctcgttctttaaaccactatttggtcttcctctgctagcactctccaaactctactttgtgttacaatcacactctacttggtttatcctctcttttgccctttgaactgtttgaaaccaatggcagtatcttcttcatctttgagtcctccattttgactgagcttcatacatttttttaaaaaattgaacaataaaagtgatgtccagagaaaaatagctgattgggccacaatcacaacaaaaactaataaaacagtagccatttttttctgatacttggtccacagtcagtatgttaaa

SEQ ID NO: 47557 - DNA, 1026 bp, Homo sapiens
tatgactaaatgatgattcactcctttgtattacacctgtttattgagtgcctcctacatgccaggcactgttttcaatatcgggaaatacagcagtgaaaaaacaaacaaacaaagcaatccctcaagagcttaagctctcatagatgatgccaatgacgggtaacttcttttgatcaagctttaccttacaaacatccctgcttttcttcacactaactgtccaggatgggtattactggagatgttttaaggcttttattcctacttcagagataagaaaaaatcaaacgccagaaaaatttcaaaagttgtccagagttatacaggtcaaaagtgattaaagacagaatcaggacttgaacctgattttgtctgattctcaagcacgtgctcaactcattttgctttgcaacctccagccgtgatgcaggaaccaccaaggtcccctctgcagactcagaaccttgggcagtctctctgatctgaggaaggaggaatagcagaccagcctgtgtttagaaagcaaatgtccttttcccaccttcaccgagtcatttgggaaatttgttttcctctgccttctcttggagtctggctgatcttgttgtttcagccccacttgggaggccctggtcagccccgggctggtaaacagacaggggttgggaggggcaggggtggaattttgagctggtccagatgagatcatacttcctttaagatgcaaatcgatacctgaagatcaaaggtcccccagctaatcccctgggctggaggtgaaaactaatcacaattcatttgcaagtacaaaagacagaggtgctctatctgaagagagaaggggcagttacaagcggatgaaaaccttcgtgggaagatttctcactgacaggcaattttctaggactaaagaggaaaagatagcattgcatcctcgcatctgcagtgcattacaggggtgcatttagacattctttctcccagtagattgtgagctccgtgatggtgaagaccatataccat

SEQ ID NO: 47558 - DNA, 1072 bp, Homo sapiens
acagtttgcagtggagagagaaatataatattgtgggcaggctgaaggtaaatgaggccaggaatcctccagctgtctgtgcttttgaaagaggtgccatcactgagtgacattcagcatttagatctctacccatctaaaccagtcatgccttttccctcaagtaaagcagttatctgttggctcaaaatggaagtgtgatctgagtctttttcctttttcccctttgatgtgaatattttaggctgtgcttagtacagtcgatgtttaattatctgctgtgttgactaaattgcagactagggccccaagaaactaatttgttcaattacagcagttttttgggttttttttttttttttgctttgttttttaaagcagcagtacccttgtccaaataaagtcttatatggaagtctatcatgtaaaatagatcaaagagcagctgctctggttgaagcaggtttgtgccgctgaagaatatgctgtttcctccctttaccttacctcctgtgctaccattgcaaaacttgtgaatctacagaatacttttctgaaaaccactgaactacagcattgcttaccttatagttctgtcttattagtcatgtggccttgggcaagtcatttaactcttcctcttctggaaaataacaaaaatgatccctgcctcctagaagggtatgagataacatgtgaaaataacctggtttcattcctggaatattccataaatgatggctgttactcttttatctagttgctcaaaagagcacctgatggtgggaagtggtccaaccatgctaaacagttcctttcttcttgcttaacaggtttctatttggtgattaaaacctttctcaggcatttctttcccctcacaagtctccaaatatatcaagttcatctcttcctttctactgtctatttcacattcctattatataaatcactgtgttgcaattatctgtccatatatttgagctttattgagggctaactaatctagctaccagcatgtaacatggtgcctagtatagaatatgttatcagttatttaattggttcaggt

SEQ ID NO: 47559 - DNA, 1032 bp, Homo sapiens
caacaggagagcaaatgtttacctttgggtttgataccaacatctaaagagttctctgaggctgctgtggtatgactgaaccaacaccaactccgtgattaatcagcctgggttcaaatccctgctttgccaaattccctggtgtgaatcctgacaagtcactttccccttctgagcctcagtttcctcaagcatgaaatgcagataacaatgcttgacttacagactttttgtgaggagtaaactggatgaaataatgtatgtgaaagtgctttgtgtgatgcactgcactgagcacatacagaggattattattcttggtatgcaccaataggaagaagactagggtgttccgttccagatggactcaatctaaaccggggaacaaatgcttttttttggtaatttcatcttgtggaaacggcagtctcatgggcctatttgtgtttaatgaaccacatcctgtatcgtctttttgcatggttctgaggagaaatacgttggctctgtcttctggcgtgctgtagactagtgagtgtcaagctcatatttaacctcctccagtctctctgccttctgcaagaaaacgcttccctagagctagattgatcctacaaataactgcacagaagctaaggcacaaagggagaggaaagggatagttagccaactctcaccaccatgctgggaccctaccatagacaaatgcagccaggctgggatttttcacctaggataaaattaaggagtttagattcagaggtgactgccctggggtcaagcagctaggaatcagaaaagccaggtttatctgagttcaaagtcagtgctttcaaattttcaacaaattgcttttaatacatcagtagtcttcatcctttctggagtcagagaaccctttgagactgcaagaaagctatggagactttcatcccaaataaaacacaaatgcagatgaacaacactttgcctataccactaaggcatttatgaccctcccaggctcactcaatctcactcactcatttattt

SEQ ID NO: 47560 - DNA, 1026 bp, Homo sapiens
tttagttatagtattcttcagatttgtaatttctgtttggtacttttttatactttctttttgttgaaattcccagtttgttcttatattgacctcttgactttggagagcatctttattactattattattatcattattattattattattattattgagacagagtccactctgttgcccaggctgaagtgcagtggtatgatcttggctcactacagcctccacctcctggtttcaagtgattcttgtgcctcggcctccaaagtagctgggactacagtcatgtgccaccacacctggctattttttttctatttttagtagagatgggtttccaccatgttggacaggctggtctcaaactcctggcttcaagtcatctactcacctcagcttcccacagtgctagggttacaggcatgagccactactagcagcctatcaccattattttgaattgctgtcaggtcaaacaatatctcccattcgtttgggttagtttctgtagaattatcttgctcttttatttgtttcttcatttcccttgactctctgtgttggtttctgtgcattagataagacaaataactcgtccagtattgtgaggctggccttatataggagaagaatctcacctatctgtccagccacccgccttggcctcccaaagtgctgggattacaggtgtgagccaccatgtcctgcctacagtataagttctttcatgtttttgaaagaaactggaacaaaagattttatcatattttttatattcataggatttttctcaagtgtgaatctgtttatgtttttgaaggtacctgatatatctgaatgctttccttattccttacaaggaacaggttttctatgcagtttgagttatttcatgtatttgacagaaactggaaaggccacatttttttaatgctcataggatccttctccatttttaatctattcatgtgttggaaaggaactgggataattaaatgctttcctacattcctttccttcattgga

SEQ ID NO: 47561 - DNA, 1030 bp, Homo sapiens
aggaaggtctttatatattttcttcactgttgtatgcccttcactgagcaaaaacggaaactcaacaaatatttgctgaataaataaatgcaacatatgagaaccaacattgtttaactcaaccttgtcaatctgggcaaagtgtgctgaagacaaggagttagtccttgacgagtgagtaagaggttaagaagcaaagttaaggaagagtgttagatacggagaccccagcaaaggtccagagacacaaaacaaacagtttggtaccactggagcattaggtgccagaagccttattttctgcacgggaaataaggattaggaagaccagggctaggttaatagaggatggcagataaaaagtctggaattaactgtgtgatcccatagcatcctgttcaaacctcaaacagcacctaatatcttttactgaaacaatctgtttacacatctgtctccttacttagtctctaaggtagcagaaggtagaaactatactatgcacttgtgcatccccagagatggcacaggctctggctcactgttaagtactcaagtgttgagctggcagggtcccagaaggacctatggaagtgaatacctaccgtaaacacttttaaggcagcacagtgtagttcagggaagggctgactactaatgccacggaagagctccagtggatcccgagataaagaagaaaaccaggattctgtcatcctcagaaggtcatcagtctgctgctcaggctacaggaaagaaaaggaaaatctcatcaaaagttaactgatctggagaaaagcacttatttagaagtcagacacctgagtgctgatggcactctgtcattaatttgttgtgtgaaactggctaagtctggaggactctttctcaaatccagcccagacctttcccagttttctttgaatgtggttgattaagcagtctctagagtctcttcagttctaacactctatgattccattttaaattaaaaatgtcactagtcatataatgagggttatcttcttgt

SEQ ID NO: 47562 - DNA, 1023 bp, Homo sapiens
gagcttgcaggactggaagtttctttcccagttagtcggtgagtgaatgtgaaggtgtaggacattacggtacactactgtagactttataaacactgtacacttaggctacactaaatttattaaacattttttctctcttcaatagtaaattagccttagcttgctgtaatgtttttactttataaactttaaactttttaaaaactttttgactgttgtagtaaaacttagcttaaaacaaacacattgtacagttgtacaaaattaatttctttataaccttattctataagcttttttctattttaaaaacttttttactttttaaatgttttcttaaaaactgagacgcaaacacacacattagcctaggcctgtaagggtcaggatcatcagtatgactgcctttcatatcttgttccactggaaggtcttcaagggcaataacatgcatggagctgtcatttcttatgataacagtgttatgttctggaatacctcttgaaggacctacctgcctgagtctgttttatagttaactattttttaaaaaataaatagaaggagtacactctaacaatgaaaagtatggtatagtaaatacataagccagtaacacggacatttattaccaagtactatgtactctacataattgtatgtgccaggcttgtgtacaccttgtagcacagtaggtttgtttacaccaacatcactacaaacatgtgagtaatgtgtagcactatgacattatgacatatatgatgttactaagttataggaatttttcagctttattataatcttacgggaccactgtcatgtatgtggtccgttgttgaccaaaacattgttatgtgatgcgtgactgtatgtatttcacaatatcacatatatgaagatgtttgtcattccactatccctttctaatatcaatttatatagcattaagacttgagctactctaaatccttggattaaaaactactttaacctaatatcttatttcattaaattttt

SEQ ID NO: 47563 - DNA, 1059 bp, Homo sapiens
gtagcgtgatgcctccagctttgttctttttgcttaggattgtcttggcaatgcaggctcttttttggttccatatgaactttaaagtagttttttcgaactctgtgaagaaagtcattggtagcttgatgggaatggcattgaatctataaattaccttgggcagtatggccattttcacggtattgattcttcctacccatgagcatggaatgttcttccatttgtttgtgtcctcttttattttgttgagctgtggtttgtagttcttgaagacgtccttcacatcccttgtaagttggattcctaggtattttactctctttgtagcaattgtgaatgggagttcactcacgatttggctctctgtctattattggtgtataggaatgcatgtgatttttgcacattgatttttgtatcctgagactttgctgaagttgcatatcagcttaaggagattttggctgagacgatggggttttctaaatatacaatcatgtcatctgcaaactgagacaatttgacttcctcttttcctaattgaataccctttatttctttctcttttctgattgccctggccggaacttccaacactatgttgaataggagtggtgagagagggcatccctgtcttgtgccagttttcaaagggaatgcttccagtttttgcccattcagtatgatattggctgtgggtttgtcataaatagctcttattattttgagatacgtgccatcaatacctagtttattgacagtttttagcatgaagggcaattgaagtttgttgaaggccttttctgcatctattgagatatcatgtggtttttgtcattagttctgtttatgtgatggattatgtttattgatttgtgtatgttgaaccagccttgcatcccagggatgaagccgacttgatcgtggtggataagctttttgatgtgctgctggattcggtttgccagtattttattgaggattttcacatcgatattcatcagggatattggtctaaaattctctttttttgttgtgtctctgccaggctttggt

SEQ ID NO: 47564 - DNA, 1050 bp, Homo sapiens
ttatttttatatagtctttctgtctttgttgacacatgtagttttacacagttgctctcacagtgcttataccattttaaatttatttttctcagccaacataatattaacattcttccgtgttgctacattgtcatctgatcatttgaaaggctacacagtattccactttgttaatgcattatcacttagcctattattatttgtcaggtcttatattattatacattgagcatttttatatagtagttctttgcttctgaattatttaccgagaattagagttacagtgaatggacatttttatgtctttctgtaccatcttgttttccaaaagagctgtactggtttacatggccagtagctgtgagtgagtattgtaactgaatggcttttaatgacagtttcttttctagacaaaaaatgctgttgaaaagttcactgatgccaagagaagtttattgcaaactgagtcagatgctgaggaattagaaaggagagctcaggaaactgctgttaacctcgtcaaagctgatcagcagctaaggtaggtggattccctaagccgttgatgtatacattgagatgaatgaaaagtttgcttctaaggggataataattggtttatgataaataatgcatggtaagtctacaggacctggggggaataaagcaatgtgctttagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagtaagtaaggcctctgtagggctacaaggggtttgtgctggaagacagctctggggttccgagtcccttaggatctgctctagtgttgctggtgctttgtaggcttcagaaactacagaaagacatagagatggcagaacgcaatgaggatcaccacctgcaggtccttaaagaatctgaggtgcttcttcaggccaaaagagccgagctggaaaagctgaaa

SEQ ID NO: 47565 - DNA, 1076 bp, Homo sapiens
gcagtggcatgatctcagttcactgcaacctccacctcccaggttcaagcaattctcctgtctcagcctcctgagtatctggaattacaggcgtgtgccaccatgcctggataatttttgtatttttagtagagacggggttcaccatgttggccaggctggtcttgcactcctgaccttgtgatccacacgacttggcctcccaaagtgctgggattacaggcataagccaccgcgcctagccagttttattacactgctgtagtcagtgcctacaaatttttctcatcctgccctttttggccaacattagctttaatcattatcctaaaaccaggaagctcaatctaccatgctttcatccttgaaataaatttgggaagtgacactcaggtcagaataatttatggtggatggagacaggtgagcagcaatggaactgtcaagggggaggatttttccactaccctctggaggggttagtggagccctgttgtatgaaaggaacttttaaaccatgtgtgtctctcaaaggggatacgctgataactagtgataggcagatcgtcataaagatggaatatagatgtctaaaatttaatcctaccagtaaccctgtgatgatgggtattattattctcattttacagacaattaatgaagactcagaaagggatagtagcttattatcaaaggtaatgctaacagactctgacgtgtatatacgcccagctgtatttgatctgcccatgaaaggccgatagaattatccccatttgacagctagagaagctgaggcccagaaggggaatgaagttatagagctagtgagtgtgtaagccagcaaaccacacctccatgtgttagatcgcagagttattttcttcctcctgtgctaggagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacaggtgtgtgcccagaaagcccagctggccagcctgggg

SEQ ID NO: 47566 - DNA, 1052 bp, Homo sapiens
cagcttcttagattaagcatcttacatgcattacctactttaatcctcggtgaatgtgagtatcagtttcattttataactgaagaaacgggcactgagacgggaagtcacttttacaggctcacatagatgatagttgatagggctgggagtccatctgagagcctgtcctccctaaacatcatcctgtccccttcctgatgtgaatcaccaagcaagggacaacacaattcatagatccaggacaaggtttatggcacatacttctaaggggtgggacctggtatcatggacacggcattcaagagatagtacatggtatagagtctgtcacaaaacagacatcacatggtgcatgaagcatgacccaggggtaagaggcatgggatgccgctaaagggagacacacaggacaaagcaagaggaacgcagggcctgctacgtggcacagtcacagggtatgtgacactgggcatgacaaactctatgatgcagagacatggtacttaggatttgagacttgagctatggcaactgggcaggctcttggccacagtgggaccctttgtcatcagggatcctccattatgttggtgcctggggccccagcaagcaacagcaggaaccaagttcctcctcctcacaaaggcagtctgttttttttttcttttttttctttttttctccctcctcctccctgtctctttggatgccaaagagtgggaggggcccagcggagtggtggccagagtaaccccccgccatcccatcagctcagacaagggtcaaagcttggggccaagcccacggctcaggaagggtttgccaggcccccagatcccctctctctgagatagctgtgagcaccagtgttggctggggtgaaagccgggtaattttcctctaagctgtcctccctccgctcccctccctgcctgctggtgctggctgtgagcacgtctgcattccagagcttaggagagagagaacctgctgctgttaaggttgaggaagtagattgctaacagctgctgtaggaggggttggatgtg

SEQ ID NO: 47567 - DNA, 1050 bp, Homo sapiens
agacagtagaaaggtcaatggttgtgagagattggagggagggaggaaaaactgtgaagaatgtagggaatttttagggcagtgaaactattctatatggtactataatggtgaatgaatgtacttatgtgtttgtcaaaacccatagaatgtacaacaccaaaagtgaactctaatgtaaaccatggactttggatgataataaaatgtcaatataggctagttgattgtaacaaaggcaagaggtgttaattgtggggaggctgtgtgtgtgtgtgtgtgtgtatgtatgtgtatgtatgtgtgtgtgggagcaaaagtcataaaagaaaattctctgcactttctgctctattttgctgtgaacttaaaactgctctaaaaaataaagttgatttttttaaaaagcatgctatcagtaagccacccagacttcaatctgtttcactcttgaatgaattcacatcaggcatcctttttacataactttaaattgatttttaagaatgagacttagaatataaacactgatgatcctgccagacaaaaaagcttcttgtaaacatatataccattaggaagcaaaagaaaggaggaagttaaacaaataaaagatacataacaaatagcttcatatttaatgaattgatcccagtatgtcatttgggactagctgaccataaaatatcctcctactacccttgaaatattttttcttgggtcttcagcataatagctgtggagctactgggtccagttactgtattattgggtgttttatgggtgctatttgtacactgtatctttattttaaaaacctattttggctgggtgcagtggctcacgcctgtaatcccagcactttgggaggccaatgtgggtggatcacttgaggtgaggagttggagaccagcctggccaacatggtgaaacctcatctctactaaatatacgaaaaattagccaggcatggtggcatgtgcctgtaatcccagctactcgaaaggctgaggcaggagaattgcttgaatccgggaggcagaggttgca

SEQ ID NO: 47568 - DNA, 1074 bp, Homo sapiens
tggtctctgcccatagaatcctttctttttctttctttctttctttcttttttttttttttgagatggagtcttgctctattgtccaggctggagtgcagtgttgcgatcttggctcacagcaacctctgcctcccaggttcaagcgattctcctgcctcagccttctgagtagctgggactataggggtgcaccaccgcgttcggctactttttgtatttttagtagagacagggtttcgtcctgttggccaggctggtcttgaactcctgacctcaggtgatccacgagcctcggcctcccaaagtgctggtattacaggtgtgagccaccgtgctgggcctcttttcctttcagaagttatctcaagcactgtgccctccatgaaatttcctatggcccctcaaccttaactgccttagtgtatccttgttacgccttatgtctgcaatagttgtcggcccaagtatgttccatggaatggtaacctggtaagatgctttgtagaaaagaaggttaagaaaaggctgctgaatactttatgtacctgttttgtatagtaccaatccatatgaacaattttaaaggttctgagaaatcctgcagtaaagaaacctgctgagatttgtttactccagaactttccaaacctctgactgtagaacactttcttcttggaatgcctattgataagctttgcgacactcctggagaggtggcgttgtagacatctatataacagtttgatgctatctcctcttataatgaaggaaaccaaagcccagagaactcagtgactagcctcaggtaaatcccagtgtctaccactccatcacctcttgggtcaattggcaggtcctttataatgagtgtccaaggctgggtggcaaggaagggctggacatggtagccaaggacctgctttcaaataactttctttctttttttttttttttgagacagtctcactttgttgcccaggccagagtgcagtggcacaatctcagctcactgcaaccttggcctccctggttcaagcgattctcctgcctcagcctcccgagtagctgggat

SEQ ID NO: 47569 - DNA, 1803 bp, Homo sapiens
aagcagtgggctccctggaggaaaggcgcagggagctcagagagagtgttgcaggagggctgtggaggaggcggtgaattgagagaggggagtggtggtttttctggaaaggaagagtgaatgcgagtcagccaggtggctcaagagagctgtggcagggaaggtgagccagaaagagtggccaaaggccagcagggccagggcagctagggcaggggctgtgtttcagatttcactctggctgttttatggagaaccacactgaggaggcagcggaggatttggggggacagttcggggggatggaggtccccaaaggtagagatggcgatgccctggttctgggagatgtcaatgaaggtgatgaggtggacagcctcaagctggaatttggagctctgaagagcccatttcacagagcaggctccaagtctacaaagccagccccatgtcctgtatcctaggaggtgggaatcatgggagcaaagacacaaaggaaagaagcagtgaagggctgggggccagggtggttggggaagggataggagtagggtgtggtaagagggaagataggagtagggctggggccatatccactgaccactatcctaggctaggactagagtcaaggctgtgtgggattgaatcctgtctctgccactaatcaactcttgtgcctgtaaaatgggagagtaacaggattcactgcttttggtcattagaaggacttgctgaattgacactgcctgacaaaggggaagcactgaattgggattaagtatgcactgagtggccttgggcaactctgccctctctgagctttgctttcttctagcaggtctctgcaaaccctctaggccaaagtcctctaatctccctgtgctagcagtgtgcagctcccgagggtggtcagagcacagcggcaagctggctgtattgcctcagatgggaccgtgtccctctctgccctgtaaggggataccatgcctatcagagctgtaaggggatattttaatcagcccaggacctgctgaggtcagagggcatagggaccagaacaaagaatgccagtcacggctgctgcctggccctagatgacctgctgggccccagaatccagaccacatggggagcctgcggagggaggtggaagctgggggcctcactgtgggtcaggcactgttcaaactgggtgttctccattttgggcctcagtttgcccatctgtaccatgaggtttataacccctccctgcctgcagcacatggggtgctgaaaaaaaggaacaggctgcagtttggacaaagcagattcaggtctttattgggggctgtggtctcaaagcctgagagagagcaacaggtgggcgagtgaggctcagtgcggcccacggatgacctgctttggaatcacctgtgggaccactgcccgctgatgaaaaatgcagactcctgggctgttccccagactggctaacttagactctgcccggtgggcccaagtgtctgcactttaacccacatcccaggggactggaatgtctcgaagtccaagatctgaagttctgggcatccccttccttgcatcaggggaacaggggcccagagggcatggggtcggctggcccaagttgcttaggagactggaatcctatgccatgccactcaggggtccttcctgtgcatcgccccaggagccctgggagtcctgggtgatgcctggggcaaggggtactttatcctagggctccatagcccagcagggggcagcgcagatcagcacctgctgagggctccccgctgc

SEQ ID NO: 47570 - DNA, 1118 bp, Homo sapiens
gatgttgaaggctgggagggcaggatgggctgtctttggcttggtttagcagcaaggaagggttgtgtcctggctccatgggacccccactggctgccatgcctctggctggggagagggtaagtgccaagacgctagcctcagtgagtgggtgggacacgagtgggaaggacggtgggggcttctagggtgtcgagcgggagtcctggtccccatggccttcccgtgtagatgagcggcacagggcactctggggcggccacttgagttctgactttggatgaatctatctggtttatatggctgctgaagaggctttgttgaatgctgtctgcgtgctccgcaagctgctgtgttggggaggtggtttttttgcgctggaattctctcatctggaggttggaaaccagttggttctgtgctgggatttttttggctccctggaaaaggagtcggtttcaggggtggggatgccgaacctggctggttgggattgagggttgctatctggttgtgaggctggggtcaggccaggcagtgcttggttggcacagctgggctctgggggctgggggctgtaggacaggcttgagccttcggacttattcttctgaaacggcctcaggggaggttgccagctggtctccacagtctctgggtccctcagacactcatttcttcttcagaagctttggcagtaagcaccaaggacaggtgatcatttctcctgggtaacaaacacatgctgcttggagcgctttccaggtgaaaggtgtgccggcaaaagcattttcattttgcacactggaaatgctgctgcttcatttacagggctgttttaatgttggtaaaagtgatatagaggatgtggttctgtcagcccagaggataatttccaagtcattcatttatttattaatgttactgaggagctaggagggtcagttggcaatattatgctttcctcattccttctctctcctgatgctgtttctgggtgactctagccctccacacctgctgggaatatgcttcctttggcatgctacctgtctaaacttaccacagtagttactctaaagtgtctgtacccccatcaagctcttcccagtcatcct

SEQ ID NO: 47571 - DNA, 1052 bp, Homo sapiens
actgttttatatctcaaaaatcttgggttataccatacaccatgaaaggtactgcattgccacacctgacacttccattctggtcccaaagcaagccacacgggggctctctgatgaacagaatcctgctctgctgacacatggacccagatccagatccgacgccctgacttcctccatgatctgggacaagtcacctaatctctgaacctctgtctcctcatttttaaatgggcaccatgattgtggtgcctacctcccagggttttgaggtctacatgggatcatgttacatggtaatttgatcatattctgtcatcacacacatgtactcacattctcacacaccatgcttttgcttttttgtttgagatcccacaacctgccagcacatccaacccagtcttcccagggtccacctcatcatatatatagcaagagatggcccaagacacatgaagtgatgtttgtgctgacatttctcccacttagaaaatcaatattctgtggtctgcctaattgctctgttgctgctaaatgagtcattatggagggaaaatagcaaatgcattgtgagattaatgggagaaaatggttggcaaatgactttggtttgcttcggaaactctgagaaggtgttactacgtgaaatctgcagagccatgcaaggccgagtcctgagcagcagggagacaggcaggcagctattggcgctgtgagcctcccttttagggcggggcaccgattcaaatattatagaggctggactcaggagttactgagtgatgaagtcaggagccaacaatgggacaggtgctctgacaacctggtctcaaagaagaggatactcttcagttagagccagttacatgccaggcatggtgctaagctgagggatgtaatggtgagcaaaaccagccccagctcctcccctagtggaggacacaggctgaagtgcaattgtcctacaggtgactgtgtaattgcaattaaggcatgtgtcctgaaggcagtgagagcccagatctgaagggtttcatctggtgggggtg

SEQ ID NO: 47572 - DNA, 1027 bp, Homo sapiens
gtcagtgaatagaacctatcaccctctcctttttcgcccagcaggctgcaggggcagggtccctgggccagtgtgggtccaggctccgtaactgtgtggtcagcacctccagggacctaggcttcaggtattagacatttaatgtccaacacctatctgtaggggaggtgcatctgcagcagagtttctgcagatgaggaaactaaggcttagagaaatgaagtgcttgtgggagaagcagaccttagagtcaggcacagctggcactttctagctgtgtgactgggagcaaagaacctgactgccttgctcctctgatcccacctgtaaaggaggcataatttgacatacctcacagggctgggctgtcctgttgtagatgggttgcagtgtacatgccagcagcctgcccagggttaaccctcctggcaatgagaagtgtgcaccatgtgccaggcacagaagttggtgggggcacagaagttgttggggacacagatctctgaagaaggatatgcttggacatcgttctctccagatacctttcctgattccctgctcccaaactggaaatgctcctgcagtctctctaggtcccctgttggtccaggccctgccctggacacttttcaccacatcttctgggcctacagcctgttatatatatttttttgtttggtcctaatatttgtgtaccttcccctctctactaaactgccagtttcctgaggacagaccgggtgtcttgttcacctgtttggctcctggtgtcacttccttcccagctgggtggccttggactggttgtttaacccggtgcacctgttttcacatctgtaaaatgggaacagtgatctctctccctctggcacatgtcacggcaaggaggttaatatcacacatggcagcactgtgccagatggctgacggaatggagtctagagaaacattgggaggaaaccaaagcagaggctgcccctctgccctccttgaagtagggagtatctaaggaggcgaggcatagtgg

SEQ ID NO: 47573 - DNA, 1038 bp, Homo sapiens
actcagggacctctgggggacctcaggggaccagactaccgtccccgacccgttcgagtccagcttgacctttaaggctgagggcgggacctgtggcattggagcgagtctcatggggtgggggcggggctccttttaccagctaggaatttaggggatgctggaggaacttactaaagagtagccgcacacttgacgggaacgtttgagtttcagaacaatcccataggagtagatattattatctcccataatgaagaaacggaagctcacataggtaattttaccagggtcacgcggtcagaaagtgagggcgcttaaattcagacctagggctatccgactcctaagcctggacttttaaccaccactctgtgccacccagtggcaaaacagttgtcatttcagtagcccttctccatttacttaaccctgacaaatagtattgtcatttacgttttacagatgagacggaagtcctgagagtttgaccgatttaaggtcacgtgcctaggaagtgctggaaccaagactcggagttttctctaagtttagtgcctttattttgttttaaaccacactgttgcatttccccccattttggaaagctttatagttggaaagaatgaaaacctgatctgaccccttcattttatggttgaaacaaaatctacgtaggagaaatcacttggtacaagtcacaagtcagtggtagagctgccgcaaatgctttttgaatacgtgtgattatgaatctaaatggcagatggcagggagtgataaggtaggcatactggaatccagatctcttaactcttaggcaaaagccctttctctacctgttaaagtgtctcattccttctttggccgtgccaggtgcataatgattctgtgtatagtcagatactacaagtacctttctttacctggtactgcatttagagaagaacatcatctactatctctaagcaaaaatctggcaaaccagagacagtggaggcaacgctgggaagcccagaacctaccataatagtaagg

SEQ ID NO: 47574 - DNA, 1050 bp, Homo sapiens
cccagccatgctgagtgttctatatgcattgtatagcagttaataacatagactctagagctagattgactgaattcaaatcttgggcagatttttgcttctgttttcttatctgtaaagtgggaataatcatagtacttacttcagggttatcatgaggctgaaatgagttcatgtgcataaaccacttagaatagtttctgtcacgtagtcattgttatataaatgttaggtattgtcattattgttatcttttaaagtctcattaatatcactatgatgatgatgtggaagctgtagctcagagaggctaaatgacctccccaaggtcacacagctagtaagtgggggaattgagattccagttccagactgcgtccaaagctcagacacttccccacattgcttctatgtataggttaattttgttggctcatacttgggatctcaacaaatttttcttcaactttaattctttatctgtgctgaactgaatgttaatttgtatacccttaaggtaaaggacctaaaggactgcttttattgaacttccactttgaaatttcttgacttctgtgcaattaaaatctacgccttaagcatttcagcgatgtggtttatttatagagttgtcttccggttcacgtgtactgggtctgcttttgggtgctgcgttttctgtcaaaggttgtttatttctaacccattttgatttcctgttgctttgtgagttggtattatgacctgcaacaggaataccaggaaacctgtcttaaatggagcagccagattgagaccctgtagactaaaataaaatctactcattattctacagccatatttggttataagtatgagttaggcattggttttattagggaaaaacctagatatagaaacttcactctgagccaaacctctgtgaacagttctgctaaaatagagcttggctattagctccatgtccttggacagtgacttaatctctctgaacctcagtttcagcatctgtaaaatggggattattatacgttctttgtggcattattg

SEQ ID NO: 47575 - DNA, 1030 bp, Homo sapiens
agtggcatgatcatagctcactgccacttcgaattcctgggctcaaggatcttccggcctcagcctttcaagtagctgggaatacaggcatgccccactatgcccagctaattttttaaaaaaacctttgtagctgggcactctctctcacacttgtaatcccagcatcttgggatgctgaggcaggtggatcaccagaggtcaggagttcgagaccagcctggccaacatagcgaaaccccatctctactaaaaatacaaaaattagcctggtgtggtggcacgtgcctatagtcccagctactcaggaggctgaggcaggagaatcacttgaacctgggaggcagaggtttgcagtgagccgagattatgccactacactccagcctgggagacagactgagactcatctcaaaaaaaaaaaaaaaaaaaattgtaacgatggggtctcaccatgttgtccaggctgtccactttctaatctgtaaaatccaggtactaataccactaatgtcataggaatgttatgaagatttactgagctaatgcatggagaatgcatcagctcagagcttgatacagggaaatggctctgtagcagttatcattattattagtactgaaggggagcagatgacactggggtcaggtggctgggcaaatataagtgggccttgctgtgataataatttggtctctccttatcttcttctcttgctttattttcttcatacactttgtgtcactttatctacttaattgtttactgtgtctgtctctctttcactagaatgtgagtgctttgagaggagagaggaagagctttgtcagttttgttcattgctgtattcctaggccctcaaacagagcctagcatgtagtaagtatgcaataatgtaatcattgtttctggaacattgtgccaactgttgttccaggtgccatttatgtattagctaatatactcgtaacaacttttgagatcagtatgttatctctatcttacagatgaggtaactaagtcacagag

SEQ ID NO: 47576 - DNA, 1032 bp, Homo sapiens
agaatcactattttaggtgtttctttttttttttggaattgggttttgttcgatgaaccattctgaaactccttttttcttatttttatttttaattgtaaaatatacataaaatttactctcttaaccatgttttttttttagacagggtcttgctctgtcactcaggctggatttcagtggcatgatctcagctcactgtagccttgacaacctgggctgaagcaatcctcccacctcagcctcctgagtagctgggattacagccacgtgcaccgccacacctggctaacttttaaaattatttgtagagacaaggtcttggctatgttgcccaggctgatctcaaactcctgagctcaggtgattctcctaccttggcctcccaaagtgctgggattacaggcttgagcttctgtgcccagccttaaccattttaagtgtacagttcagtagcatttagtacatttacattgttgtacaaccatcctccagaactctttaccatgcagaactgacgctctatacccattacacaaccccagttcccccttctcagcccccagcaaccaccatttatgaatttataaatttgattaggaacatcatgttaagtggaatcatacaggatttgtctttttgtgactagtttatttcactgaagcatgatgtccttaaagtatatccatattgtagcatgtatcagaatttcctttctaaggctgagtaatctgttgtatatatgaataagtatatataaagctccttttaacagacacttaaattcatttacatttatttataatagtgatatgtttagtagaacccatttactttttctttattttcagtattaacataagtgatttggtgttttagccctaagcagataaaggattagagattagaatgaggaagagggttgcttcacatagacgaagttcagtttttgtggaataaacaaataagtgattatctctgtctgcctctttgtctctctctctctctcttttttttttaataagagatgag

SEQ ID NO: 47577 - DNA, 1021 bp, Homo sapiens
aatatttggggtgtccatgaatcaagaaatacatgaaagtatgggcaccaaaacgttaaaagtggttttgttgggagttcaggggattttactttctccctaatactttattctttgaatatcttgaaatggatattttgtaactgtataaggagaaaggaagcgaaactatttttctgcaggggtacacccacatctattgtattagacaaatcacagagggattgcaacagaacacagatttttctcactgttttttctctggttgatcgggatgcattatccaccagaaaacactgtagacgactcactcaccaggaaaagagcatatgccagttggaataaataaaggggaagagtaaggaagaggctgtagaattattttataaattatcaagtcttatgagccaggtgcagtggtgcatgcctatgtacagtcccagctactcaggaggctgaggtggtaggatagcttgagcccaggagttcgagggtggagtgtgatatgatcgtctgtgaatagccacagcactgcatcctggacaagatagggtctctttaaaaataagacttaactagcactttaataatcattgtttttgttcccaactgcattgtacattcattgaggacagggactttaaacttcattatattgctgttgctgtgtttcacctttgaatgatttttaaataaaaatctcatctttgagtcacaatctgatgtaaccttgtccatttctgtcctcttgtgtgccttaaatgcctttaggcagctgtgttgtaccagtggttttaggacttggcagtcggaagttttgacttctagactggattctgtaactaaagctaaattactttataaaaggagaaaaatggtaccattctgacgggtttgtggtgaagctgaaatgagatagccacataaagaaccatcacaatccctgacacaccgtgcgccctcagtaaatgccaggtgaattttattacactgtgaagtactgattttcaaacaggacttg

SEQ ID NO: 47578 - DNA, 1050 bp, Homo sapiens
gggcatggtggcacacacttgtggtcctagctactcaggaggtggaggtaggaggatcacctgagcccgggagtttgaggctgcagtgagctaggatcacactaccacattccagcctgggcgacagagcaagaccctgtctcaaaagtaaaagcatccttgaacttgcatccaccaacctgccctgttggtaattggacttgttataaggatctaggctcatcacttctataaaaggaggagacaaactgtgagtgcttacctaccaaataccaggctattcatatgtatcttatttcaaatggataataatccttattctatctgttttacagaattgttaggatgataaaatgagatacaaatgtgtacattttattcctttctgtgatacataaaggatatttattcaaagtactattttgcttttatttagatattaacaacttagaatgtgaaattaggaaattaatttatttattttttcctcagtaatgtgtttcccgactaacaatcaaattaactcatacaggcactgtagacataagccaagaagtagagatagtataagtattttaatttggattacttaaatcagttaataactgttaaatttttttgaatttgaagttagtttttgaaaagctgtaactattgggcgcttataatgttctttgtgtattgttaaatgttttatgtatagtccttagtaatttatacagtagctctatgagatcgatagtataacattacctctatggaaactgaggctcagtgtgacaagctcatactattagtagtagaaccagtatctttttttttttttttgagacagagtcttgctctgttgccaggctggagtgcaatggcacaatctcagctcactgcaagctctgcctcccgggttcaagcaattctcttgcctcagcctcccgagtagctgggactacaggcgtgcgccaccatgcccagctaatttttatattttagtagagatgaggtttcactgtgttggccaggatggtctcgatctcttgacctcgtgatcca

SEQ ID NO: 47579 - DNA, 1102 bp, Homo sapiens
cccaggagttcaagaccagcctgggcaacaacagtgcgaccctgtctctttaaaaaataaaaataaaaatggtaagaaaaaaactccaaattacctcgatactcagtggattaaaactatttctcttgattttgtggattgactggttggtttttgccaatcttgcgctcatacagcttcatctggtgggtcgggtggggactggacttgagtaggatggctgggtctccttccatgtagtcgctcgtcttaggcttcttcacagcatggtagtcttaggacaggagtagcagctgtaaggcccttggggctgtgggttagaaattataccacgtggattctcgtgttcaaagcaagtcacaagtccagttcttattcaaagttttgggtaaataggctatatctcttgattggaggtgctgtagagattctctggccgtatttaattttcaacatcagtatagttagatgaatgctgtggtgtagatgagcaaagggtgctatagaacagaggatggaaacctaattcagcttgagggaagggtcaaggaaggcttcttggagttggtaatgctttacgtaagccctttaaataaaagtattatgtgatggtgtggttatagaaaacataaaggtatggccgggcgtgatggctcacacctgtaatcccagcacttggggaggccaaagtgggaggattggttgagctcaggagttgagaccagcctaggcaatatagtgagagcctatctctttatatattaaaaaaaaaaaatacatagaggtatatttcttttttttttaacctagtcatccataagcaggtatttttcgtaataaaatgttttgacaactcatatcaaaatgtgagaactttccataaaagcagaacatgtattttctccatctgactgactatatgttcctctcagttgggaatcttagctcttacccaaagatactctataaatactggttggggatgcattgatgaactagtgtttcttatgcagaaagatcagttacttttttttgcttttgagacggagtctcgctctgctgcccaggctggagtgcagtggcatgatccctgctcactgca

SEQ ID NO: 47580 - DNA, 1046 bp, Homo sapiens
tcaaggatgattgtaattcttaatttggccatggagtgaatggtagtgcaactcattgattaaaaaaggatgcaggagggctgggttcggtggctcatgcctgctaatcccaacagggaggccaaggcgggcagatacttgaggccaggagtttgagaccagcctggccaacatggtgaaacccaccccatctctaccaaaaatacaaaaatcagctgggcgtgatggcgcatgcctgtaatctcagctactcgggaggctgagacatgagaatcgcttgaacccaggaggcagaggttgcagtgagcagagattgcgccactgtactgctcaacctgggcggcagaatgagactgtgtctcaaaaagaaaaaaaaaagcaggaagaggatcagtggcttaagttttggacagaataagtttgatgtatccaactgaaggtctctatccagtagacagttgaggaagggattgtagatagagatttgagattgtttgttgttgggagtagataccatacagtggcacaggagagtctaataacgtgaagttaatgccaaagacagaatcctggatgagcacctttagtagggtacatagaaaaaaaggaacagttgtgttctcaaattgcatcttttgtggaaatcatactttttctgttttattttaggtcagattttttgaggtaaaatttacaccaataaaatgcaaccctcttagttgtacagtcctgagttttaacaaatgtaaagtctcatgtaacgaccagcacagtcaagatggggaatacttttattactcccaaaagtcccctcgtgcatctatttagtcatacctttattccccttccctgataaccagtgatctgatttctgtccctatagttttgtcttttccagaatgccaggtaaatggagtcatacagtatgtagtctttttgtgtatggcttcttttacatagaataatgcttttgagatttgtccatgttattgtgtgtattagtagtttattcctttttattgcttagtagtattccattttataga

SEQ ID NO: 47581 - DNA, 1049 bp, Homo sapiens
tactttttaaagataccttgctttgaaactcaaaagatctatgattaagtatctttttcttcattatatgtttaagcaaagaaggtgataataatctatctgtaaagcccagtgataaatataaaggaaagaatacttactttttttgagttctgtatgtcagatgccatgaaacatgctttacagcaacaaaagagaaaattaaggttatgttttagggggcataggagtgatttttttagctttataaatgctttagtggtttacctgcaaatatcaaatgattttttttttttttttttttgagatgtagtctcgctctgtcacccatgctggagtgtagtggcgcaaacttggctcagtgcaacctctgcctccctggttcaagcgattctcctgcctcagcctcccgaatagctgggactgtaggcatgtgccatcacacccagctaatttttgtatttttaacagagatggggttttaccatattgctcaggctggtctcgaactcctgacctcaagtgatctactcacctcagtctcccaaagttctgggattacaggtgtaagccatagtgcctagactcaaatgatgttttcacatcaagaggcatagaatgatttttttcttttttgttattatttgcaaactaggcacagaaaagaatcagagatttgaggtctttgtttaaaaaaatggttctagtatgtgacaagaaaatgctttgcaaaattaatgaaacatgttggtctacagtgcagttcccaaagataaggacagacagtgctttaaactacgccaaggaattgataagaagattgtcatctatgtgcagcaaacaactaataaagaacttgccattgaaaggtaagcatttttagtaagtttagcttaaatataaattttggcttttatcaatctaatggcatagttttacactgtattaaaaaatgtatttccaaagaattttgttccctaggaaattattttgtttactgaagtcagtgcttcattactttgaaatagctactataaataatcagctaa

SEQ ID NO: 47582 - DNA, 1017 bp, Homo sapiens
gcaacacaaatttattgataactctaatgtgttctcttttctatcagcaagaatttgtttttaaagtggcctaatttaaacgttcttttgtgttatcttttttcttaaatttatgtcagttctttttttgtaggtgttttggtcttctccttagtccaggaaaagatgtacgaaatagtgacatgcacttattagatttggtaagaatttatttttattagaaagttacatactatttcctcagtaaaggttgtttcactttttctcatctgaatctagtgttaaaacatgtttaagaaggtgatcttgtaagctataaagacaacatgcaaaggtaagataatttcctttttcctgactagctatttacaagtctgactttggataagccttggtctgttaactgtgtggtggtgataaaattcttgtttaaatatttgagtacagttgatgtgataatcaaaagagaaaatttattaaagaatgatttatagactgtcgtgtatcttaccaatagtaggagttattagtattattcccattatctgaaaatctttattttcaaaactaaaaattataattcacatgaaagaagaattcaacattggatttaggttgtggattttcttaatgtgtatacaatttgatattcgtaagcatatacatataacttcaggacagttgcataaataattgtcacattttttaccataaatgtaatcattcacatacacttatcctcttccatattcttatatttttgcagcttctggtttttaaaggcagcaagatgggggttaactgttgttcactcactgtggcattcgggtttatttttactctttttttctaggaatctatgggcaaaagttcagatggaaagtcgtatgttattacggggagctggaatccaaaatccccacattttcaagttgtaaatgaagaaactcctaaaggtgatacagattgttgacatcatgaacagaaattttagtctcaagaagagatgcaaaacta

SEQ ID NO: 47583 - DNA, 1102 bp, Homo sapiens
tttagtttgcaattctctggctaccagtaaatttgaatgatttgctcttctatttatgttctttgtacatttatctatgaagtctttttaagataacagtttctaaacactctccatatattatgtttactgatccttttcatatgcattataaatatattttttaatgattttatttatggttttatgccatacaagacatttgcagtttttatgtagaaaattgtgtcttggttaagacctcttctgtctctatattttgtaaatgtggtttccaacattttcttgcaagatttttattctgtgtgttaatttttatgtctttaatccatctggaatttatttttgtatgtggcatgagaaagcagttcgattttactttcttccagatggataaccagttgtgctactcctattttcctactcagtagaactaccatctttgtcatattttaaattctcatatatgctgggattgatttctagattgttctttgtattatttgtttgcatattcctgtccccacactgttttgattaaaaaggctttgtattatttctgatagctgtgaaagcaaatctttgttttctatctcataccttacttgactattctgcaaatttaatctgccataaaaaccttaaaatcttttatccaatctcactaccaccatcaccctataaggttatgtggagattgttatttgaattgcatttaatttacataccagttgaaggtataagtttaacatgtgagaatgcagtatgtctttttatttgttcagatctttcttttctttttttttttttttttgccttcaagaattctgaattgccttcatagggatcttgtagctttattgttaaattggttcctaagaattaacttagcatgttcacactacagcaaatggaatagttttgtcagtttccatttgtaggtgctaactgctacaatagggaaaaagagagtgatttttacattttttctatttgcctcttaatattttgattaattgtcctaactttatatcgtcatcttttgagattttcaggtgtgtaataatatcagcagtaaaaacggttttacctcttttacaat

SEQ ID NO: 47584 - DNA, 1034 bp, Homo sapiens
tatgtagctttgtcaaacaagacaaggtattgagcttgtccctaactttgcctttggaccatttcttctttttggccttgcccccgggtttgttcactgggtctttgtctttcttggctgactttccagtgtctgtcttcttcttgtagtccttgggtggcatcgtgaagctcggagagcagtggcgaacactgcagccttgctaagatgtcagacaaaaagtgaagctcatttttaccaaataataagtggtagttgacactaatgcccagaggtgaagcttaggaatttgaagaactgagataatttatcatctacaagtagttaagtctctgaataggttgggagaaaaagaaatataatttgaacaggtcttttcctttttttgttacatttcatttctcgttctgcttttctttttaagcctgtcattttgttattttaattattttggcttttaaagttgttttaatttcattaggttgaaccatatagaaattggcgtgtttgcaggtcagaaagtatttagctagcaatgaaatggttaagtatcggtaagttcgtaattatattcttgttctgtaagaggttttaactgacattttgggagtccattttgagttagattgagtaccaaagactgtctgaaggaatgttgctctgatggcataagaacaagtggaacagagccccatgaagtagacaacttcaacccagcatcattctatcttgctaaatcaatatggttctgagagtatatagaaattggaaaattcagaaaatatagaaagctataaagaagaaagattttttaatgaatgttatcccaccatccaataatagtgttgatttttaatgtatttccttttagtcatatatatatagaaagttactcagccttcaaagtaaatatagagagaatatatcatgagactgcattattttattttttattgtattttttaatcagcatataacatacatacttatgaggtatataaggatgttttgatacatatagtatatactgatca

SEQ ID NO: 47585 - DNA, 1035 bp, Homo sapiens
acatttatgtttaactccttagaaataaaaggaatatggccgggtgtggtagcttacagctgtaatcccaacactttgggaggtcaaggcgtgcgcatcacctgaggtcagttgaaaaccagcctgaccaacgtggagaaaacccgtctctactaaaaatacaaaaattagccaggcgtggtggcacatgcctgtaatcccagctacttgggaggctgaggcaggagaatcgcttgaatcagggaggcggaggttgcggtgagccaagattgctccattgtactccagcctgggcgacaagagcgaaacaagaaagaaaaggaatatatattgttgtataaagcttaattttgtaagcacttgctttgactattttgaaaagctctttgctttttttctcttaggggatcatccataatgttgctgtgttttattttcagaaccttttcaaatttaatgtcattctgataggaacttactaaactcatcattattagaatttctgcatcacttttgcatgatgtggcctccagcaagtcaaatgaatttattccaagttcttcagcatatttccttaaggccaaatattttaagcaaatgattcacatggaactcctcaatttattatcattcttgaaggcatcaaaaattgagtgtgaattttcaaaatgaccttcttttaagggcattttgccccttcattctctgataattccatgattaatggatatgggatggcaaattgacaagaactggcccagttatagagagtactttcagttttttgttattttttacgtcctgtgtacagttgaatttctaaatctcgtctcctctctctctcttttttttaattgagacaggtctcgctgtgtcgcccaggctggagtgcagtgccacgatgttggctcactatagcctctgcttcactggctcaagcgattctcatgcctcagccttccaagtagctgggattacaggcacctgccaccatgcctggctaatttttgtatttgtagtcagagacagggtttc

SEQ ID NO: 47586 - DNA, 1028 bp, Homo sapiens
aacaaagtagctcaactagtgtgtgtaaactgatataacacatctcaggggagtatggaactatgtgtagctattaggggtttaatgctcacacagacatagtggatatgattttgggcctttaggaggcagctgaaaaagtgaggcctttgcataaagttaagacctctgaatggctcccctatctgttaaaggaggaatacaaaaactacctattagcctgagaaacagtagaaatcataatataaaatgaatagtggattagaaaaaaaaaaggaaatagaacttctggtaattaaaataatcatcagagtttacattctatttaaaatgttacatacttcataggtattacggctaacagttaatgatagtttaccatgtgcttggtactatggttaagtgcttttatatgtggggattagcgacgatatcgtatgtacagtgtttaacatagtgcctggtagttagtaagggtccaagaaatgatggctacgactataattatttcctccctgatcgttaagtagataacaaacattttacagtaatattttcaaagaaaataggtttgcacaaagcatagatagaaccaagtgagttctgagattctttgagtcactcttcccacctcagcctggttcagcacacaagaggatgctgcctcttttttgttcatgatttctttgcctccaaaatcccctttctcagtgtccccatctcaattaggggtacctggttgctcaggccaaaaaccttgctgtcctcttgactcctctctttctcacactccacatctatgctcgtcgtcagaatatatcctgactctgatcaccgccaccttcattattaacatcctaatctaaccatcatcatcctttcctgtttccacagtggctccctccctggctcttctctatcgcatgtctcctttgctgaaaactcacgtttccaccatccagaggcatcctgcattcaattttgctccttttctttccaaatgttttttatgcattcttaaataattg

SEQ ID NO: 47587 - DNA, 1043 bp, Homo sapiens
ggccttggggtacacaccctccttccctggggccgccagcacctcctctgccctatcccggatggggcctgggggtctgcccagggtgcgaaactggaatctatgctgaaacacctaagtgcccaggaggtgcccccatggcccaggagtgacacggctcccccagcagccagagcccattcctgagccagacaggtcacggttgacccaggaagagccatgtgccaggatggccgccaagcctcactgagcatgtgcagcagtggcagcctctcagacatagagggggctccctgggtgacatctccagagacccccttgtcccccagacacccctgggtagactgtgtctgacccttcacaaataggaaatgagagctcgggtcgaaatgctcacaatttcctgcgtgtctcagatggttgttttcttaaatggtcgggccatactttaacttggtttatggaaatgaatccatttcaagattcatcaaatcaataaggtaaaaaggaaaaagaaagataataaacattcaatctaactttggtgacgttggcctcaggaatttctgtgctggcctggagctctgggcaggtggggagggactggcttctagccctcctcctgcttccccgaggcagagaccaagtttgtcctttctacctggccctggagaaggggctcagggccactgcctcgttccaacccaggaaggccagctgccttccacatcagtctgaggcattcagcttgacctttttgggttgaaatctgggttgcagcttctcagctttgcccacaaagctccagatgacaagaggctgagccccagctttgacagtgaggggagtacctggaggtatcagcgtgccagagctggatgagggctgggggctcctcccaaaatactcagatgggggtttccattttccttctataaatcaaagttgctggtgctcgcagcccccgtgcagggtggctggggctgtgtatcacaaggcagcccaagaccccctggtccccagatcctcccaggtcagaatca

SEQ ID NO: 47588 - DNA, 1052 bp, Homo sapiens
aagacaatgaacaagactggctgggcgtggtggctcacgcctgtaattccagcactttgggaggcggaggcgggtggatcacctgaggtcaggagttcaagaccagcctcaccaacatggtgaaacccgtctctactaaaaacacaaaaattagctgggcatggtggcatgtgcctgtaatcccagctacttgggaggctgaggcaggaggaggatcgcttgagcccaggaggtggaggttgcagtgagccaaggttgcaccactgtactccagccagggtgacagagcaagactctgtctcaaaaaaaaaaaaaaaagacattgaacaagaccccactggaacatccacccagagggcatgtggagcaaggtgtgggataaacaattgacaaggtgccaagattaatctctgtgtttttcttttaaatgattctaagctcaaataggtttgggaaaggctcaaggttgactgtgtctttctcttggagatcagagcatgttagcattaatacaggcactgagaaatctggaagagactcaactttgtctaatctaacatttcccaaattttatttggccatataattcttatttaactcttgtaaagaaataaaatggtagacgtgctaggtaggaaaaatgcaagggtacaattagagcacagagacctgacctgctgaaggaggtagtcagggaaggcttccctgaggaggaggtgtggtttatatcagggcaagtcacttcattactttgaacctccatttccctacctgtaaagtggtctttttcctgcctgtctaccacccaggtgggtgataagtgtccaatctagtcctagatggcctaagctgtatggagtttcacagacaatttggcctaaacctctcagttcaaaggaaaggaaatcaagactcagagaggtggagtgactttcccaagaaccacagcaaagtggttctaggcctggggctagaaccaagggtttctgatttccagttcagtgcttattacttttggttctttaaagaaaacttctttaaaagtttacaaa

SEQ ID NO: 47589 - DNA, 1048 bp, Homo sapiens
cctggggggctgaccctagacttgcctgtgtatgtgggggcctctctgcctgccctgctaagtagacggatcttttgatttatttatacctctcctaggctccaagtgtgaatcccaggacagtaacaaattgatcacagcgggcttgggacaccagcttccgaggtctgtccttgcagttttgactgacaggcttttgtgtgtgtgcgtgctctctaactgttgaaaatctttgcagctgaaagtcttaattgctttaaggcaaactttagaaattccagagctccctagttggtctgacttttccaaattcagcttgccttttttgggggaaaatgtcgccttagtttggtgtacagtacgtgcaggcaggtcttggaggcacgtttaaaaaccctgtcgttaatggaagaagaatttcattgaaagggacgcagagccgtctggaagcgcctgccccggactcagcgagtttggactcagcgagtttgagcttaccgaatgaactttggacgtcttcttttagcaaacaaaacctggaaggaagcaaaaaagacccacattctttttcttttttctcctgaaaatgaaaaaaagaaaacaccttctgggtttgctggaaatgccccctctccttcccccatcaaggccaagccctcgctgcgtcccccacccccaaataaaatatgcctgtggggagccgtggaatgagtcactccctggcagagagcctgacgggcaaacatttgggaaggttcttgcctaacttcccagaagaaaaggcccaggatttaaaatggtccctgtggtttgtcagcctctgctgtcccgtctgcttcggaaatgactaaaaagtagtttgtatctccacaaaataaagtctcagactgaaggccttagacccaggttggtctggatttagagctgtttgggtttccagaaatggagcgcctggctttaactggtggcatttctggtgggtttgaacaagggcagaggagggaaatggggaggaagttcccttttgcggagcagaaggggctgtgtg

SEQ ID NO: 47590 - DNA, 1058 bp, Homo sapiens
gtaaggggccttgggcaagtcgtggccactcctgagcccccatctcctcatctcaaaaatgaacatcattcccactcttcccacctttcaaggttgtcatgcggctccctatgatagtgtggacaaaagtcactctgtagaccatcaagaactgaccaggccagatgcggtggctcatgcctgtaatcccaacactttgggaggctgaggtgggtggatcacctgaggtcaggagtttgaaactagcctggccaacatggtgaaaccccatctttactaaaaatagaaagatttgctgggtgtagtggcatgcaggtataaccctggatacttgggagggtgaggcaggagaatctcttgaacctgggaggtggaggttacagtgagccaagattgcaccattgcactccagcctaggtgacagagtgacactgtctcaaaaaagaaaaaaaaaccgcccagaagaaatgtgtcatttcaccctctggaaccatgagccctgtgatcatgaggcacaatcgtcatgtaaatatatagggtctctcaccagccacgggccaagatttattttatggagacagtgggggagggggccagctcagtttcattgtcctggtaactttgtaaaatgctttgccatcacttcccagctcctgggaggatgcagcaggagctgtgcagcctctctcgccctcccaaaaggcggatccccagaggccctggacacctccttccaggtccacaggcccaaaggcctggtgtccataaggctggggttccctggaaagtgggtttctggaaatacttgttgcagggatatcgctgttgcgtgagggctggttgtttatgataacaggaatcataacagtggcagtacccacattgattgattgattgattgagacagagtctcactccatcacccaggctggagtgcagtggcgcgacctcaattcactgcaacctctgcctcctgggttcaagtgattctcctgaatcaagtgattcagtgctcagcctcctgagcagctgggattacaggtacccgcccccacacc

SEQ ID NO: 47591 - DNA, 1069 bp, Homo sapiens
ctgaggcctgcacggagctgagcaagtccctgccagcaggacaagctcccagaaccaagggcctgcacccaccaggttctagaatggtgacagtgccaagctaaagcccaggacctgtatctccaagacccaggggaaagaccccttccaccaagaggttctgcaaacagctaagtcttgcacacacgtttggttgggcaagagattgaactaattaccattgcatcgtgactcaggaggggcacaggggccagggacacttcacgccctgtgcgtggggatgaattatgcatctgccgcatctcatgtgcacctactatgtggggatgctgtggtggcagccacgttgccccagcaaccacctcatctcctaaggctgctgacccaagagctgggcttatgcaaatctggtctcctcccacttcccccctccctgggccccctccccgcctctgtatttgctaacacgaggctggcatgaaagggcattagtcagtgccatggtcgggctgacaggtgcggtacccagcggtggcagagtggctgcctcggtgtcagaaataggagccgtaattagagcgcggaacagaatgagcgtcagacgaattaccaggcagcagatcatatttgtcaggaaggattgcatacataaaaattaagtgacagtacacgccggcgtaatgcaggaaaaatgaaagatttgcctatacacagctcacaagctacaagcaagtgtctcgctccgagcaacggcagcagctgcaagacaaatcacggggctgggagagcgggcgggcaggcctggctcctcggctgtagtgacaggacagtctcggtgacaggcagccacgggtgacagggcaggaagggcggctggtcacacccaggcccatgcagggcccgtgctgcctcttgggggctgggagagcaagtctagttgggggtgaccccatcaggtactcgaggtcacggccctgctgggtctcccagggcttagcctggcgctgaggcgcaaaccccttccttcttcttccttgagcaaactgcctggccctgggctgtgtgctgg

SEQ ID NO: 47592 - DNA, 1029 bp, Homo sapiens
aacagccccggggagggtgcgtgcctgttattttgcggagaagacgttaaatccaggtggggaaagccccgggtgtggagagttgttgagtggcgcagagccactgtgctgctggtgtgtgtcccccaggaggagtcgtgagttccagtctctccaggactcctctaaatccaggcaggtggccactctggccaccaaggtcgctgaggctagcagtagagtcacgcccatgtcacctgctaacccggctgtccctgggctcagggctccagcgtcaccgccctgcccccacttgccctaaggtctgaggaggggatgcaaacccacctgtaagtgggcatcgttcacccggtgtcagatcctgaggggaagagacaggcgttctaggtctcccaaggcccaggctaatgcccgcagcatagtggatggtcggggagcacaattttgaattagagcacgtgtctgtgtgtaggcagctcacttaccaactcactttcatccaaatcccagctccagggcccacccacggaaggatccaggcaagtcagcccctcccgggtgggcctcaggtgtcccatatgtagaatgagtggccagcccaccttgtcatagtgaggaaggaatgaggccctaggggtgaggtgcccgagtcagagaaggccctcgggcctgtccaccagctgcaggccaagcacgggcacttctgcccgcctccggcacgaggctcctgcagcttgccacatttccctttttgctttggccagcgggaagccaaagtgcagcccagcctcagtctccgaggaggctccactttgtcctcctttcctcatgtgtcttgtccctgggtcagatggcttttcgtttctttttccattctgctttgtgtttttgtaagctgcttcctgtctcccatgaaccatgggctctccacacataaacacacacacagcatatgaacacacacacaggctggccaggctgacagagctgtgcccacttccctggggctggggccgggaggccagcagc

SEQ ID NO: 47593 - DNA, 1027 bp, Homo sapiens
agagctagggctggctgtggagccaggcgcttccctcccaccctgaaggttccctccaacatgctgctgcgcacctctatccaggggcaggaggctgcctccctccctcctgaaccccctgctccccctgccctgataccggcagctggcttccacaggcagcagctctgcgaggggctggcaagaacagccacagtgaaatgcctcacccttctccggcccaccccaccccaaaatgtcagtccataggtaaggaaagctctctgaacatgtggggcacagagacctgcccctgcaggcatcttggaaaaatcgcgttttatggaaataagaccatgcactcggcaacctgccacatggagcctgggtcccccgggctgaggtgggagcaaggtgggaattagcttgcagcgtccagctgcccttctttattgccttgaaagttttgtcaccgaaaccctcgtgcccacttaatccagtgacagaatcagggtagtgttgcgcctgctcctctgttgaaccccagcatgctcggtgattcgggggagaagtcctgctggactcgccgcggtcgggaccagagagaacccatgccccaacaatctggagcagcctcctcctctctagtccttctgagccttgaggccgaaagcttatcttcgttgttcccgtcccttgcagatggcagccctccagagccccttctatggagataagatgaatctcttctccctgtgccagaagatcgagcagtgtgactaccccccactccccggggagcactactccgagaaggtgagtttgcaggagccggaggcctcgccagccccaggaggccaccgaggcttatgagggccgctccaaaacaccacagctgtggggctgaggttaggctcactttacacggtgcagaaagggagctttctggaaaagtgacttggagaggggaaagtaggtgattgcactgaagaaggggtttcaccacgcagctccagtgtgggacccccaggtaggaaccagtggcacg

SEQ ID NO: 47594 - DNA, 1050 bp, Homo sapiens
acaggatggtcaagcagccggacaatcacgagacactgcaaacgagctgctcctctgacacatgctagccaccaggtttggaaacctcccagttctgctcagcaaatcaactagaaccttctcccactgctctgagtctgcgctgcaccactgagccgaggggcccactcggcatgtaggctcaggctcaatggcacaactccctgtagcacagcacacacacactagctcccaaggccacctctgggaggctgttagcattgctgacttacacccagttaggaatctcggggcactctgagggaaagtgctggggctgccctgaaaaatgcaccttctcccagaaatcaggggattctttaagacacttgagaaaggacagcagatgatccaaacctctccggccccacctcccagcctagggctctttcctgggccaccctccacctctcccatcaaattaaatcactttcctacacctgacagcagcccactgtcataaagcaagtaacaagccgaaggtctgtgtgggaggttgatttgggaacactggatgtacttaatgtggaaagaaccaggaaaactccatccagatgccatggagataccaagggtggccacgacgccaggggacccaggaagaacttcgtctccttcactcacctggtccccttcttgttgggcactgtgtatgggcggagaaaatccagcttgttcttgctgatgacgcagaggtcaatgttgcttccggagcccaggtcgttgaagatgccagctgcgatggcttcgctcaccagattcttggcttcctcctcctgagaaacagaacggcggcaataatgtccccggccaaactagggcctgctctgacatccgcaatgtacgtccactagcagtgcgcaagacctcccgcgagacaggtgttgtttttaatgcccatctcacagatgaggaaaagatctcaaagtaccttgattatttacccaaagttcccgacccaggcctttaaaactttttatgcatgcaccgcctcttgaccacatcagacaa

SEQ ID NO: 47595 - DNA, 1050 bp, Homo sapiens
agtggctgatatcaggctggccttgtttggatggggaaaaggaactccagaactgaaagacagagggactggactgcctcttgagtgtggaaggtggatcagagccaagcagggagctggggaaccagcgctgggagtggcttgcctggtggcgcagacccagctcactcaagatggatctcatactggggaagccaggagattcagctctgctccgaaggcccttcctgtctgcacgtgggtatcactgcatgaagaggagtagagacccgattgggcagaagccattccttgttctatttttgaagctttttggctgaagccagtgtttcatacgaggaaatgaaagttggctgatgtaattcagtttaaaataggtgtcacctttggggacctaacccagattgtaattttcttttgcatgctgggtattcagaactcagcaaagaatgtgttgtcaggattgcaactgaggttggggggtaagggtggagactggctcattgttggcaaaagcttctgttagattgataaactctttccaggtaacagttgggacctcattgatcccgatagatcttagaagttctagcacatcttaatttccttaatagtttaattgatgaagagcattgatgaagagttaggaggtctccctttgtacctacattttccgcttttttagaatgagaagatgagaacgacctccagttcacatgtacgggtgctgtgaggatccagtaggggagatacagtgctcagcaccaagcaggtgcaagtgagcacaatccaattttacatcaagttacccctccaggacagttgctttgacgtggaaggtagagagggagttgaaaggagggtttgcatggttggcagaggtgccctgcagcctccctgtgcaggctgtaaaccgtctctgcccccctggaagccgtggaaggtgggtggtatggatgagatcccatctgactctgttcctgagctgtttctgaagtgagcttgttcatgacggcatggatgtgcttgagcctagctatccttaactgg

SEQ ID NO: 47596 - DNA, 1077 bp, Homo sapiens
ggttcttagaaatagagtcctccagccagctctaagggcttcctgccctggcctcagccttagcaggccagagtgagcagtgggcagaaaccttgacctcacttaatatggccttcgtccaggtgaagcagaaagagctgtgtctgcccttcgcttgggtccgtgtgagagcaaggcctttggcaagcctgtgtcgtgcctgtaccactggggctgcctcccacaccctcccctgcacacccctagtgccgcagtaagcacgcccaccattaaagcagaccaggagttactaacctgcctgccttcctcagaggctcagtgttgagttggaagagaggggttttacagtgggccagtccttaaggtggtgtgggtgctgggctgtggttgtggccttaggtctgctggcgggtgtgctgcacctccttggcctcccctctcctgggctcaaggaagtaaacaagtcctctgtatgatggggaggccaggacctctcgtccctttaaggcagcttggtgcctgccagtcacctcagcgggcggcagtcagtgggcttgtgtgcatctgtaaactcagcactttgggaggctgaggcaggaggattgctggagcccaggagttcaagaacagcccaggcaatgtagtgagaacccatctctacaaaaaaataaactaggctgggtgcggtgggctcacgcctgtaatcccagcattttgggagacggaggcaggcggatgacctgaggtcaggagctcaagaccagcctgggcaacatggtgaaaccccgtctctactaaaaatacaaaaattagccgggggtggtggcgggcgcctgtaatcccagctgctcgggaggctgaggcaggagaagcgcttgaactggggaggcagggttgcagtgagccgagatcgtgccattgcactccagcctgggtgacaagagcgaaactccgtctcaaaaaaaataaattagccgggcctggtggtgcacacctgtggtcccagctactcaggaggatggcttcaacccaggacatcaaggctgtgcagtgagctgtgatctgggcaacagagtg

SEQ ID NO: 47597 - DNA, 1025 bp, Homo sapiens
gagtagatcagctgccgcaggcatctgagttccccaaacggacgcccgaacccggcattgcgcaaatcgtttccaagtagccccggcttatttatcccgtccgggagggagggacccagggaaggcccaccccacttggttcccgagaaatgcagagcctggcgtccactcccggtctgggggacccctccaccgccagcccaggaagtcagcgccgggccctcggggcggagcagggaagagggagcggttggcccggacgctcttccgggtcctgggaggagggcccggacctaagccccgcccctccggggtggagtcacggctcgcgactggcctaagtcgccgcaggtattgcagtccggggctggagggtaggggcgagggtccccggataccgggtctatcacggtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggtgagatttatccattcatctctcaatctattttctttcttcattcactagccactcccccacttctactccatgccaggtccattggtaggttctcggaatggatctgacaggcccagccctctaggaacttagtctagtggaatttaatctagaatctagtctagaagccttaaatagataaacattccaaatgattcctgcaatggtgatggctaataccttcagagcccagtgggtggaagaaggaagtaacttggatgtgggtggaagagaaaagggcaaatcagggaaggtttcaccagggaagggacttttgaactgggctttgaaggttaactagga

SEQ ID NO: 47598 - DNA, 1031 bp, Homo sapiens
tggtggtgcatgcctgtagtcccagctgctgaggagggcgaggcaggaggatcgcttgaaccctggaggcagaggttgcaatgtgccgagatcatgccacagcctgagcaatgagtgagactctctctcaaaaaagcattttttgacctggacatttttcacatgtcagccaactcttgctcagttccctctatcaacaatatatttggggtgttgcccacctactacatttgttgagtattgcccgataaaaaaattaaaattaaaaaaaaaaactattgtacaatagttggtcagagttcaggaactaggaccaaattttcttatatgtcaagtatttaaattccttcagcacatttagacagtatgttatcttttaatttgatttatttgtttgggtatttatttcctgtcttccctcctcttccatgccctccctctgtggaacataagcgctttgaagggaagagtttgtttattgttgaatactcagggtacagaacactgtccgaaataaagtagacacggccgggcatggtggctcatgcctataatcccaacactttgggaggacgaggagggcggatcaaaaggtcaggagttccagaccagcctggccaacatactgaaagcccgtctctactaaaaatacaaaagaaaaaattagctgggcttggtggcaggtgcctgtggtcccagctacttgggaggctgaggcaggagaatcgcttgaacctgggaggtggaggttgcagtgagccgagatcgcgccactgcactccagcctgggtgacagagtgagacaccgtctcaaaaaaaaaaaaaaaagaagaaagtgatagagtagacacttggcagaccatttggctaattgtgaagccaatttgcttggaggactagcagtataatatggtgcttaagggcacagatgagggtctctgttttgctatgcactaactatgaccttggactagtgatttaacctctctctgcctctgttttctgtcacattggatagtaatagtttctac

SEQ ID NO: 47599 - DNA, 1033 bp, Homo sapiens
ggtgaaacctcatctctacacaaaatacaaacattagctggatgcggtagtacatgcttgtagtcccagctgcttgggaggctgaagtgggaagattgcttgagcttgggacatcaaggctgcagtgagccattatcatgccacagtactccagcctgggtgacagagcaagatgctgtctggaaaaaaaaaaacaacaaaactcacattaaaattatttgattgataaaatgcaagggataacattatagcaggtcattttaaaaatggcagtcatggctgggcacagtgactcatgcctgtaatcctagcactttgggaggcccaggagggcagatcatctgaggtcaggagtttgagaccagcctggccaatatggtgaaaccccgtatctactgaaaatacagaaattagccaggtgtggtggtgggtgcctgtaatcccagctactcaagaggctgaagcagggtaatcactggaacctgggaggcagaggctgcagtgagccgagatcacaccactgcactcgtctgggagacagaacaagactccatcttaaaaaaaaaaaaaaaagacagtcatgtactcttttgccctattacattaatgtgaatattacataaatactatgaggaaggccggccgcaatggctcacgcctgtaatcgcagcaccttgggaagctgaggcaggtggatcacttgaggtcaggagtttgagaacagcctggccaaatggtgaaaccctgtctctacaaaaatacaaaaaaattatctgggtgtggtggcacacgcctgtaatcccagctactatggaggctgagacaggagaatcacttgaacccaggaggcggaggttgcagtgagccgagatcgtgccattgtactccagcctaggcgacagagtgagacttcatctcaaaaaaaaaaaaaaaaattaaaaatcaaaaataaaaaaaaaacactgaggaaaagtatgtgcacaataaaaaaaaatagttctgccaaagtgtaggcatcggtatataaaaatct

SEQ ID NO: 47600 - DNA, 1165 bp, Homo sapiens
ggacccatagtgtgaaggatatgggagagaaaacagccttacctaagaggtctatagaggaagccatgttcccatgggaaagccagattttagttaaggcaggaaggtaaagagaacctctccagaaaaggttcaagttacagattttctgataattgaacttgtgttccaggagccactgtgaaaaggattgaagaggtaaggaggagcaggaggtgagataggaagaggtgatgtacaaagctatccaggtgccaggcacggtgactcacacctgttatcccagcactttaggaggctgaggtgggaggattgcttgagcccaagagtttgagacctgagcaacatggtgagactctgtctccacaaaaagcaaattttaaaaattagctggctgtagtgtcatataactacagctactcgggaggcggaggtgagaggattgcttgagtctgggagatagaggctgcagtgagccatgataccgccactgcactccgcttggatgacagcaagaccctgtctcagcaaacaaaacaaaaccataagacaacaacaacaaaagaaacacaaagctgtttagagatttggttttgcaggataaaggatgacctggaagttctgactttattatgattgacatgaacagaaataaagggcagactaaactaagacttggtggtccagggtagatttttttttttttagacactcttgccctgtcacccaggctggagtgcagtgttgtgatctcagctcactgcaacctctgcctctcgggttcaagtgattttcttgcctcagcctcctgagtagctgggattacaggtgtgcaccaccaagcccggctaatttttgtatttttactagagggatttcaccatgttggccaggcaggtcttgaactcctgacctcaagtgatctgcctgccttggcctcccaaagtgctaggattacaggcgtgaaccaccacgcccggctggtccagggtagattttgatggggttggcagtaagggctgagggaatggagaggagaagatcttcttgccaaatacatgcaggattttctggggcttccatttggcttctgatactggaagtatggagtattaattaaggggagtcttaattgagcacacaggctctcctgacttctgcagat

SEQ ID NO: 47601 - DNA, 1028 bp, Homo sapiens
tgcgcgccaccacacctggctaattttggtatttttcatagagacaaggttttgccctgttgccccaagtggttttgaacttccgagctcaagcagtccacccaccttggcctcccaaagtgctgggattgcaggcatgcactaccacacccagctccaagatcttagactatatcagtacaaaaagagtttaatttttttaggttgggtgcagtggctcatgctggtaatcctagtgctgagcgcactttgggaagctgaggtggacggatcacttgaactcagaagtttgagaccagtctgggcaacatggtgaaaccccatctctacaaaaaatacaaaaattaggtcaggcggggtggctcacatttgtatttttggcactttgggaggccgaggcgggtggatcacctgaggtcaggagttcaagaccagcctgtccaacatggcaaaaccccatctctactaaatatacaaaaattagccgggcatggtcgtggcacctataatcccagctactcgggaggctgaggcaggagaatcacagtgggggaggaggtgtgcagaggttgcagtgagctgagatggtgctatttcattccagcctgggtaaaagagtgaaactttgtctcaaaaaaaaaaaaaaaaattcaacatcttaaaaaaatatgatttttaagatgtttaaattttttcatgcttgtccaccttaatgagaaatttcgttccagtattttaaagggaaatgtttcactgtttttttcctgttttaacagagctgtgttgccgctttccttgatgttgtgattgggggccgtgcagtggagacccctccattgtcttccgtcaatcttctggaaggattgagcagaactgtggtttatataacctacagtcagcttattactctggtaatggcttcattgtttaagagaatttctcgaaagtcttttagctaagcgtgagcaaaaacatacatgagtacattgtgtgggaaatacatattgtatttgaaaaagtgatttcat

SEQ ID NO: 47602 - DNA, 1071 bp, Homo sapiens
caggagaatcgcttgaacctgggaggcggaggttgcagtgagccaagattgcgccattgcactctagcctgggcaatacagcgagactctgtctcaaaaaaaaaaaaagaaaacgtccttgatggccgggcggtggctcacgcctgtaatcccagcactctgggaggctgaggtgggtggatcacctgaagttgggagtttgagaccagcctgagcaacatggagaaaccctgtctctactaaaaatacaaaattagccaggcctggtggcacatgcctgtaatcccagttactcgggaggctgaggtaggagaatcgcttgaacttgggatgtagaggttatggtgagctgagattgtgctgttgtactccagccagggcaacaagagcgaaactctgtctcaaaaaaaaaaaaaaaaagaaaagaaagaaaagaaagaaaatggccttgatgaagcacagacattggacttactcaagactttaaatcaattttttttttaatatacttaaagagctatggaaaccacggacaaagaactaaagaaaaccaagagaacaaggtctcaccaaatagaagatatcaataaaggggtagaaattacagaaggaaccatatagaaattctggagttgaaaagtataataactggaatgaaaaatacactagaggggttcaacagcagatttgtacaggcagaaaaatcagtgaacttgaagatggatcaattgagattatctagtctcaggagcagaaagattacaaaagacaaagacattatatgttgataaatagtcattaagaagatacacccagcactttgggaggccgctctcactgcagcctccgcctcccctgttcaagtgattctcctgcctcagcttccctagtagctgggaccacaggcatatgccactatgcccagctaatttttgtatttttagtagagacagggtttcactttatgttggccaggttgctctcaaactcctgacctcaggtgatctgcccacctcagcctcccaaagtgttgggattagaggcgtgagccactgtggccagctaaagttt

SEQ ID NO: 47603 - DNA, 1532 bp, Homo sapiens
acttggaatttcttagcttttaaacttttcagcctcctttcacttagaaatgttggcacaccagttaacttccgagtagtgcagtatgttatatgtcacactactgactttatttaatttccagctcctataccatttagaaagaaagaaaaacaagaaaaagacaaagatgatctggggcctgacagattctcaacactcacaggtttgtagacccatggacttcctggctccttcattcccagagcacatatttcataacactttttcttgggtgccataagcgttgcctttctagaagagtgtgtctgtgtgtacagtggggagtatgttcttcatagctctgtggtttccagttggtggccacagtaaacctgtgtgctcttcctgcagactgccaccaccatcatcatcctcattatcataactccgtttatgatgaggcccctgatcctgagcctctaggcataccctacaactcaacatctagtgggatgatgacacacagtgccttttaggaaagtgtggtgacagttttggtgctgtgcatgctgtatctttggatcattgattgaatagttttctctaacattgatcgtagaattctacatttattttcatctacagtttgttcttgattattcaggatcacagtgaaattctgttttacctaatcgtttccttttttgtgataaagtgtttgttcaaacagtatcataaatgccaaccattataatgaaagttttaaaaactttactaattttttacagcttgaaccattttaacattgccatctgacccaaggaaaatacagctgggggttgggtttttacctgattaagcgtttgtatttctgcagctgctttttggcacattatgaatgagcaccctaaaaggacagtttgagagtagtgttaatgacccagtcttgggtttgatagctgtgtattgtttccagtggctattatagagcatcttgagcaagtttgttcaacccacggaccgcagaccacaggcagcccaagacagcaggacagcttcgaatgcagcccaacacaagttcataaacttaaaacagtatgagatttatgcaggaaccctttttttttttttttaagctcatcagctatcattagtgttagtgtattttatgtgtggcccaagacaattcttcttcttccagtgtggcccagggaagctaaaagattgaacacccctggtctagaggaaagttcatttctcacctcttttttttgattttgaattgttttcctactaagttaaagtgaaaatttttttcattaaacaattttatttaaaaatgggatagataataggataagaacatcctcatcaaagagttcagcattacaggtagaatcccattttaatgcctattattctaatggttggttccatatatttatatgtatttccatatcctagcatataagtccttgctttatttgaaatggtgatttccccagaataaagggttttgaacagcaggagatgtgcttacaggccacagt

SEQ ID NO: 47604 - DNA, 1033 bp, Homo sapiens
ccagccaagatttgttcttaccttaggattttcgaaagaaaggatgggaggactagattcctagatgaacattttcagctaaaaagcagtgcctaggttgggcgcggtggctcacgcttgtaatcccagcactttgggaggccgaggagggtggatcacgaggtcaggaattcaagactagcttggccaagatggtgaaacctcatctctactaaaaatacaaaaattacaggctcctgtaatcgcagctacttggaaggttgaggcaggagaatcacttgaacctgggcagcagagcttgtagtgagccgagatcacactgctgcactccagcctgggcaacagagtgagactccatcttaaaaaaaaaaaaagcagtgcctgaagttcttagttggggctcagtatataattattggatgaatggatgagggcaggttctttatattatacttttaccatcttctttaatatggaattccttgcagtacttgtcatataggctaccaaacttaccaatctccttcctcttttagcttcttattttgtaattgtagtataaaagtactgacatctctagttcttgttgactttaaaattaaagtttcatcatttaaatggtttattttgaacattttgagggtgaccatgtagtttgggtgcacacagccactaagtgatcgtatcacttgtgtgttgcagtcagctcagcccagctgttgctgtctaaagtgtgtgtgacatatgtcttactatttcttagtgttgtgatatttctacaacctgaacacttagcttggagggagaaacccatggggttggtcgtcacagctcctcctgttggccatcgctcttctggcttccacatgtgataaatctagttcctgtgtagagccagtttaagctagttttaaggaaaaggccctagctcttcctcttaaccatttaacagcctgtgccctttctcaccacatgaaaaaggtaaaaaaaattcaggagatgtcctctgttacctctggcaacagagggcatg

SEQ ID NO: 47605 - DNA, 1049 bp, Homo sapiens
tcagggagaagcctccagcgagtcattcctttgcttattgcctttatgaagctctcacccccaggcatgctctgtgctcacaatggcagccattgctgcgaatcctttttttttttttttttttttgagagagtcttactctgtcccccaggctggagtgcagtggtgcaatctcagctcaccgcaacctccgcctcccaggttcaagtgattctcctgcctcagcctcccaagtagctgggattacaggcgcccacaaccatgcttggctaatttttgtattcttagtagagatggggtttcgccatgttggccaggctggtctcgaacccctgacctcaggtgattcacttgcctcggcctcccaaagtgctgggattacaggcgtgagtcaccgtgcctggccctcgaatactcttacttttcctgaaagggaagagggcagctgtcccaggccccaggcctcactctcataagcagtaggatatggtggtcatgaaggcagactctggcgccatggtgcctgggctcaaatcccagctctaccacttactagtggtggatcttggacaagtgacttaacctctcttggcctcagtttccccatttgtaaaatggggataataacaataatacctacctcatagggttgttgtgaaggttaaataaatatttgtaaagaacatagagccgtgcccagaacatagtatgccctgtatcagtatttgttttttaaaaaaaatacacacacacagtgcacatgcatatataatcattatgaaaatatttgagaggcaggcagagtggctcatgcctgtaatcccaccactttgggaggctgaggtgggtggatcgcctgaggtcaggagtccgagaccagcctgatcaacatggagaaaccccgtctctactaaaaatacaaaattagccgggcgtggtggcacatgcctgtaatcccagctactcaggaggctgaggcaggagaatcgcttgaacccaggaggcggaggttgcggtgagccgagatcgtgccgttgcactccagcctg

SEQ ID NO: 47606 - DNA, 1010 bp, Homo sapiens
ggagcaagttgcgcggggccgcccggcggggcgcgcggcggcgaggaggcggcgcggcggccgcgtgagggcagcgggcgccgccgcctccgcctccgccaccgccgcggagcccggcgcttccgcccgccgcttctcctcagcctcggcggcggcggaagccggagccgggcgcccgtcctcatcgcctcagccgcgggccctgccggccgggccgccccctccccgcgcgggcggggagcgcgcggccgcctccccctccccctccccctctttcttctcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagttggtgtcgtctcattaagcatcttttgtgtgtgtgcgggagccgggcccgcggccgagtcgaggcccggggtggcgcccggggctagggccgcagcccccggcggggaactttctccgaaagccggccgcccgccccggcctcggggggacttgcccgcgccccccgaagcgggcgggagtcggcaaagttgctctggggggctcgggacggactcggtgcggcgcggattccgtggcgtcctttcccccgtcctgcccctcgcagcccggccccctcccagggatttaaacctcccgccccgaccccgtgcgggccgcgccgccgggaagtgtaactttctcctccggcggggagtcccggcgccggctcccgcggccgcgggacgacctcgcgatgcgggcggccacccgggcccggcgcggggcgatgggcggttccctggcggg

SEQ ID NO: 47607 - DNA, 1002 bp, Homo sapiens
aggacttagttacaccattctgaaaggaaagtatagtcaaccacatgtcaaaggtgagttacgaaaaagaaacaaatcttttcaaagtctgggattactggcagagagagctttggtagggctattgctatttaaaaaccaagaggcagctgacaaaagaaatttttgtgttttaaaattgtttctggggctttcagtgataacttgtaaattagattctctttttgtgctttggccagtggatccacatttgcacgttatctcttttgtaaaaagccaacagccgacaaagagtaaaggcggctgtctgggtagaggcatcttcctgctagcctctctaagctcgagagggatgggatttaagtactgagtgattgatgggggtgaagctctttctcttctttccattctcccctactacccatagcttcacctcactctccaaaactagtcttagaatgagacagggactcagaatcctcaattcgaaataaaacagctgtgtagacattagtgttaccaaagcaaagaaagcggggctgcaaattccaagcccccccactcctgcttccatagtcggtcatgctttagaaacatgaacttataaaagaaacattgtagaatatatgtatattgcataaatattttttaaaaatcattttatttaatctaataatacctaaaaattaattctttgtaatttagagaaagtttacctagtcatttatgaatagaaaccagaaacattatgttgatgactctattctgcttaatgaagggggttgagggtgaactgtcatttcagtggataatgtcatttcagttgtgcttttcttctaaaacaaaacaaaatcattttaaaaaaaatctgtttatttgtagctctgccagtggattttgaggtttctgatcaggcagtgaacactgccagttcttatgcacatgggggatttagtttagaaaacatctgtttccccctctaccatatatgaaaaggtattt

SEQ ID NO: 47608 - DNA, 1057 bp, Homo sapiens
tggcttttgtcttgtcatgatgcatgtctccgtaacattagagaaaaagctacagggccccactcatctcagttaataataataataattttaaaaagtcaaaacaataacacaaaacccctacctttctaataaagtgtgaatagaaagatactaagaacaggcagcactatgtgtttttaggaaacttgctaagtaaataccatttctgtaggttaaatttccatcacatttttaactgtcccagtattgatcaccctatagaggaatgagactgaagtctggtagttattagtataaagagggtcagctgcagagactggtaccgagtagaggctctcatggtaatgatgctgctatttatagatccccatttcattagttgcagagtttcaaggaagagattttctctaggggaaatggatacttgaagttcattttcttcctcatattaaggcaaaaatgtgaacaaccttcagtataggacatatgattacagtatttttgcaggggcagtttatattctaaatatatttgcaatagtgaatgttgtaaatttaaaacaatgtagagattcagaaatgttagttgctattctggctgagtgctactttacgtacattgttttattacccttcttgtcattttttttcttgtaaaaattactaaattttcaggaactgcaaagctgagtacaatcatgactgtattccctttctttagagtgctgtaaggcctttaagagagttaactgattgcaagaagtgtagttccccaaaaaatatagtccacccactatgtgtatctgtatatatttgtaatataggtaattgtgctttccttctcaaattctttacctttgagttatttttttccctttaagagaatatttacttagttagtattcacttaattagaactgactgtttaatgttttctgggagggtatttatggtattttctttgctatatttgcattccagaaattaagtccccctgccattattcggtgagcctttcatacattagaatgatgaattgaaagcagaaatgggaa

SEQ ID NO: 47609 - DNA, 1613 bp, Homo sapiens
accttgggttaacaatagctttgtagaggtagactttttaaaaaactacattttatccaaatttgtaactgcaatccactttcttctgagaagcctagtggatctgctttctacccagtggttctacaaacactcagaccaccagtcgtttctgagtgtagtgaatctttgagtgtattgaggggaaagaatcagaaaaatggaatagaacaattacatgaaaggcaggagcaggctagcaatgagactcaggtgctagtaggactagagaaaaaggctggcggccggtgggacggggagaggggagtttagaagagggaaatctgaaattagagacatgggttgttgaaggaacttatttggtaattagcatatattaccttgcaagaatgatacaaaaaaaaaattactggtttatgacctagatgatataaggtccttgggggtggtggggggcaagtttgtctttttggtaactgttttgttatttcatgttgctttatagggatttaatttctgctatgtgatagaattcttttaagatacatgccatccttgtgtatataaaataagtagatgatttattgggttagaatctgtatttaatttgttaaactttcctatgtaaagacttttgaagagaatatctgtgtcatttattctcaaactttttgatcttaggactcctttatactcctaaaataagttttgtttatgcgggtttaatctctatttattgtatgaacaatcgaaacaaattcttaaaacgttaagttaatttaaaaattaaaatcataaatcgattatgttagcataaataacattattacaattatcagcttgttatatgttatcctaaacagcattttctgaaacaaaactaagcaaaactaaatgataagaagaatagtattgttttacacttttgcaaatcttttaaatgtcagacttaatggaagacaactggattctcatatctgcctttgcattcagtctgtcatcatatggttgatgtatatgaagaaatatctggcctcatacagatacctaattggaaaaggaaagagtattaccaccaaacttatcaggacagtttttttaagtgctgggaagatttcatactcacagtggaggacacagtgtttcaaaattctaatttttgcttgaaagcatgaattttattattagcgccaaaactgtttattgttttacttgaagtataggtttacttggtttctttttgaaaaaaggtctgccaaaataagctgaaataaccataatttgttaatttttttttaagcagctagttcagcttgcaactcacagttatgcaagtgctttcctcacacttggcatgcagcctaagtgctttgtggagaatttgtattttgtcacagaatattaaaaagacacagtgaaggtgtgattgagttaataatttttactgtttcatcaaggacattgtgaagtgaaactggcctttaaaaaaaaatttaagtgcctagtggtaaagaatacattgttagtatagtgtggtgccgctgtcttgctttgtgcaatggcgccagcagttttatccacctttgctttgtgcaccatcagtataaatgtca

SEQ ID NO: 47610 - DNA, 1046 bp, Homo sapiens
tgctgatcctaaaggcaacagaatatatcgtgaagccattagcgtgatcctcttagcgtatttgttaagtgcctacacaagtatggtattctgctgaatattcttcagtgtggaaacagcttttgcccttagaaggcagaccctgtagtcagtcttgactgcacacataaagggaaaaaaaggatagatcaacagatcacattttgttggatcatagttttccatacagaactagtgtaagcttcctggggttcctgggtaagtcctagagtgattatttacaaaataaggaagtaggacgaggagatttctaaggctttattcagtttaatattctgattctttgacttttttttaaactgagtgaattgtttattaattagctcttaaccacttattaatttatttaagctcaactggttatgtataatttgtatttgttgctatcacattggttaagcattaatgttattttgcagtattgaaaaacggaatgtatagaagaggaaatggaagggaattgtaaatgaagaaggcttctacaagcaagtgaattttaagtggcaaggaagaagaaatttggatggtgggggggatgtacattgcagtgtatttaacatatttctgaattcagagtctttatagcctatgctataatagcagagaaggaaaatttgagttcagaaataacagtaaagcctgtaagttaaagaatctaccagtaatattctctgatagtgacatgtgtaatatgaactgttgaaaaaaatctccagagtaaaaagtggttcagcacataaatacataatgttgattctgaggttcctttagctccattaattttgaccagaaagctataatagtttttgaaggggaatatagtacttaggcattaaaatatatttatttttgctcctcaatgaaaaaaatcttgtattaccttgagatcttttgatcttccttctcatactttagaaggaaggaatactattcagtaaggaaaaaatgacccccaaactcaggttcttactcagcccagcacagtg

SEQ ID NO: 47611 - DNA, 1027 bp, Homo sapiens
ttctatttcattgatccatatgtctatccttattccattagtacactgttttgattactgtagctttgcagtcagttttgaaatcagaaagtgatgatgtattaactttgttctttttcaagattgttttggatagttgaggccccttgcaattccatatgattttgaggactggcttttctatttctgcaaaaaattgtgataggagttgcattgaatttgtacattgttttgggtggtattgccatcttaacaatattaagtcttccaatccatgaacattggatgtctttacatgtatttaagtctttaatttctttcagcaatgtctaatagttttcattgtaccaatctttcacctccctggttaaatttatttgtttattgactctagcaggttttttggtgtggattctttgaaattttctatacatagggttgtgacaactacagataaagacagttttacttattcctttccaatttggatgccttttatttcttcttctttcctcaatgatctgactagaacttccaatacaatgttgagtggctgtggtagaaacaggcattcttgtcttattcttaatattagtgggaaagctttaagtctttcaccattgagtatattgttacctgtgggttttccataaaagctatttaccatgttgaggaagttcacttttatttctagttttctgagtgtttttatcatgaaaaggtgttggattttgtcaaatagttttttttttcatccttgattggttttgtgtgttgaaccactcttgcatttttggactaaattccatttggtcataatgtgaaatcctttaaaaatgttgttggatttggttagataggagtttgttgaggatttttgtgtctatacttgtaaaatatattggtctatagttttcttgtggtaattttatctggcttcagtctcacaatagtacttcttttctttttttaaatgggcttttgctctgttgcctaggctggaaggcagtgatgcagtcttggctca

SEQ ID NO: 47612 - DNA, 1060 bp, Homo sapiens
acaggtgcaagctgccgtgcctggctaattttttttttttttgtattttagtagagacggggttttaccatgttgcccaggctggtcgcaaactcctgagctcaggcaatctgcccgcctcggcctcccaaagtgctgggattacaggcgtgagccaccacgcccagcctaattattctttaaatacttagtagaattcatcagaaaagccatttggtcctgggcttttttggaagattttttgattactttactctctttctttgttatagatctgttcagatttctgtttcttctggaatctcttaaggtaatttgtgtgtttcaaggaatttgctcatttcttccaagttatctaatttgttggtatataattatttgtataattctctcataatccattttatttctgtaaggttggtgggaacgtctccactttcatttctgatttttgttttcaaatcttctctttttttttttttttgagatggagtgtcacttcgttgcccaggctggagtgcagtggtgtgatcttggttcactgcaacctcctcctcccaggttaaagcgattctcctgcctcagcctcccaagtagctgggactacaggtttgtaccaccacacctggctaatttttgtattttttagtagagatggggtatcaccatgttggccatgctggtctcaaactccagacctcaggtaatccacttaccttggcctccccaagtgcttggattacaggtgtgagccaccgtgcctggccctcttttttttttttgagacggagtctcactctgtcgttcaggctggagtgcagtggcatgatcttggctcactgcaacctccgtctcctgggttcaagcaattctctgcctcagcctcccgaatagctgggattacaggcgcctgccaccatacctgattaattttttgtatttttagtagagacagagtttcaccatcttgaccagactggtcttgaactcctgacctcgtgatccacccacctcagcctcccaaaatgctgggattacaggcgtgagccactgcgcccgg

SEQ ID NO: 47613 - DNA, 1091 bp, Homo sapiens
aatgaacatatccatcaggcctaaagtttctttgtaccctttgggtaaattttaaaaatgtaatacgttatattaaatatatataaaataaagctattattgtagggaatttagtgagcgattgtattttaaaaacctttccattatgaagatttaaaaacatacagagagagtaatgttataaacttctgtgtacccaatcacgcaacttaaatttgtgtgataacatttttaatcttataatgtttacaatttttgttttcttacaaatatgatgttttcttacaaaagcctgataaactgaattcttaattttacaaatgaggaaattaaaatgtggataaattgaatcgcttgaaaaaatgtttaagttatggaaatgcgggagttgatgaggaggaaaaaacatattttctgcttctgtgtttactggacccttgctactcaaaagtgttctctgtggactggcagcatggccatcacctgggagcttattaaaactgaagatactcacaccccacctcagaactactgaatcagaaattgtattttaacaagattcccaggtaatcatatacacattacagtttgagaagctcagtgttaaggcaaattgcctctttgggcaacaatgaaattttataattaaaaatctttcttgaagtgaggttggtgaatgggaaaaaaattggaaacctgactttagttactgctcagtttctattattgaatgatgccctatatggtaccatgagaagttaattggttagctttcctatgtcaccattttcaatttattaaaaaaaaaagattctgagaacaaaataacaaaacaataccctaaacaattataattactcatgtatgccttttgtcaggattatgtttggtctatgaagggaaagtaggagactcatggctgtttttttttttttttaacagtcccataagttaataaaacaaataaaaactcagagtcctcctcccacccacccacctcaattccaaagataacaaggttgggcaaccagaggcagaattaagcactgttcagtgtgtacaccaagagaagacttcatgttgtgttcaat

SEQ ID NO: 47614 - DNA, 1044 bp, Homo sapiens
cttaggtgtaaagtctagcttatccttttgcagtattctgcatgtctattttctttatttgcggttatacaattagtaatgtgcagtgaaaatatggttagtgtgggaatagctcagattaaaattagaaactggacttggcatgtattcagttcactgcccagggttaaagtccagcgccacagaaagtggatcttcacctttctctcctggtgttttagctttactgatgatttgaaaccatagcagttaatatgctttagcctttgcttttacagatgagaaatggatcttatacttatatcaccaggtttcaaaactatttacactaagtgggatggtttactacctcaggggtagtgcattaagcctattgctcttgagaatccattttctccaccaattgatgggacagatatgacaagcctttaaagttgagtggaaattttctgtggggcgggctgttgtattaaattgttccttaccactatcatggatgttgtaaagacttgtgagtgggtagcctatggcgaggaaaagagatatattgtctgcagtagggaggctgtaaggtctaatatatagggaataattctcttcctatctgctatttccctctccttctttaaatcataggttgagcccatccactccaaggagattttcttgattaaacatcactgaaaagcattagtcaagtttcttaattgtatgtaatgctgtgggaggtctttttaaaagcagttgtatagagtcactttatataatatataaaaatatataatacaccgtaaggactatagttaatgagagtgtcatattaactgtagtccttatggacgtacacacacacacatatttcctaatttgcaccaatgccctcttatatttagatttatcatatttaaaaatttagatttagaatgttaatgttggttgttgtttgcaaggcctgagattacctaattcgtatggtaaccaccccccaataattcttggttgaaacacccagttgccattatgctaatgaacgtttatttgtct

SEQ ID NO: 47615 - DNA, 1028 bp, Homo sapiens
tgtcgtaaaaggtgaataactggtgtaaaagaagagcaggctttctgactttggggtctttatctagtctgagtgttgagcatctttgttgtgattttatagcttcttcatctcttgctacatttgctgtcatgagttttcatgtcagtagcctactctcagatcagtcttggggataacaaaagttactagaaatggtgaagactaaataggttatagactatatgtaggtaatcagtggtagggtttataaatatagagtttattcagtgttagatagctaagagttataaagattcttaggtctatgcatttcttgggaaaattcataaaggaatttcaaagttggaagaaatcttaagtgtcacaatccagagcttttcaaggtatatgagctattgagcctcttagctctctgggcggctgggctcatcctgggatggctaagcccttgtgctggtcacctgtggctgcaagcattcttgtctgtttatcgtagtgtgctgtacaaaaccattttctagggacaccgtgacatgaagggattataaggagactgtctttgtccagcaacccatttcatgttaaaatctccttctgtcccatctctgctaaatgatgatttagtgtagccatttattcaacaaatatttgatacaaattatgtgccaggcactgtgctagacttaaggaaaagcgcaataaagaagacaggtgggcgtggtggctcatgcctgtaataccagcactttgagaggccgaggcaggtggatcacctgagatcaggagttcaagaccagcctggagcctagccaacatggtgaaaccccatctttactaaaaatgcaaaaaattagctgggcggggtggcgggtacctgtaatcccagctactcgggcggctgaggcaggagaattgcttgaacctgggagacggaggttgctgtgagctgagatcatgccactgcactccagcctgggtgacaagagcaaggctctgtcttaaaaaaaaaaaaaaaaaaagaagaa

SEQ ID NO: 47616 - DNA, 1032 bp, Homo sapiens
tttttatttttaaattttcaaggccaggcggggtggctcacacctgtaatcccagcactttgggaggcctaggtgggcggatcacctgaggtgggtagtgagaccagcctgaccaacatggagaaaccctgactctactaaaaatacaaaattagctgggtgtggtggttcatgcctgtaatcccagctactcggaaggttgaggcaggagatcacttgaacccgggaggcggaggttgtggtgagtcaagatcatgccattgcactccagcctgggcaacaagagtgaaactccatctcaaaaaaaagaaaaaaaaattcaattctagctataatagatcagctgaactatatggaaatgggaaacgtgcaaatactactgatatcttccctgcttgtaagaagagggtttagatatagatatgggcaaagcttcatttatgaatagatttatatatcttcagtgtacatatatatccagtgttttatatatatataaaactggtgttttatgtatatatacacaatgtaaccctgtactcttcacttttaagtttattttagttagaatcttttaatacgaaaacttagaatatgaaatagcaaaatactacaaaagttgaaaacaactctgagcttttttgtgaatattatctttttttctgccacatttaattagttatcttttttgtatttcccatgtaaattttatttcacattcttggaggattaatatggaatttgtatagattttggaaaagaaattttaaaaaaccccaaagaaatctattcctattcattgtttctttcacctggatctcctagtacctataaatgggtgcatgaaaacgtttgcactgcactgaattgaagtttttactgtgggattgaaagaagcactgtgaaaaagatgaagaaacaattgaccacactggatctgtagcccaagctattagtttagtcttagtgtagtctactctgaattttgacttactggatatttaaggtctctggttattcctaacagactgg

SEQ ID NO: 47617 - DNA, 1364 bp, Homo sapiens
aaatcagataatataagtcttgtcgactctagcttgtctggaatattcacaaattaatgaagggtcattggtgattatgggattttttcctttgaaaatatatctaatgaatacataagatatatttcataaacataatatggtaatgtcactactaagtatttagacagttcagcttattgggtgatgacacacactttttttctttgaaaatatatgcataagatatattaaatatttgaaaaatataataaaggtaatgtcagtactaagtatttagatggttcaacttattgtgtgatgactttattcagaagagtggattgctctgacccttaattatggacatattttttaattgacacataatattttctatatttatggtgtacatgtgatattttgttgcatgcatagaatgtgtaatgatcaagtcagagtatttaaggtatccatcaccttaagtatttattatttctctgtgtttggtaacatttcaagttctttcttctagctactttgaaatataccacacattcttgctaactgtagtcactctaccctgctatcaaacattagaaattatacttttaatctaactgtatgtttgtacccattaaccaatccctctttatccacacctcccacccacacccctcccagtctgtggtgtctgtcactctattctctacctctgtgtgatcaacttttttggctcccacatataaatgagaacgtgaaattgggacataacttttaacccaataaaattatgcagtatatcaatgaatgtatttgaatgaattattagtggtaattctgaagtaaagacccatgtagggtatatggactttttgcattttgatttttgcttatgaaatatttcaaacacatagccttttatttcttcctgttaagtttaataaatgttaacattttgccatctctgctttagacatttatttttaaaaaatatccatttacatatgtttgaagtttccccatccgttcagctcactaacttccccaccccaaattagtacctatttatcttatggttggtacatattcttctcatgtgaaaaatgcttttactacacatacgtgtatttacaaataatgttagtatttttagtattgacaaatataatgtgtatatatacacatatgtaatacctatgtgtcgtatatacacactgtacatctttttgtagcttgattttttgctcaccagttttcaacatgtactgcattgattttgatatccgtgaattgattttattagttttacctgctttgtagtattctaccgtgcagatgaacttcacattcatttcactactgatggatgcttacatttcatc

SEQ ID NO: 47618 - DNA, 1029 bp, Homo sapiens
ctaaaaagttttaggtggtctaaaacttttggctattttgaataatgctgctatgaatatttgtgtataagtttttgtgtagacatatattttcatttttctttggtatataccttggaatgggattgctaggtcatagataactatgtttaacttttgaggaactgccagcctgttttccaaagtggctgtaccattttgtatttctacctgcactccaagagggttccaatttcagtttaactttaaacagtatcattaattggataaacactgcttgctttctctgagccagagatttttctagatgttgggaatacagcaatgactatggctgacaaatatgctgccctgaaagaccatacaattaagtgcagggagacagataataaataagtcaataaatagaataatttcgaagcatgataaacattatgaagtattgactgaagtagggggagactttagaaaaagtagtttgggaaggtttctgtaagagaaggaaaaatatgagctgagacagagaagtatagctgaggagggaacagggaagaaaaactctaaagatgtcacctttcaacaagtttttaaggtgatacattgatgtgatagtggctaaaactaagaatggatcaattatttttacttgttttttttatttttatttttttgagaccgagtctcactctgtccaggctggagtgcaatggcttgatctcggctcactgcaacctccacctcccaggctcaagggattctcctgcctcagcctcccgagcagctgggattacaggcaccaccactgcgaccggctaatttttgtatttttagtagagacgggggttgcgccaagttgactaagccggtcttgaactcctgacctcaggtgatccgcccacctctgcctcccaaagtgctgggattacaggcatgagccacctcacccgaccaattatttttacttgtttgtgaaatatttaaatctcagctgggcatggtggctcatgcctgtaatcgcagcactttggg

SEQ ID NO: 47619 - DNA, 1045 bp, Homo sapiens
tgtagatttgaggaatcaagaggcaacatggtgatgaataaagaggactatactcagattcagaagatctctcacttgttcagatctatagattgagtaaatgaatgtctttttcacagcaattcaattagaatgaggttccaaagaaagaggaaggaaacagaaataaccctataacagaaatatttccaatctttgtaagctcctgttgtgccggatgaactgatgtaacttcttcacaataaaagttagcaagatttaatgtaggtagaaggagagggaaaagccaaagatttatggggagtttaaaagcctggaaacgagagtcttttggttctcttgtctctgttaggaaagttagggaagatgttttggatatgtatagttttggattactggatcacatccaagtatatatattgtatggacaagaagacatgaaaggccgaggaaagcaaaagagaaaagggatactgttgggatatgattcttaaacattccaagactgtcttttcagtgacctccctgtttatggaattgagataatttactcctgacatctgatatatgtatactctattttgaagtattttgctctcttaaattcttagtataaagcaaaagctttcagaaacctgtacagtgttctattatctgtcagtcttgtggtactcatttctgggctttgaggagcactatggacagtgggccattcagatgcctctttgtaaatatgggtatcagcagagagatttttaaaaatgtttttcatgttcacagacctgtcttcttttttttaaatatcttaaatagtaaatagtgaagattaataattgtgacttgtctagcattatggtgatatttaaactgttttccagaagatttttctgtagatggaaacaactttggaataaaggaggaatttttttcaggatggagttttttatttttcattttttagcacactggaaatgtgtccattgtgttttagatgccacttacaatgaatttatttaatagtgttcttctggtcagatgtaaataa

SEQ ID NO: 47620 - DNA, 1213 bp, Homo sapiens
aataattgggtaaatacagataattaaatttattcttactgttgaaaattcaaataatttgtggcagtgtttttaaaatcagacttagctaatgcttggttctgtgggtgtaggagaaatgttgtagatgattcttttgtttgtgttaatctagcacaccctaggtactatgttttttgtcttgaacttgtgatgtggtaggcaccagagaaatgcatggctagatttttatgtacgtaactgttgcaacaggacatttataaccattctacttttcttcctttttgctatttcatccctggagtgttgtcttaccccagtttattcagtgacagagaagacaggaaaagagtgaagtctctggagtatagctctgctggtgtatgacttgttttggtcttgagcttgcttgcaatgcctctagtacatagacccagcttttgttcagaatgctgttgaatgggcagtgcttactttactgtagccagaattgattatcttggttaaagaatcaagggagattaagttgatctcttaactgttctggatgttggagttaatttcagaaacatgtagtaaactgcagtattggtttagagtggaacactttagttaggatgtgtagagatagtttgacctcagtgcttgtgcttttcagtgaagcttttattgtactgttaacaaaaatctagatgaaaaatttgagtaaaagactatattttatctgaaatatgagatgattttatgagacatttataattcagaaagcatggattatattgtctctcaacctctaattttgaaaactttcatttatatctgtgtattttgatcaagtgtcaatttgtcttctgccttccgatgatgaagtaactgacctccttaagatggggttagaaatataagtcatttcttaaagcaaaaagttgctgtagcgagttttccttgtgctagctcttctctttcaggccatcttactgaaactaaacatcagttcacttgacaactttactcaattctaggcaacagtggctatgctctggcctgcagagacagtgaatccattctggctctgacactcaattttattgtaaaacacattcatgttgacatcatatcagttttctgaactattacatgcataaaagaattcacccctttccattcagtctttttcagccttccggttaggagaaatctgcacacccagtgt

SEQ ID NO: 47621 - DNA, 1065 bp, Homo sapiens
attgaaaagtgtttgaaaaaagcaacggtcacataaatcccattgctcagagattaccactcttctaaatagtgctaaacacatatatattaattttcaaaagtgagttaactatgctgttgtgtagctggcatctttcactgaatagtatattgtggatatctttccatgttagcaagtcattctatgtcatcatctttacttggctgcataatattccatgttgccttttttgtcagttttgtcacatactgtgtatttgcttgaatcacaattaaatatctgtatagttattttatacttttatggggggttagtttaaaatatggcattattctaactagaagtgaaatcattaattatttactggtgcttattgtgtgttaatctcattctttgcacttaactatctgctgcccttgtggggtttacattctagtggaaagagaggtaacattatagaacaggttaaaaaagatgaacaaagacatctctctgcctagattgtaagagggaaacaaagaaacaatcatcatggctattttattagaggaatgagaaaggaccagaggcctctgtatgtgtccggggaggtttacagattcatggtttttcagcttctatatctcgtttctagctaacagggctatcctttgttctaaaatggcagatgttatttgtaactttgttttaaaatagcataatatttctgcttaaaaaatttcaaaaatgtcaacaatgatttttcttgaaagtgttaatattccttcttgacagtatccaaagctatactttggtgatttccatggtacctcaatactgaatttgattactctttgattaggcaactaaattttttgtcttacttgcttttttcacccctaagtcatccataaagacgtgattttcatggttgtgttaggtaaacataagttgtactacatatgtgtaattacaaagcaattgtaatggcaaatctagggtcttgtgacatctgttagtagggatcttcttatcatatccctcagtgatcatttgacaaaaataataccatgaagggatttc

SEQ ID NO: 47622 - DNA, 1122 bp, Homo sapiens
ggctgctgactctaggataggagtataggaattagttggtaaattgacagctaagttaaagtactgaacttctggcagaatttaaaaacaataataactcatcaccaatttaattcaattttacatcattatcactggcaatataattatacatttctaccagaatcaatttttgtgaatctccctgttgatttagtttccaaatttttatttttttactattttattattattatttttaattattaaaaatagagacagggtcttgctctgtgtccaaggctagggtgtagcagtaggacaatagtagctcctgcatcttggaactccaggcctcaagtgatgctcctgtcttggcctcccaaagccaaattttaaaattattacttagatgtatagaaatccttgagtctagacttacaaatccttaagagccttaataatttcctgctctaatgtttttttggggaggagtagtccaattgggtggatttgggaggatccattatcattaagtatttactaagggctgggtgcagtggtttatgcctatagtctctgcaatcccagcacttagggaggctgagacaggaggatcatttgaggccaggagttcgagaccaggctgggcaacataatgagacttcatctctgcaaaataaataaataaataataaaataaaaataaaaataaaaaaatagccaggtgtggtggcacatgcttgtaatcctagctactatggaggatgaggtgggagggttgcttgaacccaggagcttgaggctgcagtgagctgtgatcactgcattgcagcatgggggacagggagaccctgtctcacaattttttttttttactaaattccagactacagtttttggattacagatgtaattcagcaatgaaaaagtttagaactttgtaaacattatttcagttttagaaatctaatgttacagagaaagacttgtgtctcaaatgaagagttttatcaggctttgtgtatctctcattacttgagacggcagtagacgttaaatatataaaagctgagctgcttctctggttttgtagtttcagctgcctggtatttaacattggttctattttttaagtgggtg

SEQ ID NO: 47623 - DNA, 1027 bp, Homo sapiens
caagtgagaatcctcaaatcatttctaaaaaatggcttcaaataccttttagaagcttatttagtttttaaaggttatttgacactatcccagaattatagaatttgaaaactgaaagaaaatttaatttagcaccctttttgtaagttactatttcaattagttttcttatctcaagttgatgtgatatctacccgcttccgtcagtaatgccagggagctcaaaggtggctggtaacaaaagtggtttaagtaaagataatgataaatttcatgttttaaaataaatgcttttcacttataggccatttatagattattatctagcattcaactgtgtatctgagtttcttggctatatgaaaaactgaatgagtataggtatttttatacaataatcttagtagataatatattagttgattgaaaatatatagcagttctacttcaaaattgtatttctgaaataactttcttaatgaagcctgaagttactaagactttgttatgatcaatagtttctgctgaacggctatatatgtataggttttagtatagtactgtgcatatagtgggtactcagtaaaggtttgttgactgagagcataaataaaaggagattgagctgaaaagaatgtaaaggaagataatttggcttgaaacatagtgtgtgtcctgtagttaattgaaccaactaaccagttacatgttttctagagggtcttacttccagtaacagtttcaaagaatgttaccaaacaacaacaacaaacaacaacagcaacaacaaaaaccaggtagtaatcaatttgaatccacctggtggactgtttataatgtgtttattttagttgtctcatccttctacattcttttcttgtcagtttactactcagagttctccagatcaagtgtgaaaagtagctacctgatctgacaggaccttgcctagaccgtgacgcacaatgttgtcttttctttgcctttctttaattgtgtcaccttctttgttagagaaacccaaatc

SEQ ID NO: 47624 - DNA, 1045 bp, Homo sapiens
cacagaagcaacaccaaggatgaactacaaagttctgcacttctgcctcttggaggcggcctttaagtaataatttttctcttttatttaatgttgttattaacacggtcaataaatgtagtgacaaagtttgaaacataagatacaattaaagctaattaataaattggctttcagtgactgtagagacattatagatggtttagctttttattttgaacatggagtttttcttaaatgcaaagctgcttgggaaatttcagtggcttgagatttataaagtgtttgattttaattattttaagaattctcaaacctatcaaccatgcccttcagataagagtacaggaatgggattggtcactcgtatagctctgggtcccagcacaaggcctggcacttaaactcataaagattgttaagtgactctccagtgctttttctgttgtttttaatttattcattaaaatgtatatttttctaatttaaaaaatcctaatgcttgctgatctgaaaacaatttggatgatacctgaaaacacaagaaacacaaaaacagaaattacttctaaaccccactgtacatgatagtcacatgttagtacatttttcctgtgcttgtgtatatacctacatctatgtatgtcagtgtttgagtatttttaccaaaataaaaaaaaaaagactcatggtgtatgaaaagaaaaaaatgccctttcttccttttttatagtctataatgaatattttccccttgatttgtcagtgaatatttcccctcaacatgatctttaataaatgatcatattccattatacaaagatgtgctataaatttaatctctctctctctctttctattaataagtaggactaaggggccaggcatggtggggcagtaggactgaggggccagcactttgggagataggtggatcacttcagctcaggagttcaagaataccctgggcaatatagcaaaaccctgtttctacaaaatacataaaaattagccggccgtagtgatgggcacctgtagtcgcagc

SEQ ID NO: 47625 - DNA, 1050 bp, Homo sapiens
gttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaattttgatgcagtttcttacttcactatttgagccagccaagtgcaggcagaggagaaagtgcacccagcaccaggcctgggagtgtaactgcctcctgtcagagaccactctgagatgacggtgaggctgggagggaaggaacagctgctgttgagtgtgcaggcaccgtgccacctactgaaccattgttaggagtcctcacttgatcctgatgtgctcagtaacaccgcaaggaaaactccccattttcatagattaggaaactgaagctcagaaaacttaagtgaatgccaaaaggtcacagacctaggacagcaagaggtcacaccttgaacccaggtctttctgccctcagctcacactctcctgacctagtgatgcctttggcacttgttagatggattttttttttttttttttcttgagatgcagtctcactcactgcagcgtaaaactcctgggctcaagcggtcttcctgcc

SEQ ID NO: 47626 - DNA, 1091 bp, Homo sapiens
tcacctcccctctggtggggagcagtggctggggcttgtgctccgagtgctgggggtctaccaggagcctatagggtaaggcaggcccctcagtggggcctgcagggctgcacaccagctccgggatttcctgtcttccctttcccagccagagccccagacattaacgtgcgctggcagcctcctcctcccctggcttctgcgcctttgctcccggtgctccctgcacatgaggtgtgtttgacaggtctcagcgcagaggacttctctcccgggaagccctcccagaggctcctgggctgggcctgtgctgggtcttcttctgtgagcgcttccggggcatctcgagcccgtgtggtggtgagggcatgtggtgagcctccgaggagctccccagcgcctacctgaatccaggcacgaattcagtttcaccataaatgcgtccctggcaacccctccagactactccctggtccctgagcactgcgcgggtcttttcctatggcgagagtaatccaggcttgtagaaaattggcagaatgtagaaagtatgaaaaaacaggaattccatttcccacgagcagatgcttataaccttttgttatatttccctcaagtctttttcttgtgtactttttacataggtgatatcatatcgtgtaatagcaagtctgcatcttgctactcttttctcaggtagccttaaccataaacctgagaaccacgtccagtgcggtctttgtgtggcgtggatcgggcctctgggagcgcggtgacgcagcgccctctactgcccagccgtggcggtggcggggaatgcggttctgagccggagctagtggcaggctctttcgccgcagagccctggcccaggccagccaggaggacctaggaagcggtgggtcacagatcttgctgccttcttgagtctgtattcctctccaaagccaaaaccatgtgctccgcctccatttcttgtgtcatcgctcagatttcaaagaatttcctgccattttttggaatgccgttcattcccagctttacttcagacaaaggtggatctttgcaccgtctgtaggccatcacctgag

SEQ ID NO: 47627 - DNA, 1092 bp, Homo sapiens
tctgtggtccaggcagccgagggcagctggatgaagcagggtgggagcccaaacagctgggtgcaggccctgtctctcccaccgactagccgagtgaggccagcagagatcctagcctttctggatctaaattccacatctctccatatcagcaattgcagtaacaatatcgatcatttgaacatagcaataggtcggctcattcttatgggacgcttcctgtgcaccaggcattgtctggtgtttaaggtggaggtggtaatgcccacctcccaggacttaaagctatgtgggaaggaggcttgtatattctgcagcttgagatgccccaggcctcgcagtggccagcaaatgtgcatttactgcccctggacttcacagacattctgtccaaacactgccttgactgtaacgttcctaaacacatgaacacagaaaaaccaactttctgatacctttctccctgtatgtttatcttctttgtctagtttttcagcagaaatatgcccatttccccctgataattcccttccttagagacagcataattgtagacctggccagagaaatgctgaaaacaaagggaacccccttgagcccagcccttcacctgctcttagcacttcttcagaggtttactctggagtgaatgaagtagtgtgaccagacactcctgcctagaggcagcttataccaaattagccttttgtttctttctctacctctgtctctctcaaaataataaactctcagctgagaggggaaaatgatgaaggcaacttctttcattgaaacacatttagttgtttttgcattattaaaatggattaaattaattaaatgaatttactgaataatacccagccttcctcttacttaccctgtgtaaggtatggcatatgcacttgccatgcattatgttatttaatcccaacaaatccttaaccaagaaaatcttttacagatggggaaactgaggtcttgagagcttgtgatcagctcacagttacacctgtggtacgtggcagggctgagattcagacccaggtctctttgactgcagacattgagctcgaaaccacggtactgagg

SEQ ID NO: 47628 - DNA, 1032 bp, Homo sapiens
cagccatggacatagtgctgggctttggctgtggacatggcgctagtctgtggccatggacgtggtgctgggctgtgacttgctggctgccacagcctccccaccagttttccactttaagggaaaaaggcctcccatgctccttcatggttggatggcttttgggccccactgtgcccctgaaggctcagccctgcggccctcctcgctcatcagggcccttgggagggctccttgctgcaggcggctcgctctgggcagcagggagggctgggcaggcctggaaagccgcctgctggtgggcagggcgtgggcaccccagggccctccctggggctgggtgcagtgctccgcctcctgctggggcgatgtgacccctgccgtgttcctgagggcctcccttcctggcctgcccgtgtacaggtgtcccccaaggagctgcagctcatggtcagctcacccatagggcagctccacttccacctgctgtctgcaggggagcccttcttatgacaattctactgctaaaacttttcaaataaatacttcaaatgcttgaaaaccactgatctaatctaagctcctgcttcctaaaatccatgtgaccatgaggctgccttgacgcagggttccaggccattccccataccccacccagccccaacgccttgcacctgtgtccggccaggcagctgccagcccatttctgtggctggggtgccccgtgcctgctctgcccacatgccctgccttatgtttgggcaccgagacctcacctggcctcttaagtgaactacaggtgctcctagccccctcagaggtacttaaccccttctctaaatttccatcagacttggaacgcgatttagtgagccagggtcggttaggtgagctggggtctctggcgtgaggcttaactcctgcccccagacaggggagcagcagggctgagccgtggaggaaggtccccccaccgggcagctgccctggccccgctgtggcctgtcaggagtcctcagcaggggtgcctct

SEQ ID NO: 47629 - DNA, 1078 bp, Homo sapiens
cccggccgccactgggccctgccggtcaccaggccactgtgcagtgggcgcagagcatggtcaggagtggcctgcccgtactcctccacccagatgagggccctccagagcctgcaggcatctgtggggaatcccagcctgcaggttcttggagaagcaggtgaacctaaggatgaaagcaaaggagggccttgaggaagcagcccccaggcctggcagccacgcagcggctgagctcatgaacttggttcgcagcctgccttgcccctggaggccacgccaggcgctcacccctgagcccacagcccctgcttgggctgcctggcaccctcagggtggcccggcctcctcctgccactctgagcacatgtccgggggttgccaccagagacggctttgttctcccagctaaggccgtggagctgctgtgtgactgtgtcaggcctggacaaggaagacccttagggatgacgtccccgctgcatatttattcaaggtgactcttgtacttggcaagggaagtccactgtgtgattgtctgtattcttaatataatttgttaaataaacgtttgttttaacctctttccccagtttgctgtcgtggtgtctgaaggcagcagaggtcagtatccctcagggcaagccccaagctctctctcccccagcagggctcttgtcaccacctggcctgtcagccttctagaaaggactggtgggcttctttgccccttgcttagttgagacgacctggttacaagtcagtgggattccgggggatgcagaaagccccgctgttatctggtggcagccctcggggtgctcctggaaggagaaaagccccagttggcgtgaaggcaggagcagctcctgccaggtggccccggtggggagggccggggtgctcggtgcctttcacctccgactccccccagagcccttgtctgggggcgcagaccacgtcggagtctgggtggtttcaatcctgtcccgactgctcacctgcttgtgagaggccactccagacaccagctaaggaggctgcagggcccaggaacaggcgcagcgctccttgtgag

SEQ ID NO: 47630 - DNA, 1046 bp, Homo sapiens
cacaataaaaatttttttattcacatttctttttttctttgagaattgcagatgcatatttatttcatctgtgcgtaaatgcttttcagacaggaatccaagcaagcgggcgcagaaacgtgccttcttgatattgtcgagtctgtgcgtcagcggtattgagaaattaacaatccccccaccaaacacaacttctgaaaaatgtgtcctcacccctggctgagttgcagggctccgtccttaaaaagaggttgccatttttagtaaatgtctcttcttcctttcgatttgttctcaaagatcccagacacccagaagtgccaagttgtcttacgcaccacgggggtgattaattgacactggggcacattgagccgaatttgataaaaatcctcttgtacatccttggcgggcagagcagagcgccggccgtggagtttgggcattttcactcttaactccaaaagtctcctttttccccatgtgtgagttttgggggctccttcaaaaaaaagaaaaagcagccttttcggacagaaaaccagttaggaaacggagaggaaacgcagcctcccccaaatcagaacacctctcaccgtcctccaccggagaacaaatgaaaaataaggcactttcccccctcccatgtttttatcttggcggcttggccgaatagaattatgtaactctcttttcttgccgtctgtcgctcgtctggaaagggtttttatcctgaagaggtggagaattcctggaggaggctccggaaggggggagggtcggtgggagagtccaaaaatctgtcacaaaatggagtctaatcgcttgtaagacagctcccaggtttggcgacccgagacccgctggggtgcaagcgggcgcctttgtgcacggcgagacgcggggttccggcccgggccgcgctcctacctcggcggcggggccgcggcgtccttccgcccgcagggcctgcccgggcggccgagcctctcggcgacacagacttcagggctccgccgggcccgctgggggccctttgggctcgc

SEQ ID NO: 47631 - DNA, 1049 bp, Homo sapiens
ggactggaggctgcagagcagggcaggagcctgtggctgtgctcgggcgtttggattttatcctgtgggcaggagggagctattgaaggttattggacaggggagtgacaggaactggagaggcactttatggagctgatgctggcaacatgtgcctgggattagaccggcgggaggaggctattgccaccttggaggtgagggtagttgcgggaaccagagagggaacagggcacagggagggtcacagaggcctggggcttggagctggggtggctggaaccccaggtactcagctgcctggctaaggccttgaggtcctgagcactctgggctggtcccagcaggggtgacccacttagctgggtccctggaagagccggcttgacctgtgcagccccactgggccccacacccagaagggcccttagcttggtttaatgctcctgctgtcacactcttgagattcttaacttttgaacaagtggctctgcccctgccttttcattctgtgctgagccccgcaggcgagcccccagctcacctgccattcccacatgtcccagacacttgcccacatcaaggtcttactcaggctgtggtggttgcccaggaggcgtcccctggcctccatcatcctttcttcttctggaaaactctccctactcccaaggcctggcacaagagtcaccggtttcatggagtctctctggctctgagccccacccccgtcctccaggcttggatctgtcctgtagcacttgctagaggtgcagaatcctagatctgtgagggaactcgaactctcgaggtgaagcccatgagtctacatttccagatggcccctgggggaagccttgcctgctgaggtatgacaacctctgcccagggtacctccaagcctggcacagggcctggtacttggtaggtgcatccgtgtgtcatgtcattgtgaaggaatgaatgaacggtgcttacctgtccatctggatggatgaagctccctgggcctagctcattgcctggcatgggtgggtgggttgcagcaa

SEQ ID NO: 47632 - DNA, 1071 bp, Homo sapiens
cagacagacaaggacgaaggcctcagaagccacttggaggaggcatttctgaaggccactgtaccgaggaaggaagggatgtgatgcctcagggaactcttgggacatggggagaggtgggagcctagctggagggcagtggtgtgttcctcctgcccatccctcaagcctgcatgctctcagcaggtgagagctgagttctctgacatatgagtctaaaacagttgactgcaaggtttctcaggctcagcaggttgatgtggtgggtcagctcatgctttgttgtgggaggctgtcctatgcatgtagggtgttcagcagcatctcagctgccactcacaggatgccactggcaccgcatcccccagtccatggccatcaaaaatgtctccagacatggctgaatgccccttgaggcaaaatcacctctaattgagaagcactgagtagggaaagacaccaggccctctgaccttctatgtgccagaccctcaaaactccctctatcccagatctggctttttcctattgcctgatgaaagaaggattcacactcttaggggtggccctggtcacctaacacttgcctggccctactgccaccttttaagcagcacttgtgcaattttttcaatattttattgcattttgttctgagattttgaaaaagtaaaataagtgagaactgggcaaaataaaagcactattactagtaagaagaaacatttttcccacaaaggtagacatcaccagcttggcaaagtgaacataagactgtctgatggtgaagagaaataatgacatttaaacacataaatatggtagagcataaaatgctggcaagtatctttcttggtcaggtatctgatatgacgcacaaaatgcatgaaataggcaaagcatatttgagaatctgaccctactttcagttctctgcaagcagaactctgcttatgtgcaagtctgttccccaatggtgacatgtttccaggatcaccttatccttgggagcaggggatgcctgcctgcatctggggtcaggactggggttggggggagaagatccacaga

SEQ ID NO: 47633 - DNA, 1340 bp, Homo sapiens
ggcccccaggtactccccaggccatgaggcaggacaggaaccacagtggccatggttagaagtggagggggtaggagagaaatgaagccttccgaggaggctgagggcagggctcctgggtggaggattggtggacaactaggggtgaggtcacccaacagacagcgaggagacccccttcctggcaacttttccagaaacctggcactgggagggccctaacccaaatcccagttcccaagagagtcccggcgtgtgcctcaatctcccagaatataccagctgggcccccagagcagtcacctgatgctgggtctgagtgaccccctccaaggggcagagccctgaaacagcccccacagctgcctcccatggccagacatgtgcatacatgagtagaggcggcagacctccccacgggtggacacgtgtgcatgtgcatgtacaaatgcatcagcagttgtgcgtgcatgtaaatgtgtgagcacactcagagagcagcctgtagatagagttgtgtacgtacgcatccttggtgcgtatgagcatgcatgtgagtgtatgtggccagtatgtgtgcatatgggtgcagacgcgctcagatttgccggcatattgtgctggcatgtgtgggcatgtgtaaacagcagggttgggcagatgcagatggacaggtaggtgtgagtaggttgacacgcttgagtacacgtatgcacacattgtcaacatacacatatgtattgacaggcatgtgtgagtggacacgggtgagggcctagactgttggcacatgcaatacaggtatgcacacatatgtggtacctgggtgctgtgggtggcagtacagtcagtcctccctcaccctcttggataggttcttggaaactgtgacattaagcgaaaccacagacagcaggtcctcaaataacgtttccatgtaacacggacgaaaaaagtttatttcattatatggcgtttctcttaaagtcgcagttcccaagaacccatccacaagggtaagtgaagacttactgtgcgtgtcacaggtgaattatcatgggtgtgggtatagctgtgggtaggcatgaggattgggagcccagcacacacagacctcccacgctagctgccaccactgtggttgtctggaggggagtgcaggacagatacacagccaggggccatgccaggtggcagagaagggggcaagagaactatcagctgggacacctcccatactctccagagtttggcacccaggcacagccccatgcccagctcaccagccgttggcaggaattcaatcccaccccagtaaacccagctctgcttcgccaccg

SEQ ID NO: 47634 - DNA, 1044 bp, Homo sapiens
ggagatggttggtcctccctctggaggagagagctaccatgcctcaaggtcttatatggacagactcaggctcattcagagggtgattagaatgtggagaaactgctgggcatggtggctcacgcctgtaatcccagcactttgggatgccaaggcaggtagatcacttgaggttgggagtttgagaccagcctggccaacatggtgaaaccccatctctacttaaaatacaaaaaattagctgggtggtggcccgcgcctgtaatcccagctactcgggaggctaagacaggagaatcgcttgaatccgggaggtggagcttgcagtgagccaagatcatgccattgcaccccagcctgggcgacagagcgagacttcgtctcaaaaaaaaaaaacaaaaaacaaaaaaaaaaaacaaaaagactgcggagaagctgccacaggagcctaaccaagaaagggaggtgtcactgtctttgagtgcctgaagggcaagaaggagctcacttagtctgtggggccccagctgaagctgggcatttgaacacaacatatgacacccccaaatctgtctcaaccccatgctttttaccctgagcatgtttttatcacctgcctggtaaaatttgtagtaataaactttggtaattttgttaacattgaaaaccacccatcctgatcctggggaaaatttagcttggtaaaataatccatacaaaatataactgacaacggtgacacgaccacagtaagatgtgtcactggccacaaattaaccaaagagtccatcagcaggatccaatacaggcaaaaacctgatgctagaggaaagctttatagaaaatttttcatgaaaaataattatctcaatgagaataattttagggaaataatggggaaagtagaaaattatttgactctactagaaagaaaattgatttaaaaaaatgctttaatggagtttgttccagaaaacacttgctcaaagaaagtttattagtgttgttacagccctaattaaaatgctatggtctatgtgcagc

SEQ ID NO: 47635 - DNA, 1047 bp, Homo sapiens
ttctgatttcaggaattttaaaatgtgaaaaaatgcatgtctgaaaattaattgaagagtatcattttcatgaactttttttttcttgtttttgtttttgttttgttttgtttttttgagatggagtctcgccctgtcgcccaggctagagtgcagtggtgcaatcccggctcactgcaacctccgcctcctgggttcaagcgattctcctgcttcaacctcccgagtagctgggattacaggcgcctgccaccacacacagctaatttttgtatttttagtagagacagagtttcaccatgttggccagactggtctcaaactcctgacttcaaatgatccacctgccttggcctcccaaagtgctgggattaacaagtgtgagccactgcgctgggcctgaacttttccttttcaactctatttatatttgcagttagaataggggcttttgtcttatttgtaacatattgaggaaaaaatattttttaaaatttgtcgatatgttgttaatttcttgaaatgagtactgtttctgccttctgctttcttgatttcagcttcttatcctgaattctaatgcacgtgagggtacagttaaaaacatttccttggctttattgaaattcaatggaaggatgatcgataaatggggggttagtttctagaacgttaccttctcttttgaatctcagagagtttgctgtaatagaatgtttgtcctagaagtttttaagtaaaacattcagccgtggcttaaaattgaagggaatcatgaatcaaacttcataaagcaggtggcttgtttttttaaaaaacatcttaaaatagtttttactaagtgatttggccaaagtgttctaattaggaaaaaaatggaagaatactgattgacaatggtcaggagaccaatagcactgttccaaaggatatattaattctgcaaaattacatagtcattgaccatgttttctagttttaatgaatatgccacagtaatggatgagaggtatatgggagttatgcactatcttttcagtttttttg

SEQ ID NO: 47636 - DNA, 1095 bp, Homo sapiens
cttctctctcgctgttttcactttcttgtattttagtagaaggtccccaaagtgccttccacattatcgattccatttttttactgttgtaattctgcttcttattgcctgtgtaaatttctgctctatattagtttcctgataccctatcattaattcagtctgcccttttttcatatcattctactgttttgtctcatcttccttatactttattcagagactgtgttttcatgaagtttgtgaaaaacattttaaaaattgtttaaaatgtactctttgtctatttcttgctattttttctttttgatattctggaatatatccacagacctgtgttggttttattttgtttaattcttgagagggaaacattctgttcaggtctgaaatttgcttttgggtcccttgttgtatacccgaatattgttagaatcagctcttagttcttaagctagatgcagggctgaaccacattgacatctgggattagttgagtggggctggaggggtaggccttaggccctctcaggggagcttgagctctgtgtactttctttgcagttggtgaaattgggatactaggaccctctgttgtctttggcccaactggcaaatgatggctatgcctttacctccttcctggggctacggagtcccacccccttatgttaatattttttccttctgccaaggtaatgtgcaacctttggtatcctaataccacccacctctgagttttgccagtctgcaggacctgtctgtccttggcttttagctctgggactcccaagtgaaagagtgttactgatcccgtcagaattgcctggaataggacgtggagtttcaggccagtgtttcccttcaacttggccccatttccactgtatcttttttttttttttttttttttttttttgagacagagtctttctctgtcacccaggctggagtgcagtggtggcagtcacagctcactgcagcctcgacctcccctgttcaagagatttcccctcttcagccttctgagtagctaggatgtcaggtgcatgccaccatgcctggctaatttttgtatatttgtagagatggggt

SEQ ID NO: 47637 - DNA, 1034 bp, Homo sapiens
ttttttacaaagcattactgctcattgagaaggcacttggtcacccaagagctctgatggagatgtacaaggacattagtattgttttcatgcctgttaatacaacatccattctgcagcccatggaccaaggagtaatttcaattttcaagtgttattatttaagaaatacattttgagccaggtgcagcagctcacacctgtaatcctagcacttcgggaggccaaggcaggcagattgcttaagcctaggggtccaagaccaacctgagcagcatacaaaaccctatctatactgaaaatgcaaaaaattagtgaagcgtggtgtcatgcacttgtagtcccacctacccaggatgcagaggtgggaggatcacgtgagccagagagtcgaggctgcagtgagccacaatcgcaccactgcactccagcctgggtgacaaagtgagacccccatctcaaaaaaaaaaaaaaaaaaaaggatattttgtaaggctatagctactgtagctgctattgatagtgattcctctgacactctgatggatatctgggcaaagtaaattgaaaatgttttggtggcagtgtggtagctcacacctgtaactcccagcactttgggaggccaaggtgggtgaatcgcttgaggtcaggagtttgaaaccagcctagccaacatggtaaaaccctgtctctactaaaaatatatataaaaattagtgtggtggcatggtgtcacatgcctgtaatcccagctacttaggaggctgaggcaggagaattgcttgaaggcaggaggcagaggttgcagtgagctgggatcgcaccactgcactccagcctgggcaacagagcaagactctgtctttaaaaaaaaagaaaaaaagaaacacaaaaaaaatgttttggaaaggattcactattctagatgccgttaagaacattcgtgattggtgggaggaaatcaaaatatcagccttaacagaagttgattccaaccctcatggatgactttgaggggctcaagacttaag

SEQ ID NO: 47638 - DNA, 1048 bp, Homo sapiens
ggagaattgcttgagcccaggaggtcaaggctgcagtgagccgtgatcacatcactgcatttcatcctgggcagcagagcgagaccctatcttgggaaacaaaaaagaaagaaagaaattgctacagccaccctaccgttcagcagtcaccaccctgatcagtcagcagccatccactcaaggtaagaccctctaccagcaaagggattacaactggctgaaggctcagatgattgttagcatttttcagcaataaagtatttttaaattaaggtgagtacttttttttttttagacataatgctattgcacacttaatagactacagtatggtgtaagcattacttttatatgcactgggataccaaaatttatgtggctcactttattatggtgtttattttattgcggtgttcttgaactgaaccaacaatatctctgaggtatgcctgtatatgtctttatagcaggcttaactggtttataatgttgttcaagtcttctatttccttatagatcttctgtctgcttttttctatcaattcttgaaagtggggtattggagtctccacctattattatagaactgtctattccttccttcaattttatccacttttacttcatatattttagagttatcttgttaggtgtgtatatgtttataattgttatattttcttgatagattgaacctttttactcaacatataattctttgtctcttgtaaccttttttgacttaaaatcgatcatttctaataatatagccatctcaggccattttttgttgtgcttacctggaatatcttttttcatccttttcctttcagcctctttgtgtcgttatatctaaagtgagtctcatgctcacctcggcagcacatacactaaagtgagtctcttgtagactgcatgtagatgagtcgttttttaatccagttactgacaaggaaagattcactttacaatttagctatttgttttctgtatgtcttacatgttttttattcctcaattcttccattattgcccccatcctactttt

SEQ ID NO: 47639 - DNA, 1022 bp, Homo sapiens
tttcttgttaaatgatatccagtcttgtaagagtgtgctaagtagacactgtcattgattgttggtgagggtgtgacttggtgcaggctttctggcaagtagtttggtaatatgtatcagaaaattttttaaaaacattagccaggcatggtggcatgcctatagacccagctgcttgagaggctgaggcagaaggattgcttgatgacccaagagttcaaggctatgtcaaatgcacagccccttaacccagcagttccactggtagaaattaagctataaatatttccaaaggtatgcaagatagttatgcaaaaatatctattgtagcattgcttgtgattttacaacccctgccaactgaaattctgtaagaggagaactgcttacattacgatacatccatataatagaaagctatgtggccattaaacagaatgagttagctctttttgtgctaatgtgggaagatctccaagatatattaagtgacaaaagctaagtgtagaataaaatgtaggtaatgaacccagttgagtagggatttttaaaggatgtatatgatttattctgatatatgcacagggaagtttctagagatataaacaggagtttaatggtgatttcctttgggggagactaggaataaatgatgggagagattttttttttttacacctttctataatttttttttacatgtgcatgtgttatatcccacaccccctttttcaaatagctaaaagcaaaattctacagtggtgagatctagcagagaatctgttcacccagatgtagtttccagaatttacatacttttagtctactcatttatatagtcaacttttctttttgaaattacgaatacctaaatcatttatttcatgatctatttttgttttaaattactatgaaatgttttaagatgtataaaacgataaattaatacttcactctaaaaacacagtcttttaaaattattagtgcctaatctggcatttttggcatcttagaggaggcag

SEQ ID NO: 47640 - DNA, 1776 bp, Homo sapiens
cccagctactcaggaggctgaagcaggatgatagcttgattacccaagagttcaaggctgcagtgaactatgattgtgccactgcactccagcctgggcaacagagcaagaccccatctcgtttaaaaaaaaattatattatttgaatgggtatcttgtttgttttaactgtaaatatttacagtacttggttttacttgggagatttgtatagcttacaaatcttgtccctatggattcagttctcttacccacagacacagaaccaaaatcaggagttccacaaggagtggtggtgagtcctgcctttggcaaacacgcacctgcaagctttgctctagggattgaatcccttacccagtggggcccataggctagaggactttgtggaactttggaacttgtcttaacaatggaggaggggataaaataagtttatctttgggctggaatttgtactaatttttctttctcttgtagcaccgaacaagatttgtgatgaaatggagcctggaacaaactcttttcgggtagaatttcctgatttttccagcaccattctacagaaactgaaccagcagcgccagcaaggacaattatgtgacgtctccattgttgtccaaggccacattttccgggcacacaaagccgttcttgctgccagttcaccctacttttgtgaccaggtactcctgaaaaacagcaggagaattgttttgcctgatgtgatgaacccaagagtgtttgagaacattctcctatctagttatacaggacgtctagtaatgcccgctccagaaattgttagttacttgacagcggcaagcttcctccagatgtggcatgtggtagacaaatgcactgaagttttagagggaaaccctacagtcctttgtcagaagctaaatcatggcagtgaccaccagtcaccaagcagcagtagttataatggcctggtagagagctttgagctgggctctgggggtcatactgattttcccaaagcccaagaactgagagatggtgaaaatgaagaggagagcaccaaagacgagctgtcatcccagctcaccgagcacgaatacctgcccagcaactcgtccacagagcatgaccgcctgagcacggaaatggcaagccaggatggggaggagggcgccagcgacagcgccgagttccactacacccggcccatgtacagcaagcccagcatcatggctcacaaacgctggatccacgtgaagcccgagcgcttagaacaggcttgcgagggcatggatgtgcacgcgacctacgacgagcaccaggtcacagagtccatcaacaccgtgcagacagagcacacggtgcagccttcgggagtggaggaggacttccacatcggggagaagaaagtggaagctgagtttgatgaacaggctgatgaaagcaattatgatgagcaggtggatttctatggctcttccatggaagagttttccggagagaggtcagatgggaatctaattgggcacagacaggaggctgccctcgcagcaggttacagtgagaatattgaaatggtaacagggattaaagaagaagcttcccacttaggattctcagccactgacaagctgtatccttgtcagtgtgggaaaagtttcactcacaagagtcagagagatcggcacatgagcatgcacctcggtcttcggccttacggctgtggggtctgcggtaagaaattcaaaatgaagcaccatctcgtgggccacatgaaaattcacacaggca

SEQ ID NO: 47641 - DNA, 1061 bp, Homo sapiens
aaagttcagaaaagtcattcacattgttccaaatttgtaatggttgtcacatgtcacatgcgtctttttcagtaagtgccagagtgttcccactgtttctgcccagtgcttgacttctcggcccggaagagaacctgctttctctggtttccttcctgagtctggcacagacggggctattgtagttcttgatcaagtcctggagtcagccttgcctggctctccttgtagcagattcagtccacagacctcttgctgcccctcagtgacaagtatgctgtgaattcaacctttggacttgctgcccaagcctttggttgctgccctgactattgtaagaggtaaacttacctggtttgtttgagaatgaccattttcctaatgtgaaaaccatctctctcaccacttttattagtagggctaacatttttttccgttataaatggttgagcaatttgaatgacttaacacagtgtcattatcttgcaatataaactggtaacctcacaactccacacttcatcaccatatgaagtaaatgaagctagctaagcggatgctgtatcaactagtaacttgccattaaggattattttatagcatgaatttaagactatttattcaaatgatattttactcttgtattcactttgttttagatttgtgacatgaatatttcagtgctgcttaattttgttctgaattcttgtttcttgcttgtaaatggcttttttatggtataaataaagtcaatggacattgctgtttgtaaataaaaatgctgctagagcaaatgtgctgtggtctccctctgcgtgggccccctgagcttcggtgagtgtcagtggctctgacaaacatctgcagtgtcatagtttctgtaatcactgtttttgaaaggtgagggtttcctaagaagctcttgtgccaccatcgtgctgaaaagaagagaaagaagcgagtatatttctgacctcttgtgtggcgactgaattgtcggcctcggtctgcacccaggcacccccagaacaaatcgtgaatccctgcccctcgcgcctgca

SEQ ID NO: 47642 - DNA, 1050 bp, Homo sapiens
gagagagatctaggctggaacagtggttctcacactctagagcatcagagtcctctgtagtgtttgcggggagggaggctggtagtcttatgtttaagggctttcacagatggttctgatgccccaggagatacttggggtcattcttgcatagctggcccctgaagttgtgtcataggagaggatgggatcactcaggaaggctgtgtggtagtggatgagagtcccggctgaattgctggggagcgtcagcatgagaggtggaagtggaagtcagggaagaagcaagaggaggaatgggcagctaggaagaaagacaggaagaacgatggtgtggaaaccggtggtgggggcaccaacctccacttctttccctgcagggcttcagttttctcattttcctctctagtaattcattagggaattattgccctgctacctagagctgagccttccgtgcctcccttcaacatttgtttacactagtgtcagagccagtctccctgacaggttatgcttcagttacctttgttgtcgtgtgcagaagactctgaaagaggctgtttgctgcagacagtctctacccccttcagcgcctcccagcaaccttctcaagcaattccctcatgccttctattgctggtcctcgggactaaaatctctatccgctgaagccagaaagttgcgccctcccccatctaacattgtgaggttcaggatggatctgcaacctcagggatgtgtgtctgggtcctaggaaaggcagctgatcggaacagtttgagtctgagaagatgattaaaacattcagattagactaacgcgatgcgtgggtaggtatctgtgacttggggttggggtgcatccctggtccactctgtatcctgtgcttgggtagcagggaaaagcctgttacagaatttctggaacttattgttggggtctgagagttagagtacttgggatctactcagactgctggtggcggtatcctaaattggtaaaagtggaagtctgtctccctggtaagcctaagtgcctgactgagct

SEQ ID NO: 47643 - DNA, 1024 bp, Homo sapiens
agaccgcagtctgctaacccatttcacctgggcccacctggatgacagctgaccagtcatcccgagcctcaggcatgctaaggcagcaggaggtcaagcagtctgttgtgaacaggggatagagaacctgcactcactgacaggcaaagacaagtgacattgcatttaaggactcttggccatggaagggagagaaggaagccaagcttcatacttgcagctgtggcgcttttgaggcaggatgaatggagtgactgcataagaactttataaggagagaacttccaaagcgaggagattaaagtatatgagagactttctggaactgaaagtcaatgaagaactgaaattagtagtttggaaggtcaaaggaaaaatatttcgtgacagagtaataatgacaagaaatgggaataatgaaaatgtgaggtacttagaggcagcaagaacagatttatttattatttttttttttccaaaggaaagagaattaggctgtctttgggcttcccctgtgcaactctggaggctggaagacagtgggctggtatctccagactattaaagggagagggccccaagtcctctatatacccagccaagatgtcagtgaggtgccattgcaaaagaaagccattttcaaacacgtgaggacacaaaacatttattaaatgtacctgaggaaaatatccagtgaagttctctaacccaaggacaagggaagtggagtagagatatggagacaggtaaggaaggagtgcagggaacaggaacggcaccttttttttttttttttgagacatagtctcgctctgttgtccaggctggagtacagtggcatgatactgtctcacgaaaacctccatctcccaaatagttcaggtgattctcctgccttagcctcccgagtagctgggattacaggtatgcaccaccagacccagctaatttttgtatttttagtagagatgggtttcaccatgttggccaggctgctcttgaactcctgacctcaggtgatccg

SEQ ID NO: 47644 - DNA, 1055 bp, Homo sapiens
tttagtgaatatccttctatacttctatatgtgtgttcacatgtgttataaagattttaaaacatgttcaagtgtcattttctcagtgaggacttctcatatacgccccccccctttaaaattatgacttcgtctagttgtgggggggggttgttggggaaggagggatgattaatggattcaaagataggaagaagattggataagatctagtatttgatagcacaacagggtgattgtagtcaataataatttaattgtacatttaaaaataacaaaaggagtataactggattgtttgtaacacaaaggataagtgcttgaggtgacagatattccatttaccctgatgtgattattacacattgtatacctgtatcaaaatatcccatataccccataaatatatgcacctgctgtgtacctgcaaaaattaaaaataagtgtaaaaaaaagagaaaattatgacctgtctcccaccctgcctacttttctctgctttacttttttctttatcacttaccatgagctggcaagccttgtcttttgctgaatgatttacttagtgtctgtttcccccactagaatatactgggggttttgggttttttcttcactgctctatccctagcatctaggacagtgcttgatatatactagcttttcaggaaatagttattgaatgaaagcatgaaagtgagtgtgccctgagtttatggacattgctctctgtcaggaagtattgatctccctcacctttttatctaccacttagtatcccattgaatggatgtgttctaactgtctttactgtggttttcaagtgttttcctggcttttttgtagccagtgttacagtcagtagctttcctggaacatatactctctggttatctatttgatgatttccttgctttgtttgaactctgggcttagtgctttacaaaaaatagctcatattaatcctcacaccaaccctctaagaaagatgctgctcttagtttctccttttcacctgatgagaaagctgaggtttagagagaacaaaccccctg

SEQ ID NO: 47645 - DNA, 1051 bp, Homo sapiens
tcttttttttttttttttttaaagagaacatctgaatgatgtattcggaaaaaaacatttcccaagaatatggagaaagggaattgaacataattcccagtgtaagagtggaatgagcatgtggccctgtgggcctagtcccagtttgttaatcttgtgagcagagctgctggcggctgctctcagtccgctaatcgggctctttctctgtcacgtggacaggagactgctcacagggttgcagttggctgctgccctgcgttgacagctggttctaattgtgcagagctacgtagtactagggctggagagggaaggttttgggaaatttgcatcatcttcctgaccctaagtctgtatgttttccaagcagatggtagcttgaggatttgatgaaacagtagtgactgtaaatgagttgttattctatagaaactagtatgacctgaaagctgagaaagataaattgcttctgcttattcagtgagtacatatatgtgtatactgatttcactggaggcaccatttttccacagtgatcctttccccctcttgtggtttgtctagccaggggttctggggcctcgggaggccctcatgttcatttcttccacggcccatactgcctcctccctttctccacacacacagcccttaacaggtatttatttcaaattaccaaagtgagttgctctcacataagaaaatgcaaatatcccgtgcacttaccaaacttgattctagtatagtagaaggtgcttaaagggtttgggccctctctgccgtgctctccctcatggcatcagggcaatacagcctaccaaacactccatgtgagggtttggggagccacctctgcccagtccctacgttgttttcccatcccatgcagaaaaaaaaaaaaaattgcactctttaccttcccttaaggctgggacctggcctcccacccctgtcctgtctcactgtttcttctcccactcctccccaggctccttctgctccagccatgggctaccttgctgttctcagatatctcatggtgttcctg

SEQ ID NO: 47646 - DNA, 1033 bp, Homo sapiens
ttctatgagaaagatgggtgcctggggatgactgattagggtctgagagggcctggaatgttacccttaggaagcctgttgttccctgatggagtatacagtgggctcctgagtactcaagggaaacaaagatatatccttttttgtgaccatccagaaaggcatttggtgcccactcattcttttaaaaacttaaatattacaaaagtaacacattgcttgttgtaaaaattattcacactgaaaagaagtttataaagtaaaaagtgaatgtgccattcttcttctcccactttccagaggcagccagtgtttgcagtgggtatgtgttcttccagacattcttatccacaaatacaaaaggacatgcctgtggaggggcacatatgatattgtgctttttaaccaaagtgggaacattttatatgtgttgttttgcacatataaactatcatagatattgtacagtggcagcaaatctagaactcccctgttctttctggtagctctttgacacccacagatgtatgggcaacgtgttggatatcgcctggatgagtgctgatttgtctagctgtgtcccaactgataaatatttagactgtttctagtttttcccttttacatatacaagttgaatatccctaatctgaaaatccaaaatctaaaacattttgagagtcaacatgatgctcaaagaaaagcctcactggaatattgtggatttcagattttcagattaggtttgctcaacaggtaagtataatgcagatattccaaaatctgaaaaagtctgaaatctggaacatttctggtcccaagcattttggataagggatgctcagcctgtagtgcagtggggagcatccttatctgtgtgtctttatcctcctgttaaagtacttctgaaacactgagtgctggaagtggaattgctggggcaaaaactctttgcaactttacagtgcctactgctggaatgccctctgaaatgcttgcagttatatttctgcaaacaggatatgagtatgcc

SEQ ID NO: 47647 - DNA, 1050 bp, Homo sapiens
ctcgagcagacagaggccgtggagccagagccaagggtgcaggggaggcctgggccacgcagagaagtgaggtgtgagagaggagagggggaggcttggccgtggtgggggagacagcatttcgccccacagctctgaagcgcaggggccacactcttctattgaagattgccaccagccccctgcccctcaaccctggtaataagcctgcccaggctaggaagagaaatagagccagatgccaagacgaaagccaggaagaccccaggccagttcctccacaccacacacacctctggtgggttgagggcacaccttcatcactaagaatgccactgtcagcaggcaggcaggagtttctattgtctggccaggggtgagactctgcatgcccgtctggtgaatttgccttccctgagtttatgcacatagatgtctcctctttgggtagtagccagagttcaggctgcagatgcccagtaggtccccatagtgttcggccataaagagcttccacacgggagctggagcccactgaggcctgcggagctgctgtactgccctcggtgggaatgggtctgttcctactggactgtggaacaagggtgcagagagcaaaggggaccctcttctgctcttcatcctcctgtctcctcacccatgtcagccttggcaaggacacagggcctgtggggtcggggaggggcagtgagatgcagggaggtgtttgttagtcacttctgagcccccaggctgccttaaagaccctcccctacccttggggcccagaatgaggacagggtggtgatcctgggccagggccctcaggaaccagagagctatgggcaggggtgggcctgctcttctctgtgactccacctagtgtccctggtcagcagtcttcctcacctcatgccggggagagtaggggcgaggagagaaggggggcccccagcacactctgctctcccagggaggtggggaggcggccgcagggcagcggccgcagggcattcagttacctggagaggagggctgtgggcttgtcag

SEQ ID NO: 47648 - DNA, 1045 bp, Homo sapiens
actctcagataccctcttctgatcagcatcttcccttgagacaaggcacccccttgctcagcttagaactaagcccagctccagaccagaactttgaatctggttcctgtgtctttcccacaataggaaatgccacagaaacacccactgggggatgattatgagcagctgtgatatcaccccaggatcaggttctagcatctatttaggtcatccctgccaagagctgacttcatgggaatactccagactcactaaagggcctccctgccccacaacccttgggaataatgcggctagctaacttactgacagccagccatggaccacgcaaagctgctggtgaaagggggtccctagcttctcagtgtgtttgagccagcaggatctgtcttgacataggccctctctggcctggctcatggtatggccccctcccctggtcgcccccagccgtcccacgaagggtgttatgcgaaatgtttcccatgcaggaattggctgaattctctcaacatccctgtgaggtagattctcttactgtctccgttttatgctgagggtcctgaggctcagaaaggggcagacacacatttaaggtcccacattagtgagcagtggagctgggattgaacccaggtctgcctgactcccccgattgtctgcttgttgcccctgagccctcctgcctctcctgcctccacttccctggtaacccctgcagctgagcaaaagactggaagcacatccccagctgtcaaggcttatgagagaaatggctacctgagccctcagcagcagatgggggcgggctgaagcctcctgctccctgggggtcaggtgggcagcactgatgctcctgtccctaagtgtccatgtgtgttttccccagggatcagccagaggaggagcgggggaagcaggagtcctctcctagcccatcttgggagggctaggcgcatggcatagagggtggcgcttcaaggaggacagttaggcgtagtgcctgggagtagactcagcaggccccttgcaggcagcagct

SEQ ID NO: 47649 - DNA, 1047 bp, Homo sapiens
cattgggaggctgaggcacggggaccgcttgaggcctcaggagttcaagactagtctgggctacatagcaagaccccatctctacaaaaattaaaagaaattagccaggcatggtggcacatgcctgtagtctcagctactccagaggctgagtcaggaggatcacttgagcccaggagtttgaggttatagtgagctgtgattgcaccactgcaccccagcctgggcaacagagcaagaccctatctcaataaaataaaacaaaactaatttgtgtttgtgagaagaaatctgaaaaatcaagaaaaatataaagaggataattaaatgtttatttacccataataccactaggtattaactagccttttttcttaactatgtatgtgtatatttatattaatgttttaacttgcttttccacttaatatagtgtaaggatttccacacatccttaaacatttctgaaatctcttttaaattgctgcctggtattctgtcatatggatatattaccatttatttattggacacatgtagtttacttacagtttttcactcttactaaagatgctgtaaatccatgtgcatttgtttagctatgaagaggtcaacttttataaacaggtcatcataaatttatagaagtgatgggagttattggatcaaagaaaatgaacattttaaagccttttgaagcataatgctaaattgctcaccagagagttgcaccaatttatagtcccccaagggcatatgagtgtgcctgtttttccccactctcaatactaggcattatcatttataaatatttgccaaagtggtaccttgttttaatttgaatttctttgtttcatagtgaggtgaaacttttccttgtatttatccataatttatacttatttttatgaaatatagatgcatacactttgtcgattttcctttggaatgcttatgctttccttattgaattgaagcactttttatttatttattaaggaaattaattgtttaggtcaaatatatagcaaatacttttttcagttt

SEQ ID NO: 47650 - DNA, 1050 bp, Homo sapiens
ttctcaggtccaaaaaattcttctggaatcattgggactttagtttccccccatagtttgtttttctcagaagaactataattcatagcatactactgatttccaagaatgtgactgcctgttggtttgtaatcaggttgagttttgtcttgtaaaatttagaacttagaaaatttaaattccatccaagcaggaatgacagatgtgaccttatctgtatgttgaatgtctgagcaagacttacatcctgagaaaaccagtacctgtgaattccctccagcagcacctccctccagggacccaggtctggccttgagaccttgagagctctgaatggctggttaaaatattatctgcgacagtccacttgcaccagatcaaactatcccctcctaaaatatgaaatacctcattataatgagccataccttgatttctggagataggtgaaaactgttagtcatggacataatttgggaagtcctggacaccatattacctaaatgaggctgtataagtaggttcaagtacttaacaagtacttccagtctttctggaatctccacctgaaacaggaggatttcatataatttatcatttaaactgggaccctttgagagtaattactaataacatcaggacaacagataaaacagatataagctagggctgtcttggcaaacttggacacatgatctccctaccttgaagatcctacacccttgggtgcacaggtacttaaaagacccccatcatgcaacccttgctgctttacagactttgctcttgtctgaccctaataacttgtgatgaagacttgacaagaccttgcaaaaccagtctttctggagtctccacctgaagcagaagaggtcctcagcaggggtatggtagcatggtgccagtctcagagcaatcctataaaaccttttaaaagcattggccagtgatcaggtggtagtaggccccatctctgcttgtacatctcagtttcacttgaaacttttcagagaagattatgccatgatactggaaagaatgctggatcaa

SEQ ID NO: 47651 - DNA, 1007 bp, Homo sapiens
cttctgcggccaaggtgccagaacaccaagctggccgttctctgggagccgggcctgcccctctcagaggcatccaggccatgctgctgcgccctgggccgttccccgggtgccccgcccactgccgccctcccgcctgcaggtgtggtcatggtgttcagcacgagtgccttcggcgcctacttcaagctgacccagggtggccctggcaactcctcgcacgtggccatctcggcgcctgtctctgcacagcctgttgatgccagcgtggggctggcctggctggccgtgggcagcatgtgcctcttcatcgccggtaagggggcctgtgggaggctgggcgaggagtgggaggtgatccccccggccctgctgtggcggctcccggcaggtggggtcttccccagcctcacctctcctctcgtaagttccaagctctgcatttctagctctgaccacatgcagctgtggaactaggcccctctgcgttcctttcacttaatcccctgagcagccctcgagcaggccccgttgtgaccccatctcagagacagagcctgtgcctgaggagggaagaggctggccgaggccttggcaggaaagcatggagctggtgggaccacactgggatccgggaccccacagccccacaggctgggaagctgggtctcttggctctgcagcaagctgaggagcccagccctgcggaccctgatgcctgtcttgcctgtctcgctcccacaggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggtgagggcaggctccaccagcaccgcgttcgtgcagtcagccgagaagcactttctaaaaccacttgtattgcagaagacccagggtcgtggccttacatgcagcctgagccccacc

SEQ ID NO: 47652 - DNA, 1050 bp, Homo sapiens
tggagaggtgggggagatgatggggaggtggggggagatgatggagaggtggggtagacgatggggaggtggggggagatgatgaggtgggggaggtcatgtggggggagctgatggggtgggggaggtgatggggaggtgggagaggtgatggggaagtgggggaggtgatggggaggtgggaggtgatggggaggtaggggagatgatggggaggtggggggagatgatagtgaggtgggggtaggtgatggggagatgatggggaggtggggggaggtgaggggagatgatggggaggtgcacatcaaaatgtgaacagtgctgccctgccacttgactttttgaaagctgccttgaaaataagctttctgggtccaaatgatcctttgctcaagcaaagccactgatacatggctttaggttagtaatatataaaacccagagcttatgagttcggggaggaagtattcacaacattatggttatataaacatcgttactgtaaacctaatgaaatggacttaaagacataatcctatgtcagtcagcctgtgttactcaaaaaggaatattctaagcagcaatataaaatggattttctcttatactacatcagttaattaaaataatgccagatttgagtttgtaccttatttaggacatgataatattagatttcttttttacctggagttttgttgttgttgtttttccttcttaagaaacgtgtcattttcttcaccatatgactgaggtctttcccctttgtaataatgctagctgttgcatggaatccatttttttctccttctgacctcttgttttgggggacctgcggcaaagctgttttcgtttcattgattcctgggttaatttctctgcttcttgggttccacaccttgctccttggattccatttcttttttctttctttttttttttttttttgagacggggtttcgctcttgttccccaggctggagtgcaatggctcgatctcggctcactgcaacctccgcctcctgggttcaagtgattctcctgcct

SEQ ID NO: 47653 - DNA, 1041 bp, Homo sapiens
tggtactgccccttgttctgaggtctgaccctgtctgacatgaaaatcgccactctgttttggcagtaatttctaatattgtcttattccctgtgcctttttattttatttattattatttttttaattttcctggtttccttggtgtcttctaaacctgtgcctttttcgtagcatcctgtgctcttctttttaatggcttgcctgtttgaatttctctaaggatacatattttcactttttaaatatcagctttaggctgggcacagtggctcacacctgaaatcccaacactttgggaggccaacgtgggcggatcatttgaggtcaggagttcgagaccagcctggccaacatggcaaatccttgtctctactaaaaatacaaaaattagccaggcgtggtggtgcatgcctctaattccagctatttgggaggctgaggcaggagaattgcttgaacctggaaggaggaggttgtagtgagctgagatcacaccactgtactccagcctgggtgacagagcatgactctgtctccaaaagaaacaaaaaacaaaaaaaaccagctttgattgaggcattatttacttaagtaaaattcaataattgtaagtataaaatttaatgacttatgacaaatgtatacagtcatgtaactgtcaggcctctgagcccaagcctgcacgtatacatccagatagcctgaagaatcacaaaagaagtgaaaaatggccagtttctgccttaactgatgacattaccttgtgaaattccttctcctggctcagaagttccttcactgagcaccttgtgacccctacccctgcccgtaagagaacgaccccctttgactataattttccactgcccacccaaatcccataaaagtgccccaccccatctccctttgctgactccttttatggactcagcctgcctgcacccaggtgattaaaaagctttattgctcacacaaagcctgttggtggtctcttcacacggacacgcatgacatttggtgccgtgactcggatcgggg

SEQ ID NO: 47654 - DNA, 1047 bp, Homo sapiens
caaagtgctgggattacaggtgtgagccaccgcacccggccatgtgactatttgtgaaggaaatatttaaaggacattttgctaggtgccaacttaccttcccaaaaacattctgccagtttacactcctctcagcagtgtaggaaagtgcccatttctccaccaccatcaccatcacaaacagttaccagttttcttactgtcaaccaacctagtaggtgaaaagattttactttctttagttaccagtaatgttaagcatctttccagatgtttattgatcacttgaatttcagcattggctatttgcttcttttgcccattttctaagggagcgtccatctttttacacaagatactcgaactacaggctgaaggcgaacagagggccccaagggttgcttgtgatgcggtaggcatccagagagcccatctaggtgtaggttgccaaatcaaggaggccttcctggaggaggtggtgttcatctgctgggattccctgttggaaatgttaaatttgctgaatgaatggatggatttttttctagaataagaatggaacagttgatgtccataacccaggaggagactgagagcctgcggcgacgtgacgttgcctgtgagttttgggatggggagcttgtgagcacgctgcctgctggctgggctggcagggtggatggccctccctctgttggccatgcatggagggccctgagtgttagccctcgagaggggcagtcaagtcctgccatggagcacaggctctggggtcagcctagatgtggatgcagagtcccagttcaaacacccaccatgtgaccttagggacattactgcttactgctccccaacttttccaaggctcggttttcttagctataaaatggaggaaatgggccaggtgtcggggctcatgcctgtaatcccagcgctttaggaagccgaggctggaggatcacatgagcccaggagttcaaggctgcagtgagctgtgatcacactactgcactccagcctgggtaatacagcgagaccatttctcag

SEQ ID NO: 47655 - DNA, 1053 bp, Homo sapiens
cactaattgactagcaagaagatcccttaaaaaaagtcacgaggccaggtgcggtggctcacacctgtaatcccagtgctttgggaggccaaagtgggctgatcatctgaggccaggagttcaagaccagcctggtcaacatgttgaaaccctgtctctactaaaaatacaaaaaattagctgggtgtggtggtgggcacctgtaatcccagctactcgggaggctgaggcgtgaaaatagcttgaacccaggaggcagaggttgcagtgagctgagatcacaacactgcactccagcttgggcaacagagtgagaccctgtctcaatacaaaaacaaaaacaaactgattgggagctctcaccctgtggatgggcctgacctggataggctgtttgttggggaactcccggtgtcagcatatttagatttttcttcttggtctctgattccccagaaaggtcttcttttgtctgctgtctgggagataaaggtctggctaccagaattctgggaactgactggatgagatgagctgacagtgggttctcaacaagctttatgcccctcttattcttttttttttttttttttttgagacagagtcttgatctgttgcccaggctggagcacagtagcatgatctcaactcactgcaagctccgcctcccaggttcacgccattctcctgcctcagcctcccgactagctgggactacaggcgcccaccaccatgcccagctaattcttttgtatttttagtagagacagggtttcactgtgttagccaggttggtctcgatctcctgacctcgtgatccgcccgcctaggcttcccaaagtgctgggattacaggcttgagccactgcgcccagccacccctcctattcttttaagttccagaggcagctggtgctgccagttcctgaaacttttgaggattctgctgtgtacatttggttggttttcactgctccctaccaccagataaggattccgctttcatgggcctactaagtcagttacaacgcatctattgtagaaaataaggcg

SEQ ID NO: 47656 - DNA, 1034 bp, Homo sapiens
taatgtgagataacagaatgaggtggaaaatggcctagcaggggaattcaaaaacagcaaatcatggcattgcagaatgaataaaccaattttacaccataagaagcagaatcttcgctataaaatatggaaattgcttgagaaatcacgcagcctgcatattcatgagcattagtgctccccgtgtttcttttggatttttcgcgtcttctcttcctggagctccacctccttcccgtgctcgatctttggccccaaccccaaaaggatgttttcttttcctggtatcttactgtagccagttccacaggttggggaaaggaagccctcttaacactggccctttgtgtgtgtggatgggtgggtggggcatttcctgccttctggaagcttccctggggcttttgtcttatgtgggtttgacatcaatagcatggctgaattgagggttccagagggagcgtgagcttatggccttgtcatgttgtgtgggactaaacatttcctaatatctcagatctgtagacctgaagcaggctaaatcttagagcagaacagattgggctggtcagaatcttggacttgaaaataagacagagctgaacttggtgacatgcacctgtagtcccagctactcaggaggctgaagcaggaggattgcttgagcccaggtatttgaggccagcctgggcaacatggtgagactcatttcaaaaaagaaaagaataggatgactgtcaccaccatggtcatggataaatcatgtgatctctcctggattcagtttctttataagatagactgcatcagaatttctcagtgttggcactattgacattttgggccagatgagcttgtgccttgtgggatgtttagcagcattcctgacctctacttgtagattcccatatcatcccctagtcgtgacaataaaaaatgtatccagacaatgctgaccttcctcttgggggcgcaaaatcactccctgttgagaaccactggactaggtgatctttttttttttttttttttga

SEQ ID NO: 47657 - DNA, 1045 bp, Homo sapiens
ttctactttgtgatgtttgtgtacccgcttgtacacactttttacctcctttctgaggctagcgactccttggtgcccagtggtgttttatacgtagtaggtgctcagtagatgttgcatgcatccatgattagtcccttggtcacaaactgttgtgctttttcctagtactccacccacctgcaccttgctgaggactgtatgaagcattaccaaggcaccgtagacaaactctgccgagtggagcaggtaggactctccttctgccacggcaagtttttgccaggcctatttacccagcagaattttaacatctgcccttgaacatcctgcagaatcataggaaatagagacgggaaggcctgctagatcatgctgtctcaactctggagccagtgcggttccactgtccatggtagggactagattggtctggaatgctgtgccgtttggattttgcatgcctattttgaaaggctctgttttccctggaatgagtgaagaaagatgtgtggggttctgagccctacattgacaggactggcagaattttatattctgaatgtgttctactcttgccatggccagaccagctttggagacctcgaggctgacagagggtagagcagtagcaatcagaaatttgcccaaagcatccctgatcacaattgggattgtaaattgagaatttggggtttgagttctgtctctgtcactgattatttgatgtgcctgtttctttgtgtttcatttttttcatctgcaaaagggaaatcattgctgacatttttcaaggttgtcttgtggagtcactaatcctggcttagattcatcctaattcttcaagtgtttcaacattataaaaccatggttcaaattctaagcgaagagaagatgttaaaagattctgaagccggctgggcgtggtggctcacgcctgtaattccagcactttgggaggccgagacgggcggatcatgaagtcaggagttcaagaccagcttgggcaacacagtgaaaccccatctctactaaaaatacaaaa

SEQ ID NO: 47658 - DNA, 1013 bp, Homo sapiens
ggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccagggggctccagtctggctttcctttgggcaacggaaggagaaagcttttgcagtggttcatcgcagaggaggcgaccacctccggctgtggcatggagtcttctggacccaggtccccgttgcttgcgttagatctgtagccgccttacactggggactagccatggagcttgtcttgggcccctagcagcaacagcgtgctgcctagagatgaggccattctt

SEQ ID NO: 47659 - DNA, 1042 bp, Homo sapiens
ttcatccatcagtccccagcagcaccccctcctttccctctcgtttccatgccagccgtgggccctgatctggttcctctcaggaacatgtgggagttgaaaaaaaaattggtattggggtttcaggctgatccgtgtggacgttggcggcgaagactgacagttctcatggtttaggctcatctccattgccctgtttatccagaaaatgggatcgtgatccccgcggggttggagtgtggacggagtgaaagaatccgggggaaattttttttctaaaagtcaaagcgagattgttactattgtgggctcttggccgaggtgtgggcataggggcgcagagaaatggtcatccctgggcctgccaggaagagaagtgctggcctttctgtatgagaacctcagagcagaggctgtttctttcccttctgtctcttcccccttcagtctgacttggcgggtgtagctgccattttcccaagtatttcatttactgtagcttagcctgatttacagcctggaataggactcctgagtactttacctaagaacctgtttcactgctgagttagtttggtccatttgtacacatgacaattagagaatctcgtagccaagtatgaaaagaatctggtaaaccgccaatgaattaaaccaatttgttgggtgggtgtacataggtgttgttaactcatgttcaagattcttggatcaacatccaaggtatttagcgctaactattaggatcagcctaggaggaccaagagtaacactacgcaagatagaatggttaagtccaggagatttagagacaagttttttttgtttgtttgttttgagacggagtctggttctgtctcccaggctggagtgcattggtgcaatcttggctcactgcagcctccgcctcctgggttcaagagattctcccgcctcagcctccccagtagctgggattacaggcatgtgccaccacacccagctaatttttttttttttttttttgagagagtctcactctgtcacccaggctcgagtgcag

SEQ ID NO: 47660 - DNA, 1014 bp, Homo sapiens
tagcaggtgcgagggggtcctgggcggctcataccctctgtcccgcgtcctccgcatcgcgaaggggaggctcggagaccaaggtccgtctgccgcccggaagggtcagccatcccgcggggcatcgagggggacttccttcctgttcccaacccacctccctgcggccgccgcggtcctgcgatcctggggccccgcgcggggctgcggtgagagggggcgcgcagttggcggatgtacattcattcgagggacccaggccaggcgagagggcggccaaggtcttacagtccgtcaggagtttgcccacggaggggtggagggagagtccccctccaagtcttttctcagtagatttggctaaggaaggagtaggtgaggagggtcgaggccaattatcaaaaaatagccctaggggccgggcgcttccgcctgtaatctcagtactctgggaggccgaggctggaggatcaagaccagcctgggcaaaatggcgaaatccctctctacaaaaaatacaaacattagccagggtggtggcgggcgtctgtagtcccagctactcgggaggctaaggcaagaggatcacttgagcccgggaggcacaggctgcagtgagctgagatcgcgccactgcactccagcctgagcgacagagcaagagctgtcaaaaaaaaaaaagtaaaaattttaaaaagaaaaggagaggaaaacagagccctgctcccttatcctgcacctaaaatggtcctgcccccaagaacccccttaacaaccgctgtatccccccatccccgcgccgtaacaatccttggctactaagtagtaattcttttatttattttttatttatttatatttttgagacggagtctcactctgtcgcccaggctgaagtgcagtggcacgatctgggctcaccgcaacctccgcctcctgggttcaagtggtcctcccgcctcagcttccagaatacctgggactacaggcgcgggccaccacgcccggctaatt

SEQ ID NO: 47661 - DNA, 1021 bp, Homo sapiens
aagtgctgggattacaggggtgagccacctctcctggactaagtagcaattccggctcccttttctgtggctccctgccttgtgcgtgtcacagcctgggcgactcctcgccctgccttccgcgccgacgttgggcgggcagggcgcgcgggggcactggcggcgcgcagacccgggcaggcggagcgcgttgacggagggcgctcgggcagcagaattcgcgcgtccataaatcactgcagtcatgtgacgagcgccgctccaaagctctggactggctctgcggcagatgggcggcggctgaggagcctaactcaacctggactagtcgtggaagagctaggacttagaggcgcgaaagtgactcagcgaggccggagcgcagggtggcgtccagggccccggggacgtcggcgcctatgggtgaacaggcagcctggagggtggggacttcgaatgctgggctgagaagtaggctttatcctctaagggtagggagcactggagaagggtgtgaacctcatgagtgacagcatcaaatctgccaattagaaaacccgctcccgtgaaaaccaagacagaagcagtgaggagagaggggcgagtcaagactgcccaggctctactgggcacagcggctcacccctgtaatcccagcactttgtggggggtccaggcaagtggatcacttaaggtcaggagttcgacaccagcctggccaacatggtaaaactacgtgtctactaaaaatacaaaaaaaattagccggatgtggtggcgggcgcctgtaatctcagctactcgggaggctgaggcagaagaatcgcttgaacccgggaggcagaggttgcagccgagatcacatcactgcattccagcctgggcgacagagtgagactccattttaaaaaataaaaatcaaagactgcccaggctgccaagcaagcatgttaacaccttgatctgggtgctagcgttggagaggtccaggattgaatcgtgactcccctgccttgtggct

SEQ ID NO: 47662 - DNA, 1065 bp, Homo sapiens
caactaatacatctctgcaagctccttctatgaaccagttttcttgctagtggcccgggcagcagtggcagggctgccctccatagctctccacctcaccacgttcacacagtcccctggcatccaagtcccttcctggccctgtgaccatctgtcctcaaccctttcctcacccttacccccagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagtgaggctcccccagctcctatcactgaatccccgcccccagcctctcagcgtggggctctcccagggttccctttgctgggctgctcctgccccctcaggccacaccactctcccaccaggatggtccagcagttcgccgtagactttgagaagcgcattgagggctcaggagatcagatcgacacctacgaactgtcagggggagcccgcattaaccgaatcttccacgagcgcttccctttcgagctggtcaaggtaggtcaggcagccctggggacaggatggctcaggactccccccaccctcactcaggactctctctgcgtgtgtttttgctggcccccaccccacaggccctgatgcccagccctaggtgtggggtgggccctgtcttgacctcccaggtagtaggacaggccctgaccaggcttttctctgcttttctacacagatggagtttgatgagaaggaactccgaagggagatcagctatgctatcaagaatatccatggcattaggcacgtattggggcctgggagggtggctgaaccccagaagtagggggtctgggacagaggcacagggagtgatgaagtgggcctccctcaggaaggactgaaagctctgttccccagtcctctcgaccccaactttctggctccctgcatgacaggctccagcttggggaggtggacccgggccaccccgcctactgcaacttgctgggccaactg

SEQ ID NO: 47663 - DNA, 1052 bp, Homo sapiens
ctcatcgatatcgagctggcttacatgaacaccaaccatgaggacttcataggctttgccaagtgagtgctcccccaggcaaaaagtgagtgctccctgggcagagaaggtaacgtgtgtgtgtgtgtgtgtgtgtgtgtgtgtgtgtgtgtgtgtgtgtgtgtagagcccaggtctgctaggttaaccctctgggtcctgtgcccactaagcagtgggcagtagagctgggcctcttgagaagttctgagactcctcccctccctcccattagtgctcagcagaggagcaaccagatgaacaagaagaagacttcagggaaccaggtgagtggggcccagcaccccagcccgagggatggagggtgccggacggacaccagactctgagagccccctcccctgaggggaagggtcccacgggggccagggacctgtcagctgccagccacaagcctcccactctgcctcagtaaccctctctcctctctccccgatgcctctcgtggttgctatggttacctctttgcaggatgagattctggtgagtaccaggactggggctctcggcttgtgtagtgagggggcggagggtccatcggcagtggggatctgcaacgggtaggagggcaccctttggctgaagctgcttgtacacaccagcccctggcatttcacacctgccctcaggccagaggcaggcccagccgcatccacccgtccatctgtgtgcacgagccaagcacctacttcaggcagagctagaccgtgtggggctgggtgggtgagaaggctgggcctggcacggagtaggtgctccttaaacatctgctggatggagggatgcacgtgagcaagacacatttttaagaagctgacagccatcgcctccggacttgaatgaagagacgaatgagaagtcaagagaagtcaagaagtcactgctcacctggcctcctgctctctgtccttagatgtctgcggaaacatccctcgtcagaagcgcttgctcagttgtacacatgagcccgagggtcctcagcttttctttcc

SEQ ID NO: 47664 - DNA, 1098 bp, Homo sapiens
gaacccaggaggcggaggttgcagtgaaccgagatcctgccactgcactccagcctggccgacagagcgagactccatctcaaaaaaaaaaaaaaagaagaagaaatataatgaggggctgtgcacggtggctcatgcctgtaatcccagcactttgggaggacaaggcaggaggatcacttgagcccaggagttcaagaccagcttgggcaacacagtgagactttgtctctacacaaaaattttaaagaatagcgggggttggccgggcgcggtagttcatgcctgtaatcccagcactttgggaggccgaggtgcgcagatcacctgaagttgggattttgagaccagcctgaccaacatggagaaaccccatctctattaaaaatacaaaattagccgggcgtggtggcacatgcctgtaatcccagctactcaggaggctgaggcaggagaattgcttgaacccgggaggcggaggttgcggtgagctgagattgtgccattacactccagcgtgggtaacaagagtgaaactccgtctcaaaaaaaaaaaaaagaatagctggggttggtggtagcacgtgcctgtagtcctagctactggagaggctgacattggaagataactttgagcccaggaggttgaggctacagtgagtggtaatctccccactgtactccagcctggtgaaagagcgagaccctatctccaggaagaagaaaaaaaaaaacaactgagtagacaagagttctggtggcatgataggtcctaagtcccctcccggttctgtgaccttggtcagatgacttttcctgtggacctcagtgtcctcatctgagtgagaaaagcgcggtggggaggtgaatcttccagtctacgcagtgtaggagccgcgtctgaaaagccacaccagctcacagtcccagcagggcccggtggggcggccagggcggcacaggcatcaggtccccacctccttccctctttgcctactcgcagaccaaggagttcatcttctcggagctgctggccaacctgtactcgtgtggggaccagaacacgctgatggaggagtcggcggagcaggcacagcg

SEQ ID NO: 47665 - DNA, 1030 bp, Homo sapiens
gtgtgatggcacatgcctgttgtgctactcaggaggctagagtgggaggattgcttaagcccagaaagttgaggctacagtgaggtgtgattgtgctaccgcactccagcatggatgacagagcgagacagaccccatcttaaaagaaaaattaaatttaaaaaaggccgggtgcggtggctcacgcctgtaatcccagcactttgggaggctgaggtgggcggatcacgatgtcaggagcttgagaccagcctgaccaacatggtgaaaccttgtctctactaaaaatggaaaaattagccgagtgtggtgacatgcgcctgtaatcccagctactcaggaggctgaggcaggaaaatcgcttgaatccgggaggcggaggttgcagtgagctgagattgtgccacagcactccagcctgggcgacaacgcgagaactgtctcaaaaaaaaaagaaaaattaaatttcaaaaaatattaaaaatcaggaaaaagggatagtgagtgattgagatgttactgttgtagacagggctgtcagagagggcctttctgatggggcgataggtaagtagagctttaactggaagcatctggaggaagaacttcatcgttgggcgctttctctttggggctaggctatgccttctatgagagcagtgggctgggcttgatgtctcattcattgctgcgctcctggaccctttgtcagttcctggcagagagtgctcactcattcctctgagtgactggttacaagccactaacctaaaaccaggaagaccgtcttcctcggtcccttcttgtatcatgtgtagacagctcatccaacatacatttcctgaagattggctgtgtactaggcactggccttcacagcttctacaggcagaaagggcaaagatgaaagccccaaggaagggttttatccaatgagattataaacccagtgacagatgggcatggtggctcacgcctgtaatcccagcacctggggaggctgaggcgggcagatcacttgaggtcagga

SEQ ID NO: 47666 - DNA, 1027 bp, Homo sapiens
ttttgctatgttgcccaggctggtctcaaactcctgacttcaggtgatcctcccacctcggcctcccaaagtgttgggattacaggcatgagccaccacgcccggccaagaccagcgaattttttaatttttttgtagagacggcgtcttgccacgttgcccaggctgctctggaactcttggcctcaagtgatcctcctgcctcagccccccagtgttgagattacaggtgtcagccgctacacttggccactaagtgttatatatatatgattttcatggtttctcacattaaccagctaagaaaggtgttgtctgcacttcacaaattaagacactgaggctgaaaaatgtgaagcaggccaggcatggtggctcacacctgtaatcccagcaatttgggaatccaaggtgggaggatcacttggggccaaagttcaagaccagcctgggcaacatagcaagacctcatctctacagaaaatttaaaaaactagctgcatgcctgtagtcctagcagtgagctatgatcacaccacttcactccagcctgggcaacagagcaagaccctgtctcaaaaaaacaaaacaaaacagaaatgtgaagcaatttgtactaggtcacctagatagtgaacacacctggactgtagcccagcatctctgatgcctaagcctctaccaatcaatggagacatgatattgtattgtgaaaagtgatttataaaatctttacaacgttgtgctaactagagctgtcccgccccagtagattaagaataagaactatagatatgtatactgatcccttgttgtgtgctgggtaatttgctaagtgtttagcctgaatccttataacaaagagctagacatcatccctaatttatcctgtaggaaacaaaggctcagaccaggtcagctaacttacctaagatgacatcccccatttgtgcccgtttctgtcctttcagacatggtcgcagttctaggggagaccacaggacaccgcaccctgaaggtcctcagg

SEQ ID NO: 47667 - DNA, 1050 bp, Homo sapiens
catggaatgtgaaggagcacctttgtccccagagagatttagataaaggttcaaggtgaggctaccctcccctccctgaggctgattttggtgagaggtgtggtcatcttgtagtatcaagactacaggcatgggcttgagaattaggaggagcctgagtgagaatcctggctctcttcccagctttacaagcctggacaaatcctttgacctcgctgagtctcaggttcctcatcagaagtaagaggacctcccatatatcttccagggcacttatcggccttggtaatggatattaaggccactggctttggaatccagcagactttgtttcaaatgctgactcggccactttactagctgtgtgatcttgggcaaattactttatctctctgagccttgttttccttatttttatttatttatttatttttttgagtctcgctctgtcacccaggctggagggcagtggcacaatcttggctcactgcaacctccacctcctggcaattctcctgcctcagcctcctgagtagctgggactacaggcgcacgccaccaggcctggctattttttgtatttttagtataggcgggatttcatcatattggccaggctggtctcaaactcctgacctcaagtgatccgctggccttggcctcccaaagtgttgggattacaggcatgagccaccacgcccggcccttgttttccttatctatatctgcagtaataacagtatttacctccaagattgcaaggatgaaaggataatatatgtaaaagacaccctaggtgccggcacctggtggatactctatgatcaccttcagcttcacacagcaggctaaggccattctttgggaacaggaagaccaggctgttcccactgtgtatgggtgctgctgagtactcagaggcagtgggcagttaagaggagaagagttctgggatcagaaaagtgcccaggactggccttttattcatatgttcaagaggtgttcattcatccaggccctggatcaggctactggaggtaaaagaataag

SEQ ID NO: 47668 - DNA, 1054 bp, Homo sapiens
agacaagctcttgccccgtcatgtaggctggagtgcatggcataatcttggctcactgcaccctcaacttcctgggcccaagcagtcttcatctcaacctccccagtagctgaggccacaggtacacaccaccatgcccaactaattttttttaatttatatttatttatttttgagacagggtctcactctttttgcccaggctggagtgcagtggcacgatctcggctcactgcaacctctgcgtcccaagttcaagcaagtctcccatctcagcctccccaggagctgggactacaggcgcatgccatcatgcccagctaatttttgtattttttggtagagatggagtttcaccatgttggccaggctggtcttgaacacctgacctcaggcgatccagccacctcggcctcccgaagtgctgggattacaggcgtgagccaccacgactggccgcccaactaattttaattttttgtagagatgaggtctctatgttgcacaggctgcttgaactcctgggctcaagtgatcctcccacccttggccttccaaataatccagatgtgaaccactgtttccaaccaatcaggagctgttttattcttactgtgttcataagcacaaaaagctgcagttcattttggagtggcaaaaaggcattttccttgggtaagagccaaggaacaaggaccggctggatgaaaggtattagaagagtgggtggccctggcttgggtttagaaccagaaaagccccaagatggaagaggctttagcatttttcaggccaattcctcattgcgtgaatagatgattgatggcccagaggcaggcagagaattgcctggagtaactaaaacacaggccacaggccccctggtatgtttaccagtgcctcagtttccctatctataatcagtttctaactgtactatatgtcaggcagtactaagcacttgagatgcattatcgcactgacacctcaaggtcaccacccaaggagggagatggtattttgcttgtgttttactaacgaggcagtaggaata

SEQ ID NO: 47669 - DNA, 1042 bp, Homo sapiens
acttcctccaacagctgacgaagctggatccctgggcaccgcctcttccgtccgcggcacccggagacgcccggaaatttgcgggcgcgccggaagttgaggggagtttcctgcgagctcggcttcctcaacatggctgcgcccttgtcagtggaggtggagttcgggtgagtcacagagctggggcgccgtggggatggattgaagtcgtcgggcccagaattcctttccttctgccgtggggcctgacacggccgaatcactgggtgtcccagtgcccgctgtgagctacgctacccgcctaggagagtctgagaggccagtctctcttggcagtgaggccgtctgtccggaaatagaggcgcacattgggagggaaatgctctctgtgtaccactcggtgccctgtgctccgccggagtcggaggtcgtgactgttagcaggcagcctctctctcttcttttccattcctatctcggaccaatcccatctgtttggcatctgagctcctagaacctagaaggaccaccctccacccgctgatttcattctttgggcagcagtttctttttacactgttattaaggtcttgtttctcgtgggatgtagtggccagggcgggacttttttctttttctttcctaagacttggggatggtaaacagacctgagcctccttcaggacagtcagtaaacttgctgattgccttctgcagaactggagtcaggtggagacacggggacaaataagaaatcacactgaagggaactaacagggacagtatagtatacacaagatgaaaaatgcagagattgggacacacaccagttactgaagaaacacagagcagggaggaagtctacccaaggcactatttgtgcttcctacaaacaggtttgtcatatggtttcaaagctgagggaaactgcagagcttagagagaaggcaaagaaacaggccttgaaagatgggtggtgtactttacagtatcacgtggaaaagaggaaataggtagggatgtgtgtgtgtgtgtgtggaat

SEQ ID NO: 47670 - DNA, 1721 bp, Homo sapiens
aggggctggcctgtggtcacacagccacaggtcacataggtaggtatctgcccacctaacgaaggtaaccagggaatgcaccaggtgtgatccttaaagtcgaggtacttttcatctttcaaaatgcattcgttggccaggtgtggtggctcacgcctgtaatttcagcactttgggaggccgaagtgggcagatcacctgaggtgaggagttcaagaccagcctggctaacatggtgaaaccccatctctactaaacaaacaaaaattagccgggcatggtggtgcacacctgtaatcccaggtactcaggaggctgaggcaggagaatcacttgaacccgggaggcggaggttgcagtgagtcgagatcataccactgcactacagcctgggcgacagagcaagattccatctcaaaaaaaatgcattattcttctcttatctttgtccatgacataagcaggacagcttaagttatagagggaggacgtgaagcccagagaaagatgggacttgcctgaggtcacacagcaggtcacagaactgtggtggggacctggctgtgctgcctccagcctctctgctgtagcacacctacccttcactgttccaaggagagctcgacctcaaaggtgttagtgctttggggtcaaggctgccttggggttcaatcctgtggctgtgccccctcagccttttttcttcccgtccccaggtgtgccacggaccacaatgtggacaacaccacagagatgctgcaggagtggctggcggctgtgggcgatgactatgctgctgtggtctggaggcctgagggcgagcccaggtggtgatctgaggggaagggtgctggggaagatggagaacagctgcagcccagagaggaaaagggacagcccagagccacagcctccaagccagggctctgtccactgccctgcagagagggaggggcatgtaccccatgggaacatctcacctctatcccctcaggttctacccagatgaagagggtcccaagcactggaccaaagaaaggcaccagtttctgatggagctgaagcaggaagccctcacctttgccaggaactggggggccgactatatcctggtgaggaagtctggctagaatcgggcttctgaaaggcggtagtatccgtccctgatagaaatctgggtataggctgggtgcagtggctcacgcctataatcctagcactttgggaggccaaggcaggtggatcacctgaggtcagaagttcgagaccagcctggccaacatggtgataccccatctctactaaaaatacaataattagctgggcgtggtcgcaggcgcctgtaattccagctgcttgggaggctgaggcatgagaatggcatgaacctgggaggtagaggttgcactgagctgaaatcatgccactgcattccagcctgggtgacaagagtgaaactcagtctcaaaaaaaaaaaaaaaagaaaaagaaatctgaatgtgactgacccacccgaaggctggatccttcggcaggctatctgggccagagcccagaccagatgttcagattggatccctatgttaaaagctcagactaggtactaagcctggacccctcagatagatcccgttgtatacactttactgagcctcgatttctgggctagagcccagggtataaattgagcctggatctctgaactagagctcagagtaggt

SEQ ID NO: 47671 - DNA, 1081 bp, Homo sapiens
ctggctgctattaagtttcaaaatttcttgttgaaaagtacaggcccaggagcaatggctcactcctgtaatcccagcactttgggaggccgaggcaggcaaatcaactgagatcaggagtttgagaccagcctagccaacatggcgaaaccccgtctctactaaaaatacaaaaattaccctggcgtggtggtcgcgccaccaatatcagctacacagaaggctgaggcaagagaattgcttaagcccatgaggcggaggttgcagggagccaagatcgcgcccctgcactgcagcctgggcaacaaagcgagtctccatctcaaaaaaaaaacaaaaaaaacggaaaagaaaaacgaaaagaggactggccgggcctggtgtctcacgcctgtaatcccagcactttgggaggctaaggcaggcggttcacctgagctcaggagttggagaccagcttggacaatgtgacgaaaccgtatctctaccaaaaatacaaaaaattagcccagtgtggtggtgtgcacttgtggtcccagctacttgggaggctgaggtgtaaggatgggttgagcctgggaggcagaggttgcagtgaaccaaagttgtgctactgcactccaggctgcttgacagagtgagaccccatctcaaaaaaaaaaaaaatggaaaagtgcagggatgtacacccatcagaagtgtattgctccatgaattttcacaagctgaaggtacctgtgtaacgatcacccagcatcctagaagctgcccctggcttttgtctatgtcactccctccccatcacaaggagtaagtagtcacactttcccatatatatatatatatatatatttgtcattttaaaaaatatatagtcatgtggccgggcgtggtggctcacgcctgtaatcccaacactttgggaggccgaggcgggcggatcacaaggtcaggagatcgagaccatcctggctaacacagtgaaactccgtctctactaaaagtacaaaaaattagccgggcatggtggcgggcacctgtagtctcagctactcgggaggctgaggcaggagaatggcgt

SEQ ID NO: 47672 - DNA, 1030 bp, Homo sapiens
cctgcttctcggtgcttctctcagggaaagtgctctgtgggttagagtagggggcctttccttttctggttctttggatagagttgagggtaggaggtccacctgaagcagaaccttcctgtgggttactcatgagccatcccttccaggccagctttgctccaatggaggacaaactcaaccaggcacacctcgaggtccagcagctgaaggcctcagtgaagaactatgaggggatgattgacaactataagagtcaggtaggcctcactggggccctggcccttctgagcagtgccctccctgcccccatcagactgggggctccctaccaggccactcccagggagggttgggtatggaagatggttttcatcaaaacgtggctctacctaagatgaaccacagtgttgttggtccctaggtgatgaagaccagattggaggctgatgaagtagctgcccagctagaacgctgtgacaaagagaacaagatccttaaagatgagatgaacaaagagattgaggcggtactgctttccttccttgttttcttctcctacccaattccatatctaactcaatgactgtgagtctgttccccttgtttgcctttgaccctacctgatttgggcaacaaaggtgagctcattttctcattggtgggctcatccactctaccctgtgcctctctctcctttgtctctttcttgtttcctctcttctctctctcatgctgctgctttgtcttttttttttttttctcttggttttcttctacctccttttcaattttcttaaaataacaacaacaaaaaaactctcctggctgggcacggtctctcacacctgtaatcccagcactttgggagactgaggcaggcaggtcaactgaggttgggagttcaagaccagcctgaccaacatggtgaaacccctgtctctactaaaaatacaaaattagccgggtctggtggcgcatgcctgtaatcccagctactcggaaggctgaggcaggagaatcgcttgaa

SEQ ID NO: 47673 - DNA, 1099 bp, Homo sapiens
ggggagactggttgaggtgggaggatagcttgagcccaggaggtcaggctacagtgagccatgattaggtcactgcactccagcctgggtaacagagtgagaccctgtctcaaaaataattaattttaaaaatgaaaaaatatatacatctaggtttgtgtaaggatgctttacgatactcgcacaatgacaagatcacctaaccctgtgtttctcagaacttacccccattgttaagtgactgacattctactgattgtgtatacagtagcttacttcagaattcctcgtgttctgttcagtgctttagattgctttcacatatgctttagtgggaatctttgtgcattgtccctttttctgtagttagggttatttagtctgattttcattagaaggatagtagtctaggtcattatcaagaaaccactgtactttgttttcatctgattgttaatacattactttgggtctttgatgtttatttatttaggccttcttagatgttcagtaaggcatgtagtggattatactgagaacagttgacgtgtaagttgagcttaaccctattcttttctctaggatgttttagaagaatgtatgtctcttcccaagctatcttcttattctggatgggtggtagagcacgtcctaccccatatgcaggagaaccaacctctgtctgagacttcgccatcctctacgtcagcttcagccctagatcaaccctcatttgttcccaaatctcctgacgcaagctctgccttttccccagcctcccctgcaacaccaaatggaaccaaggtaaggttgtgatcagcttaagacaaaagacatggtggctgcaaagtcaaaatgtttaatattgtcatatgacagtgaccataccctaggggaaataatgattgctcattgttgtagctgttgtagagacaatgttgacagcaccattcagtgttctctttagacagatccagagggagaaaaatcccctctattcttagtaccgagaatagtataactaatttcatgagcaattggatttttttttttttctgatgaacgctgcgtctgtttaactgatatggtctcccttttt

SEQ ID NO: 47674 - DNA, 1030 bp, Homo sapiens
cgcgcagcatccccagccagactgcagcgatacccccgccccgcccttctccgcagtcctggaagagctcccagggcggagtggtgcgatgcagacgactgtccgcagggcgggcggtggcggggcgcaagctgcggggagggaggtgaggcgggagcgtctctaccgccagggcgtaggcagtgacctcactgcaccatcacccctcaccccttgcgcgcgccccatttccccatcctcccgcggcccgcccctcgctcacctcttcccccgcattgtcgcttcggctccttccgggatcgctcggccctttccgccgggcggtcgggcggcgagccggcgggagcaccgccccctttgctccgccggcgcgctcccccacccctcgcgcagcgccggggcgcttcccccggcgctcgcgcccgcccgccgcgggagcgcgcgtagccgcttataaaagaggcggggcgcgcgcgtcgccgccactacccgctgcggagtgaacggtgtggagcggaggccgcggaggctcctcggtccttcagcacccctcggcccgacgcacccacgcccctcaccccccgagagccggtgagaggggcagccggggagctccgggagggagcggggccccgggcagccgacccccgggtgggagctgggcagctcttcaggcggggcggggccggcgcgcggacaggtgagccgggcgggccgcggggctgcctccattcggctgagtgggggaagccgctgccgctgcttttgtggcgcgtgggctgcggaggagcagccgggccgaggctcggcgccgccgctggaatgtcactgacggggggagggggcgcgaggccgccgggtccctcccaaccacccccaagcctggctgcggcgcggccctgccctgccccatccggctgcggcaggtgggtgggggctccctcgtcgggatcttcgccagccgcctccctgcagaacgctccccgcaccgcccccggtcccttccctcggccgggagcgacttctgcag

SEQ ID NO: 47675 - DNA, 1046 bp, Homo sapiens
tatgatctgttcagcagttacttttctccagaggccaagcttgggactagtgtgcttaccaatgaagaactcttatcttccttcctaggcattagatgaatttgcaaccaagctaattcagaacaaccactatgcaatggaagatgtggccactcgccgagatgctgtaagtttgtaggttcttcatgctcctcctttttggtacatgaatgtctcttctaagatgttccagttaagtctcttcaactggatatccctttgggagtgaacactagagactcacaggggatccttgtctttcagctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagtaatgtactgttagtgttgccatgtagcactcgattagtaagctaaacacagctctcacaaataaattgtagctaaaggacgaaataagggattccagaaaccccactacttaatgtaagccaactgttttatacattcctccataaagataagtatgaaggtagtgcaagggaacttgacgttctcaggttcaagatagaaagaacccccttcttttattcacaggatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggtaagagatgttccattgaattgtgacatgcatgtttggggaactaaatacccctttctattaagtattttagggacatataccccccaagaaaggtgaggtggatgactttggcgttagggataatttcctgtgtaggaattacttggcttaag

SEQ ID NO: 47676 - DNA, 1047 bp, Homo sapiens
caaatttttgtatttttagtacaaccgggattttgccatgttggccagcctggtcttgaactcctggcctcaagtgatctgcccacctcagcttcccaaggtgctgggattacaggcatgagctaccatgcctggcctgtgtagctatttttaaaagactttaattgaaacctttttggacaaatttagttttaaggaaagatatgctatgttctctacatgttgttataagaacttttctaagcctaaactacaatagatgtgaaagtactcttttttttttaattggggtaaattcacaaagctagccattttaaactgtacaattcagtggtatttagtacattcacagtgttgtgcaaccaccacctctagttccgaaacatttgtgtcacttcagaagaaaaccacatatccgtcaagcattcatttgccattctccctaaccccagtggcccacgcagccactcatctgctgcttgcctccagatttacctattctggacatttatataaatggaatcacgttatgtcactttttgtgactggcttcttttgtttaggttttctttcttttatttatttattttttgagacaaggtgttctgttgcccaggctggagtgcagtggcccagtctcggcttactgcagcctccgcttcctgggctcaagtgatcctcctgcctcagcctcctgagtagctgggattataggtatgcaccactatgctcagctaatttttgtattttttgtagagacaaggttttgccatgttgcccagtctggtctcaaactcctgagctcaggccgtctgcccagcttgccctcccaaagtgctgggattacaggtgtgagccaccgcacccggcccataatgttttccaggttcatcctttttgtagcacataccagtactccattcctttttattgctgaataatatttcactgtttgatacactacacattgtttttgggtttttttgttttgttcgttttttttgtttgtttgtttgtttttcgagacagagtctctctctgttgccc

SEQ ID NO: 47677 - DNA, 1101 bp, Homo sapiens
ctcccaaagtgctgggattacaggcgtgagccaccgcacccggcctgttttgttttgtttttgagatggagtttcgctcttgttgcacaggctggagtgcaatggcgcaatctcagctcaccgcaacctctgcctaccgggttcaagcgattctcctgcctcagcctcccgagtagctgggattacaggcatggacccccacacccagctaattttgtattttcagtagggacagggtttctccatgttggttaggttggtctcgaactcccgacctcaggtgatccgcccacttgggcctcccaaagtgctgggattacaggcgtgagccaccatgcccccagccatagcttatttttttaatcccccccttttttttttttggtaggcctctgtagaagaatccttatagtttcaagccatagtttgtgactatgtctcctttgactttggcttgctattttgggttttagttattatggcttttgctttaaaggacctgaaggccaatgagtcacggttgaaggacattaacaaggtagctgaagacctggagtctgaaggtctcatggcagaggaggtgcaggctgtgcaacaacaggtaggtgtctccatcttggagtgaggctctgttgctgtaaggatgcagctttgttcctcttgtgtctgtcatagcccaacaagcagtgtttcataacacagaactgtggcttggctgtaggtcaggtcctctatgtgaccaaaaccattttgattaacttctttatacccatatccctcactttcacttggtttggaggggggtgggggcttctgtcttctccgtaagctcattaaatatttaatgtttatatagccattaactaatggtaatttcataagttcctcaaagaaaaagtttatatataaatacttgaagctctgctggacatttggactggcatttccatttgtccttttggaattatctcctgtgtttccaggtttggccataataagtattcttgagagatgtgtatttcttctaataataaaactggtttctctctctccttgtaggaagtgtatggcatgatgcccagggtaagtttcgggtgctgt

SEQ ID NO: 47678 - DNA, 1049 bp, Homo sapiens
caagaactccgtctcaaaaagaaaaaaaaaagacatgacttggaaggccttttctgagatgtgttcaagttaaaccttaaaaatgtgtcgtttttgtttgggtgtatatcttcagcttgctttgtgtcattcttgtggtcctcttgggggagagaccataagtcactgttgatggatgacaaagggtttgacccttcccaaaggtccaaagactgtccctgctgaagcctgtcccaccactgctggttactctcactgcctcactgcctcctgttttccttccttttatgattctctatttattaatgttcctctttattatcctcttccccagctagactgtaatgtgtgcatggacagggaccatagcagttttgtcactctctgtccccggggcctagcccacaacacatagcaggctctcaatagtgtgccttggctgcttctactccagggcttactgaagaaacatgaagcttttgagacagacttcaccgtccacaaggatcgcgtgaatgatgtctgcaccaatggacaagacctcattaagaaggtgagtccagcccattggtaagacctccatcgcccactgggacacccacgtgttggtaccacagaggtcccccaaagttcacttcctgggatgttcaccaaaccaaggtctgcgtggagaccagcagcaattccattcctgtgtttcgtgacaagttggatatttccccctttttgaagccagtaaagttattctgcagtgcttattttttctgcattaagcaacagagacactggcactcccaaatgctgctcttagtttatttctcaagcaatacagtctctttatagggacagtagaaaatgcaaataagcaaaacataaaataaaaattacccataaagccccaccctgacaccacacattagatctttgtgtctgacctgccagacctttcttttctctccacaggtttagagctaccagctagatcaaacagccgcagactcccgtttaataggatcatatcactccataaattatcaaaaacctcgagg

SEQ ID NO: 47679 - DNA, 1035 bp, Homo sapiens
gtaaattaattaaggccaggtgctgtgagcctctgcccggggcacccacctgccctccctgctcaggctcttgcttcccccgctcctagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccaggtatgggcctcaggaggtgggtgaagaggtgtcctttggaaaactaaagccaaatttgtggcagagctgagtctggggtaacaggccctgcgctgggtattctccccatttacaaatcaaactcagtatggacagaagtcccggatctgcttgtagaagcagctccgagcccccagcatcctgagacctgggaggtcgggtttgaagtgggtgcagctggctcaggcaccaggtgccatctcttaccccacagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaagctttgcttttcttcatttggcttgcgtcagaaacacaaggctcggcacagcgaaggcttgcacccgcctcccgggacccctcaggccgcc

SEQ ID NO: 47680 - DNA, 1028 bp, Homo sapiens
attttttgtatttttagtagagacggggtttcaccgtgttagcctggatggtctcgatctcctgacctcgtgatctgcctgcctcggcctcccaaagtgctgggattacaggtgtgagccaccgtgcccagcctattattattatttttgagacagggtctcactccgtcgcccagtctggagtgcggtggcgtgatctcggttcactgcaacctccaccttctgggttcaagtaattctcctgcctcagcctcctgagtagctgggattacaggcgtgtgccaccacgcccagctaatttttgtattttttagtacagactgggtttcatcatgttggctgggttggtctcaaactcctgacctcaagtgatttgcccaccttggcctcccaaagtgctgggattacaggcgtgagccgccacacctagcttgtttttgtactttatacaaaagaaatcacatggtgtatactattttgtgtctttgtctttcactcaacattatatttgtaggctgcattcacatcattccgagtaccagtcattcatttcttttcttttttagagacggagtctcactctgtcacccaggctggagtgcagtggcgcagtctcggctcactgcaacctcagcctcccgggttcaagtgattctcctgcctcagcctcccgagtagctgggactacaggtgcgtgccaccactccaggttaatttttgtatttttagtagagacagggtttcaccatgttggccaggctggtcttaaactcctgacctcaggtgatccacctgccttggcctcccaaagtgctgggattacaggtgtgagccacctcgtctggcccatttattttcattgctttgtaactttcctttccttgaatatctcacaatgtattcattctaccttggacagacatttgcattgtttccagtttgtctattatgaatcttgctgctgtgaacattcttgtctattatgaatcttgctgctgtgaacattggtgcacgttatgcatatctgt

SEQ ID NO: 47681 - DNA, 2574 bp, Homo sapiens
ttgggaggctgaggcaggagaatcgcttgaacccaggagggggaggttgcagtgagccgagattgtgcgcttttgcattccagcctgggcgacaagagtgagactgtttcaaaaaaaaaaaaaaaaaaaaaaaaacctcaaagacgggaaaagatatacagctactgctttctattctgtttaggagaagctatattctaattgcttgatgaaagatagtgacagtctgatattgagcaattgcctttagttaataatgggtttataaaaccaaagatgctcactaagttcggaaaaattttaaagggatcacttaaattgttgttagtgtgtgcctgttgaaaattcagctgacctgtaattttctggcctagtgtctgcactgcttggggaggaagatgaagaggcactgcattatttgaccagagttgaagtgacagaatttgaagatattaaatcaggttacagaatagattttgtaagtatctctaacttaatcttgtttgccactgtggaaattaatgtgagctttggttggaagacctgttcatatttctaatctttcaattatttattacagtattttgatgaaaatccttactttgaaaataaagttctctccaaagaatttcatctgaatgagagtggtgatccatcttcgaagtccaccgaaatcaaatggaaatctggaaaggtatgttttgaggaattatttgacaaaaatagcattttgcctatttcagtttagttttaaccacttacaagtgcttgatactttggtcatgtggctaaatacaaaaccttaaaatataaaacgttccagtgtgctgaagccaagtattacagtagtttagggttctcattagatactacagatgtaggcaggaagatctcttgagcctaggagtttaccctgggcaacatagacccttaccttccaaaaaacaaaaaaaaagagaaaaatctagcccaagtttaagaattgagaactggactaaattttttgttgctgttgttttctgcagtggtgactgagctcttcaaatggcttgccatttctcaaaatcatttacatccgtatttaggtagtaagacatagtttagatatttatactgtgttgtgctagtggctgttaacagtggaactaattttatggaaaaccaaatgtagttgatactacctctacctgctgcacagttttataattgctcttaggtaataatggtagcgtagatagtatactgatatttgttttgcttagcttttggggaaaatcttattttttaaattatagggagtttgggtgttatggagagattgtatcaaaagctcttccggtattcatttaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggtgagttctaatactcatttattcaaggttggacttgtctcggttgtttaaaaatgagtccttatattgtgcttttttttttttaaggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggtaaaagaaaatttggctaaacccacaaagataacttttaaagaattcatgttattttggggtgtatatatatatatatagtgtggtagaactgaccagaactgattgtggaaaaaaagtaagccattttgttgttcaagaattaaggaaatgtttgataagcacatggtactaatgtttaactaggttttttttggtttttttttgggtttttttggttagacttatcaccacccaagcttgtttttccctagccagtacttaggcaatataggcagtgtagctggtcaaattctgacatctctgaaataacaaagtttcatgtattttcgacaaactgcacaatttctgaatagtcaaattaggataggttggttttatttcggattatttgatccgaaatatacctgatttggttagaactgaagttactaattaatctgaagcaacatcatcacgggtgtttccttcgatgcagctgacttacaggtttagaaactggagtgcccccaggggcactcgtggggtccattgtggtccatatgaaagcaagtctcagcattaatcctgaagattaactgcccactttttctttcaggaggatgaaggagaagatgactaaatagaacactgatggattccaaccttcctttttttaaattttctccagtccctgggagcaagttgcagtcttttttttttttttttttttttttccctcttgtgctcagtcgccctgttcttgaggtctcttttctctactccatggttctcaatttatttggggggaaataccttgagcagaatacaatgggaaaa

SEQ ID NO: 47682 - DNA, 1047 bp, Homo sapiens
atgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattttttttggactggggtcattctccttgttttatagagaaatgttacttgctattggattcagaaattgttctagttttttgtcttcacatcgttagtgactggggaagcgtgggttagcgctaatggtatgacattggtttagaaagctttgagctggtcggtgtccgagtaaaggacaaattcaaatatcttacttggatacagtttctgagtaaacagtttctgagagg

SEQ ID NO: 47683 - DNA, 1044 bp, Homo sapiens
tcaggcctcggtcgaaggggttgctggggcgctggcggagataggcgatgcggtgtgaggagatgaattcccaggtggtggtgttgctggccaccaggtagaggtgcgagacgaggagcaggctggccaccaacgagaagagggacagcagcaggaaggtggcgaacaggagcccgctggaccgcaaccactgaccccagggctggaagaaccggaggcctgacctgcggtgcaggggacaggggcctggtgctgggggagggcaggggagcccttccctccccatgccgggtccctgggagtcctggctctgtccacccctgtgggagcattcatcccaccctccctctacacccgggcagcagcacccaccatgccaggtacaggccccacagaagcaccaccagctgcagcgccaggtagaccacaaagagtgggtggttgcgctctcccacacagttctccatccaggggcagtggtggtcgtagcggcggacgcaacggcggcactcacggcagtgccgagccctcaggggctgctgtgggcatggaggagagtggaggctcagtgccagccctgctgtgggcccaccactgagggaaggaatcagggcctgattctggaaggccttcttggaggaggggcgaggcccaggcagtggggcaggaggaggtcgaggagtctcagctttggcccaacctctcccacgggtgtccgtgcatcactcaccagcaccaggcagtatctgcagcgccgaagagggatggctggaggaaccatggctgtctgctcctctttgagctcctcctggaatgaggggtggggtgtaagacagggtccccttgggagacagatggcattggcgggcagctcccctaggggccggcttagctctgggtatggagtttgggacccatcccatgcagaatggaggtgtggggtatggcggagcaccctggactgagggcggctgtgtatgtttgcaagtctcttccttctctggggcccagcagtttcctcactactgtagatggggctctagg

SEQ ID NO: 47684 - DNA, 1050 bp, Homo sapiens
tcaaaagaacatttcaggccgggcatggtggctcacacctgtaatctcagcactttgggaggctgaggcaggtggatcacctgaggtcaggagttcgagaccagcctggccaatatggtgaaaccctgtctctactaaaaatacaaaaattagccaggagtggtggcacacatctgtaatcccagctacttgcaaggctgaggcagaagaattagttaaaccggggaggcggaggttgcagtgagcagaaatcacgccattgcactccagcctgggcaacagagcaagactttgtctccaaaaaaaaaaaaaaaaaaattagcatccagtctaggctgggtatggtggctcacgcctgtaatcctaacagtttgggaggccgaagtggggggatcacctgaggtcaggagttcaagcccagcctagccaacatggtgaaaccttgtctctactaaaaatacaaaaattagctgagcacagtggcgcgtgcctgtaatcccagctacctgggaggctgaggctggagaatcgctggaactcgggaggcggaggctgcagtgagccgagattgcgccacttcactccagcctaggtgttagagggagactccatctcaaaaaaaagaaaccatccaatctagtcatctttcttggggaaatgattcttgaagaagtacttcttgcccactctactccccgccagttggctccacggtgaagggctgggggttctgggactctggcctggggcatgacctttgcctgctgtgtccacaggcatcccctgtgagggcggactgcggtgcctctgctggaaggtgggtgtgcctggggtggggcttctgctctgctgagagtccctgggttttcctgcatgggctgcccctacccctggcttcttcctcctgttctgcacctttccttgcttgtctgagggagcttttctgggaagtcctgggttttctgttcctcttggtgtcttctctgggatccccttggggatgggacactttgtaatgccaacaatgaagacctctgcttcctggtccgt

SEQ ID NO: 47685 - DNA, 1054 bp, Homo sapiens
cctcatgcttaggggagtgacccccttactgtggacactccaggtactgcaggatccgggccagctgtacgcacgcctgccccttcttcccaactcctgtgaattccccctccacagtcctggagagagagagatgggggctcaggatccagctgtggccccttcaagagctcctgtctacaagtgcacgcgtataatcccagctactcaggaggctaaggtgggaggatcatctgagtgcagcaagtagaggctgcagtgagccatgaccatgccactgcatgcactccagccggggtgacagctgagatacaggtttaggccttctggctcccaatcccacctctgtagtcatcacccccacctggcaactctacccactaaggattacacagggaatatttcaggcagggcacgagggaagagccaggcatgtggacggggccatggtgaagcctcggcccatcccggcagcccctccctctccctgaaccctggcaccctgtgggatggccccttacttggcatcctggccctcctcatcaaacaccacgatctcatccacacagaagatggcacaggctctggcaatctgaccggccaagtaggtgcgaagctccggcgactgagcattgtccaggatggagcccggcagggctacgctcagtgtgtagggccgccctgagcaggggagggatgttcccagccagtgtgagaggcaagggccccctacctttctctcccttcctctgtccctagcgcccatggtttgagaatttcccaagtgggaggaattttgagatgagcaaaatagatccagctcccctctctgggcctcagtctcccagcagtctccatggctcctctgagcagggcaaaccactgggcgaggctgtggagcggttagtagcaatggcctaagttcacatcctggctctcccacttactgcctcagttctccagctatcaaatggggataaaatgaaagctgatatctaataagtctttagtgtgtgcacattaacccgatagccattaacctgatccctagtga

SEQ ID NO: 47686 - DNA, 1056 bp, Homo sapiens
atgatgaaaccccgtccctactgaaaatacaaaaaaaattagccgggcatggtggcatgtgcctgtaatcgcagctacttcggaggctgaggcaggagaattgcttgaacccgggaggcaaagattctagtgagccaggatcgcactactgcactccagcctgggtgacagagtgagactccatttaaaaaaaaaaaaaaaaaaaagaccatgtaaacttaaattgtgcaaagagaacttaataatcgagaaaattattattggataataataattaataagacaattgttctgtgaccttttaaaactctcttaccatctgttaaaaatgtagcccaggtgtggtggctcatgcctgtagtcccaggactttgggaggccaaggcaagaggatgactggagcccgggaattggagactagcctgggcaacaaagtgagactctgtcatttaaaaataaaaaagtatagaaaatgaaaaaaaaaaaaaactaataagaacttagtacactgtaatttaatattagcaacactgaaaattaagacgttttctttcgttataaaagtttatcaaggaaaaaattttattgcaaatagcttgggccaggcgcgatggctcactcctgtaatcccagcactttgggaggccggtaggcaggcagatcatttgaggtcaggagtttgagaccaggctggccaacatggtgaaatcccgtctctactaaaattacaaaaaaaattagctgggtgtagtggcaggtgcctgtaatcccatcccagctacttgggaggctgaggcaggagaatcgcttgaacccgagagatagaggttgcagtgagcggcactgcactccacagagcgagactccatctcaaaaagaaaaaaaaaattaaatacaaatacaaaaaattagccgggcatggtgatgcacacctgtaatcccagctacacggaaggctgaggcaggagaatcgcttcaacctgggaggcagaggttgcagtgagcagagattgcaccactgcactccagcccgggtgacagagcaaatctccgtct

SEQ ID NO: 47687 - DNA, 1023 bp, Homo sapiens
agtcttgctctgtcacccatgctggagtgcagtggtacgatgtctgctcaccgcaacctccgccccctgagttcaagggattctcctgcctcagcctcctgagtagctgggactacaggcatgtgccaccaggcccagctaatttttttgtatttttagtagagatggggtttcagcatgttggccaggctggtctcaaactcctgacctcaaatgatccacctgcctcagcctccctaagttctgggattacaggcgtgagcagttgtgcccggctgtattctggatattaatcttttggtagttttaaactttggaaataactcttcctagtctgtggcttcttttcacttgtttattattatgtctttcgatgtatgctttaactttaatgtgatcaatacgttacgtttcctataaggatttatacattttgtggtaagatattcctatcttaatgacattaagacagtctctgatttttcttttctttttgagatggagtttcactcttgttgctcagactggagatcttggctcactgtagcctccacctccctggctcaagcaattctcctgcctcagcctcccgagtagctgggattacaggtgcctccaccacacctggctaattttttatatttttagtagagacaggattccgccatgttggccaggctggtctcaaactcctgaggtgatcagcccacctcagcctcctcaagtgctgggattacagacgtgagccacagcacacggcctgtcttagctattcttgatcctttgagatcgtgatttaaaaaaaaattttttttttgagacagttttattcttgttgcccaggctggggtgcaatggcgcaatctcggctcactgcagtctccgcctcctgggttcaagtgattgtcctgcctcagccttccaagtagctgggattacaggtgccctgcagcacgcctggctaattctttgtatttagtagaaatggggtttcaccatgttagtcaggctggtctcaaactc

SEQ ID NO: 47688 - DNA, 1057 bp, Homo sapiens
ggtgagccctgggatggaggtgggagcagctggccaatgcgatatacttcccagggccaggtgctggaagatagtggggatcgaggcaggcaggtctcatccttagagcccacatcaagggggtaacagatggaaggatgagcactgcgagtggggacatgggggccatgagacccaggagatcagggaaggcttcctggaggaagtgagcaagagctgagacctggtgcacaggcagatgttggccagagtttggcccagattgtgctgatgctgggggcctggggatcagaaaagatgctgagatcttggggagagagggaagggaagcccagaggccccgtccaagcccacacccacctcactctcacccctgcttttttccctccagatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataactta

SEQ ID NO: 47689 - DNA, 1076 bp, Homo sapiens
ctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccctgtcaccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaagtggcctttggaggtctttgtgtcatgggaggacgcttccctcacttctctgaagcctgccgggccgtgtggaacgttgcttgggcacctacaggagagttaactctgctcatctcctgccccatgagactctgtgcctttggaggcagttactggagcttgtaagctggacgcagcacctgctaggtaacaggctgtgacctgggctggggatcccatagccagcacaatctctgtcatcctactcacctgtggttgggcactcatgagggggtttttttgttgttgttgtttttttgacagggtctcattctgtcacctagagtgcactgctggaatatagtggcgtgatcacggctcactgcagccttgacctctccaggctcaggtgatctcacctcggcctcccaagtagct

SEQ ID NO: 47690 - DNA, 1050 bp, Homo sapiens
gatgctcagcaccactgcaaacactactgccgcctctgccagcaccgatccactcagcggagccccaggccccggggccggagatgggcactctcgggtcatatctctagacctggggcttcacggaggccggggcgactacggacgccctagacttcgggcccctcagccccgtcaagcagagggaggcactttcacccggccagcaaccttctccctccgttctccagcagcgaggagggaactccaccgcaggtcacttctgcggcctgggagctggcgcccggccaccccccacagcctccaacctacggcgtagacgtcgccactctgcagccttcctcacagttacagccgcccccgctgccggctcctcacctctttgggcctcgccatcttggcaccgccccgcggcaacgtcacgtgacgaaatccccgcccacgctccgggtccgggggcgagcggtcacgtgggcatggcgtctgggggcggggttagggcgagcgggcgcgcgaagatggcggcggccgccggcgggccgtgtgtgaggtgcggagcgggtcgaatggaccggggtggctgtgaagcgcggtgtcaaagccgagcggaagcggggcgggaattggaggcgggatgtggcgacagtggcagggccaaccccggctggatggacgggcaccgagacgggaggcggttacgtccaaacggtccccgcgcgcggggatctgaagagtcttcttcaggaggggggccggctcttcaccccttccctccgcgctcggcctcccatctcctcacccagggccctttgccttcctcctctctcacctccgacgcgtctcttggcgccccacccgcgcttccttctccggccgtgacgctccctcgagccacggggagctttgcggtctcctggggtaccccccacccacgtccctgctgcaggctcccagtgtcctgccccggcgtcgagtgcgccctgctggctccccgacctctcccgcgatctgttcttgttaggattttgtttcgcgttgagcggagccacg

SEQ ID NO: 47691 - DNA, 1053 bp, Homo sapiens
cagtgttttccccacttttttttttttttttttttttttttttttttgagacggagtctcgctctgtcgcccaggctggagtgcaatggcacgatctcggctcactgcaagctctgtctcccgggttcatgccattctcctgcctcagcctcccaagtagctggggatacaggcacccgccacaacgcctggctaattttttgtattttcagtagagacagggtttcactgtgttagccaggatggtctcgatcttctgacctcatgatccgcccgcctcgacctcccaaagtgctgggattacaggcatgagccaccgtgcccggccctaacaatattattatataacaagattactttccaaaaatttaacaaatcgttttgtatattgagattttttgcttttagagagcagacaaaatggctatgaggcagtgtacaagtttgtatgatcagaaagagcaaaattacctctgttctctcattttgcaggagcagtagagaactgtggactattctgcttggaaggtcagctctgagagagctggtaagtggtggtgttcttgagtgggttctctgggttctttgtgtagcttttgttaccaaaaaaaacctttttttaaatgtaggaagtaaacacatttatttatttagagacagagtttcgctcttgtttcccaggctggagtgcaatggcgtgatctcggctcaccgcaacctccgcctcccaggttcaagcgattctcctgcctcagcttctcgagtagctgggattacaggcatgcaccaccacgcccgactaattttgtatttttagtagagatggggtttttccattttggtcaggctggtctccaactcccgaccttaggtgatctgccctccttggcctcccaaattgctgtgattataggcgtgagccaccacacctggcctatttatttattttgagatggagtttcactcttgttacccaggctggagtgtaacagcatgatcccagctcactgcaacctccgcctcccgagttcaagcgattttcctgccacagcc

SEQ ID NO: 47692 - DNA, 1029 bp, Homo sapiens
gacagggtttcaccatgttgcccagggtggtctcgaactcctgagctcaggtgatccggccccctcagcctcccaaagtgctgggattatagacgtgagccaccacgtctggccagttttctttattgtaatgtctgttttatatttaattgatttctgttgtgtatttttttttttttttaaattttcactcttgttgcccaggctggagtgcaatggtgtgatcttggctcaccgcaacctctgcctcctgggttcaaatgattctcctgcctcagcctcccaaatagctgggattacaggcgcccaccaccacgcccagctttttttgtatttttagtagagatggggtctcaccatgttggccaggctggtctcgaactcctgacctcatgatctgcctgcctcggcctcctaaagtgctgagattacaggcgtgaaccaccgcgcccggactctctctctttttttaaaatagatttctgcctccgtgtgtgtgtgtgtgtgtgtgtgtgtgtgtgtgtgtgtgtgcgtgtgcccagccttgttctttagtttttatatatgtatatgttttttctccctttttaaatggatttctgtctctgtctgtctctgtgtctgtgtgtgtgtgtgtgtgtgtgtgtgtttgtgtgtgtgtatgtgttagaagtctcactgtcacgcagagtgagactctctggatttaatgtccaaatattggatgttttttgtaaatatctgggttttttttttgagacaggttctttctctgttgcccaggctggagtttagtggcacaatcacggctcactgcagccttgacctcctgggctcaggtaatcctcctacctcagcctcccaactagctaggactacaagatgctgcaggttttgccatgttgcccaggctagtcttggactcccgggctgaagggatctgaccaccttggcctcccaaagtgctgggattacaggtgtgaagtactatagcagacgaaacatcttattgttctcaatgtttttatt

SEQ ID NO: 47693 - DNA, 1063 bp, Homo sapiens
ttaatgtttgcatatcacatcctagaatggatgcatcctgatttatttgcgctactttctgtctttcactattacaagcagtgctgcagtgaacattattatccctaccaccctgtaaacatttgtttacagttccaaagatttatgtaggtataaatgaacatgatattttttattagatatttccaaattaccttccaaaaaacattgtaacagtttatacttataacaccaagtattctatcgttgctgcaaggtcttcatcattgtttagtctttgccaatctaataagcaaaaaaatgtttcacttttcagtttgtatttatttaaccatgagggaagttgagcatttctttatactgattactgtctttcctgtgaatttgcgggcatctcatgcttgtttgtggtgatgtcccttttagcccagagctgtagtctggatgcttccctttctgccaattttctgggagctcttcagtgcccttctgtgggagcccattgaggtttttgtggaagcagagctctaagcctgtgtgttccggtctccaccaggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggtaagcctgtaacctgggatgacactgggagttggctcactgggaggcagatgctgggctctgcaagtacagctgctggcagtggctgtggaactgaactcttacctgtcccttcttgcaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaagtaagtctg

SEQ ID NO: 47694 - DNA, 1057 bp, Homo sapiens
ccagctaattaaacattttttgttgttgttgagatagggtctcatcatgttgcccagactataagccctattttattttatttatttatttaagacggagtctctctctgtcgccaggctggagtgcagtggtgcgatctcggctcactgcagcctccgcttcctgggttcaagcaattctcctgcctcagcctcccgagtagctgggactacaggtgcgcgccaccatgcctggctaatttttgtatttttagtagagacagggttccaccgtgttggccaggatggtcttgatctcctgacctcgtgatccgcccacctcagcctcccaaagtgttaggattacaggcatgagccaccacgcccggcctatataagccctattttaaatcagggagactgttttaccaatgactaattgcctagcagaggaccccatgtttcttggcctctaaaatctggaaaattttcccagctgaaacctttttctgttcctttgcaggcagatataatgcacctgactgactctgtggtgcgtcgccagctctttcttgacgtgcttgatggaaccaaagcattagtaagtgtgtctgggagattttacatttctcccagggaggttgtctttgaagtcaaatagcagaggtcatgagtctgccagccagccgcacaaatagtcaggtcacagggctcacgttggcctgggaggcctgagactgtagtgggtcagcagagctctgctgctgccatgccaaccctggcttctccccctccactccactcctgtgagctcactgctggggaagaaaggcaatgaggccggaggtgccctgtggatggcatgcgaatctttccactgacttctgactggtgtgctgtctcctttcagctcctagttccagcctcagtgaactgccttcgccttggctccatgaagtgcactctgctgcttatcctcctccggcagtggaagaggtgaggctgtgccaggagaggcaagcccgaggccagagccttcttgtcagtgcctgcttgccttcctgaaagggagaaatag

SEQ ID NO: 47695 - DNA, 1245 bp, Homo sapiens
ggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcaggtactgcccatcatctgttcagcaccacctcccctaaaggctctgctctgctgtgtaccgagagctacctggggccttaattgggtcctggatggctcttgtcttttctcgcagtccctggaccttgctgaatacaacttcctgtttgccctgagctttaccactcccacctttgactccgaagtggccccctccttcgggacccttctggccacagtgaatgtggccctcaacatgcttggagaggtaagttggttctgtcagacactgtcctctccccccggctcctccccctgcctgccacttcccagctgaccttgggcatgttgggcatggtacctagcctcccaagcctgctcctctctgtaaactgaacatgacagcacctctgagaattactgtgaggattaaatgaggtaactgattaaatttgcttagtgcaggacatgcaagtaggaagctctcagtaagtgggagctgttcctgttgtcttagttttttacccttgcttctcttcagctggacaagaaaaaggagcccctcacccaggcagtggggctcagcacacaggcagaagggaccaggacgttaaagtaagtgctctttctgggatttgataaggggctggggcagtcatgggcccactgttctcaagcttggccagcctggccctctgcagcagtaccaaaaacctgtgtctcctcccaggtccctcctgatgtttaccatggaaaactgcttctacctgctcatctctcaggcgatgcggtaccttagggacccggctgtgcacccccgggacaaacagcggatgaagcaggagctcagctctgagttggtacggatggatagggatacggagggctggaccaatagggccagagccctgtggggtcctgcctggcaacccccaagggtcagaacagtagccagatgtgctgagcctcaccaagccactttttttcttgtagagcacgctgctgtccagcctctcgcgctacttccgccggggagcccccagctcccctgccactggtgtcctcccctcgccgcagggcaagtccac

SEQ ID NO: 47696 - DNA, 1025 bp, Homo sapiens
ggggacgtggcttacagtattaacctaggtcctgaccactgcagctcacgtagctcaattcacagcctcctgggcagatgtctctacccctgacaacctggaagcttccttagcctgccctgccctctcacacacccccaccagccctagagcgagactgacaggctcctcagtccttcccactcactggggagaagctgtttcttctgctggcccagtgactttggcggccatcccagggagacagggtctgtcctggcttgtgtgttccttccgcttgaggtcccgggagaccttgaaggcatccttgggcttggagctggaagtgggggaggaccctgccgggtcttggggtccaggctaggtgtgatcaagccacttatttcctggccttgggaaggggcaatggggtaccctggcagggaggggagtatctcccaaggtccaggggaaagctgcccagtactctgtggtctgctggggcttgctacttcctgctgcatgtcaaatttagcaaaagcattgtactgagcacaaagtctgactctaccaagtaccagctgtgtgactttggactcctgacttagcttgtctgagattcagtttcctcattggaaaccagaggtgaggctggggggaaggtgggtggcatcaacttcacataatcctttttttttgtttgtcttttttttttttttttttttttttgtggcagagtctcgctctgtcacccagactgaagtgcagtggcgcgatctaggctcactgcaacctctgcctcctggattcaggcgattctcctgcctcagcctcccaagtagctgggattacaggcacgtgccaccacactggctaatttttgtatttttagtagagacggggtttcaccatgttgaccaggccagtctggaagtcctgacttcaggtgatccgcccgcctcagccttccaaagtgctgggattacaggcatgagccaccccagccaacctcacaaaattctaatgattcagtgagatgatggatg

SEQ ID NO: 47697 - DNA, 1051 bp, Homo sapiens
cctcccaagtagctgggattataggcgcatgccaccccatgtggctaatttttgtatttttagtagagatggggtttcatcgtattggtcaggctggtctcgaactcctgacctcaggtgatcttgacctcaggtgatctgcctgcctcggcctcccaaagtgctgggattacaggcgtgagctaccgcgcctgggcttttttttctttaatacacttttttggggactttttgggcaacatccaagttttcaacagtgaattatttatttatttatttatttatttatttatttttttttttggagacggagtctcactctgttgccaggctggagtgcagtggcgcgatctcggctcagtgcaacctccgcttcctgggttcaagagattctcctgcctcagcctcccaagtagctgggattacaggtgtgcaccaccacgcccagctaatttttgtatttttagtagagacggggtttcaccatgttggccagaatgatctccatctcttgacctcatgatccgcccgccttggcctcccaaagtgctgggattacaggcgtgagccaccgtgcctggcttatttatttatttatttattattttattatttttttttaagacggagtcttgctctgccgcccaggctggaggtgcagtggcgtgatctcggctcactgcaagctctgcctcccaggtttacgccattctcttgcctcagcctccccagtagctgggactacaggtgcctgccaccatgcccggctaattttttgtattttttagtagagacggggtttcaccatgttagccaggatgtaattaattaattaattaattaattaattagagacggagtctcactctgttgcccaggctggtgtccagtggtgcgatctcgactcactgcaagctctgcctcctgggttcacgccactctcctgcctcagcctctggagtagctgggactacaggtgcctaccaccacgcccagctaatttttttgtatttttagcagagacagggtttcactgtgttagccaggatgg

SEQ ID NO: 47698 - DNA, 1028 bp, Homo sapiens
aggctctgggtgcaggatggctggggaaagagggggttcctcctggagcctgtggtgagggatgctcagctgtgctcagtgggccaggaatgtcgtggaggaaggctaattaaaggggaaggttgtaattaccccagcaaatccttagctgccaagtcccctaattgcccgtggctttgatggtagccatccacaccaagcaggtattgtcttttttttttttgagtttttcttgttacccaggctggagtgcaatggcatgatcttggctcactgcagcctccacctcccaggctcaagcgattctcctgcctcagcctcccgagtagctgggattacaggcgcccaccaccacacccggctaatttttgtatttttagtagagacggggtttcaccatgttgggcaggctggtctcaaactcctgacctcaggtgctttgtcctcccaaagtgctgggattgcaggcgtgagctgctgcgcccggcccaggtattgtcttagctcaagggctgtactttggcaggattgcagtgtggttacatgcttgggttctggagtccagctggctagtttcataacttgtgaatcatttttgaccctctgtttcctcatctgtagagtggtaagagtcagcagactagtcatggccccctggggaaaattcactgagatcccacgagtagtggttgtcttttgcatagcgcctaacacatactaaataaatacttcgattgttattagctattgttaccattaggcattagtcagttctaattttcaatagtgttgttgcatagaaagctagcttttggctgggcgcggtggctcatgactgtaatcctagcaccttgggaggccaaggcgggtgaatcatgaggtcaggagttcaagaccagcctggccaacatggtggaaccccgtctctactaaagatacaaaaagttagctgggcgtggcggcaggcacctgtagtcccagctacttcggaggtggagtcaggagaatcctttgaaacccgggaggcg

SEQ ID NO: 47699 - DNA, 1004 bp, Homo sapiens
cagaccattcctgtttgatatgactgggaaaggaaggaggatactttttcaccctgtaatctgatcatgtgttccctgcttagaagcctgcagtggctccctattgctcttagggtaaagtctgagctctttcctatggccaaaaggcccatgtgacctgtagcctcctgtcattacacgttctcccttgctctcactgccttcgacatactggcctccttagtgttcctcaaacagatcaaactttttcttgcctcaaggcctgtgcacatgctattccttctggctagaatgcatttcttgcttccctcactccctttgccttgccagctcacatctttcagatttcagattagatgttacttccttaggggaaaccttgaacccttacgtcagggtccttctgtgatatcctccagttagtaccctgtctttctccttcagagctggaatcatagtagtgactgtatatttataatgtctgttgtccctgatagatcataaactttctgagggcaaggacttacttgtcactgtctcctagtgcgtaacatggacagtgactgcttacatagtaggtgctcagtaaatatggtggaattgctgagtgagttaaacctacgtaatgaaatgtaaatgtccagcccgggtcttttacgagtggaattatagtactggtagttcttttttttttttttttttttttttttttgagacagtctcactttgtcacccaggctggagtgcagtggccttatcatggctcactgcagcctcaacctcctgggctcaggagatcctccatctcagcctcctgagtagttgggaccacaggcacatgccaccatgtctggctaatttttgtattttttgtagagacagggttttgccatgttggccaggctgatctcaaactcctgagctcaagcaagctgcctgcctcagcctcctgaagtgctgggattacaggcatgagccaccatgcacggccagtactggtatta

SEQ ID NO: 47700 - DNA, 1047 bp, Homo sapiens
aggttatgcggaaactccagaaaacatacaggatggagccagccggcagccagggagtgtggggtctggatgacttccagtttctgcccttcatctggggcagttcgcagctgataggtactagagcgggaggtgcctatccctccacccccaaccaaggctgcgttctgtggccctcccctgcccctcctgcgctccctccttcccttcttcctgcccagggcagacagtgacagcttggaaagcagggcattagaccagctattgagggaggctgtttactgtcgaccttctgctgtgagagcccgtgtggtgggctggaggaggcggaggccaagcgccaccaagataatgggaagtgacatgggctggagcaagggcgcacgcctggtgcataatggactggtgtgaaatgcgccccagctcctggcagcagctgtggggttttatgttgaaaatgagggacccttttgatttggtgaccagtgtcatccactgttattatcgagctgtgtgcaaaggggcccgttagggagcagccgccaagtgctgggtggtgggcctgcttcctgtggggctcagagaggcctgctctggtgactccccaactcttgaagctagttttcaggatgggcgtaggtgatcatctctattttgatgaagaatgaactgcctacagactgatattcataaatgaccattagttgtggcctcgggtgcattgcctccccgaatcttctcagtgacactgcgaagggtctgccagcatgaagccggctctgctgactggcacctgcaccaggcaccatactgagtgctgtaggtgtggtaattgttgtcatggcccctaggaggaggtgctcttcttgtccccagtgtccaggtgaggaaactgaaccttggcaggctgaagtcatgcgtccaacgccatgcagctagagcttagcacattagaatacacaaacccagagttacttattgctccttcaaggtgaggtgttgagggcaccacgggcaggactgaggcccctgggggggtgtgactgc

SEQ ID NO: 47701 - DNA, 1042 bp, Homo sapiens
actgtgatctaatgagaaggatcctttaatgaaattttaatggggagtggtgggccgccacgactgcagaatttgtgttgaccaaacaataggatttgtttgagttataatgctaaggtcaggtgttggctccttaacttcaggtagggagaatttgggttcctggcataaaaataagtagggatggctttggccaagagcccaaaggtggaggaagccacgcaatttgtgcagcaggtctctacttagaagaggcatggggcaatgtgggattaacaggaagcaatgtatgagggtgacgtcccgaaaggaacaatataaggggagtgtttggaggggagttttctgaatgccctttatgccaacaacagagattaaggagcaaattagaggtgtggggaacaatcttggcagagggaaggacgtgagcaaaggtaaatgaaggaacttcttgccatttgccatttcgataaatgaagttatctaaatcccttaaaatttggtggtcgaatgtgccgttttcaggccaacggttgcccttggcctgaggccaggcagtattgcaaaagaatataaggcactttactttaatgtccccctttataccgagtttagaaaggttacaaatcaggaaacctagaggggaggaaggagtaatttgagattgattggagcccattgagatttggcaaggaaaggccaggggtgtctgccgttagactaggcatccccagaaaaagggcagagacgggagatcctctcaagaggaggtagactgaggggaaaggtcaggcatccctgaacgtcaccctcccaaggtctctgatggtcctaatggtccccaggagaccgggactgcggacctgagtctcctgggtagcacaggagagacaggtgggggcaaaccttactaattagtgtctggtgttggatgttttagaaggaaccagcaaaggacctctcaaactggagccgttggggagaaacagaaagtaaattgcccagatccagcggttggaggcaaaattctgggtccgggagt

SEQ ID NO: 47702 - DNA, 1007 bp, Homo sapiens
ggcagggcactcccccaccccggtccccagaccgcagcaaatccctttctctgagcctgtttcccttccgagaaacagggatatggagagcgcccacttggaggatggatgggaggaatcggtaaaatcggtaaaatgcccagttcagagcctggcacagttaagtgcccgctgcacagaagttgctgtcgtatttaaccttgggtgccacccgagcgccagcccgacacaggtgcagctcaaaaaagacagcccgagagcccttgcggccaaggtcagcctgtctgcagggaggctgccatatcgaaaagcccagactttgctgcgcaccaactgtgtgatctctccctctggactttggtttctcctctgtactataagtgattgccacaactggtgtcagaggccctgacagcggggagggacagtgtaaccggtggttgtggtgtgtagaatgattgcccagtgagatgggatgagcctctgggaggaaccagggctggtataaggagcctggattccctccttaattctgttctcggcttcctgtttgtatgtttaaagacacgtcacttcctttagtgtgctggtttttctctatgtaaactgaggactgtgcgggggttggaaggatgcatggagcgttttggtggaggccggaagccctaggatcacaaggatggcatctaaaaaatctcggtgggggttctgtgcttataggcagaggaagctcactccccactctggctgatttgcagagctgtttgagtctgctggcttggccgcccagcataccagtaacagtcccctaggtgtgtccaatacagcttctgtggcattctaaggcagttttcccatttgatcctcatagtgggcagagttgacaagaatctcatttgacagagatttctaagctcaagagagaatatgtgcccggcactgtgcaaagcactttaagcttttcatatgcacttttaatcacagcctttctgtaaagtcggtattac

SEQ ID NO: 47703 - DNA, 1033 bp, Homo sapiens
acgggtgtttggactgagggtgttggctattctggacgaagactcctagttatgtgccatggtttccaccctctgctccacccccagccttttctgtaccaggctgggacccccagtcctggagccccccaccttcttgtctcatggctggcactggaggctgctgttggccacctgctccatccagcgcctcccctccctccatgttccctctctgcacccttgttcacctgttgccccgcttccattctccccattcctctctgccgttgtttacctggagactcaggagagattagtgcacctgttcaagttatcacctttaagtggaaattagctttcatttagaaatgtgtggcccagggcaggggcagtggctcactcctgtcatcccagccccttgggatgccaaggtgagaggattgcttgagcccaggagtttgagaccagcctgggcaacagaccgaggccccgtctctacaaaaaatacaaaaaaaaaaaaatgagttgggcatggtggcgcatgcctgtagtcccagctacttgggaggctgaggtgggaagatggaggatggcttgagcccaggagttcgaggctacagtgagccatgatcccaccactgcattccaacctgaacagaatgcagaatgcaacctgaactttcaaagataaaggaatgtgtggcccagcagtgtgtcctcccatgctcatcccctcgactccgtacaagctggcagccagcacagacctccccaccagtgctcagcttgtgcggagtcctggaatcctgacttgagtctaagtcctagggctcgtgaggaagggccgcacgtgcggtgacagggtccctctgataggttatatgcctctgcttttcaggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggg

SEQ ID NO: 47704 - DNA, 1049 bp, Homo sapiens
acaaggcacttctcggggacttggtttccttgtctgtaaaatggggataattacagaacccactgcatagggttgttggcacaaagttcccgcccataaatgggtgcctcagtgtttacggtggaggagcacagggtgagggatggagtttgagaaaatatacgtactccccttcctggggtgaaatggcactttctctgtccagagacccggcatacccggtccagaggctcttcccccgttcctttgatgtccactagccttaggagccccagctggggacccaaatcaacttggtacctccggctcctgcacctctgcttctcgcccctggggggcgccgtggggccgctgcagggccctggactgggttcccgcgatgtggccgcacacaccccatcctctccgctctcctgggagatctccagggctggcaacgggctcctgacccagcctcctctggaaagacaaagaaacaagcaaatcccaaaccaccagcaggggttacagcgtttacagaagccttaggaaacaggaaccaacagccgtgaagatattcacatgctttcccccagcaaacccgtctctaagctctactttgaaaaataatcaaaatctcaaaatcggggggcgggggaagcaatgtgcacatcagtgtttatcacatattttatacgtgcaatgtaaaaaatctggaaagacacaagccaaaatgtgagtagcttaattttttttttttttttttttttgagactgagtctcactctgtcacccaggctggagtatggcacaacctcggctcactgcaacctccacctccctggttcaattggttctactgccacaggctctcgagtagctgggactacaggcctgcgccactatacccaactaactttttgtatttttagtagagacagggtttcaccatgttggccaggctcgtctcaaactcctgacctcaggcaatccacctgcccgggcctcccaaagtgctgggattatagggctgagccgctctgccaggccaattagcttaaattttatgg

SEQ ID NO: 47705 - DNA, 1044 bp, Homo sapiens
gcccacctctggtgcagcctcagctttgcctctgctctttgcaatgtagcctagaggtcttttttctccttaacaggttttattccctttgttcctcccatccttcatgtccttggcattgctttcttcaaaggaagcctcaaagaactgaaccttgagactgtttctccttttgagatattgtttccacattcattttatattaagttgtctaggagggttagttctcatttaaatgaatgttgtccttgtcaaggttaacattcccactggcaacatagcaagactccatctctacaaaaaataaaaaaattagccaggtgtagtggcatgcacctgtagtcccagctacttgggaggctgagatgggaggatcgcttgagcccgggaggctgagcctacaatgaaccatggtcatgtcactgcattccagtctgggcgacagagtaagactctatctcaaaaaaaaaaaaaaaaaattcctcctgttaggtggggactgaagaaagaaatagaaacttaactgaacaaggaagtagaagtgtttgcccaacaaactgacgtgagacagggaagactgctaaaaaggaaggaaggaaggattttcttgttctttacattcttcataaatctccggaaacagagtaatataaatggttgagggcatgtctgggggagtttcctggtatagcctttcacgctttggggttgagggcttgttgcttgagtgtctttatgtttgtttgaagaaaacatctggaacagatgcttttcatgaaatgtcattgagtcagctctgttggtctggggcactgtgtactgtgcaggtcttgatctagttccttattcctcagtatgtctgatagtactaacttgagattgtagtccaagagagatgaaaactatggctacgttagcagtgaatgatattcacggatcttgccgggtggctcattcctgtaatctcagcactttgggagggtgaggtgggtggatcacctgaggtcaggagtttgagacgagcctggccaacatggcacaacc

SEQ ID NO: 47706 - DNA, 1049 bp, Homo sapiens
gtgtgtctgggacttgctacaaaagcaagaggaagcaggaggttgagatgaagcaagattggccatgagttgttaattgatgagtctaggtacatggaaacatggaagtgcgttatatagtttggtctactttgttttttccttttttttctttatgctcatctttaatgtgacggtaagttctgcctgcttttcacatttacattttctataagttagaaagcaactgagcgggcccttaggatctgacccacttgaggttcagctctagcgccaacattcctatgagaccttagacaagaaggagcctctgttccttagtctgtgaaatggggctgatcacagctgcctcaacgattgctggaagagtttttcataaacgaatgcacaaaaagcacttggtttggtatctgacacctcatgagttttagtaactcacgttctgaatgagaatctggccagttgaccctggctgaccatttgggacagggaggggcacgtaaggaggagtctgggggtccacctctcagatcaggtgggcacacatgcagcttctgcctttgttttttgttttttgtgtgtgtgtgtgtgttttgggatggagttgcgctcttgttgcctaggctgcggttcaatggcacgatgttggcttgccacaacttccgcctcctgggttcaagcgattctcctgcctcagcctcctgagtagctgggattataggcttgtgcatcatgcccggctaattttgtatttttagtagagacgggatttctccatgttggtcaggctggtcttgatctcctgacctcaggtgatctgcccgcctcggcctcccaaagtgctaggattacaggcatgagccaccgcacccagtcttttgttttgtttttaagactcatgcagtcacagaggcttctgcctttggttaaagcagtcttggctccagttacatctttggttggtttggaccttatttggcaacagtttgaagctataatcagcagtcagattcctggatttgattctgctaaaataccgtaggtgaagc

SEQ ID NO: 47707 - DNA, 1026 bp, Homo sapiens
ggtgcaaaccaggactcaagtgtgactgtgtttagaagagggacttctgtgagggagctgagtgcaggcgaggctcctggcgcactccctccctgccacgctacttctaacagggttaggacgtgttccactcacagggagggcctggtgagagacactgagggacgcccgtgctttgtggccattaggaaatgattctgctgcctgggcatggtggctcacgcctgtgatcccagcactttgggaggccgaggcaggtggatcacttgagcccaggagttcaagaccaacttggccaacatggcgaaaccccatctctacaaacaatacaaaaattagccaggcatggtgatgtgtacctgtagtccccgctacctggagggctgagtgagttgggaggatcacctaagcctgggaggttgaggctgcagtgagccgtgatcatgccactgcaccgcagcctgggcaatagagtgagaccctgtctcagaacacaaacgaaaaagagactgtcagggctgggcctagtggtatgcacctgtggtccaacctactcaggaggctgaggtgggaggatcacttgagcccaggaggtcaaggctgcagtgagccatgattgcgccgctgcactcccgcctgggcacagagtgagaccaccccccatctcgaaaaagaaaatgctcctgtcagaaggagagctgcctctctgagcagataggcacattctattcaaccggagaaaattagcatctcccaggccgggcgcagtggttcatgcctgttatcccagcacttttgagaggtcgaggtgggcggatcacctgaggtcaggagttcaagaccagcctggccaacatggcgaaaccccgtctctactaaaaacacaaaaagtagccaggtggtggcacacacctgtaatcccagctactcaagaggctgaggtgggagaatcgcttgaacctgggaggcagaggttgcagtaagccgagatcgcgccactgcactccagcctgggtgacagagtga

SEQ ID NO: 47708 - DNA, 1054 bp, Homo sapiens
actccatctcaaaaacataataataataaataaaaacccattaagtgatgtttgtaggcctggtgcggtggctcatgcctgtaatcccagcacttagggaggccgcaacgggcacctcacttgaggtcaaaagttaaagaccagcctggccagtatggtggaaccccatctctaccaaaaaatgcaaaaattagcccggcgtggtggcaggtgtctctagtcccagctacttgggaggctgaggcaggagaatcacttgaacccaggaggtggaggttgcagtgaaccaagatggtgcccctgccctccagcctgggtgacagagtgagaccctgtctcaaaaaaaaaaaaaaaaaaaaaaagtgatgtttgtaagtaagtaaatcaaatccttctttgcacaaatactgtagaatcggtgccagtcgatcaggacccacctgattacaccagctttatgcagtggatctttcctaatccattggctgcagcctcactttacatactgctttgtgaattctgagtagggagggatgcatttattcactcccccccaaaagtatctggaaagttttgggaaattaaaaggattttcctggccgggcttggtgactcatgcctgtaatctcagcattttgggagaccaaggcgggtggatcacctgaagttcaagaccagcctggccaacatggtgaaaccctgtctctactaaaaatacaaatttatctgggtgtggtggtgtgcacctgtaatcccagctacttgggaggatgaggcaggagaatcgcttgaacccgggaggcagaggttgcagtgagctgaaattgcgccactgcactccagcctgggcaataagagtgaaactctgtcccaagaaaaataaaaataaaaataaatttaaaaagaataaaagaggattttcctcatctcgttcccattgattattatgattgcgcattgatgatgatgatggtgatgatgacgacgatgatgatgattgtgcctcatctcgggcccattgattattagctgctccattctggtaaatctcaaa

SEQ ID NO: 47709 - DNA, 1031 bp, Homo sapiens
ggggtctcgctctgtggcccaggctggagtgcagtggcacgatcttggctcattgcatcctccacctcccaggttcaagcgattctcctgccttagcctcccaagtagctgggattacaggtgcatgccaacacacccggccagtttttttttgtaattttagtagagacagggttttgccatgttggccaggctgttcctgaattcctgacctcaagtgatccacccgcctcagcctcccaaagtgctgagattacaggcgtgagccaccatgcctggcctggatttcactttaaagtcttactgatgttttacattttgtccgtttctcttgtgcaccaatttgctgagcattttaacgatacttaaggagaaagatgtacctcagaattgtgtggttactaagatcttaggcttaagagagactacctggatcctcgtccaactacttcctagcttggtgcccttgggcaagttatttaacgtttctgagcctcagttttggtatctgtagaatgtggataatagaatctacattgtagaacatgataaggactgcatgagcttggcacagggcctacacgcagcgtgctcagtggccaggagcactgctttgaccttttttccttctgtcttatttgaatgtagggtaagagtaaagtctccaccagaagctggtacccagttaccaaagatcatcttcagcagggatgagaaagtccttggtcagagccaggagcctaatgttaaccctgcttcagcaggcaaccagacccagaagacacaaggtaaaccgtaaggtggaaactggctttcagttttcactacctgctttgtagcttttttgttcctaattaaaagtaaaagtaaaacatgatctgttgtcgtcttagcattatattttggaagttacacaaaaatacgtaaatgttaaagaaaaatgtggaaaatctgaagcagatggaaaaacaacagtcatttctccttattcccagtgttagaattttagtaatttatgttttcttataagc

SEQ ID NO: 47710 - DNA, 1028 bp, Homo sapiens
tgtggtcgcagatcgtgggtctggaggccaaggtgtacaccccacattggggctgctagcatcataacagtccacccatgctttggggcctcagcaacttctcatgtctgtaggtcctggcaaatgtagcctacatcatcatagagtccaccgaggagggcacgactgaatatggcttgtggaaggactctctatttctggtcgacctgttgtgttgtggtgccatcctcttcccagtggtgtggtgagtagctcacagggagggaggccacatgacagcttggctgtcaagcccaatagctgaactggccattcccaaactgatctcagtcacatgggacgtgtgtttaaaagtacagctttctgagtcccagactgacctgaatcagcctccaggggcagaaccctgtgtctttttccagttactcggggtattctggcagagctaatccgtcaccatgagctggcatttaacagagttctaagacaatagagaggaattgggaaatgagaacttggtagtaacttaaagtagcagcctgaatttgtggtggtggtagggagttggagaaatcccataaacagccagttcttgccaacttaggtggaaaatgaggaagttcattaacataaaactagtgatagttctcagcacacaaacatttttgatgttttcagaatggattgctccattcctggaaatggcagtgtttagatgcacagattgtgcattgggtctgtgtaaagaagtgttagtgtcaagtcagtggttgatgagaaaatatccttattaaatcacatgcagagtggtagaaattcagaaggctagcagcaataaaacactttacccttagtgatataattccatggctattggaatgcaattcttttgaaataaattttaaagaaaatagattcaccccggccttccattacaagtgcttcttttttttttttttaacccgagatggagtttcgctcttgttgcccagggtggagtgcaatggctcaatctcggcccactgcaa

SEQ ID NO: 47711 - DNA, 1035 bp, Homo sapiens
ccggcccctgcttcgtcctcctgactcgtctacctgttcggtcctccatcttgctttagcgagtgtggggtggctgtggtgactgccactgggaccatttattccacctgaggttggttggtagctgaggatcttagtaaggtgctctgtctggagtagatggcacagcaggtgaggcagcatggggtcagcgttgtcccccagcatctgtagtaaagggtaacttcctttaacaggaacgcttttgtcatggcctgggcacacaaggcagtttctcatttttttccaccaggtgacagcatgggacctcttcagcagagagcgaatctaagagcaggaagtcgcataggtaaaccagggttcacattccccattcttaggaagacatctgctaaggaagcacccatttctcatcagcaaatatcacaaatactctgaaagagggacagagcagattagaacgggattgtcattttggttcatgttcttttccctgaattgattgaggctgtgagatgcttttgggcatcactctgtaccctgaaaagtggttatgcttgcgacactcccagagccagagcagccgtgttcccagctggagcctcccctgcagagaggtctcaggaatggcctgtgctggagctgccctcggttgtgactacagggcggctatgtgctgtgaagcttgcgggaaagcgggagtgggcatgcttccagtcgctggtgctgggatctgtggccccattggccctctgtgccccctcagttcactcctgagatctggaggcaactaggagcacaaaggctacaggcaataatgtctcctattagatttggaagctttgctggatagagcctgacattctgtttcctgttctcaggctcattattccagtgactcatttcatggccttgacagtaacttgggcttttcttttttttaatttaaaatttttgtagagatgaggtctcactctgttgcccaggctggtcttaaactcctaacctcaagccatcgtcctgcctcatgaggcc

SEQ ID NO: 47712 - DNA, 1409 bp, Homo sapiens
tagctggcgtggtggtgggtgcctgtagtgccagctactcgggaggctgaggcaggagaatggtgtgaaaccgggagacagcttgcagtgagctgagatcgcaccactgcactccagcctgggcgacagagcaagactccgtctcaaaaaaaaaaaaaaaaaaaaaaattagccagccgtgatggtgcacatctgtaaccccagctacttgggaggctcaagtgatctgcctgcctcggcctctcaaagtgctgggattacaggcatgagccaccgtgcccagccaatgtgtgttttttattaagctgatttaatacagtgattttaaatttctttaatcaccaaaactctcttgtcattacttttccttagcagattgcactctattcctgtaatgccatcaactgagtcgcagcttctgatgaacattatgaaataatccattaaccagtgataccactctcagttcatttaagctacatccaaaagcagaggtctctcatatcatccggctgagaagcagtcttgtcttggacacattgccaggcttttttaggcctttaaagtgttgggaatctagaacttcagggggcccacagccacccagagggcctggttagtggtccgtggtggcagaccctccctggacctgcctgggcctggttcttctgcctactggtgttaacatgcatgtgctttctgtgtgtcttgagacattgttgagaaccaactcttctcaactgatgactgcagtatttagggaaggtcagattctcttgctgagaaggttttgcctgctattaaccagcctttgtcatcaagcattgggaagtctgaccttcatccttgcctagctcgctgctgtgactgtgtgcagtggacaggaggggttgggggtaatgtgcgcctcagcccagctgcagggttgcgtcccaagtctcactggcatagctcacagcattgcggctgcaggctgcggctggcagagaaacaggagagactgacgggagctgagtctgagatcagcgtggccctttgcacaccaccttctcgggtgcctttggtgcattatggctctagaatcgaaggtaaataggagctggaaacctaacaggcttggcaacagaagtctttgtcagagctagctttcctggtattgtgtggtctttagtgctactctgaggagctgtttctgctgcttttgttgatgctttttatttatcatttaagatataatttcgtttacaataatatgcacagtccttaactgttcagtttgatgacttttcatatctcctgggtcattgcttcaaatgtatatttgaaatgtatttttttttttttttgagacagagtttcgctcttattgcccaggctggagtgcaatggtgcgatctcagctcactgca

SEQ ID NO: 47713 - DNA, 1024 bp, Homo sapiens
agcctgctgttcactgccccatccactcctcgatcgctctgcatcgatggacatctcactgccttttagaggggcctccgcagagtcaaggtctttgacctcatttgggcttttcctcttttttctctccatccttcctccacggagggattgttctcaagtgtagacctgatcgtggtgttgcctaaagcctttgggaggctggttcgaaggtggctgtgacccctctccgttgatttttcagttacagatcgaactccttgttctgctctttcccttctcactgctgcagttgactagtttaaaaaacaaacaaacgggctggcagggtggctcatgcctgcaatcctggcagtttggaaaacagatgggaggattgcttgagctcaggaattcgagaccagcctgggcaacgtagtgagaccctgtctccataagaagttagctggacgcgatggtgtgcgcctgtagtcccagctgtttgagatcatgtaagcccagcaggctgaggcttcagtgaaccatcatcacaccactgcactccagcctgggagacagcgagtgagaccctatctcaaaacaaaacaaaacaaaacaaaacaaaacaaaacaaaacccttcagaatagcagtgtccaatcttttggcttccctgggccacactggaagaattgtcttgggccacacttaaaacacactaacactaacgatagctgattagctaaaaaagaaaaataaaataattgcaaaaaaatcttataatgttttaagaaagtttacaaatctgtgttgggccgcattcaaagctgtcctggggcgcaggttggacaagcttgctttagaggttccctgggacccccaaaaccaacaaggagaacaagctcagtcttctgtgtcttaatttttggctttactcttagccctgccccatttcctaggctctccacagtccagccgctttgagctacttttccttccctgatatgtgcagctctctcacctctgagcctccgcacctgctgttc

SEQ ID NO: 47714 - DNA, 1046 bp, Homo sapiens
cagcatctgccagagaagaggacagaagtcagtaatttccctgtgtggctttattttgctattactactggtaaatattcctcaaagcctgagcataagaaataaaatctttggagattgaaatcaagggcttatgtctgtggatagggtgaggaagggttaagaacaacctgactaaagtgtcttgtgctcccggtgggtgtggctgttagcaatatcttggtcacctggagagagagaagaaattcaagtgtaactagcagagtagccatgtctctccgctgcacgtattaattcacactgtaagtgtcacatacttttctttgagtgattctgttttctgtttcctagttcatttgtgaaagcaaattgttaaagtggtgtcctaattttaatgttgatctgatttcctgtttctttcctcctcatgcagattgtgtgttacatatacttcactaggatcattgcatttctcctcaaactcgctgttccattccagtggaagtggctctaccaggtacgctgctcacagggcagaatgccagagaatttatgcctgaggataaagtcttgaagtgtaacttaacagttgttactaatttatctgggaatgaccactaagaccttccatctcttcttttttttaactaaaaattttttttttagtttttgagacagggtctcactctgtcacccaggctggagtgcagtggcgcaatctcagctcactgcaacctccacctcccgggttcaagcgattctcctgcctcagcctcctgagtagctgggattatagggatgcaccaccatgcccagttaatttttgtttttttagtagagatggggctttgcagtgttggccaggctggtctcaaacacctgatctcaagtgatccgcccaccttggcctcccagtgttctgggattacaggtgtgagccaccacacttggcctccttccatctcttctggcctataattgagatgatctgtttgtccagaaatgctgctggattctatgaggaatctgaaaataattgcattctt

SEQ ID NO: 47715 - DNA, 1040 bp, Homo sapiens
agggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattg

SEQ ID NO: 47716 - DNA, 1052 bp, Homo sapiens
tgcgcttctggaaggaggacagtcagtgatcaaaggtgtcaggaccgaggggactgtctgatttagtaagatgggtcactcgtggccaggcccaaaggccccgccttctattcttgtgctgctcaaacccaaaggccctcttgctggtgcggttttccttcagctgtggtggagggctggggccaggtacagagacactccggcagccctcaaccctggagatggatccagggccaggtccgccccaggagggatggcggaagaggctggattggctggccgtctgccgtccatgcctctagctgaagccagcgccgggagggggctgccagcccctgccttttgctcccaccatgtttgagctgagcttcaatcaggagagaggtgttttgctttagggaaatcaaaatcagacttaacatcctcctgggctcctgggactggctctcgtgttcattcctggcagacaagggctgtgtggaagggaggaggagctggagtagaggagctggggacctcaggagcgctgccggggtggaaaggaggctgtgggcaccgcgggtgcttcctggctgtggggtacgagcctggagtctgtgggcgtgggggtgcggcgaaggctaggacccactctctgctctgagactgcagctgccctccccttctgcagctctggctctctgggggtcagtgaaggggagtagagtggatgcccagccccccctctcccagggccctgtgtcggctctgatttctccatccactcctcaacaaccttgacaatggctctgcctggtaggagtttataccccatcctacaggtgaggacttggaggttcagaggggttaagaaacttgtttggaatcacccaggcttcaagtggccctgacaggatggcaccccagaactttcccctgtctggccccatggagagcatggcccattgccagttttaaatcctggttttggtacgagcctgggcctgcaggcctggaggcagagtgtgatggagagagttcgttttaaaaattggccaaagccagatgaaatt

SEQ ID NO: 47717 - DNA, 1050 bp, Homo sapiens
gtagctgctttttctcaaaccgtagaggggctgcggctgtgggctttgtgggctgtgggctgatggggacagcagtccagctgctcaggatgggggcatgtggaggggcccctgagcgtggggtccagacagcctttgttcagtggcctttgtccttgcgggactgacgtggtttcagtggaactgggttgggggtggcgctggggtgtttgttggtggtccttgctttgagttgcatctttagggaccaccaaggcctgaagggttgattccaggccctgttcaccaaagagaagggtttggataagaaagtccttctatgaccttgagaggtcctttcccctcgctggggctccgtcaccccttctatagaatgatcgattcgattggatcagggatggcaaatgggtttgctcttggatgccagctctattcaatctgtcgtagctgcctggagggccgtgataaggattccgaggccgtacgtcatggagcaaatggaaaagcggcagtgagggataagtggggcctgtaatggatgagcagtgccagggctgggcctgggggaggagggcggtgtattgtccgtctttgtggaatgtggagcagacaggaggctcaccatgtaaggtggctgagctgtaggggtggcacgtagggacatgaggcaatgagcttggagattttccagtcaagtctggcagggccgggcaccccccaggagcctccagggccactccctacacctccctgcctcaagtccaagctgcagatggggcagggctatgctggcccgcctggctctgctgagcccttgctgggaggtgccccatcctgggattgagtttccgccctcactttccacttctgcacttccccaggtgagtgccctagaaacaccctccttctagatcttcacccatgtggctctgcttcctggaatgcccgccttccttcctgggccatctgaactctgcccctcccaaggctcagcccaagtcgcctccaccatgaaacctccctagattccccatccgtacatgttctccc

SEQ ID NO: 47718 - DNA, 1031 bp, Homo sapiens
aaaaaaagggactccaaagaaataaggaatccttctttaaatcaaacttacttaaaactaaaataacttaaatgtaaatttgaaataatgacgttagggaaatccaggtgttacgtgccttcagcaaaataacataaaatggtcaggtgcggtggctcacacctgtcatcccagcactttgggaggccaaggcgagtggatcacttgagctcaggagtttgagaccagcctgggcaacgtgatgaaaccccgactctacaaaaaatacaaaaattagccgggtgtggtggtgtgcacctgtggtcccagctactcgggaggctgaagtgggaggatggctggagcctgagaaaccaagtctgctgtgagccgtgatggtgccattgcactccagcctgggtgacagagtgagaccctgtctcaatcaatcaatcgatcagtcaatcatagaaattcctgtaacgcagggctgcttattagattctggctggagacagctgtttgccctaaaagctttgacctgaggcctgtactttcttaattaaaaaagggagattagcccatgttagaggagtggtagagacgtgctggcctcagacccagctggcgtcttggtaatgatcaaaagatttatcgacagagtgtggagcacggaataataagtttctcgtggtgtgcgtccacgtggcttaaggccaaggccgcacattccttactgtccccctgtctgcacttccgtcattttgggaaacagcacagaccctgtagtcacactgactggggtgtgaatctgacttctccgtttcccagccctggggcctgggtaggtgacggagcctcagcttcctcactggtaaaatggggatgagagcagcacccccttcttggcttggccgtgagggttccatacactgagggttgcgccgagcttggcatatgtcgtgtacgcagcgagcgatccctgagcacagctcggttgtgctcatcggcgctgttttcggcacttaccctctctggatacccgagatcga

SEQ ID NO: 47719 - DNA, 1271 bp, Homo sapiens
cagttccagcagatgaatgtgtcatgtggcacaccttgtcccttcccgcagcatttcctggttccccccagacccttgagcgctctttgggacccagaaggagtccttgcacagggaaggcttgaggtgagaagccgcttcccagactgtcagggccaggcctgggtctagaattcttgctgctgctttgcagagtcaacagcccatcagcccatgttttagaggggacactttggtcctcggttcccaccctcagcaagcaggcctccagcccgaggaaggcctctgccgtagtgacgttgccgtgtggggctgcgtggctgttccccttggctggagcattcagccaaccccagcgtcccccctgaggcgttcattggcagccccctaggactgcacgctggccccacggtaaccccccctcccccaccaacatcctgcagggatggggtcagtggttccaccttcacaggccactttgaagggtggattctttgaggcccctgccagtcggctccctgctcagctgctggcccgggcgacctgggactcagcaccaacggctgaagtttctcagctgggctctgacctggggtctggggcagggaacgaacatggtggctttgggctgagaggatgagggaggtctttcccaggtcaaattactttcctttggcctctgcctgaggctcgatttgcctctctggtccaatgggactgacactgttgtacaacctgacctgtggctgagggtgtctgggcttaagcatgtggaccccttcggtgtgtccggccttcctccatcgtcctgccctttggccttttggtttgaagccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcagtgatgccgcagaatcctgagccaggtgcctcctgagcagcccgtgcgcctctccacagcggcgtttgccacccaatgcggctcgcttcagatgctctgatgcagagggcacgcccatagtccctctgcagagcctcgcactggggccagggcaggcaccagccccaggcggccagtcggccacggcctgtcctcttcctcgtagcgtctgctcctcactttgtgtt

SEQ ID NO: 47720 - DNA, 1230 bp, Homo sapiens
ttgtatttttagtagagacggggttttgccacgttggccaggctggtctggaactcctgacctcaagtgatccacccacctcggccgtccaaagtgctgggattacaggcatgaaccactgtgctcggccatgagagcatgtgtaggactccacagcttcagggcaccccagccctctttttgcggtgaggagctgacctccagagagtggaactagtagcattgttctaagtgcctgccacaggcatctgggagatggtccctgtttccatggagctcatagtgggggagagggcagttagaatacagcatgatggccggatgtagtggcccatgcctggaatcccagcactttgagaggctgaggcaggcagatcgcttaagtccaggagttcgagtccagcctgggcaatgtagtgaaaccccatctctacaaaaaatacaaaaattaggcaggtgtggtggcatgtgcctgtagtcccagctacttgggggtggtggcactgagctgggatgggaggatcccttgagcccaagaggtggaggctgtggtgagctgagattgcatcactgcactccagcctaggtgacagaatgagaccctgtctgaaaaaaaaaaaaaaaaaaaaaggatacagctctgatgggcaggaggcatggcgggtcactgaggcgatgcaggtgatccagctgtttctgtggagctgcccctccgtgtttctgtggagctgcctctcttggctccaggtgcctctgggaggaggcaggagcaggggtgactctcagagctgggtgaatcttgggccagcatcatcagatcacacttgcccaggacttcccttccttgagtctccagtggtggtcttgtacctatgagcagggggttaaggagccgagctgatctgagttggagtcctggctctgctgcctaccagtcaaacgagatgcagggcaagttcctcagcccaagcctcagttttcctgactctaaaatgaagagaaccccagatggaagggcttagcctaagacggacatgtctattcccttgattgtggtgttgatgtcacgggcgcatccgcacgccgaaacttgctaaattggacacaaaaaaatatgcgattatttttgtagttgatgaatgtgctgattgggtattctcgtgtgtgtgtgaggtgccaccctcaaactttgttatgatgttggcacattacccatctgatatttaaaaa

SEQ ID NO: 47721 - DNA, 1199 bp, Homo sapiens
ctcccgccagacgctatgtccagcaaaggctccgtggttctggcctacagtggcggcctggacacctcgtgcatcctcgtgtggctgaaggaacaaggctatgacgtcattgcctatctggtgagggagcgacctgggtgtctgtcttcctgcgtgtcctgcaacctgtcctgtctgccccctgccagcctctgtctgggttgtcagcctgtctgctcaccgtcactcattcaagcctggcctcttctctcgaagcctgtcttgaactggaactaggaaaatagcttctcgttgtactgcctcactttctccatctgcaaattggccatccttgagatgccttccagagccaggtgatggaggcgcggggagggcacagaagtgaacttggcagtgctgctggcttagcctgcttgcagagaggcatgggctgggacctgctgccagccctgggaaggcacacagtcttcccatctccagagtatgctgtcagcctgcagtaattcagcaaagattgtggaatcctgagctggaaggaccctgggggatcacctggttctgggatgggaaataggtcacaggtgatgggttatgtgtgaagccacttcctcatccagggcccataggagtcatccctctcaaactagctcctcttcgactgaacctggccacagctctgagtccttctctgtgtggctgtgctgttcaggactcttaggtgcaaattttagaaactgaactcaaaccaacttacgcaaaaaggaaagggaaaagacaattcttggctcacacaactgagaactccaggggtaggatggcttcaggcagggctggatccaggtgcttctaagatctatctccaactctacttggcttcattcttggcctctccacagggcaggcaaggctcatggtcaccctcatagcccacctttcccaaaaaggagggcttacccccagtagggcccatggggacccaccacgcattagtccctatggctgcatcatggggtgcgaggcttgggccatgagcctactccttcagtgggcgggatttcttcctctccatccctgtggaatggggtccacccaggaaagaaggttctgtttccagaggaagtgagcctgggtctctggacagacaaaacttagctcttgccaaaagtggcttgtttgccggcatattggcatgtctaact

SEQ ID NO: 47722 - DNA, 1075 bp, Homo sapiens
agggagagtaacagtgcagtgtgctgggattgatgaatgatgtctactacagatgcagaagaagaagcaccaggtacagcgggggtggccccgtataggtctcagctagctgaggcccctggggctctgtatgccagatggcccctgtccttgcctacttcttccttctgggctcctcttcccgtaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggtgaggcacctgggaagggccgggcagagggagatggaggcggaggggtgtgggaaggagatgagcacccctcgagcggtttcctggtgtgcctccggggcagacttggtgcaaggcagctacatggctttgtttagaccccaatgagaggggtaacagctcgcccctgcgctctgtgcactgtggcacctgaacgcccattctgagtcctcacctccaccttctgctgtgggagcgatgtcaccccatttggcagacttgctgctgaggcctggggacattgtccaaggtcgcattggccaaggtcactgcgtgagtcccccaggggacacgcaggaaagtgttgaaaaccctgagttggcagagtagggttcaaaggcagctctgctgctggcttgccgtgtgtcctcagccagggcccttctccccttcctgaacctcagtttcttcatttgcaagatggggctcatgccatgtcttagtttcccagggcgagggtaacaaaatgtctcaaactggtggcttagaacacagaactgttctgcctcatggttctggaggcctgaggtccatagtgagggcatgggcagggccacgcagcctctgaaggtgccaggaagcctccggctcaggcctctctccagcttccagtggcctctggtgtcccttagcgtgtggctgcgtcactcctgtccttcc

SEQ ID NO: 47723 - DNA, 1050 bp, Homo sapiens
taaatatttttatataatatgtattacatataaatacatatgttttatatatatatatatatatatattttttttttttctttttctggagactcgctctgtcacccaggctggagtgcagtggcacaatctcactgcaacctctgcctcccaagttcaagcaattctccctgactcagctcctgaataactgggactataggcatgcgccaccacacctggggtttcagcattttggccaggctggtcttgaactcctgacctcgtgatctgcccgccttgggctcccaaagtgctgggattacaggcgtgagccactgcacccggctgtagtagccatattaaaaaatagaaaaatgaaacaagtgacatgattttaataacatgttttaccgaaaccgatatatccaaaatattatcattcctcctataatcaatgtaaaaaaataattattaatgtttacattcttttttcttctgtgttgagtctgcaagacccagaatgtgctgcatgcaggcatgtctcgctagctggctggatttcaggtgctctgaatggccacccgtggcttgtggccacctgtgggcagcacaggccgggactgagctcttttgaggccgctttgggctcaagctctggaagagttgccccctcctaagcccccaaggggctcacaggagtttccattttgttctttctaagaggaatctctttccccgtccctttaaccagctggtagctcttgggatgcgtggcctggaggtgagccgtaatgagctctaatgatctgttttgaccccagacaccaggcagctcagtggctgggacagtagctgcttgttgacttgctgccagcgaggccgcaggacggggccctccctcggttcccacagcagcttgtggggccagggtgtccagtttcgaggtctttgtctgcagaggccaagcccaggcactgagatgggattggggcaggggccaagctgctccaggagctgggagtagggctgtggtcttcccatggctgctctgaggggctgaggaggtgg

SEQ ID NO: 47724 - DNA, 1037 bp, Homo sapiens
gcagtgtttctgcacccaggaaatgtcagaatgactgagcagtgatgaggcctcctccaaaattctgagccaggcaggatctgagatggatgacacaaaaatcaatggggctttcaaaaatctctgctttcaagacgcttcggtagccaaggcaaaaaggcgccagaggactcataaaaaacatgcatttgcttcgctggccatcctctcccaacccatcgtccaacggaaaaacactcagaaccaccccatccttgtcactgtcaccataatttaaaaaaaaattttttttagagacagtgtctcactctgtcacccaggttggagtgcagtggcacaatcctagctcattgcagcctcaacctcctgggctcatctgaccctcctacctcagcctcctgagtagctggaactacaaacgtgccctagtacatctggctaatttttgtttttcatatatttatttatttatttttttacagacagggtctcaccatgttgcccaggctggtcttgaactcctgaactcaagtaatccaccctccttggcctccccaaagtattgggattgcaggtgtgagccaccacacccagctttggctaatttttaaatttttttttgtagagacagggtcttgctatactgcccagcctggctataattattatttttaaagccagactacaaggtgggagctagaaacaggatggtctcacgttgtctacatgttggagatcgttttgttttttctcctcaattacaatgagagtgtgaggggaggcacctcgggaccgagagaggctgggaaacacaaatctctttggtcttgggagggtcattgtcattggcccctgttgctttcctccccgccctttagcctctccttgctcctggacggaggtccgctgagaagggaggcaaaggttctttcacgccaccgcccaaaaacagaggctccacggagcctggccggctgctcttcttagcacccagctgctgagctgagtgaggagcgaggacggagcccagcaggcca

SEQ ID NO: 47725 - DNA, 1029 bp, Homo sapiens
tcacagctcttcctcgagccctgaaccccacctgcgccctcccctctctggactgatgggaggcgatgctgtggcctcgaatgttctcgagacaagactgtcagtaagtagggcacacctggaggacgctctgaacacttacctttgaggtaggtcccaaaggaagttggaatgtcagagcagcaggaacttgcagccttcttgttttccagatgggttgcctgggtctaagagagggggctgagaccggccaaagtcacacagcaaagccaagctgggcaccttctgtaaaggccaagctgggcactttctgtaaagcatggttgtaggactcctggtgcccagctccagccctgcaaatgtagtttggactgccctacagttggccgagctgaggacagaaaagcagggaggcgggcctgggtgtctaggagttgaaaatgaggagggctcctgctaccggcctacccaggatggcgccattacgactctgtggccagtgtaaggatgggctttgcaagtttctggaattttccaaaatgtacccaaactaatcactagaaggcctgtttccaacccgatatgtatccagttctagcatgtgccaggatggaggaccagcaggactttgtcagtgtcgtgctcttgggaaattgctttatttctggtaataaggtttctaggctgattgaaaatttgctcctcgaactttatcgttatatctgccattttggagacagagatttcctgtttctgcacacactggtctttctggacacactgctgaaccattcccctttctggtggcttttttggcactgtcatgtttgtgtgcggtcatcatgttttgttttgtttctctttcagacagggtcttgttctgtcaccgaggctgtagtgcagtggtacgatcatgactcactgcagcctcaacctcctgggctccagcaatcctcccacctagcatacaccaccacacccagctaatttaccatttttttgtagagacggggtctccctatattgcct

SEQ ID NO: 47726 - DNA, 1215 bp, Homo sapiens
tcacgtgccctgaccccgccccgcagacgcgactcctccagctgcgagcgtcccggctttcccttccgccggaagtagggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcaggtacgggcgcagccggctggcaggagcacgagatcccgaggcggggcctggcgggcggggaagaggggttcgggcctggggggcgggaggcagcctgaaccgacgtctcagccgggccgggccgttccgtggagttcctacagccgggaggagccggggggataaggcgccactgcgaggcccaggcccggcctgtcgggcgggtctcccaggtgcctgaagtcgctgggaaagggtttgcttagagcgtctggccccatcgtgccccagcggccagcctggacccacagtgtagctagcgcggggttctgaacctcgcgaggggaggggtccgggaagcccacggggaggatctgggtgtagacataaagcagctgtctgacgcccagtagcttgttaaaacttggggaacatcgtctttagactttctgttgagtagaaggaactcgagggcatcttatatgtgagggtgctctttggagaggtgagagagggaggtgttacatgtgtgggggtggtccccaagatgtagaaatttctcatggcaagcttgcctctactggggagaatgatatggcctcattccgacattgaaactttactgtctgacaatgtcgtgcatttaatcaaagttaaattaactgggttttagaaggctccaggcttccccagagagtgaatatgggacctgccaaaaatacttactggcttctggcatggtacttagaacagaacgtgttcttcatttgtatctaaaacttacttacaagtcagccctaacacttcagcttcctcggttaagtgtcttatgtcctcctctcttcttatgtaattgtaagcgcactgatactttaaaagttgggctataactaattactgcttgattcctaacagaaagccacaggagtcattgtattagaagaaggtcttcactcgggc

SEQ ID NO: 47727 - DNA, 1119 bp, Homo sapiens
gaagaactggctggaaaatcaggactgttgactgattcctggtccagtgctctccttctctgagtttccactaactactggtagttaagtgtctgtgacgttgatttgtttttcatttatcactgtgcttaaaatagcatgggtagtgagataacccatttgcctccccctgaaaagggggaaaataacttgtgtggtagaaaattggtagcagagtcctctcagggtcacgcttgcagataaggaggagagtggccttggttttgtggaccatcctggcttttatctcctggcctacagcattatgaactgaggactgtacctcacttcccttaagtaactactgtttaaaatgatcaattatgtgaagaattgcttgggctctgtgcactggaagtcaggctttatttaagtccttgggaactgagatatgtttaagaaaatattaagtggagggaagggagcagccaagtggtcagagaattttagtcttgaaaatgtgcactgagaataattaattgaaaataggaaattaatgttttctaactttaatgatttgtgtacctcctttatggtttttgccatatcattgaatcttcgacataccatttacttggactccagagtcaggcagacctgggtttgaatactgtttctgccactttttatttttgtttttgtttgtttttgttttttttttggtaaactgaaagcaagtttattaagaaaggaataaaatagagcaggctgtttctgccgcttataagatgggtgactttgggcaggtcactccatgtctgagccccagtttttattgtcttaaaatggaaataataaggccgggcacggtggctcacgcctgtaatcccagcattttgggaggctgaggtgggcggatcacgagggcaggagtttgagaccagcctggccaacatggtgaaaccccatttctactaaaaatacaaaaattatccaggcatggtggcgcatgcctgtaaccccagctactcgggaggctgaggcaggagaatctcttgaatccaggaggcagaggttgcagtgagccaagaacctcctagagaatcatggtgaggaataaatgagatagcatatttaaag

SEQ ID NO: 47728 - DNA, 1029 bp, Homo sapiens
ctgtaacctcaaaccccggctcaagcagtcctcctgcctcagcctcctgagtagccgggactacaggaatgcaccaccacgcacagctacttttttattttttgtagagatgggggtcttgctgtgttgcccaggctggtctagaactcctggcctcaagcagtcatcccgctttgacctcccaaagtgctggagttacctttgctagccaccatgcttttggctggggtgttttagaagcagaaatcagcatgttactctcctgcttaagacttgcagtagctgcccatcagccttcctataaagtccaagctcctcaccatgacctgaaagggtccagtgtgaactacccacctttggaacatatctagttccttccatgctggcaagattgacttcttttccaggctcatacctaccaagcttgctcctgcctcagggtctttgtacaagttcctctgcctagaacatgctttctcaatttttatgtagccagctcctcatcatcacgtaggactcagatgtcactcctcacaatggcctgcccattcaccccatttaaagcagcttcctaagcacgctctgtgtgacattatcttctcttactgtggtaatgcttatcacctgctgaaatgatcagtttattgattacctggtttacctttaacttcccccagctgctgactcttaagtgccaggcctggtagttctccttcaccacaaaagctccagtgcctcaaaaagcccatcacacagtaggtacttaacatttgttgggtgaattgccttgttttacaaccctagtatttgtggtgtgttcaagtattcctccgccttcaggaatcttattatcttttcaaaaactatgaaatatatggtattaccctggggcatcatgcagagaggagggaggcttgcctcaacatcacagaactcgtaaatgtaagggatgatgtctgctgtttaaatcctgtatttggttttcagtatcatgattgtctttggttgtttatttgtttcaggtaattt

SEQ ID NO: 47729 - DNA, 1050 bp, Homo sapiens
gctctgagataaagacttggcccctgagcatcagcttggaagtaatttgacctatttgagaattttgtttgatttagcctaactcccttcttcagtgcgcatgggaattgaagttcccactttctccacagaaaagctacgatttggtgcatggctctagggaagctgtggctacatcttgaccttaaagaaagagaagaatggtgacctttctgcagtctagctgccagctttttcaccattcccatttatgtcaggctttttctagaagcatcccttttctttaattcgtttatttgttgttttgttggctggtttatataccctactccatcccaaaaagaatttgagaacacttagaagtgccaatccccagcactctggcagagtatctatcagatgtgtttctgtagagagcttggacatctttatcatattttgtctcctgttactatagaagagatagtgaagtacactagattgacatgaatttgcatgtagtcgagtgagtcggtgtcttctctgtgttctttttctgtcgctatgtacccaatcatttatgtttgtacatatttctgtgatgtattattatgtgaaaaatgaagatgtagaacagtatgtattatataatcttttctcccaaaagtgcatatttttatatacatagaaaaatataatttgccatgactcatttctctggtctctaggaattcttgtttttttttttaatccctccttagcgatgggatcacactctgctcaggctagagtgcagtggcgccgttgaactcctgggctcgagtgatcctcccacctcggcttcccaagtagctgggactacaggcatgagccaccatgcctcctagtacgtttttaaatcctccagttcatagacttgtttgcaaatctcaatgtcctgaataaaccctatgttaaggttctttttagttaacttaagagttgaagtattttattttatttgtaatttttgtgagtgcataggtgtatatatttatggggtacatgagatgttttgatgcaggcctgcaa

SEQ ID NO: 47730 - DNA, 1033 bp, Homo sapiens
tcgcagctgttaatagggaagaaaagtagttgccaaattaaaagaggattcataggtttccagagttcaacttgatggtagaacctctctcgaatacagtttgggagtgtcacaaaactaaacatgcacttacgcacagtccacaactgcactgttgggcatttatccccaagaaaggaaaatgttcacacaagagcctgttcacatagcagctttattcataatagtcccaaactgaaaacagcccacgtgtccttcaactgatgaatggttctgcttgcgatacagccataccgtggaatatcactcagcggtaaaacggaacaaatgctgagtacatccagcaacttggatcaatctccagggaattatgccgagtgccagaaaccaatcccaaaaaactacatactgcatgatcccctttatgtaaccttttgggaacggagaacagattagtggttgccagtggttagggattgagtcggaggagagggggtcacctaagatcacagctagaagggaacctgaagcttaaactccttattgttgtagataaggaaaccagtgtctctgaagaagtaagtggtttgaccaaggccagatagatacatgataagtgacagaagggaggttgaacctgggtctctgtctcatgtgccataatagtatagtacttaaacatgtggacttcagagtctgacagatcaaggtttgaatcccagctttgctagtcattagctgtttgaccttgggcaagttccttaacgtctctgagcctgtgtttcctcatctgtacaatggacctgatgatacctgcctcatcagattatcatgagggttatatcatgttattttcaagctttaagaaatactactcccgggcctggcatggttgctcatgcttgtaatcccctttgggaggccaaggcagacagatcaacgaggtcaggagattgaaaccatcctggccaacaaggtgaaaccccgcctctattaaaatacaaaaaaattagctgggcatggtggtgcgcgc

SEQ ID NO: 47731 - DNA, 2847 bp, Homo sapiens
agaggttcctgttcctggagttggacatagaagttggccatatgagtacccagcgcccctgatctaactgctggttttcatttttaggcagcaaatgggaatgttccgaagggaatgaaactgcaatcacatgtttcagccttgggtggactccagcatttgcatggaggagggagatgatttatccttcctaagcatctgccagctcagagttgactctggacttgaacctgatttcctctcagtgatgcggctctcagcagcccatctatctgtgggatgatagtgtgaacattttcatctctggtcattatgagtgcctccaccgtggctggcaggaatggtgtcatgtgcgtggcacctgtaacacatactttgccaacaaaaaggaattgccatttttgtgatgagcacaaaatttcaaatggcttttgaacaggagccctctgaatattcttgtgaatctcaggaagttctttatggtagcactgccctttgtttctgtggcttttctggctgagacagaaatttctgaagatcatcggccctttgacatcctttaccaaacaacgcagtggaccagaacccacggtgcggcctcattcccccagctgaggaatgctgagcacctctcctctgtgttctcatcatttcaagacattttagttcttctggcttcagtagattctttacccactaagaggggaattctgatagcaatcagggaagctgagcttgacccataaataggaacagctaaccaagctcacaggtactctgtcgttgacattctcctttggtgtgtttcttttcctccccactgccctatgtggccaacatacctccctcaggaatgtctcagccccaacattattcaggggctgagtctgtggtgaggatttctttcctgacctggtgattgtccagttttcatgcagaatgggagttgtgaacactacctgttccaagcaagaatgtttgttatattcaaacagataggcaaagagaaaattttaagagtcagtaaaaaacaattctcttatccctgagataagcagattaatagtgtctagtgtcaatattttggctgtagaccattatcttgttattgatccagaagaaatatggtattgacttagtagcttcgtttgctttttgctagcattgttttgctttgctttttcttctttttaaatgtcacggtctgctttttttcctttgtctctttactgtccagtcggagaatgacagcagtgagtttgagcacaagcagagcagttggctccctgttctgattcagatggagttcaattgtcaaaccatttcattctctgtcctcaagtgggtgtaatcgatcctttgcgacttagctcatgtccttagaataactttccccaaagacgtatttctgaatgccctttttagcatgttgtaaggtgcatttggttctttgtgatatgtttaggatttgtattttttcattgtctgctgactgtgtttcctgagctgcattttccaaaagagaaacactacagaatcatttttgctgatggctggtgaaggagagacactcatcaatagctgaaagaggagaaactggaacaaaaagtgtagctaaagtggttttgtgggaatgtgattacagagttggttttaataataagaggctgtttggcaccgttgtctttgtgaaatgggcttgaaaggcagttgctcattcttagtgtccgctgcacatggactgctctggtgggtccgtgacgaggcctgtggaggtaggaggctggatcctctccttcagatgcttatggtcttgggggtgggggggccggcgaggggggcaccagggggcgtctcctcccccgtggccaggaggagcatatgtgcgtgttcctcatgactacagctgctgtggagcagtccttaacaatgcatccaaggagggtaaatcttctcatttgtttttaaaagagaaagaaggatctctttccatctttacattgagtttggatccagagcaggagggaggtaggaagttagagggatttaggctagcaggattttctcccaggcctcacagcatgtggacacacagatcaatttcttatcctgtgttcagctggacactgggttacagactgtgttgatcaagatgtcccctcctgtttcatatcatataacgcattcatttcagccactgagcctaaattactgtttgctttctttctgcctttcttttccaccccacccgaaatggtaagaatggtaaggatgaagttagtttatccgtgctaatgctttgattttttttttctctttctctttgccacagtaggtaaccagttaggggccttggtacatcaaaggtaagcagtgggttacgttttattatttattgatcatttctaattgtttattgatccaccatctgtactagagtgctagaaagtcagaggttgagaatgtgaaaaagcatgggttaggcttctttaagactcgagttttttgctagccatttctaagatagtgtcagctcagggataaactaatacaaggcattaaaaatcagccattattgcagtaacttaaaatacttgtagaagattggagttgctctttctaccaatgtacatttaatttaaaaggagagaatgagattttcccacctggttttgtggtgttgccagtattttattaatccttaaccccttcacctgagaagagacacctcgaagtgtgagggtcagacactcacaagagaatgctttgggtgcccagggagtatgggtgggtggctagtgcgtggtgaggaggccagaagccagggttccatccttccgaagtggt

SEQ ID NO: 47732 - DNA, 1050 bp, Homo sapiens
ttttttccaaaatgttctttgtttttaggacggtaataacggaagaattcaaagtgcctgacaaaatggttggatttagtaagtatccatgttgtctactttttccctgattcctgtctcttctttttctctctttttttctgagctgctttgccaggatgttctttttgttttaatctctcttgtgagtatcacctgtagtagaatgctttgcacatgccattccccacagctctgaaatgctgcaggtctcttcaggctgagggagaaaccagagcactggactgtggatgtccctcccttccccacctctccccacctcagctcagatcccctctgcctgtaggctgtttcacaagggctttctgctgccatcatgcccaaagagtggagatgggctcacgggggccaactcgatgtgtagtattgtgagccaagtgtcacagtttgtggaattaattcagtcattcctgcgtggtgaaatatggaataggggcgtgtattctgaccctgttcaatttgtttcagttatcggcaggggaggtgagcagatttcacggattcaagcagaatctggttgcaaaattcagattgcttcaggtaagggctttttaaaaatagatatcaattttgtagaaatcagtattttgcaaaactttccagattcggtactttgcttgttgcttgggtaagtatatgcgattagtgttttccttgcactttgggagttggactcctaaatgagaaccagaaggatcagagcaaaggtgggcccggagataaggcctcctatctggcttctggggtaaaccctccctcagctctgtggccagacatggccccttcccaaacacctgccactctaggacctatgttttctgcaccagaatgttatgccagacatagtggcatagtggggcctgtaggaatcctatggctttggggtcactccttgactacatgcatcaggggaggctcccatggatgagactgtcccttccctttgtgggaagaggatagctgggggtcctggctgaattagcactcact

SEQ ID NO: 47733 - DNA, 1280 bp, Homo sapiens
gcatttaaggaaccagattgcctctcgcctttccccaccctgctcagcgtccggccgtgggctccagtactgtgatggtgttggatccaggcctgtgggcggccacagagtgcctgcctcttggctgccctccctcagaggccttctttttctatcacagcctttgatggtgtcttttgtagggaaaaaccccaagcaaagaatatatcattaatgtcccataaatttgcaggaaaataattttaacttaacgggttttagtgatttttaaattttaaaactgtatatttcattttttttttttttttcatttaggagatggagcctgctgtacttagggcacctatgtatctcttcaacctgcctaacattttgctgtatgtgtgtgcatgtgtgtgtgtttctttaccattgaagtggcagatgttatgacactacccctaaatccttaagcatgtgtctcctaagaataaccaggcctaagaaaactgtacttctgaaacattatctggtatccagtacatgtccagatttctgcaaatgtcctaaggttgtcctaagatttaaattgctgacgggtttgttttgtttcttcctagacacagttctcacattcccttgagttgtaaggtacagtaggtctttagcgcagattcctgtgtggctggtactggcatgggttggccaacatgcagtgatagacttgccaagtgtgtgttttggggagaagaacacttgaatctgcctgggatatagtgacgtccacaaggaagtctcaccagtaggttatagaaataagataggcttgcccttttgttgttgttgttgttgtttgtttaaagcaatgtgtttggctttcagccttttctttttaacttactggagtgcctctgtgttgtaaagccttggcaaagttctctgtctcatggacctgccctcagtgggcgctcttagacaccccttcctgctagaaagaaatggcatcaagaaacacctaggccagtccactttattgatcagaaagaaaaagatttaaaaatgtaaaaacacctaggggtgataggaatccatttctgaccacacgcagatgtgctcacccaactgaggctttttatagaaggtggacccttccccgtgtggacatttgggcagtggaaagaacacatcacttaagatacgatacacacatccccctacatgtcccataagccataagtgaattgtcctacagctgagcgcctttaaacccaagttaagagggtttgatcttgaaatttcac

SEQ ID NO: 47734 - DNA, 1054 bp, Homo sapiens
ctgttttctcagctacttagaggctgaggtgggagaatcattggaacccgggaggcagaggctgcagtgagctgagattgtgccactgcactccagcctgggcaacagagcgagactcagtctcaaaaaaaaaaaaaaagtgccctttaaaaagacaggtttgtgaaaagttctgatgtggtttggtttctctgtgcctaggtatctgtgcctaggtttgctgtggggattgtaataggaagaaacggggaaatgatcaaaaagatccagaatgatgctggtgtgaggattcagtttaaaccaggtgggtatgatgatttaaaaatccttagtgttaaaaaaaaaaaaaaatccttagtgttaaaaggatgataaaacaccttacaaaacaagggcttggctattggttcatgtgtattcacctttctcatccttgcaacatcctgctaccagatgaccaatctcagtttcttctcccagccttcttttccctccccggatacatgtcggtcacctttgatttccaggccttttttcttttttcttcctggagtatatgcatagtatgtcataaatgcatagtatgtcagcttctgattttgccaagtaaaattttaaaatatatatgtataattttgattttattaaattggagataatttaaaaccacacacaaagacaaaacatcttagaataaaggacaaatttttaaattttataaatttgccttaatgagcaaaattttcgacgtggtctgaaaagaggaaaacatggcaggctcttctctggaagctgttgccatagctctgctctgactcccttggcttttttaaagtcaagctttgttttagttctttaatgatacattttttaaatggctataattgcataagaattgagcattgacctgaaacatgcaaaacaatataatgacacacattttcctatcacccacatcactccaaaagagtccctgcagctggcagtattcctgttgccccttttggcaccgcgggtgagaatattgattgggaatcagattaatccttgtttc

SEQ ID NO: 47735 - DNA, 1028 bp, Homo sapiens
ctgtgatctttccaggaaagagacggctttggaggcctggcagcagccagaggaagaggtcgtggccgtggcgactggagcgtgggagcccctggtggcgtccaggagataacatacacggtgccagccgataagtgtggcctcgtcataggcaaaggtaagaggcagctggggtttcacatcccccctcagctgtttggcttgagggaaggcaggtcacgggacctccagaacctttggtgaggtccctttgctgctgcaggctggggctgcccggtctggaggcagtagccaccttctgccgaaaccctgcttggcatggttctctgaggctgctgacgggcctgttgtgaggagcaaagtgtattatttctggtgagtatgaagagacagcagtaaaactccctgcctgttgagggcagcttagcttggtgaaaagataccttgcgcaagatggggggcatttgtcaatcgactgattggtaattaactcacctccaaggaacttagagggacggttgagacagtatcctcagtgaaaattccttctcgacagtgtgtcacttgtttcccttaccaggtttgagtatttggtcttgatccgcgtaacatgtgaaaatggtttttatcctttctgcatatttaccgtgagtcacggactctctgtggagggaaataaacattgatgtgttagttttttctgggcattttggagaacattaggaagaaaccctcattcatggctactgtagctccttcctgtccttcactgagaaccaggagagagcagccacatttctcagccattggcagcagttcatcttggctagccctgggacccagaaaggctactgagaccagggccgaggctgtggggccttcccagtgtagcagcagggctcggcttccgtggggctctgagccaggcctcgctgccagcgggggactcccgttgtcactgggtttcgtatttgccttcattaggtatttgacagcatgtggagaaaacagtcgtctctccagagttt

SEQ ID NO: 47736 - DNA, 1516 bp, Homo sapiens
aggcagtgagtaagtggaggagacgtgagcagacttgtgtggttggagtcctggctcagatttcctttctcttcctttggctggtgcagaactcatccatgtgccacaggaaaatagtccgtgtttttcattgtcgtgtaatcgaacaaaatagggtttttgggctaaatgaactacttggaatggtgatatgtctaaggatagttaatggagactttatacgtggaggaatgtttgaagttagcagtttctgaaagtaagtccagacaatatagttacatgaatttgctgaatgtggcgcctgttccaggctttcaccctgttgaaccgacatctcaaatggtgtgtggtcttgtcagaaagtctgctcacagatggatgaaccccttgtgttttgtctttcagatacattggtgaagtaggagacatcgtagtgggacgaatcacagaggtaacgtcgatatcagattggtgtttacaaagtcgaggcaggctggcgatttcattcatgggacagtcattccacttgtagttacatgaaaaaggcattcattgcatttggccgttgtgtggcttctgatgtaaatatgtggcttgttcgatttcagattactggttcatgtttttttttttttgagatggagtctcgctctgtcgcccaggctggagtgcagtggcatgatcttggctcactgcaacctccacctcccaggttcaagcgattctcctgcctcagcctcccaagtagctgggattacaggcacccgccaccacgcccagctaatttttgtatttttagtagagatggggtttcattatattggtcaggctggtctcaaactcctgacctcaagtgatccaccagcttcggcctcccaaagtgctgggattacaggcgtgagccaccacatctggccttactggttatttatgatatgacacatgaacatggagcatgtgtccaggtgtggaacttggcttataggttcaacagaagaggtggaaggtggagaccaactccaggctggattcggtcttgctgctctcgtccatgaaccttcctggaggagagctggtaagggctacagctggggccatggactagggcccagtgggctggggggagccgtgggaccctttgttccaccagaggactttgatttacactgaggttgcccctttgactcctgtttgtctgctgtgaagtttgctgcctagatgtgtatgtagacttttcaccctgtccaggtctcccgaaagagggagcagttggcatatggtaggatcagaaacatccatggggtgggatcccaacagagagttggggagagaagcccttagatgctggttgttaacagttttcctttttggatataacagccttgcatagtgaagatgttccttgaaaagttgtctttacattaggtttttgtgaattgaaaggcatttcattcaaccatgtgtggaatgtggttgctggcattccagacaaccacagtaactaagccacagcctt

SEQ ID NO: 47737 - DNA, 1036 bp, Homo sapiens
tttatttatttatttatttatttatttatttatttatttttttgagacggagtttcactcttgttgcccaggctggagtgcaatggtgggatctcggctcactgcaacctctgcctcccgggttcaagcgattctcctgcctcagcctcctgagtagctgggattacaggcatgcgccactatgcccgactaattttgtacttttagtagagacggggtttctccatgttggtcaggctggtctagaactcctgacctcaggtgatcgacctgcctcagcctcccaaagtgctgggattacaggtgtgagccaccgcacctggccttctgtctgtatttttaaaaaaaagatattcatgacaaccaaggggagaggtaaggtcacagtgatgtgctctgggtcaaagattgttgagcctggaccattggagaggggaggaaaagatggaggtgtggggtcaaggggagaggctgcagaggacaggacagtgtgtggccaaggctgctgtttgttccttcatcaccctggccaggctgaggtccaggcagtgttctctgacggagctgtctctttgcacacgaggagcctgaaatatggaaaagtaagtcgggctcttgatgttcctgtttgctgactgagactacaaggctatttttgaatccccatagctctctggaattctggcctaaagaaccccagtagctaagcattaatagaggctggcatcccacaaactgatcgtgttccttaaacgtaacatcaggacggtcagggttcacagggtcatgggtcagtagccttgtaaagaacaagttttatcctttttctccaaggagactgactttcaccagaagagcccctccaactgtgggctgggaggtgcagctgtctctcttcctccagggggcgctgcagctcagcactggggctgaggctgtcctgggaacaaaggcaggctgggtctggttaaacagcccttagacaaacgtccaatcagtccagtggatgttattgctggcaaagcttgctctgtca

SEQ ID NO: 47738 - DNA, 1948 bp, Homo sapiens
tgagtgtctggtagatctttccctaagaaacttgcaatattctcaatgcctagtgtcagtctaaggattttggggcaggaggtgtcaggtgggactagtttatgagagcaacctctggactacatcttacctctcccaaatttcagccagcttttggatgaatgtcagaataatatctttgttcttgtcgactatatcccagagcatcttgctgatttattaggctgcttctagcagatcatatcttgtaacgcttagtctctgagacatgaaaggaatacagaaagtttatgttaacggcttgatttatgtttggattggcttggtggtctgtttatggttggtttcttttctgaacaaatgccttttccctttttcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaatgtgagaattcctgtgcattgttttttctgatgactatctaaaaatggtgccctgatgtaggtttgggggaacattcttaaaaacaagggtgctatgtgcctgtaatccagcactttgggaagctgagtgggcagatcacctgaggtcaggagttcaagaccagcccggccaatacagtgaaacctcgtctttaccaaaaatacaaaaattagccgggtgtggtggcacaagcctgtatgtagtcagctactcaggaggctgaggcatgagaatcgcttgaattcgggaggcggagttgcagtgagctgagatcgcaccattgcacttcagcctaggtgacacagtgagactgtctcgaaagaaaggaaaagaaaaggcggccggacgtggtggctcatg

SEQ ID NO: 47739 - DNA, 1073 bp, Homo sapiens
gtgaaaccctgtctcttactaaaaatacaaaaattagctgggcttggtggcagctgcctatagctactcgggaggctgaggcaggataatcccttgaacccggggtacagaggttgcagtgagccgagatcgcgccattgcactccagcctgggtgacagagtgagacaccgccccccccccccaaaaaaaagcatttattaggaaacaggaaagactgaacaagaacaagagaactaagcatgtaactcaagaagccagagaaccaaagtaatcccacagtacacagaagagaataataaaaataaaaacaaattaagaatggaaatgatcaataaaaccaaaagctaactttgaaaaatattattgatctaggcacacttctggtaagactaatgaagaaaaagaaaaggtagaatatttagaaaaggaacaatatttagaatgaaaatataactataaatactctcagtttttgcctctttttttgtttgtttgttttttggagacaagatctcactctgtcactcaggctggagtgcagtggcaatcatagctcactgcaacctccgtctcccagactcaagctgttctcccacctcagcctcctgagtagctgggactatgggcatgcgccaccatgtccagctgattttttttttttttttttgtggagacggggtttcatcatgttacccaggctggtcttgaactcctgagctcaagcaatctgccctcctacgcctcccaaagtgctgggattacaggtgtgagccactgtacctggctggttttttttttttttcttttctttcctttttttttgagacagtgttttgctctgtcgcccaggctggagtgcagtggagtgatcttggctcactacaagctccacctcctgggttcatgccattctcctgcctcagcctcctgagtagctgggactacaggcgcctgccaccacgcccggctaatttttttgtatgtttttttagaagagacggagtttcaccgtgttagccaggatggtctcaatctcctgaccttgtgatccacccgcctcagcctcccaaa

SEQ ID NO: 47740 - DNA, 1049 bp, Homo sapiens
gtgccgggaatcagtgggggcattttggaggcttgccactcgctgcctgtaaaatgagcatcataatggcacgtgtaccgctaccaccccctgccagcacaaggggaacatgaacctaacataatgggggcagggaacgggcagaagaggcttcccagaggagacacttaggcagagactgggccgctgagtgggcgtttgggaggtgagggtgttccaggctgaggggaggtttgtaggaaggtcctgagtgggaaggcactgcctgcagtagcgcatggcctggaggagacagcaaggcgggccagggtcagagaggccaggacacacacatcactgtgtccttgagggagatctttcttctctaggaatatagctgagcttaccccagaaaccaggggagaaaataggagccgagttttctggagtgcgtttcttctgtgaagtgaggtttgtgtgtaggaggcatctgtccagagcttttcaagttttatttcattattgctggagggaactagctctggtcctgttggttgggactgaactgtattgctgaccctttcccatgttcaaagttcccgcttccattgggggactgtgctttgtgcttcttcttgtaacaatgtgtttagcttatttagcagcatcagattctccttctgatatatgcattcgataaacctggacacctgtgcagatttctttttcgtggtggcactgtgttttcttttgcttgttatgcgtaaggtcagatatgttgtgttttgggtccctgacaccttgggcttggatgaataatgtcacttaagaggaggcaagtaaaaggccaggcacagtggctcatgcctgtaatcccagcactttgggaggccagggcaggtggatcacgaggtcaggagttcgagatcagcctggctaacatggtgaaaccctgtctctactaaaaatacaaaaattagctgggcgtggtggcgcatgcctgtaatcccagctaattgggaggctgaggtgggagaatcacttgaacctgggaggtggaggttgcagtg

SEQ ID NO: 47741 - DNA, 1026 bp, Homo sapiens
tggggtttcgccatgttgaccaggctggtctcaaactcctggcctcaggtgagccgccagccttggcctcccaaagtgctgggattacaggcatgagccactgcgcccagccaaaagttggtgtttttaaaaaatgcttcctggtaactgccttagggagaataatgttaacatttcagttgtgattctcttgaagcacagtatttccctgccttttagatttgaaatggatacttctaagcagttgtgactggctggatttcagtcatttacatcggaacactggtctggtcagctcacctgcatctttggtagagagatatctcccaaacatacactctccctgaaggattttcatccttcatatgcttatcaattcccttgccaagtatttactgtttgtccacatgagtacaaggcattgagcttgtgctactgtagactcacagatggtcatgattttcaggaattgaatagagaagatgaaacactgagacactggattcaaatgctagaccttactgggttgacgttagtaatagacatgtgaagaattatagcggttgagaggaaagagacatctcctcactagggtgactggtcagggaaaaagatgggagtggtttttggtgggagaagaggaggagacgggatctgggcatatgaagaggcctggggtactgaggtggaatttcaccacaccccaaatctgttgaaaagaggaaagtgtacaggcaggagacacagaatctggccagagtgaatgtcctgagcaagggcatgggaagaggaaaacgcagggcacagggattaggtgaggatccaactgaatgcttgcccaaggggcttcactgtcgaggattttgactgagatgggggcaaacatgatagacaaactttagggacaatttagcattgtcttcaaacacaggtatgagggagacttttgctggtgataggacagattatcctgaaaattgacctgacaaaaatacttagacctgatccctaaaatataataaacat

SEQ ID NO: 47742 - DNA, 1052 bp, Homo sapiens
gagaaaacaaacaaccttgcatcacagagcaggaaaatgaacagtagaactatagtactttatagctttagatataaaaactgtcagattcagaatataaaatactggtttaaaaacatttaaagaaataaaatgtgaaatagaaaacaagtaaggactaaaatcctatgaagaaaaatcaaataattgaaaaagaactaaaaaagaaatgaaaactacgatcagtgaaattaaaacttcagtggatgggtttaacaagttagacacaactgaagagagatttagtaaactgagggataaagctgaagaaattatacaaaacgcagcatagagagacagaagtctaaaatataagcctataaggagagagaaaagaagtcaatagagataacagatgagagacaatatttgaggagatattgctaaataatttccaagaatagtgaaaaacaagaatctttagattcaggaatcagagcaaatcccacgtggaattaaaaaaaaaaagtcttctccaaatataaggccaatagaacaccaaagacaaaaataagatcttaaaagcaatcagagagaaactgattacctcccaaggaaccctattaaactcaaaggagacttctctacagcaacgatggaaaccagaaagaagacagtggaacagtatcttaaaagcgctgagagaaaaattattgtcaacctagaattttaaacttagctaaaatataatttagtaatgagagcatgataatgacattttcagataaacaaaaactgatgtctccagcacggtctcacaaaggaacttttatactttcaaaaaagagaaaatgatccaaaaaggaagaatgtctgcaatgcaagaaagaatagtgagggaaaagaaaaagtggaatgaatagagaattagtcatgtggtatcacatggcagctcactcaggaatcataaagctggccttgggataacagagctaaactttagagtcctgagtcctgttaatactcaatcctctgtgaaattcaattaagtgagcttcaagttaacctaaaaa

SEQ ID NO: 47743 - DNA, 1027 bp, Homo sapiens
ttaagtagggggatgaagggggaagcccttcagttaaacaaagttactgacctgtcttttagacaggcaggacagaggatctcctcatgaggtttttttaacctttttgttctgaagttaatgtgtgttttaaatgaataatcttatttataacaacattttcagcgtggcaactgcagtttcagaatggtggaattataccagtcagagagagatgcaaatgatttaaaataggaagaaagcaggtgtctggcccagaggaccagattaagaagaccccatgagagttacaatagttagtgaaaatggtgcttctgcaaacctcatgtctacagaagctggtcaaagaccagatgccaccaggtagaatcccagcaaactcttcaatggtagatatctgtcaccatccttaggaggtaggtctgtggaagctcactataataccatttgcttaacagatatacaaacatggatcagatataatttcaacccacaaggagctcacagtctggctcttcttttgaggcaaaaagactaaagctgttgcctttatggtaagataaatctgccttggagtcaatccaaggtgatttaattactgtaggtagttgtaccaataaggcttgtatcccagagaactccatattgcatttaagcttgttagtaagccaggccagctctatttcctgtgaggactttaaaaaaaattgcattcacacatttaaaaattagcataagcagggtgcagtgatgcacgcctgtagtcccagctacttggtaggcagaggtgggaggatcacttgagccccagaagttcaagaccagcctggacaacaaagtgaagtgaagactgtctcaaaaaaattaattatgacataaaatgttatatgtcttaatttacacaaatataagtatatacttttaaatcccattcttacacacaaaagctagcatactgtgtaaagtattctggacctacacacctttatttttttaacataacaatatgtcttggatacattttcct

SEQ ID NO: 47744 - DNA, 1031 bp, Homo sapiens
agatgaaaaatacactgaagactgtcagaataaacattgcacaagtaaagatttgtgattttgaagacttaaccatagaaactatccaaaatgaagcagaaaaaaaaaagaaaccctgaaaaaaatacatgaacacaacatcagtaaagtgagggacaacatcaggtagccaaatgtgtgtggaattggagtccctgaaggaagggagggtatgagggaccaaaaaatatatatagagagagaaaaaaaaatggctgaaaaatttccaagtgtaatgaaagcagtaaacacacagatccaagaatttcaaggaactccaagcacaggaaacatgaagaaaaactatatactaaggcacatcttaagcaaattgcttaaaaccatggtttaaaatggccaaagaaaaagatacattatatacttaagatcagggtgacaccagatttctcattggaaacaatgtaagccaggttaacagtggaacaatacatttaaagcaaagaaagaaaacagttgtctacctagaattcttttctcagtgaaaatacctttcaaaaatgaaggcaaaataaggtctctttcagactttaaaaaaaaaaaggaagaatttattaccagtagatatgcagtacaagaaatatcaaaggatgtaattaaagcagaaagagaatgataactggtagaaaactggagccaccaggagtcccaggctgcagtgagctatgatcgcaccactgcattccagcctgggtgacagagtgagaccctctgtctaaataaacaaacaaataaaagaaaactggagctataaaaataaatgaagacaatgcaaagggtaactaagtggataaatacataagatattttttctttttgtttcagtctcattaaaagatatgtcttagaggtaattacacattgtagcatttgtaacttacatagaagtaaagtttatgacaatagcagcacaaagactgggagtgggagaacaaatatactcttgtaagctttttacactacatgtgaagttg

SEQ ID NO: 47745 - DNA, 1232 bp, Homo sapiens
agtattttacaaagtaagggtgctattttgcattactaccagcagttcacaccatatgtattcacaccagttgctccatttggtcttcgttctgtgacttgtctctattctcttaacagtatctttagaacagcagaagtttttgattttgatgaaattcagtttatcgggccaggctgggtggcttatgcctataatcccagcactttgagagaccgaggagggtggatcacttgaggccaggagattgagaccagcttggccaacatggcgaaaccctgtctctactaaaaatataaaaattagccatacatcgtggcgcatgcctgtagttccagctactcaggagtctgaggcaggagaatcacttgaaccctggaggaagaggttgcagtgagctgagatcatactgctgcactccagcctgggcaacagagcaaaactccatttcaaaaaaaaataaaataaaatttcagtttatcagtgatttctcttaagtttcatgcattgggtattgtagctaagaaatcttcacctaactcaagtttacaaagattcttctgttttttttctagaagatttataagttttaatttaacttttaggcttataattcatttcacattaaatggtgtatgtggtgccaggtattgctcgagagtcatcatcttgcataggggtttcggatgttctagcaccatttgttcaacagatagcctcttttcattaaattgccctttcacctttgtggaagatcaattcagcatgcatgtatgggtcacttgtatgtttttaattgatttctaaattctgaaaggaaaatgataaaaaggaagattctttcactatatctgcatttccaatttctcccccaagaacgctttcctaacacctgcaggcagaactaaccactctgggcccctgtagctgttgtgcgtatgtttattattgagtttttctggcctttgcagttctttcagtgtctgattctccctctctctcagcttctttctcaagactgtgcatccttggaggtcagaaattgtctcatcctgccgggcgcgatggctcatgcctctaatcccagcactttgggaggccgaggcggttagatcacaaggtcaggagttcgagaccagcctggccaacatagtgaaaccctgtctctattaaaaatacaaaaattagctgagcgtggtggcacatgcctgtagtcccagctactcgggagg

SEQ ID NO: 47746 - DNA, 1375 bp, Homo sapiens
tgatttttatctggtcgttttatactgattacatatgtgttatctgtactatgcacacacaggatgttttcatatatcttataaggtatttatatggccatttcttacactgttttcccacacatgtctttccacgtccatatattcagatctctccctctccctacctcttatttatgtatagctgcccagtactccatttcactcattcatccggtcctcttttgatgtgcatttggttgttttacacatttgtttggtttttgcccttataaacaaagcagaaacaaatattcatgtacacgaatctctgggcactttggctggtatttctaaaagttgaactgttggttccaagaactgtgtgggttttaaattttgatacattttaccaaactgttaaaaaaggttgtgccattgtatgctccagtcagacgcatatgggagtgactgttcctggtccccagtactaggctttgtcagtctgtttagtcctcatgttagtctcattttcatgagaatttctttacttcagactttgataaccgtgaagaaagaacaagatagaaggtgagctgtttggcttagtaattttctacacctactagagcgggactgggaaaaatatatttgtaaatgcagttcttgctgtcactgtctctctggggttttacaatccatattcctgccagcatctaacgtcttttcaaattcttaatgtctataacaggacatgatgacattcatcgttttgacttgttgcagcaaaagatggttagcaggattggaatgttgctttcattctagacttttccttgagaactgctagccccgtattgctagccagatctcatggatgatctgacttgggtttcatctgtccaggttggcagtggaatccctctgaccggccctcctttgctgaaatccaccaagcctttgaaacaatgttccaggaatccagtatctcagacggtaaagtacccatcccggggtacctgcagtggggtgaaagggcagccatgtgggactgcagcctgggtcattcggttcacttcctggtgaaagttcacagaccagcctgtcctgagaccagaaagctgggcagaggtgtggagtattgtgctttcttgtctgctgcagccctgcagagttctaagaaatgctaagggctgtttctccggtatccacgtgccttttctttagttgtatgcagatgagcactgttaccttacaaagaaagagaaccaccacaccaagccaacaccagtactgatggctgctggatttttgtttctgtccctgtatgattcttagaagtggaaaaggagctggggaaacaaggcgtccgtggggctgtgagtaccttgctgca

SEQ ID NO: 47747 - DNA, 1044 bp, Homo sapiens
ttacagagcagaacggtggcaggttgcccccagctgcccagggcctctgcggcctgggtgcccacagccatctttcaggcacttgccctgctatgctcggaccctttctgtacccttggcgcttacctgctggcagcctggccccaccggcatcactgggagtgggctgtgccaccatacaagccacatctgactggcggtatcaggctgtcgcagcgacgtggaagtggggtgaggaggtcacgtcccgtgcttcttgctggctgagggcaaatccctccccacgtgcgcctgttctctctccacctttccgccctaagcccccaggtgcccttactcactcatgttccttgagccaggtgtcttaggtctttgtgtggatgaggaggagcggaggtgtgaggtgtgctgggccttcagggcctgggaaggccatcccagactgagccccaccgccctttcccagctcagtccccaccgagctgacagcttggaaaggggcggttgggaagtgagtagcaccctctgataatgatactgatcaggccagcaggtttgtcaggggtgcacatcctgctcagcagagcatatgaagatcacagcttggtgaagctccactcgagagacctggagcgagactgctgtgcggtgggtgacaggtggaactccagccgggccggggctggtggagcccactgcgagcagtgccaggcacaagattctccccctctcatttcacagggacaaaaccaggctggggcccccaatttccttgccggttgaaccatagctggccaccagatccaccaagcctggggcttctcttgtcctttgaatggctgcttctcccaggtctgaacgaagacataggacaactctggtgacagccacagctggtggccgcttcctcgtgtcagatgtggacggtcaccccgccctcccagcgctaagcgctgagactgcgtgtccagagtcggctcctgcacgtgaggccaattggtcacactgggccagtgtggaggaagacgcctctcatctcccaaa

SEQ ID NO: 47748 - DNA, 1581 bp, Homo sapiens
tgcagctcgtaggcagcctgtgtggtcagggcgtggatcctcttgagccctgaagttggggggaaaatggtgggagaagctgaggggcgtaggaagcgactccccagggagaaatgataaatgacagctgagctcatgcagttggggacagaaagggacaaccaccaagtgcgtgcaatcagccctgggctacttccttcttcctgcaggcctgtgttgggcaagccactgaggaccgacagttttcatgtttggttttctctgttccctttaagtggagctgtgatgcttttcaaacgttggggctctgagctggtgggaagactgcaggaggcgggaggaggtgggggtgacagcacccttacccagactccagccagagccagacagacaggatctgtgttcgcattttcctatacctggcctctgggcctttgcacatgctgttccctctgccaggatgcttgtccctactcctcctcacttggttaccttctattcatttctggaaggctgcctgacctcctgtcggcgttgaggacctcctctgccaacacatgtgcccctgtgggtatttatctttcagggtcccggctgcctatcttgtcagtttccccaccagtgcggaattcccgtgacagtggcatgtccgacctagccactgctgaccccagtgcctggggtggggcctggcacaatggtgcttacccagcgctggcttagtggatgggagggagttggcggcaccctcacccctctaggccggctctgtgcccccatcctactctctccctcctgctgtccccgccccacctcaactctgccctgcccatccccggggtctcatgccaggcctcccctaccatacacatacgtgctcagactcccaagatgcttcactgctggtgtggttactcttgattaagagggcatttaatgaaatgtttcacaagttagtagcagcgagtggtattccatccgcttctccctcctgcctgcctctccccggctccgcacctcccggggtcagtgtgtgctggctggaggctgtgcggatcctcccccatcccgcccggacaagaagcctttggtcccagtcaccaggtccagggaccaggagcagctactgtgggaggagtcacagcaaagctgaccgcacgacccacgttcctccccaaggacctgccagggcatgggctttgacagcctagggtctcacccagggtccccacctccctgactctcctgctgctgagtctcagggcagccgctctccctctctgggccccagctcggctggcgcagggctgatgtgaggggccaggagagtgtcatacacaaaagggcaggtgggaggtaatcatgacaacagccgccacctggacggcactcgcaagggcccagcaccgttctcagcccttcgtgcagatgagtgaatccagtggaattagagtgagtctaatttaattacagaatccctgggcggctcttctggcagggctggcccgctgcacacattatccaggtgctgactgctgcttcccaaggccccggggaaggagtgcctattactacctattt

SEQ ID NO: 47749 - DNA, 1029 bp, Homo sapiens
tgtaatcccagcactttgagaggctaaggtgggtggatcatttgaggtcaggagtttgagaccagcctgaccaacatggtgaaaccctgtcccttctaaagatataaaaaaaattagccaggcatggtggcacatgcctgtaatctcagctacacaggaggctgaggcaggagaatcgcttgaacctgggaggcggaggttgcagtgagccaggatcacaccactgcactccagcctgggtgagagtgagactccgtctcaaaagaagaacttgcttagaatcataggtgggaattgaacaatgagaacactcagacacagggtggggaacatcacacactggggcctgtcatcgggtggggggaggggggagggatagcattaggagaaatacctaatgtaaatgaccagttaatgggtgcagcataccaacatggcacatgtatacatatgtaacaaacctgcacgttgtgcacatgtaccctataacttaaaaaaaaaaaagaatttgactactctggggacctcatataactggaatcatatagtatttgtacttttaaaatttttttggagacaggatcttgctctgttacccaggctggagtgcagtggtgcagtcgtggctcactgcagcctcaaactcctgggctcaagcgattcttccacttcagccttcgaagtagctgggaccacaggcacgcaccaccacacccagctaattttttttttttttttttttggagacaaaaaaatatgttccctatgttgcccaggctggtctcaaactactgggctcaagtgatcctcctgccttggcctcccaaagtgctgggatcacaagcgtgagccaccatgcccggccttatttgtcctcttttgactgacttatttcacttagcagaaagtcatcaagattcacccatgtggcagcaagcattttcaattttcattcgtagtaagaggagagagaattgccatgctctacacgttgtctggacaccaggcccacactaagctattcacaca

SEQ ID NO: 47750 - DNA, 1215 bp, Homo sapiens
ctgcttgggagtttttctttagctgccccatctgttggcgaggatgcggcatctgaatgaggcccagggctgcagtggggaatgtgaacccgctgtccttgtgggtgcacattacaggcttctgctactcaccaggtgccagcaccacttgtggcctggccctggccctttaagagcctgtgggctgcgtcagaggtcctacgccccggcatggtgcttcctgtccttggagttcttgtccaaggcctgagccaccagccccttggatggcctccaagatggtgatatccgcccaccccaaaattctgctgcagctgatacagaaagacaagcctggagggccaggagcaagggttcgccagaaggtgctagaggtaccagcccagaaagagagttaagtcagcgaggagcaggcaggtgggagggcttctgaggacaggcacggcaggggctgccagcttctgatgggtttggaaacagcccctcctgggcatagcacttgggggcctcgctggaggctgggatgggcttgggggactctggcgagcatcagaggctgtaggtgaccaggaaaggcggcagtgaacagatgctattggggactgagatgggagggttcaggcaggttggatggcccatcactgccaggtcagccgggggctgaggacaaagcaaaacttgcccttgagggatggccagtgggccaagacttgccaggaggacttcagggcatcacggaggagcacagcatggtcggtgggtgatgttctttccctgcccttcccccgcacacacacctgcctctcgatgtggcttgagtttggatgatcctaagacataataataattttgaacacttagcaagtgtactaggagccaggctccttctgtgcaattagctcgtttaatccttaccgcaggccaggcactaaggcaggaggatagcttgagtctgtgaggttgaggctgcagtgatcctgcagatcgtgccactgcactttaggcttgggaatggagcaagaccctgactcaaaacaaaacaaacaaacaaaaaaattccttacagcaactcagtgaggaggttctgcatatcattatgatcccatttgatagataagcccactttatagatgaagagactgaggcctagagtggtaaacaggtaaagttgccctgcccagagccacagagctagtatgtgctaaagctggaatg

SEQ ID NO: 47751 - DNA, 2736 bp, Homo sapiens
taatcttgtttttctttctttttttcttttctccatctccaaaccagagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgacatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggctccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggttttgggggaaaggtcagctcagtgctgttccaccttttagggaggttactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttcactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggct

SEQ ID NO: 47752 - DNA, 1055 bp, Homo sapiens
tgttgaaattgtctatagcaaatagattgatgcataaaacaatctttttttatggttatggagaaaaataaactgatttgagataccttgtgtattcagtaatttccattgaatattaaatgtttctgcatttactatttgttaacttatttcacttttgcatatttgttttaaaaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctggtgagtaataaaggctttcacactgtagcatacaatcatggtcatctacttaagaattgatttctagaagtgaaagtggatagctttttgtgttttggttttttttttcatgacgagggaggttaaggatggaaggtattcttttttgagacagtctcactgtgtcgcccaggctggagtacagtggcatcatctcagccactgcaacctccacctcctgggttcaagcaattctcgtgcctcggccacccaaatagctgggattatagacatgcgccaccatgcccagctaatttttgtattttttgtagagacaaggtttcaccatgttggccaggctggtcttgaactcctgacctcaagtgatctgccctcctccaccccgcatatgctaggattacaggtgtgaggcactgtgcccggctgagagtattctttatacccatagttaatgtccttgaagccaaacagcatacataatttaacctgaatgtacttgggatttctggagaaatattttggtacagctggtttagaagtgttttttgggaataattgtttctggatctgtaacggtggtactctgaaagtcatttgtacctttgggcggaaaagcattttaaatattaaatgggagcaggagaatgatttctggttttgtttttttttttttgttttt

SEQ ID NO: 47753 - DNA, 1026 bp, Homo sapiens
caagacagtatcttgatttttaaaattatttcatttgctctcgaatatttaatgccaacagtgtgctaggcactgctttaaagctgagtatatagcagtgatcaaggtgatgggcttgcttttatggttttaagtttgttgttgttgttaatttttatttattttttagagacagaatctcactctgttgcccaggctggcatgtagtggtgcgatcacagctcactacagcctcaaattcttgggcttaagccatcctcctgcctcagcctcccgagtagttgggaccacaggcatgcaccaacacagccagctgtttttaaatttttcgcagaggtagggtcttgctttgttgcccacgctggtctcggactcctggctttaagcagttctcccgcctcatctctcagagcactaggattacaggtttgagccaccacacctggctggtcttacattttaatgggatagtcaatactaaatgtgagatcaaggactgataagagtgatggagaaaataaagccgtgttagggatagatgatgactggtatgtgtttgagattgtgtgtcaagggaggccaatttgatacttgaaaaagatgtcttgtttttaactcttttggatttctaataaggttgagtttttgaaatatgtttatctagatgccttattttaagattagaggttttttctattctaggggataatattaacactagtatttattaactgctacttatgtttcatgtactgggctggaagttttgtatgtatcatttcattttacactttacagtagcctctgaagtaggcttagtaggtctagtatacacatgagaacactaagtatcaggaaggttgaaaaatctgcatgtctcgtgggcagaaagtggcagaacagagtttaaatgcagttcggttgatggccaatgtttgtactccttgtactaagtgctgcctttataccatgtccgtatatctggactttgagtaaatattctcatataactttaaatgatttatt

SEQ ID NO: 47754 - DNA, 1060 bp, Homo sapiens
taaataagaagcaagtgcttctcctccccacatggatactttgtgctccacccatacataggtactttgtgcctcttcaaccattggcatttatctgtcactctctgggtggccaggtggcccattaggagggccatggctctcattgtctaggggtggctgcttttggatgaggctagagttcagccatctgatttgctgctctagaactatcttagattgacctcagtaataatttcttattagtacaagtatttcatatgttcacacattaaaaatgcaattttatttttactttctatcagaataatttatgttcatgtttttgaaaagtaaatagtagagaagggcttataagtgaaaagaatcacccctgccctacctgtttgctttctagaggggactgtttttaatttgtaaacattttcttataatgctgccaccttatccctaaagaaaaatctgctttataactagtaattggttattagttttagaccttactgactgtacggcaaatgatgatctagctcacacatggcccccagtcccctccttcctctcaagagttacagcgttgttttaatttcttatcttggtgaacctttgtaattttaattggtgttttttaccctcatttctggtggtatctttttttttttttttttttttttgaggccaagtctcactttgtcacccagtgcattggcgccatcttggctcactgcaacctccgcctccctggttcaagcgattctcatgcctcagcctcctagtagctgggactgtaggcatgcgccaacacgcctggctaatttttgtattttttagtagagacaggtttttgccttgttggccaggctggtctcaaactcctgacctcaggtgatccgcccgcctcagcctcccaaagtgctgggattacaggcatgagccacagctcccggtctggtgataactcttgatcttccactttgtgagaggaatgtcttagcactcccaccctttcccttggtagccttccagttgttatctgcgtcttctcttttgtaaaattgca

SEQ ID NO: 47755 - DNA, 1572 bp, Homo sapiens
tagtgaaataaggtggaggtctgaattaaaactttttcctggttgttaatgaaatgttgcagtgactgaactgttttgtgtgccatagtagcactgagaagtccatgaagtccaattattctaatgtctttccttagttttccttcagtttcatttatctcatgagacctgaaaactccaacatgaactgtgtacccatgtgttctttttgcttcttaaactagtaacatttctggctttattctaccacaaattctttttcacttgctttctattatgtgaacctccactgttacagtgttaacattttccttcctttttttgtcactgcaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaagtaagtcacttctaaagtttgattcttctgtgagttgggtagaaatattggatgttatttactaaaagtagagtcactctgagaggagttaactgagtagaatttttttacccagagtgatacttgcaaatggcaaaaattcaaccaacataaaatactggcatttcatcagtgaatagagtccagaagggtctcttagctagcattttatttttttgactatgggatttatattcaggtatttgttttgcttttttacgttacaaatgtaggaaatattccttattttaaaaaaagaagcaatccagagtatgcatcctggaagggaaatgaatcccttgtagtcttttttcctccctgtgtctacccttaactctctctgaactgctgtctacacagccacaaagtcatcttgtgacactgtaaattgttaggtgattcttctgcttgacagtccctatgaagccccgtggctgctcactgctaattcttaggttggtatccagtttcctccagatctgggtcgggcagctcactcatttcttatttatttacttctttatcttgttcttttcttcccactagaatgtaagcttttggagggaagcaatcccttatatcttgtaacccctcccaagataaccatgagttcccaagataaccatcgagtataagtactaccagctttttccctacttgcctgtactatctgttgttgctatggtggtgctgctgccaccacagttactgttaatactgaattg

SEQ ID NO: 47756 - DNA, 1037 bp, Homo sapiens
caatgtttgtgtttattaatttactgccccaagcatacctatgaataaaatgagttttcatgttttataattcagaccttggacatagtaattgggactatgtgatagtaaataccaaagtgcgaggtttgaatacttgtatactcgtaaaagccatttagctattttaattttttattcatgtataatacaaatagaaaaaagtacacatgatacatgtacagctcagtgaattgtcaacaactgaacataccttggtaactagcatccagatcaagaaacagaattttacgagaacctggctgggcacagtgggtcatgcctgtaatcccagcactttgggaggccaaggcgggcggatcacctgaggccagtagttcgagactagcctggtcgacatggtgaaaccccgtctctactaaaaacgcaaaaattagccgggcgtggtggcacgtacttgtagtcccagctcctgaggaggctgaggcatgagaatcacttgaacccgggaggcggaggccagaaccccagagttctttttcacctgtccccttctagtcactactcttgccaaagagtagctgatttgatttccaacagcatagatgaggttagcctgcctgtacctcctatcaagtggatttgtacagtatgtattcttgtatctggctgctttgttcaacattatgtttgtgagatttatccatgtcgttgtatggaatttattgtgtgattatattacaactatttgttccactctgatgggcgcttgagtagtttccaggtttaagccattgtatgtagcactgctatgaccgttccagttgacatcttcaatgaacacatatgcaagtttctcttgggtgtatccctatgagtgagattgctgggtcatagaatctgcatgtattcctcattagtagattcccaccaagagtgtatgagacttctggctgctccacatacttgccactcttggtatttttcatcttttgttgtatggttttgtggttttaatttgtatttctctaatgatt

SEQ ID NO: 47757 - DNA, 1074 bp, Homo sapiens
tctgagattttggtgcacccatcatccaagcagtgtacactgtaccccaatgtgtagtattttagcccttaccgccctctctcctttccccccaagtctccagagtccattgtatcattctgtctatctatctgtctgtctgtctgtctatctatctatttatttattcattcagagacagtctcactctgtcacccaggctggagtgcagtggcgtgatcttggctcactgcatcctctttcaccgtgttggccaggctggtcttgaactcctgacttcaagtgatctgcccgtcttggtctcccaaagtgctaggattacaggcgtgagccaccgcgcctgttccgttgtatcattcttatccctttgcatcctcatagtttagctcctgctcataaatgagaacaaatggtgtttggttttcaattcctgagttacttcacttagaataatggtctccagctccatctaggttgctgcaaatgccattatttcattcctttttatggctgagtagtagtagttgtgtgtgtgtgtgtgtgcgcacgcgcacgctcgcgtgtgtgtcacattttctttatccactcgttgattgatgggcatttgggctcgttccatatttttgcaattgtgaattgtgctgctgtaaacatgcgtgtgcaagtgtctttttcatgtaatgacttcttttcctctgggtagatacacagtagtaggattgctggatcaaatggtaggtacttttagttctttaagaaatctccatattgttttctgtagtggttgtactagtttacattcccaacagcagtgtaaaagtgttcccttttcaccacatccacaccaacatctattattttttgatttttaaattacggccattcttgcagaagtaagacggtattgcattgtggttttgatttgcatttgcctgataattagtgatgttaagcatttttttggatgtttgtcaaccatttgtatatcttttaagaattgtctgttcatgtccttagcccactttttgatgggattgtttgttttgttcttgctgatatgtttgagttccttat

SEQ ID NO: 47758 - DNA, 1047 bp, Homo sapiens
cggttatacaacattaggaatgtatttatgccatggaactgtacactttaaaatgtgactatggtgcattttatgtcatgtatattttaccacaataaaaaaataaataaataaaaaagaagggaggcaggagaatcgcttgaacccgggaggcagaggtcgcagtgagccgagatcatgccgttgcactccagcttgggcaacaagagcgaaactccgtctttaaaaaaagaaagttttgggggaggaattttgccttcctcagccttcaaaggaaagttgagattttgattggaattgtattgagtctctagatcaacttgagaattgacatttgtgcagtagtgaactctcagttcctgaactgggtacatatttgtatatttgggtgttctttaatttctcttaatgttttctgcgtgggagacatgcacatcttttgttagattaattgctaaaaatttaattgcaaaaatttgttgctcttataatggtagattttttttccttaaattttatggtttatgttggatgtagtatcgagaaataccattgatttatgtgtatttacttacagccaacaacctggcagaattcatttattctaacacgtctgtagctgtttcttggccttgtaactatggaaacaatgaaatcctccatggatactaatggtgacgtttctgcctttccagtccttttgttattattattatcattattattattattattattttaccttacttcactggctagaacctccagtgcagcgtaaaagtgtcgtgtagctctccttgatctcaaaaggagcactttctatagttcatcctaagatgtgaggtttgctgcatctactgagatgatcatatgactttctatccttttgtctccccaccctccctgccctcagtcatgtagctttctacctttccttatctgacgtagagtgtaaacagaataagattctttaaatttcagtgggacgctctttctaatgccaggcagttagctgcatccttgatcacagcagagagcagcacccat

SEQ ID NO: 47759 - DNA, 1036 bp, Homo sapiens
aaaattctgttggtccacagtgacagttcaaaagcctataaggtagagaaagtgaaacagatttgtaagatctcagagtatataatgagtcgatattatgagattttatggcttcacgtaacttctcctacactcactcaagcataattattcttaatttagttttcacagtaaccatgagtgttttgaccagacactttgtccaagtgtcattgcccaaaccaactttatgcagaatgtgggtcttcctcagtgtccccttttgttggctcctttattatagcctacctaatttggcgtgtattacttcctgctgcaagggtcttgtgctgtctgcaatactgaatttttacaacactgttgattctggcatttgtttcaatcatgctcttaagtgggccttcaagcaaattctgttagaaattgaacttcatacattagcagcctgcgtctcataatcttaatcatacagtcattctgactttctctgtaatcccaaactttctgattggatactggatttatctttagtagctattccttgcagaaggaagccattattgcataagccagagttgtattctagaattcggagtgatatggaaccacagttggtatcatgtacgcctcacatgagaaggaggtatctagcacttctcgaccggggcctaaagctttatgttaaaaggaaaattatatagtagaactgtcaaagacttgagtattttacaaaaaggttttgaaagatcatatactcttttttcaaggacttcattggagaggtttttgtcactcttggagttagaatcaaagaaacctaaggaactttgctttatgcatgtctgggcaagtagtgtgacttgcaagaaatttccgagattcaccattcattgctgatcatgaaatcctctcttttgttacgaggtgttcacttctgttttcacttgccaggtaatcaaggtttagaaaagaacttttttcttttggtaggaaaacttccctgaaaggtgctgcttaagagtttgcaaaaagtttc

SEQ ID NO: 47760 - DNA, 1123 bp, Homo sapiens
ttgaaaaccatatgctaaggctgggcgcagtggcacacacacctgtgatcccagcactttgggaggctgggatgggcagattgcttgagctcaggagtttgagactagcctgggcaacatggcaaaattccatctctacaaaaaaaaagacccacaagttggctgggcgtggcagtgcatgcctgtagtcccaactactaaggaggctgaggtgggaggatcacttgagctcgggaggtcaaggctgctgcagtgagctatgttcctatcactgcactctggcctgggtgacaaagtgagaaccctgtctcagtcagtcaaatttatttatttatttagagacggagtcttgctctgtcgcccatgctggagtgcagtggcacagtctcagctcactgcaacctccgactcccaggttcaatcaattctcccacctcagcctctcaagtagtagctgggactacaggtgttcactgtcacacctggctactttttgtatttttagtagagttggagtttcaccatgttggccaggctggtctcgaactcctcaccttaggtgatctgcctgcctcggcctcccaaagtgctgggattacaggcgtgagccactacacctggcctcagtcagatataaaaattaaaaactcagattgggatctgaaagacttgtaagtgcaacaataatttattcagcatacatatcctccagctctcccccgctaatcctccccaactttgcaaagaaaaaggaactaaagcagcactaaaaagtagaaagaactcacagggtcttacattctcctgttttctggaactcttgtttgaaaggtgatacttcctcttgcctcccacctcagatacttacagaccaataacctaaaacctaagtggagactgttgggctaaccagaggtgagctcagtcttcttaaatctgtgactctgttccagatcaacccttagtgaaatctgaataattatttcctcactttaatcagacgaaatgggagctctcactctctaggaaaagcattaatgttcttcagtcaccactgttcttccataatacaaacatacagagcaaccaaaaaagagagtgacacccacaattaaatttttaa

SEQ ID NO: 47761 - DNA, 1044 bp, Homo sapiens
cgtgagctaaccacttcttacaacagtgcttttagatgtggctgtccccatttcactgataggaaaatcaggtccaagaggagatgtatactgcagaagttgcacagctactaagtggcgtagccaggatttagtccagctgcgtttcccgagctctgattggccttgtttacagaacgtctcccaggtacgcctttttgggcaacatttatgcatggaaaagaccccattatagagagttatttgagcagtcccctttgtgacatttatgccccgggctgctttgccctgaaactgcccactttacccctgagaagtcgtgagaactataacaatgaccgcaaaagacaagctgagaacaccagtacttggagttggcatgttctgtatccagaagctcaaagcttgcaagaagggcttcttctctctgtcatccccatagaatctactaaagaaaacctgggaacccatggagacatctaaaattcaccaccactgtggattgttacccataaggacctgttgcctcctttagtattgtcctgaggacactgtgtagggccattcccagcacattctttctgtttagggtcctgaaagacatatttgtctcatcagaagatgaagaagccgtttgatgatgatcttgtgggtttacagggtccctctacaactgttctttaagaaaatatcttggaaagtatcctgggcaagagcttcctgagagaccctttcggagtatgcattgaattcttgttcaatgactttagacctgcaggatgatatggggcctggtctgatactctgtatcggatttaattgctatccagtttatattaagtataatttaattcagattgggtcaggccctgatgttggatgatgctagtgtttttgccaaataaaagaccaaagaagatccatgttttgccagcagggtggaagcccagagcagatgccagttttacctgtacttggcacccctaaagtgtcagtcacagatggctatgcaaagacaaacttgttttttttactggatagttt

SEQ ID NO: 47762 - DNA, 1028 bp, Homo sapiens
tgagactctgtctaaaaaaaaagtatctttattgagattttcctgaatatgaaaactacttttttttttttgagacggagtctcgctctgtcacccaggctggactgcagtgctgtgatcttggctcacagcaacctctgcctccctggttcaagtgattctcctgcctcaccctcccgagtagctgggattacaggtgcccgccaccacgactggctaatttttgtatttttagtagagatggggtttcaccatgttggccaggctggtcttgaactgttgacctgatgatccacctgcatcagcttcccaaagtgctgggatcacaggagtgagccaccacgcctggctatgaaaactacatttttatgtcattttttattgtgataagctatacatcacacaaaattgatcattgtagtcatttgaagtgtacagttcagtggcattgagtccattcacactgttgtgcagccatcaccaccatccatctccagaactcttttcatctttcatcttaaaacacagaagctctgtccccattaagcactgactccccactccccttcccccagcccctggcaacctccattctacactctgtctctgtggatttgactgttctagggacctcaagtaagtggaatcgtactgtatttgtcttttgtggctggctgatttcatttagcatgatatcctcgaggtccatccatgctgtagcgggcgccggcatttccttcctctctaaggctgaataatgctcagttacaggatggaccacatttcgtgtatccattcgtgcacccatggacacttcggttgcttccacattttagctgttctgagtaacgctgccgtgcgcacaggtgtatatgcatcttcttgagcccctgctttcagttattttggttgtatactcggaatcgagctgctggatcacaaggtaattttgtgttgacttgtttgaggacctgtcctactgttgcccacagcggctgcgtgattttacattcccccagcaatgccca

SEQ ID NO: 47763 - DNA, 1024 bp, Homo sapiens
ttcctcctcttttgcctcccctcaacccccaggagagaaattcagccctgttgaaactgtgggcctctgaagagtggatttgccttaagaggtggatttttttcctttttcttttttcctccttctaaatatcgtgggaggtcggagcccacctttaggcaagaattggaggtgttttcagtggtgagcttgaaggaagtgggagaaggggggctggggagtgtcttttgctaaatggcttcctgggagaaatctttaaatgcctttggtttacaggactgttaaactttccctaagattttttttttctttaaggtttagtgtgcatttgatgtggctttgtacagtgtcatccagtttggtttttgtaaccaattgtgtgcggtcttagcatggtttttccgaatctcgctgcagccatttagtcatgtctatgcacagcgctgtggtgtaaggtgggactggggaggcccaggcattggggtgcagatcctgcttctttcttccgtaaacctagtgactctggggctgtctgaggcttcatctgcataaatcggggcgtgcaccctccacctggcaggtttgggcagcggtgaagggcctagcagagggcctggcacagttagtggttcctcctacggttgttggtataactgctgtcaagtcctaggacagacgtgagccccttgtggtgccacccatagagccaaactgtgcccatggatgccacaggtgctggcctaaggcatggacaatacagaaggaattcaaggcccaaacattagtgggcgcttatacagtgctgagcctctcgggaggcagggatgggaaaaagtagcatttggaggtctctagaacttagtagacccggagtgtgtggcagttggtcagtttaaggcagggttagaacagtacgagatgctcaggacaaacagacgcccaaggagtcctgccttctgaggataactgctttccttggggattggcagataatcatctgagagtgagtttctacttgtttggg

SEQ ID NO: 47764 - DNA, 1165 bp, Homo sapiens
cgtgcagcaggagtagctggcagaacaaagcctatctcaagttgctggcggtctttcacatcttgtacaggacttccttccgttcttacctctgcagccagttgtgtggcttccgtctggaccgtcttcctcctttccaagataaccatcagtctttttctctgtggggctgcagcagcagtatttattgcatttttaattgacttgtcaggcaatagatactccttgagcacctatcatttgccaggcattgtacaaggccctttaaatacatttttcttgtggtagggcaaggtggctcatgcctgtaatcccagtacttggggaggccaaggcaggtggattgcttgaggccaggttaagaccagcctgggcaatgtgatgaaaataaaaaaatgcctcttaaaagaaaaaattagtagggtatagtggcgcatgcctgtagttctaactacttgggaggctgaagcaggaggatcacttgagcttgggaggttgaggttgcagtgagccgtgatcatgccactgcactctagcctgggcgacagagtgagaccctgtctcaaaagaataaaaagtaggtcgggcacggtggctcacgcctgtaatccaagcactttggcaggccgaggtgggcggatcacctgaggtcaggaattcaagaccagcctggccaacatggtgaaaccccgtctctgctaaaaatacaaaaattagctggatgccgtggcgagtgcctgtagtcccagctactcaggaggggtgaggctggagaatcacttaaacctgggaggtggaggttgcagtgagccgagattgtgccactgcattccagcctgggagacagagtgaaattctgtctcaaaaaaaaaaaaaaaaaaaaagtctgggcacggtggctcacacctataatcccagcattttgggaggctgaggtgggcggatcacgaggtcaggagatcgagaccatcctggctaacacgatgaaaccccgtgtctactaaaaatacaaaaaattagccgggcgtggtggcgggcgcctgtagtcccagatactcaggaggctgaggcaggagaatggcatgaacccgggaggcggagtttgcagtgagccgagatcacgacactgcactctagcctgggccacagagcgagactccatctg

SEQ ID NO: 47765 - DNA, 1044 bp, Homo sapiens
cgttatgtctcccaggctggagtgcaatggcacgatctcggctcactgcacctctacctcccgggttcaagcgattctcctgcctcagcctcctgaatagctgggattacaggtctggctaatttttgtatttttaggagaaacggagtttcgccatgttggccaggctggtctcgaactcctgagctcaagcgatttgcctgcctcggcttcccagagtgctggaattacagccatgtgtaatcccatggtggcaatgttgagccaccttgccctgccaaccattttactttctttctgtgaaaccgaatactcttaagtacctcatgtaagtgagatcatccagtatttgtcattttgtgtctggcttatttttagcatagtatttccaaggttcatccatgttgcagcatgtgtcagaactaacttcattcttaaggcagaataatattctcttatttgcatgtatctaccacattttatttattcattcagcgacgggcagcagcctgtagatagttttgttttcatgtattgaatggtcctttcccccagtggagtgagtaaatgcatccggaagcagaattctgttgtttcccattcatcactgtgtgccaggtgtctgagaagggggtcttataggagcccacgcagaaaccaagctcacctcagtctgggtgtggggcagtcagggaaggcattctggaaaatgtagctgactcgaaataagcacctattgaaaatagtgtgctgagccctggaacattaaaaatgtgttcctatgtggaaatcagaaatgtatgggtcccagaagagaacttgtgggtcagcctgctttccagagagtgccgaggccctttgaatggtgaacattatgcaagcattcttgtatggccagtggccagcagggaggagggcagagaatgactgtgcctccgggaagccggcgtcaacttcccgacacgcttcaggatcatctctttgtatagaaccatgggatggatcgctgcaggacctactggaaaaaggaggtcatctccagga

SEQ ID NO: 47766 - DNA, 1052 bp, Homo sapiens
tgaaggccactgtgggagctggaaggaggcgatagacacagccaggtctaaggttgattttctgtatcaagtaaaatgattgtccttgctgcctgttttcttccaactgttatacactggagcctggtgcataaaattcagagacggcctccattttaagttttctcatagccccgtctttcacagtccttggtggttttgttgctgttaatattcattgctgttggcgcttttgcagctcctgatagtggctgttgtgcatatctcacttctcgactcaacctcttggcgtcacttgccacccctcctgccccccactttggtttagttcttccaggagatcacaccattggttgaagtgactgcagaaatgaagcactggaatgcctgggtggtggtgtttcatcaggctaggctggcggggatttgtgctctggcaagaggaggtgcggtttggaattacactgctctggctcctgggggggttattgttagctggaattcagagagagctcgctgggagagttgggaatgccatgccccctcttcctggtggagagtagctctcccttgcaggcacagtgcagcaccccacactggaagccctgctttggggtcagctgccttcaagtccaggttctaccacttagaagctgggtgacctggggccagcttttaaatctttttgaatctccattctcttcctctgcaaaatgtgatagtaacaccttcataggacctgggaaaggattcagagggtcatgtgctgcagagttgatagggcacctggcacaagacagcaggctctccatagaccgcagctattaatggttcctggattcagccctccccgggggcccgggggtttggagcaggcaggcttttgtacacttggggcttgtttgttacctaggtgttggggtttctaattatgtgctcagcactgtgctacatgctaaagatttggacccgtagcgcattgccctcacctcctggagctcagtcaccttaactagcaagggcctcccatgggcaggtgcatcagggctctt

SEQ ID NO: 47767 - DNA, 1057 bp, Homo sapiens
gcagtttgtgggttctggctgcaagggagactgcagctgggccagcaacagccctgacttgacctcaggccgacaggagtgttcctttcagccacttagacctacctgctatgaggtcttgaacaaatcatgtcttttgctcctttaagtctcagttttcttatctgccccaaatggatacggaacctgtctcacagcattgctgcaaagattggcgtaatttctgggatgcagtgttagtgcagtgtaggaaacctagtcaacttggaacagtatatggtgttgatactatgttgctcagttcaccgagatcttaaaaacaatgtaacagttacaatacaggcgtgtcacagttacaatacagccttgctacaaacatcaagctccagaagtgtatagagtagaaagtgaaagtcattccttcttccctgctgtttctttataatatcaagagaggactgctgtcttaaccagttgtttttaactaaggggactgttttaactgtgcatatgaattctaaacctgaagtgaccactggaaggtgggaggtgtgactgtttataggtagaccttaatataagcaaagacatctcatatggctccttagtgtggtctcttcagctttttgaggggagaaaaggccattgtaattctttgcacaccctggatgaatcataatgttgtattggtaaagttcagcagtggcatagactgggtttaattaacaagtgctgcttccaaagatcccacagctttacaatttgctgttgacatggttggagggtgggggaaggggaaaggtgggcatgcccttagggtaatggggcagtgcaatacggttttttagacgcttcggggagatggtgggtgggggaggagagttgtgagtatagagttttgggtgaggtgaggagtctgtgggtaaggtgtttataacgtgtgtagtgtatttggagtgagggtgcatgctcccttttcccaccgttctgaagtcacagcttggcgtacctgggaatgcccttggcgtagtaatccctggcccttattttggatctg

SEQ ID NO: 47768 - DNA, 1576 bp, Homo sapiens
tgtcctgggtttcctctagtgtctgaggcttggaggagaagtcatgcacggcttctggggtccagtcctttggcctttgctggagattatttataccaacccagcccttttagctcccacttcagtatttttggatttatttattttcatcaaagagaaagttcctttgtctcggctgagttgatgaacgtctctatagcagcaaacacccgagggcgtgtggcccagttctgagaagctgtggtagagtgaggagggcactgtgtgaccctggttctcacttcacctctgagcctctgttcccttatctgcaaatagggggtgatagtaaggacagccaccttagtggcggttaggaggatgctctctgcagctgtaatgtttattcgggcagcccgatggagtatttcctcaccggggtaacgggaggcattgcatccaggttggagtggttgctgaggagtccttcggtgcttctggtgatagtcattgttggccctaatccgcctcctgcagctgaactgtgggagtgccacagctagagggggtgggaagaagaggatggggttgttgtaagtaggctgtgttctctgcctgtctgggcatttgctgccgaagggcgtctgactcccatgtaatttacctaatgagaggtctcgggccttgctggttactctgtgcggggttacaggtctcaactcttttctttctatggacacaaacgaaaaatgtgctttgcagagatgccaggttgtaaagaaatattggccccagcatgtaaagatacatgtactggagtgttggttgtggcattatttgtggtgggacatgttcagttggacatttccgtagggaaatgggtaaataaaatacgatgccactgtatagtggaatgctgtgtaggcattaaaaagaatgaggtagatcactatgtgtatttttatcttttaatttttaagtctgaactaaacagaacttatgtatatttttagaaagatgaccatgtatagaaagagaagaacccaggttgaataatacagtagcttcctgcatttgtagagaagaccatgactgctaatatgaatgtgtataagcctggaggctgtccaccagtttgttaacactgtttaccttttgagttggattgttttcttgtgcacacattagtatcttttttttttttttgagacagagttttactcttgttgcccgggctggagtgcaaatgatatgatctcggctcactgcagcctccgcctcctgggttgaagtgattctcctgcctcagccttccgagtagctgggattacaggcatgtgccaccacacccagctaattttgtgttttcagtagagacgaggtttctccatgttggtcaggctggtctcaaactcccaacctcaggtgatccacccccctcggcctcccaaagtgctgggattacaggcatgagtcactgcgctcagccacttttttttttttttttcctgagatggagttttgctcttgtcgcccaggctggagtgcaatggcgcgatcttgtctcactgcaacctccacctcctgagttcaagcg

SEQ ID NO: 47769 - DNA, 1054 bp, Homo sapiens
atgctgggattacagacgtgagccaccgcaccttacaggtgcctgccaccacgcctggctaatttttgtatttttagtagagacgggatttcaccatgttggttggccaggctggtctcgaacgcctgaccccaggtgatctgcccatctcggcctcccaaagtgctgggattataggtgtgagccactgctccctggccacattagtatcttttgaatttgtcttactgaatgtgtattagtaacatgtattggttacaaagataataacaaaggtaactcgcatgcatttcagtacagtggagcctgtgggggccgggctgggctggggcagctgctgtgttggtggctcttttcctggtgccagatcaaacttaccgtgaggtaagagctgctccaggcttcgtattccacgcagacccatccagtgcaccctggctcctggtattgggccccagtggttactgtgaatttaactagttcaatcgtctgtctctgttgatgtgtcagtggccctcagaaactgctttgtttatctggttagaaggaacaatccaatacaaatgctgtctccgatttctcttctctactaaatcagattgtacaataaagaacatagattttggttgcatttgcagagtacttctcatttgttaattcaccattatttggaggtggaaaaggaaggagtaactgaaagaagcccatgtatttcatgtatttcttttatttgccaggtccttgttaaattttgacgccagagagggaggcctttgtatagcacatctgtccaactgttcatcactcaccatatgttgaaatcatcttcttccccaccccccttgctaaattaaccgcatcttcaaagcgggaggtaggcaggaacttggagaccgcatatgggctttccagccagagtcctcttcaggcttcagcccaagcctgcctgcctgtgagctagatgaggagaggggctccaggcagaccctgtgggtgaggagcccagagctggtgcagactctgggggtgtgggatgctgtattagagtaaagat

SEQ ID NO: 47770 - DNA, 1024 bp, Homo sapiens
ccagggtggagtgcagtggcacagtcacggcttactgcaaccccaaactcctggattcaagggagtctcccaagtagctgggatccaggcatgtgccaccacacccagctaattaatttttttttttttttctgtagagatggcgtcttgctgtattgcccagactgatctcaaattcctcacctcaagcgatcctctcacttcggactctcagagtgtggggattacaggtgtgagccactgtacctggcctgaatttttcttaaagtctaatatagtcacttttagaacatgtttgctcatctacgttgaccgtctctatcttgatgggcttgatctaccaaggtggacaggcttctgtttgttctaatgtttgtactttcattgtgggtggtcctcttggccctttaaaactaccctgctctgctgcttgctcttttgtgtctgtctcctttgattcaacattttttttgtgcgtttcatctgtatagttgtgtatgtttatttgttcttattgtaggatggtttttggttatgtggatgtaattatccatgtgacagactgagctcatttccatagttcttccaaacaatgctgccacagtgcgggtatgtgcgtgcgtgcgtgcgtgcatgcacacgctgttgggtatatacctaggtttggagttaactgggtcatgggtgagcatatggtggctgcatgggcagctgccagctctcagtgatggcaccaggtacatgagggtcatccttgctctgctgacgctgtaaagatgttgcttctttgcaaattaaccgctggattccctgtaattctagtgaaaatcccagcagcttttcttttgttttagctgtttatttcagaaattgacaaactcattctgaaatttatatgaaaatgcaaaagggccaagaataatcaaagcattctctctctctcttttttttttttttttgagaaggagttttgctgttgctcaggctggagtgcagtgagacgattataggtcactgcagccta

SEQ ID NO: 47771 - DNA, 1743 bp, Homo sapiens
ctcccaggttcaagcgattcttcggcctcagcctcccgagtacctgggactataggcgcacaccaccacgcccagctaatttttgtatttttagtagagatggggtttcaccatgttgggcaggatggtcttgatctcctgacctcatgatccacccgcctcggcctcccaaagtgctgggattacaggcgtaagccaccacgccgggccttaatcaaagcattcttgaagaaaaacaaagctgaaggacatatcctaccaaatatccagactttataaaagctgcagtgattaagacaatgcagtgttgccaaaaagatagacaaataggctgattggagggaacagtcttcaaacaaactgcacatcagtagtcacttaatttatgacacatgacaaagagaaaagatggccttttcagaaaaggtactgggagaactgaactctccataagggaaaaaaatgaaacttttatcacaaatcatatcgagaaatcagtgttaggtagatcatagatgtaaacatgaaagataaaacaataaagcctctagaataaaacataggatatcttcatgattttggaaaaatcggacacagaaagcagtaaccaaagtagaaaaatttgatacattaaactgcattaaagtttgtatcttttgctttttacattgctccaagaaaatgcaatcaatactaatttgtaatttcctggaaatggtagataatccatcctgtttgttcctccagaagcctctatcctgtttttaccaggactgttgcccctctggcccatggtgcggctaccatcttgggctttttttttttttggagatggagtctctgctgtgtcgcccagactggagtgtagtggcctgatcttggctcactgcaacctctacctcccgggttcaagtgatcttctgcctcagcctcccaagtagctgggactacaggtgcctgccaccacgcccaactgatttttgtatttttagtagagatggggtttcaccatattggccaggctggtcttgaactattgacctcaagtgatccacccgccttggcctcccaaagtgctgggattacaagcatgagccaccgtgcctggctgctatctcgggcttctgttggtcgtcattctgggacttgtttttgtccctccacacgtggtccttatttcctggatcctatttgtattggttggataatttggacataatgacagcaactgtcttttttgtttgtttttttgagtcggagtttcactctgttgcccacgccggagtacagtggcacaatctcggttcactgtaacctctgcctcacaggtttaagcgattctcctgttttcagcctcctgagtagctgggactacaggtgtgcgccatcacgcccagctaatttttgtatttttagtagagacgggggttttaccatgttggtcaggctggtcttgaactccggacctcaggtgatccacccgccttggcctcccaaagtggtgggattttcaggcctggccaacagcaactatcttaataagaacgttcattgactcaagtaattgcaagtccagaagtagacaggtttgggattatttgggtgcacccattctgaaccagtcattagaaccggagctgggcttctcttaggccaggcccccgctcccctggggctggggctgggtcagcctccctcaggctccatcaggaaggaggaagggagaattaactgctgggtagg

SEQ ID NO: 47772 - DNA, 1013 bp, Homo sapiens
ggagttcccatatagcctactcccagtttgcccccattaaacacatcttatgttagtacagtatatttgtcacaactaatgaaccagtattgatacattattattgactaaagtttatgctttattcagatgttcttagcttgtacccagtgtcttttttttttccgttctaggatgccacattaaatttaatcatgtccccatagtttccactaggttgtgacaattaagtttttgatgaccatgacagttttgaggcataccgatcagatatttggtagaatgttcctcgatttgggatttgtcggatgctttcttcatgattatcctgaggttatggggtttgggctataacatgcttaattgtaactagggtgattcttgttttctagttattttttaagggggaaaaaaagtttatttcatgggtgtggtatcttctcttgattttatgaggatattaattttataatacatatttttaatctttgatctctggcactgtctgtttcctctgttattttgtctatttatttggtgtctgtcttttagttggtcatctctcagatacctgtggtctcgggcacacagctgattggaaactgcatggactcttcagagtgggtgcctggatgggaggctggccttttcatttcttgaatcccatgttggtgtatataggttttctttctctggggctggtttttcaagagaagactcccttgtctttgcctgaggagtggagggtggtgtggtgtttgtctgctgccctcctgtgaggagcagcagaagtggggggcctgaagcttctgaggtttgccactcaggttctctcttcacttttttggggggtctcctttccccaccccttccccctctgaccctggtgttctcaagtctagacttctcttgtttaatgtatccagtgggggagggaaggggccgtaggtgtctagctgttgcacttgcagccttcagccagtccccccacatctgagttcccaccttcccct

SEQ ID NO: 47773 - DNA, 1045 bp, Homo sapiens
tttctttttctttctttctttctttctttctttctttctttctttctttttttttttttttttgagatggaggctccctctgtcgcccaggctggagtgcagtgcatgatctcggctcactgcaacctccacctcttgggttcaagtgagtcctgtctcagcctcctgagtagctgggattacaggcatgcactaccacgcccagctaatttttgtattttcagtagagtcagggtgtcgccatgttggccaggctggttccgaactcctgacctcaggtgcacctcagcctcccaaagtgctaggattacaggtgtgaaccgccacacctggcctacccttgcttttctgacagtgccacgtagggagcctctgcaagctggaggtgtggtgggggttgggttaggctgtcatcgagtgaggcagcagaagtgtcccctcaaacccacctggttcccccaccctgatatgcacacaagttcatcatcatcttgcaatgtattcatgtccatactttaccctctgaaccagaaggcagcaaactgcaaccccgattgcagcccacctcctgtttttgtaaatatggctattctcttttatgtattgtctggggctacttccatgctacgacgacagcctcaggcagagttgagcaattgcagcagagagctctgtgtggccagcaaagctgagtacatttactgtctggccctttacagacaaactttgcagatctctcctgctgcaggagtgcagggtggagtctcctgtctccatgtccccagcaccaagtgacacagggtctggcacacacattggtcagtaaacgtttgagtatttgaagtaggtgaggtcgccttacttacgttaaaggtttttttgccagacattgattggtgtgttggggaaagatagacttctttcatcttgtccctggatttcgtggtgatggttcttggctgagacttaacaagtaaactgtccagtggccacgtccttttctggcccacattgttacttcctgaagcgtttatccagcctgcta

SEQ ID NO: 47774 - DNA, 1028 bp, Homo sapiens
ataagccaggtttgacttatgctaacctgcgaggacttggtgcgtctatgccgggtctagtcccacagacctaggggtgagtcagagctggatggaaatgcctcagacccgctggagagctgttctcttgcctcagccggcttcctgcttcacacttggatgctcaccggtgctttctccctgcctccggataggctagtttagcttggggtatgcatgtgtgttgatggatggaaactcggcaggtatttgaagcctggtaaagccctgctaacagcgccctggcctgatgtttgtgaaaagcagctggcaagcagtggggccagatgcttgtgggcggggccagcctcgcactcagccggtcagtggagatccctgcaacgggaggaaatccgaatgattctggtttattttggagttgtgtccagtgaaagatctcctgactgccgtaaagcaggtgtgtatacacaaactttgtaaaggaccaggcagtaactgttctgggctttgtgggccatagatggcctcttgcttatttctcttcaggctgccggcccctgctctgatggaacgttgaggctggaagattctccacttgtgcagtcttcactgtggagagtgtaattgtcctcgtaggggctgctttcattcactgcagcagtgactcgcctggttccttgttggtatcccaagtttatataggaaaataggatccaatcccaggcttgtaagaggtggctgattccacagtaagccatttctttctgctacgttttttttttttagacagatttttccctctgtcgcccaggctgtagtgcagtggcccaatctccgttcactgcaacctccacctcccaggctcaagcagttgtcctgcctcagcctccccagtggctgggattacaggcgtgcatcaccacgcccagctaatttttttaaatatagttttagtagagacagagttttaccatgttgctcaggctggtcttgaactcttgggttcaagtgatccgcctgcttcagct

SEQ ID NO: 47775 - DNA, 1050 bp, Homo sapiens
gctgggtgtggtggctcacgcttgtaatcccagcacttcaggaggccaaggtgggcggataacttgaggttaggagtttgagacaagcctggccaacatggtgaaaccctgtctctactaaaatacgaaaattagctgggcgtggtggcgcgcacctgtaatcccagctactcgggaggctgaggctggagaatcacttgaacctgggaggcagaggttatagtgagccaagattgtgccactgcactccagcccgggcgacagtgtgagcctctgtctcaaaaaaagaaaagaaaagaaaagatggagggcattaaagaaaacattgtacaagcaggttaagtgcagatgttagtccaatgtgtttcttgtactggcttcaccaaggctctgtgattggaaggggtggaaaacatttcacctggaacacagaaggtgcccagttaatatttgttgggtggttgaatttactgggaggacatagttcaaggaatagttgtagacagactgacatctcgtaaacacaattctaaatttctaggagagtgtctcatgtttgggcgaggttttttgttttttgagatggattctcactctgctgcccaggctggagtgcaatggcgcaatcttggctcactgcagcctctgcctcctgggttcaagtgattctgctgccttcaagtgattctcctgctttagcctcccgagtagctgagattacaggcgtgcaccaccatgcctggctcctttttgtatttttagtatagacggggtttcaccatgttggccaggctggtcttgaactcctgacctcaggtgatcctctcgcctcggcctcccaaagtgctgggattacaggcgtgagctaccacgcctgacctgagcaaggtttttttccttttgttgccactagggtatggggaagtatgaatcaaaccttctcagagaagtgtggtgtgtgccaggtagttacactgagagctgtgtgtgtccattctacccttttccctcaggcctggtcagcacagagtcagagaaagtagaggccag

SEQ ID NO: 47776 - DNA, 1088 bp, Homo sapiens
atcacttgaggccaggagtttgagaccagcctgggcaacatgatgaaatcttgtctctactgaaaatacaaaaattagccaggtttggtggcacacacctgtaagcccagctactcaggaggctgacacaggagaattgcttgaatctgggaggtggaggttgcagtgagctaagacggtgccactgcactccagcctgagctacagaaagaaactctgtctcaaaaaaaaaaaaaaaaaaaaaaagaaaaagaaaaaaagaagaagaagaaaggaaaatcattcaatgtgaaatcttgccatgcctttctttttcttgagacaggatctcgctctgccctcaagaggcttgcaatctagcccacggaacgatgctcttattaattatgacttttggggagtgggacagcaactccctggacctagcctcagggagggagatttaaaatggcccatggaccccagggcaaggaagcagccaggtcatgggcaccgcagtcaggattgggcacgtgggactgactcccattctgagcattggtgccctttgctccagtgcaggaggtgagctctggggagggctgctggggtcaagcagctgctggcaggtaacttgggggcagtgagtgcttggaagcacttttgctggtatgtttcttcattgtgccagactctcttacgccctctagtacattcagcatccttgggcttggccactgaatgtgggcagcagtcccatcattgtgacatcaaaaatgctcctgcacatttgcaaacaccctggtattccttggcccatggcagcagctgaataaactgggatttgggtgagggaagggagttaagtaaccaaccagcatggctgaagccatgtggggcggagaggagaatttccttgaagaagggcacagtgtcggcccctggttgtgtcccctgctcacacagatcggacgtaggaccgcttatccctcggcatccatcttcctgcgttcttcatgagcatttcttgatacgaattgcatgcggatctgtccctcagtgattggcagatcttaggtatcagtcaatacctgttaaatgaatgaaag

SEQ ID NO: 47777 - DNA, 1050 bp, Homo sapiens
gtcgggcgcagtggctcacacctgtaatcccagcactttgggaggctgaactgagcagatcacatgaggtcaggagttcaagactggcctggccaacatgttgaaaccccgtctctgctaaaaatacaaaaattagccaggcgtggtgctgcataactgtaatcccagatattcgggagactgaggcaggagaatcgcttgaacctgggagaaagaggttgcagtgagctgagatcatgccactgcactgcaacctgggcggcagaatgagactccatctaaaaaaaaaaaaaaaaaaaaaaaaagccaaaaaattcttattgcagttgtatctgtaagggggaagaaaaacccatatgagagactggttaaattatgacctgtctagttgtgttgtgtgctcattaaaagcaaaaggaagatccgtttctatgttgatgaaaagatgttcagatgcatgaagtaaaaaagtcatagagctttatgtatggggtcactccacttctgttagaaaaatactgtattcctgcagtgtaaaactctgctggttaaaaacaaaactgtattaacaggtatagaaaagtctgcttggagtttctctctggatgatgagatcatgatgttctgtgttacctagttttatttataagtttatttttactatgagcatgtatttcttttataaactcagagaaggttaaaaagtcagccctctgagtaggtatgggctctgggtctggggtaaggggcacaagcccttcattccagtgattgaatttccctattggcaaatccttcatttgcattgtttacagtgagcttttagtttttgcagacagaaggctctacaagaaggcagaaaagtttcatttttaaaaaagaaaggccaggcaaggtggctcaagcctgtagtcccacctactcagaaggccgagatgagaggattgcttgaggccgggaagcagaggttgcattgagccaagtttaccccactacactccagcctgggtgatagagtgagaccccctgtctcaaaaaaaagaaaaagaa

SEQ ID NO: 47778 - DNA, 1050 bp, Homo sapiens
tactttggttcctcttgatttaccgtgaggcagggtcactcaggctggactgcagactagttcagggtgaagctccatggaagcgtcacgtgagctccatggaagcttgggtcacaggaagacaaaaagtggcaggtcacaaaaaggttcactggccaggtgagtttgaaaaacaaaacgaagcgagctcctttactgcggtacttctcagtgcctttcatatgctaatacctaatgtgactctctgagaagaggatataatgggcagcagtccctgaatttatttgtcccaggaaacatttctttaccgaatgtctctagggactaatgtctctcagaacacgctttgggaaatacgaagctacaatccttcatttgttgatatgttttaagtgtttttctaagcagaaagtaatgatttcaccaagcaagagctcataacacactcagtccatcagagcctggctacaggtttccagagattggcaggaggatatacttagccagaactagaaatctagatgagaagtctatgaattttttagaagactaaaagtagacgtagatatctcatattcaccagctctcttgacagcgggaatgaacatattttggttttgctttgctgcatgggcaatataaggtctcaaatgtcatcccctctctgctttaaccatactcagggaagtctgtggctttgccagggcaccctctccccacctaacactgaaccgtgcttttaaaattaaagacaagaaaagaggtctataatcatgcaagatgcccttttccttggcctaaatccactgggacccataggctagtcagagtatttagagttgagttcctttctgcttcccagaatttgaaagaaaaggagtgaggtgatagagctgagagatcagatttgcctctgaagcctgttcaagatgtatgtgctcagaccccaccactggggcctgtgggtgaggtcctgggcatctatttgaatgaattgctgaaggggagcactatgccaaggaaggggaacccatcctggcactggcacag

SEQ ID NO: 47779 - DNA, 1029 bp, Homo sapiens
tgctgtgtcactgtctgtgtgacttgaagctggtcactccccaaatcctgctccttgtctgtagagtgggcctggcattttctcgtccctgggaccgctgtgtggagtgtgcgttacagggaaggttcagggctttgctgctgctcagaaagtggtggtggatggatccgtatagggtttgaatctaaggtgctggcctctcagcaccttgttgtaataggctgttattgtacagtggaataagggagctggccctcttctgattctcttccttctttcagaatacaaattcagtgccaggtggaccaaagtcatgggcacagctgaatggaaagccagtaggacacgaaggtggtaagtgcgcacgtgtgtgtgttgtttggggacgctggggagagggaggtgaatgccttttccagaatgtctggttgggtctaggcacccagaagctttgaggactctcttccacaaagaggtaccgtctatggagcccttgcctgtgcacagcgggcgctgactctgtagaggtgccagctctttggtttctttggatgtgtgctcttgctgagacagaggagtgctgactgggctgtgctgctggtgatttttgatgatagcttgaatgtttctagcatactgtgcttcagaccaaactaggcagcagctctgagtgggaaggagagtggtcgtggtgtgggcagacgattcaaaggaatgtactggggaaagcccacaattcactttctcctgtaaagcagcactggctgccctttattaccctttgccaccatcctgatatcgccttctgcttcctgcactacccctgccagccaaggcttcaccagacttggtctttagtagcctgtattagaaaaccagctgcacatccttcgttacctgaacctcacccccagcctgccatgcctaggaggtcctgccccttatgggttgaaatccctgtgctcaaaggctcttccctcagtctccaacgggaaatgaccgatcaatgtgccaattggatttcagtgc

SEQ ID NO: 47780 - DNA, 1037 bp, Homo sapiens
tgcgacgagatctcactatgttgctcaggctggtctccaactcctgggctcaaatgatcctcctaccttggcctcccagagtgctgggattacagacgtaagccaccgtgcctgacctcaaaagggtctttgaagatgctttatgaagagcattcactggacttgtaactggttctttggctttccatatcttatatttctgtaaggttagaattttttgttttgtttttgttttttttgagacagagtcttgctttgtcacacaggctggagtgcagtggcacaatagctcactgcaacctccataaggttagaatttttaaaaatagatagaatatattaatttttatttaaaaagaactacaaaaattaaaagaaaaacttctgtataaattggcccaactcctatggaagccagtttggcgctgcctggcaaaataataacacataataccctttgacctagcaagtgcaccctgaggaaattgctctacaaattatactcgcccgtgtgtgaaatgacttgcgcataagattattcactgcaacattataatagcaaaagattgcaaacagtcccttgaaatgcctgtaaaattatggtactttaatgaaatgtgatttggctataaagaaaaaaagcagaagttttctattgatttggcaagatcttcaggtgaaaaaaagtacagaatggtatgtatagtatcttaaccatttgtgtaaaaaatgggggtgagggctggacacctgtaatcccaggactttgggaggctgaggcagaaggattgcttgagtccggtagttcgagaccagcctgggcaacatggtgaaaccctgtctctacaagaaatacaaaaaatcagccaagtgtggtggcagacacctgtagtcccagctacttgggaggcttgaggcaggagaatcacctgagcaccagaggtggaggctgcagtgagctgtggtcacactcctgtacaccaacctgggtgacagagcaagaccctatcttaaaggacaaaacagaaaaatgggag

SEQ ID NO: 47781 - DNA, 1050 bp, Homo sapiens
ggctgattttataggaggctgtgcttgtctgtggccccaggcagtcagtagaaccttccctgctggggcaggctgtggcctggagcggctgtgatgtcttacctctttccatttgtaagcaggcactggtccttgcaggtcagctgggaaggggcatgatgctgtcagcagcagtctcccttgccaccctcagcaccctcgtggcatctgccagcacagagcacccttgtgacaagactcccttcaaaagcccacttccaggcaacacggctttcaaggtgtggagctgggaagcagacgactgttgactccatctcacttcctccatgtctaccccgtcttcttgacaggtttaaggggctcaagccgactgttatccttctctcccgaggaatttccgacgctgaaagcagctggagggcaggacaaggctggcaaagaaaagggcgtcttagatctgtcgtatgggccaggaccaagcctccgccctcagagtaagtgactgcagcctctgggcactcgatggagtaacagaacttcctcctctcatctctctgcactcctaaaagggtgctgatgccactggggtctccggttcgagctggaaacgtggctctttgactcgccacgtgatctgtgcatccattggacttgctgcctaggccattggattgggccttgtgccttttttgtctcttgggttgggccaggcctgtcccctccccctctgtcatccggttgttaattttgctgtgcctggtggctgtggcaaggatggacaaaggaccaattaacttaggtccccggttcaagagcttgttttctaaagctcccaatcctagctacatctagtcggaatcactggggagtttgtgaatgagtctgatttccagtcctcccctcccccagcccaattaggacctgtatttttaacccattcctctggggattgttacataaatcagcctggtactggtctctactggcccctcatcttaggtcgggccagggaagtggcaggattgtgtagcactggctggaaatttctcc

SEQ ID NO: 47782 - DNA, 1928 bp, Homo sapiens
cagtgatcactgtggatgtgtcttacttaaaccagcactcactgcctttccagtggcccacacaggactggtttattttgctgcttttttttttttgagatggagtttcgctcttgttgcccagggtggagtgcaatggtgcgatctctgctcactgcaacctccgcctcccgggttcaagtgattctcctgcctcaggctcccgagtagctgggattacaggcatgtgccaccacacccagctaattttgtatttttagtagaggcgggtttctccatgttggtcaggctggccttgaactcctgacctcaggtgatccgcctgtctcagcctcccaaagtgctgggattacaggcgtgagccaccgcgcccagcctgtttgcatcattttaagggacacgaattatgtctttctggggttaattaagaggagctgccttgtgggactataaaaacgtagacatagaagaagcttctaagcatcagtttaatctcctcattggagaagatgagaaaacatggacagaggggtgaccttggcttgccccaaatcacacagcaaaggggttgaagagctgggatcagacatgtcctgggtctctttcccttaagggtcgtgtaactcagagacctttgtgcttcaacttctaaccaaaaggtgaccgaaaacaggggtctgttgtctcatttgatttcttgttggcctctaataatttccacccgatcttaccacatttggcaatagaaagcatcattttaaaaagacaggtcagcaggtttccgtctgtgagctacgcaagtgccccacacctccactggaaggacagcagctgcgccttgcctgtcttgtgggctgggggatctttattaaaaggtgccactgctaaacaaagcctgaaaccactgtgcccggaacttgctcctgttttaatgtgtagtccagtgctgaccctaagtgggctggtcagtgtttgttgaaggaatgacccaaggctggtttcatcagggccatcttcatctctctgggttgtgagacttggggaagggtggtgattgttgcttactgatgaagccttctctctgagtagatctcattttatatttcacagtcagacttccctcagcaagttcatcctcattggccaggggtctgccccaaccttccctgacagatttaacagttcttcacttttggtgttttttgtttttcattttatttttttggtgaaggagggggtcccttgaccttcagaacctcatacgatccctccttccccctcctcttccctctccccttttgccccctttcaatttccagatgtgacaagctggagggagggcggtgggcgacacataatttctgccacgtctctgagcacctccccaactgagctgggcagcaggaactcgagtacgggagatggagccccctcctcggcatgtaccagcgattctaaggacccctctctccgcccggctcagcctgtccgaaaaggggcttcacagttcatgggaaatgtataccacccacctacataccatgacatgcttcctgcttttgtaagtcttcagagtgtactttttttccccccatgaagttggattgtgtccagcagataggtcaagtggttgaatgtcccccttggggtctcctcttggccctgttaccctacttctgaggcttccactcgttttgcattttctctccctgctttttaaatcttcagggcctctgacttctttccctggtgatgtggatatgattttagcctttggttctttagaaacaggagaggcaggttttccctgacataggtccccaagtctacttactggcagcaggaatgaaatgggggagatggtggtaggattaattaggaaaccccatgactttcctgtttctttttcccattttccactttataaa

SEQ ID NO: 47783 - DNA, 1014 bp, Homo sapiens
aaccagctcagcgtggcagggtgtgtggggtggtggctgggatttggagctggatgacagattgagtcatgatttcaagtgcctggtagagttgaagttctggcacgtgtgtgttgctgctgccctaggccttagcaaccagcatgtaaaactgcaggacaaggcagaacttctttctgggatgtactcgtttgctcattatatatttcttttaaaggaactgatagaaataattaaatcaaacatgaacctttgcagtgtggaatttatttttggaaaggtatttgattttgcttccgtctgtatactggacatgattccatcatcttttcttttatcagaaaagaaaacaggctgggattgtctcgcccactccgcccactaaggcagctggtggagcgggcaccacggcccaccattatcaatgcggaaaacctgaagggccttgacgatctggacgccgatgccgatgatggctgggcaggtgggcagagaagcacgggtggtttagacgggcaggaccaaagtccatatgtacttaccagggatggaaaccccctggcaccaccgtgtgttttcccttggcaagatagggatgaagagccggacagggaagcagacctgatgccctccttcctcatttactccctgactagaggttccttcctggccaagccattagcttcttttggtctttagtcttgatcttagagttttgttgttaactttttaaaaattattgatgatgcaaaatttaaacaaaaaagaaaatagctcccaaccactgatcactcaggttcaataagtaccaatgttctgccattcggtttttgtttgttttaatttaatttttttccaagagacagggtctcagctactctgggcatactgcctgtgggttagccctactctgcaaggagcagtaaaaaatataaagataaaaaggaaggctgggcacggtggctaatgcctataattcctttggaaggctgaggtgggcagatcacaagatca

SEQ ID NO: 47784 - DNA, 1031 bp, Homo sapiens
aaatttgggtttttttgtggttattatttttgtgtcctgtttaaaaaaatgtttgcttccccttggtggtaaagatgttcctagatgttttatagttttaactattaattttaggtctttgatccacattggattaatttttgtatatggcataagataggagtcaaggtttgttttttcccatacggccaattctccacaacatttgttgataagacttcactttccctatcgaattgctttggaacctttgccaaaagtcaattgactataaaagcattggtctatttctggacactgttccattgatctagttgttcctcataccagtaccacactgtgggtttatagtaaatcttaaatttcagtagtgtaagttttccaactttgtcgttttccaagattgtttccacataaatttagaatcaacctgtcagtatttacaaagggcctgcgggcattttggttaggattatgttgaatctgtatcaacatcgataagtgacatcttaaatttttttttttttttcccgagacagagtcttgctctattgcccaggctggagttcagtggcatgatctcgactcattgcaacctccgcctcccgggttcaagtgattatcttgcctcagcctcccgagtagctggaattataggcgcgcaccacatgcccaactaatttttgtatttttagtagagacagggtttcaccatgttggccaggctggtctcgaactcctgaccttgtgatctgcccacctcagcatcccaaagtgctgggattacaggcgtgagccactgcaccccacctgacatcttaactttgaaacttggtggtgtttttttttttggatatggggtctcactctgccacacaggctggagtgcagtggcatgatctcagctcattgcaacctctgcttcctgggttcaagtgattctcatgtctcagccttccaagtagctgggattacaggtgtgggccactatgccctactaattgttgtatttttagtagagacgaagtttc

SEQ ID NO: 47785 - DNA, 1046 bp, Homo sapiens
atgtagaggtcctgaatgtcttttgttaaatttattctcaggcattttacggttttttgatgctattagaaatgacattgatttttaagaacaatttcattttttaagggtttgctgtcattatatagaaaatacagctgaggccgggcgcagtggctcacgcctgtaatcccaccactttgggaggctgaggtgggtggatcacaagatcaggagattgagaccatcctggctaacatggtgaaaccccgtctctgctaaaaatacaaaaaattagccgggcgtgttggcacgcgcctgtagtcccagctacttgggaggcggaggcaggagaattgcttgaactcgggaggcggaggttgcaatgagccaggatcgtgccactgcactccagcctgggtgacagagcgagactccatctcaaaaaaaaaagaaaatacagttgatttttttgtgttcactggtaccagacactttgttgaatatacattagttttactagtttttgttgatttcttagagttttctacataaacccttatgtagtttgtaaataaggagttttacattgtctttttcagattacgtgccttttatttatttatttgtattttgccttattgcactgtggtatacttctagtataatattaacctcaagttctttctggtctgaggaagaaaatgtttcatgtgtcagcatgaagtgtcagctgtgggtttttcagagatgctgtttatcaggttgaggatgtgttgccttctgtgtctagtttgctgagcctttgggttttttgtttttgtaaattatgggtattgcattgtgttcaatgatttcctacatctgtgttcatattatttttctcctttattttgataatagattgcatttttttttaatgctaaaccaaccttgcattcttagaataaaccctccctctttgtatgcctagactcaatttgttaatatgttttaaagttctgtcatgagggatattagtttgtaattttctgttcttttaatgtctttgtcaggttttggtatca

SEQ ID NO: 47786 - DNA, 1935 bp, Homo sapiens
ctctgtaattgttgtcccctctgtaattttcccctctgtaatctcctaagctatgttacctgcctcgtcttccctccctcgccacgtacgtgtgtgggtagacacacaggcccacacatctgccatccctgattcccgcttttctctgatctgcagtattaccgggcccttgcaaatgctttgccccagcaccattgcttccattgtgaggcgtccagacgagcatggcacccatccccttcttgtccagccacccctgcagctctgtttggaacacctcctccttttccatgctgtgtcggctctgcttgtctcctcttgctctttttattgtggcactgtttagtagtcatcttttgttcttttgaggggcatttattgagcaactggcttgtgcagagcatagggagggagatgtaccaaaaggagacggacacgcacctgggagtcctggttcaaatctgtgagctcctccctgtgaggggtgccccgttaaccttgatgagactcagctactgactttttaaatcaagagtgtccaatcttttggcttccctgggccacactggaagagttgtcttgagccacacataaaatacactaacactaacgatagctgataagctaaaatgaaaaagttacgaaaaaatacctcataatgtgtttttatttttttttttttctgagacggagtctctctctgtttgttgcccaggctggagtgtagtgccgcgattttggctcactgcaaccttcacctctggggttcaagcacttctcccacctcagcctctagtagctgagattacaggtgcctgctaccacacctggctaatttttgtatttttagtagagacttggtttcaccatgttggcctggctgatctggaactcctgacctcaaatgatcagcccgcctcagcctcccaaagtgctaggattacaggcgtgagccactacgcccaggccctcttataatgttttaagaaagtttacgaatttgtgttgcgctgcatccagagcccagggccatcctgggccacatgtggttggacaagcttgctttaaagtgaggatcatgaggacttttttttgcatcggtgaaatagtgtgacatatcgtgcctggggctctgtttaatgagagtgacttgataaatggtggggctgaaccgtggaattcacatggaagtagtgggagtggtggtccattctaatgaagaaaatgatttggacagctgacttgggaattctcaaggcctctgaccagtgagatcagaaatgcttggcctgagtgcaaaaacttaacatcaaatgtggtttgtcctaggaacagttgggaccctaggaggcagcggcagttgtcaatgagctctgcagacagtgcggacgctaagcggactcgagaggaagggaaggactgggctgaagcagtgggtgcgtcccgtgtggtccgaaaggcgccagaccctcagccaccgcccaggaagcttcatggctgggcaccaggccctgactaccaggtaccaagggcccttggctgtcctgtgtatttgtacttcattgagttgggtggctgggtttctgagaagtcctaagtgggcatttctttttcatttttatatttcttcttttgttaaaatgttttttcatagagacagggtctcactatgttgcccaggcttgtctcaaactccagctcaagtgatgccaaagtgctaggattacaggtgtgagccaccatgcccggctgttcttactttttttaagataaggtcttgctctatccttcacctcccaccctcaagcgatcctcccacctcagcctcctgagtagctgggactacctgtgtgctgccacacctggctcatttcattcattttttgtagagacgaggtcttactatgttgcccaggctagtcttgagctcgtggg

SEQ ID NO: 47787 - DNA, 1816 bp, Homo sapiens
ggtgaggcccggaagcaggcagagaaggaagtgccctggtctccaagtgctgagaaggcatctccccaggaaaacggccctgctgtccacaaaggtaagagctgggccgtcttcccaccaactggaaaccctggcctgttgtcctcgtcttgttacttgcaactgccttccttcttagctagcagaacgtatggcttacaacgagatcgtattgggaagcatcagttattaagagcataggcctgggtcaaatgcctgggttctgatcctatttgaacttcttttttataatttcaacttttactttagtttcagggggtacattgtgtgatgctgagatttggggtatgaatgatcctatcacccaggtactgagcatagtacccaacaggtagtttttcagccctttttccttctcccatctgaacttgttaaactagctggtgagcacctcacctctctgaagcctgtttcttcatctgtgaaatgggatgagtatgtacctgccagcacgcggaggggtgtacagcacgctccagtttctgggacattgaaaccatgcatctactcactgatgatactcatcatcgtcactattatcctcgctatccctgcctaatcaaagacacgtgtgctctaggactttaataaaaccacagatcctttaacatggaataaaaataagcccacttgcttggtagaatacattttttcctggtgttgattctaaaaggaatggatcacatggccctattttttttttgaaatggagtctctttctgtcacccaggttggagtggtgtgatctctgctcactgcaacctctgcctgccgggttcaagcgattttcccagctcagcctcctgagctgctgggattacaggcgtgtgccacgacgcccagctaatttttgtatttttagtagagacagggtttcgccatgttggccaggctggtttggaactcctggcctcaagtgatccacctggcttggcctcccaaagtgctgagattacaggcgtgagccactgtgcctgggcaacacggccctatttaagagtaatgaagcagtgctctataatgcagagtgtctcttgtagcagttttgaagaatataatcagctgttttctttataattttcttaaataaactcagatcagctcttgttaggagacaaggggatgtttgaggctctgaaagcttctcgggttagagagtcctagtgcccttctggccagggaactcatttctagtttttcttctgccctcctttcattaaaggttgagtgaggactgtgccactcttataggaaagttgcactgagcattttctgcctgtcaggcactgttttcagtatattattgtaattaattcaattcttacagaaacccttggtgaacacatggtagttattcttatttgcagatgaagaaatggccaaggagagcctgaaaaatgtgcctaggtcacatagcctttctcttgtttttgtttttttcctcttttaaaaaaatgttttttcctttatatccttgccagcaggaagtcatacacagcatttccatatgttgagttcctgctgttcagatgttggatatgtgggctgtcactgagttcatggctgttctctatcagtccttttttttttgctggggggagatggagtcttgctctgtcacctaggctggagtgcaatggtgtgatctcactgcaacctctgcctcctgggttcaagcgattctctcacctcaacctcccatatagctgggattacaggcgagcgccaccatgcctggctaatttttgtactttct

SEQ ID NO: 47788 - DNA, 1022 bp, Homo sapiens
cccatagccccagactcttcacggcctcccaggctccagcttgctcttgctctttgacccggaggattgcctggctcctctgtctccagggggcacaccgtacccagcctgcggccacgacagtcttcactctcaaggactccaggggccaccgaccaattcatggcctggcatttctgagacgtgtttaaagatagaacaaatgttgatgcttatgtttttttttggttgttgttttttgttttgtttttctagctttctttttaaaaagtgttttagtttttgtttttgttttttctttttaaaactaagctctgtgttcagcatggaaaccaggaaccaggctccaatcgcattgactgatttttctggttccttttcaggaatgaaagctctttctctgcctcactcggaagggcagggggcgtaagtgctcagcgcgatctctttgaggagagaggggaggagtacttgagtgcttttgacaagaaggcccaagcagactttgacagctgtatctcttctcaaagaataggccaggagcttttgtttccaccccaagaaaatgttcaggatgcaggtgctcctgggggtcacacccaaaacctcaggtgttccccattggagcctgactttgtcccagatgagaaaaagccagagtgtggcagttgggatgttagccaccagccagagaccgctgacacagcccatggtgttgagcgggagacaccccgggaggggacggcctttaacatctcctcctgggacaagaacgggagccccaacaaacagccatcctcggagcctgaatggactcccgagccccggagctccagcagccagcacccggagcagacgggcaggacccggaggtcgggacccatcaagaaaccagtcctgaaagccctcaaggtggaagacaaggagaaggagcttgagaagattaagcaggagctaggggaggagagtacccggctggccaaggagaaggagcagagccccacggcagaaaaggatgagga

SEQ ID NO: 47789 - DNA, 1034 bp, Homo sapiens
tgcggatcccggcgacctacagacagagactatgtcccagattcctacagacaccctgacgcatttggtggccggggctttgaggacagccgcgcggaggacaagagatccttcttccaagatgaacacgtggcagattctgaaaatgcagagaaccggcccttcaggagaaggcgccccccacgccaagataagccccctcgattccggcgcctccggcaagagcgggagtccctgggcctgtggggacccgaggaggagccccacctgctggcaggtcagtggccaggcaggcccaaactgtgttctggggacaagagtggcactgtgggccgcaggtcccctgagctctcctaccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaaggtaaaaccagacaccatctgggccctttttgttgttgtgttctgttctcagcagcactgagttcacgcatgcatgccgatgccgccgtgtgtcggggctgggggcctgcccccaggccgtctgtgcgcgtctccattgcctgcccccacattgcctgtctgcttctcgtggtggtgttattgtggctagagctcccacccccacccccaccccagtggtgctcttgaggccactgtccagcacctgacctgagagtccagtcatgtgtccctggagccccgccgaggggccgctgcagcgaggaacgttgcctgtgcacagtgccaggtgccggtcagtccaccagagtcctctgctccg

SEQ ID NO: 47790 - DNA, 1049 bp, Homo sapiens
atcactgttatgcagtggaagaaaccgagtcttgaagagggtgacttctctagggtgataacagtggaaacttgtccaaggcaagatgcagacctccgtcacctcccagcttctccttcctccccactcctcattcctgagtggaatgagatttgtctccctcaagtcaagtggatcgtgaacgctatactaaaatggagtcagggctggacctgcacacagattacagtccgttggcctttcaggtctttcttggggggtgctttgcttggcatcgcagttctgcttgaggttttgggagacgagcgttccacacatctctggagcattttcaggtggtgtgatttttggtacctgggatacttatcctggggagaatttgtcagtcttggtgcctttggctagactacagcatcctttcttcccctcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccagggtgagagttgggggtgtgaccccagctgtggcacccaaggtcacatcacacactgggtttgcttctggggaggatcctgcttttgagctacgaatatagatggaatacagatggagtacctgtttgctgtgttccgctgctgagctagtcgctgaatgccgtctgagtgatttgctgctgcaacccccaaacggatacacaattttccttgcctaaaattggtagaagagcagagcattcattagtctggtgatctggaaaaggatggccccttgggcttagatcacacagtagtgggaatggccttctttgttggtcgtcgttttctcccactaacttatggaagagaagcaaatgacagatagaccagccgcaagagttcaggagctctcttctgtgctgtgcacccttttcttaacatggggaaggctctggaaacccctccctgaatgctcttctggaaaggcaaactgaga

SEQ ID NO: 47791 - DNA, 1103 bp, Homo sapiens
ggtggcctggctgggggtggtggggaggagccagtgcagggcggaattggcttgctcatctatttctcattgtctgtctggttttccatccccctcacatgtggtgaccagcacctggcccgccacggcagccaggaggcatttgttaagcgaataatcgagacagggaagaggagtggagttggctgctccagactctgcttagttttcctttctcaaagttctccctcctgtgtcctagccggggaattagctaaaatggaattttctttggtgatcaggtatccttctgatgaagagaagaaaggcctaaactcccaggcatggatgcattagaaagaggtagtcttagaaatgagcaggcgttggttatttatgcaggactggcatactttctgtgctgccaaggggtgatttttggaagtctcccctctaatgctggtgctgggcctttgggatggtctagccgcccctcagacccatgtgcctccacagccacgacagtggacttccaggcagaatctgctccaagtgcaggcttgctgatggaggatgtggcctctgctgacctctttttaaaaacatgttcttaactgctgtattgtttggttaccaagattttggttcttgcataactgggtcagactgcatgtatctttctttttgtgcattgttaaattcagcgttatgtttttggaactcacctctgttgacgtatgtgctaggatccatttttgttgctgtgtagaattccagggtagggatatgctgtggtttggggttgctaccagtttttcattataggctttatcccaatagcaagggaagcccaggaatgacatgctggcatttgaattttgggcagtgttccagcagccatgtggagaggggcaggggaggtgggaggggaagaaccacctggatgggccttgcggttacctccccgaccccgttttcccgttcacaggccgccgctgcccagcagatcccgatctcccttcacacatctctgcaggcacaagctcagcttggactgaggggtgggcttcctgtgtcccagtcccaggagatcttcagctccttgcagcccttcaggtgagctc

SEQ ID NO: 47792 - DNA, 2009 bp, Homo sapiens
ctaagcactgcctgctcctgcagcccccagacgggggctccttcctttctccctgcccttgtgcagtagggtgtggaatgggttaagagtcctctttgtgtagttgttgatgcttctagactcctcttcttccttcctccctgaaacgccagctttgaagcccacaccatagactgtgcctgacaagcccttcactctgctatggtgccatcaccacatccagtgtctgctgagaaatcttcctctccgtcaacctgtgggcagtatttggcacctttgaaggtcaccctccttgtctggtctggcttgcagtctgtctccactctcctgttccagttcctagtggttttgatgtctgcagagatgaccccgggtctctgtgccatggaccctgtccatgcagtttgtgccctcctcgccactggtgcccttgttcacatgggcccctgctctgtgcactcctgtctaggcttggctgctcccagtagctgtggctctcgcataatctcaactctcagtgtccctctcagttgtcacctctggctttttcaattcactccctctagtgacccaactccaaaattcttttttttttttttttttgagatggagtttcgctctgttgcccaggctggagtgcagtggcgcaatctcggctcactgcaacctctctgtctcctgggttcaagcaattatcgtgcctcagcctcccgagtagctgggattacaggcgcccaccacccaccggctaatttttgtatttttagtagagatgggggtttcaccatgtcaggctgatctcgaactgctgacctcagtgagccacccaccttggcctcccaaagtgctgggattacaggtgttagccaccacacccagtctctgccacccatgtttttgtcatcctcccccttggcctggcttcttcctccccatcagcagatctgccgagccacatggcctttgcatttcatccaagctgtggctcccagtcaacccccaccctcctagcagcttttcagacttgcatcttgcccctcgctgcctcccacccatgacctccctttctgtgtcacccaggaaacaggagcagtgacagtctccaagcccctgtggccacatccctgcctaggtgctgcctgtgcccctggggggccctgccccagcacatctccctctctttcatgcatcagatatcccttcccgtcagtacacagacgagctgcagtgctgaccccgtaatcccgccccccacacccctcgaaccactttcttcacccagtttccaggccgtcgctcctggctttcctgctgcctcaggcctcctcctcagtctcctttgctgtcccctctccttcccagtctgtaatggtcagcatgcccgtgggccctgctttgggtgtgtttcaagagtcatggctctaaattccttcatcttctcctcactcccaaatggacatctttagctcagatctgtccctggaattgaatctcaaatccaatggactttccagcatgtctgctatggtgtcttatggcatctcaagactcatcatattcaaaactcgattttcctcccggtccttctgcttgtccagtccacatcctccttggctccctgctccccctcacctcacccccttacccttcagcaggcctgtcagctctggctttaaaaggattcagaatccagctgtgtctcatcccctccacacccctgcatgctgtccagctcctgtagggactcctacctggcctccctgcaagtcagatcataccccaagtcagcactctataaatggcagcatcttcccatcattttcatcctgcaccattttggtgctccaaggaggagcatggtgttttgcggctctggccaccacaagtctcagtgatgtaattccaatagatccttctgaccctccactgtggactcaatagcagggagatgaagaggacagtgactgagagaccaaaagtggcccagcccccctaccccatcctgttcc

SEQ ID NO: 47793 - DNA, 1008 bp, Homo sapiens
ctgtacaaaggaatgcagagatatacgtccgatgcagctttcatcttttgggacttggcttcgccattacttctgactttcctcactcgtcctctccttgcccaccccgccccgtgtgcacccataaatctggtgtgcacccacagatcctatgccgctctgcatcccgagtgtcctgcagctgtgtccagtgtgtgacacactatcctggcagtgtgcaggcccatgttggacagggccctgccgcttccttggcaccttgtatgctttcagtaagcacttgctggacaaaggcagaaagggctgaagatagacgcagcccttagcagagatgtggatgagacacacttaacgctgttagttcccatgcctgcagccagcttagtcttgcccgttttctcaccacctactctattccagcaagaagacgtgcctctgccatcgaaggtgtgaaatcctgggcgatctctcctgtgctgcagtagaaattagagcatgtcctgctttatgcaggctttgctttagttcttctgaagtgtatgaatctgaagtgcatgtgcggtcgctctttggtgcgtttggggtttctccatagcatcattccccctcctgactgtcattgtcgcccagcagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagaggtaaggggaccccatctgcctctgaccctagggagggggccttgtgtcaccaactttttctagcaagctaagtacccctgtgtggtagaaagagccagtggcgtgggactgccagggcagaaaggaaggtgaccatgtgtggggccatcacagaggcaggtcctggggactctgaacatgtcgagggctgagggccaggaatcagcattcctccccagc

SEQ ID NO: 47794 - DNA, 1025 bp, Homo sapiens
agctgtactggtctgtgggaaaattgtcttccatgaaactgggccctggtgccaaaaaccactgctctataagatgcctccctgggaattcccatggccctcaccacctctgccctgggttgttcagtaagtgtgtggtccagctgtctccagggcctcaaatgacagcttgttcctgcttggtctctctagccctctcagatggagatgaaaggcttccactttgccgacagtaaacagaatgtcccttcaggaggccccgtgccatcgccacagacctacaggtaaagccactccctggggactgcgtgctgtgtagctgagcagttgccagagctgcggcccagtgactcagaagaatctgggcccagggagagccgccagagacctggtccctctatgggccatgtgtcactgtggtgtttcagcactgggatgcacttgtgttccagttaaatttgggggagtgaggagtcaggagagtggttttggttttaatcattataataagatgctctggattggggagctttctggaaaggtaggaaaaggaacggctgacatttagtaggcatcaggactgacgtgacttcccattagatcctaaaaacaggacccactggccacagggctgcatcctggcaaggggaggagcgtggcctttcccagcgtctctttcctcagacttgccctatgacccctgccaggggactttttattgctgggcttatggggccattccttccatgctacaaaccagcaccctctttttgcttcctttgtgtctgtctccacctccagcaactgtctcaggtccccttagctggatactcaggtggctctgtcggatgttggcgagagcctctggtccactgccttttctgcccgtgctggtgtgtgaaggcagcacgctctggccctgggctccgagggcttgtacagtccacccttgttacatgtgggagattcctgagacccctctgtgtttacaaatgagtgaaacagacctgcctgacccatggtgc

SEQ ID NO: 47795 - DNA, 3139 bp, Homo sapiens
gagctttccctgcaactcaggagcaggaagggagtggtgggaactatgtatccaaacacgtttcagcgtcagggtcactttgtttttcccattcatctgtccaaaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacataccacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctgtgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgc

SEQ ID NO: 47796 - DNA, 1134 bp, Homo sapiens
gcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaagctgaacgtgctttctcaggttgtacatccctcgtttcttggtcatttgaccagagagacctacagatcaaagaattctaattttacagagttcacacggaaattaggagtggcacggctgaaatgccttaacagaagctgtgtgggtagagaagggattgaaacccgtggctaagaagcatcttccaaatgcggcagcatcaagcactccaccctcttcccacggatggcatctggttgtgcacagtgcctgcctgtggccccgtcacttgccgtgagaaacgagctggtcagaggaggtaagcatttgatgtggcgtgttgtgttgtcacttctagcggtgcttttgcaggaagtggaggagga

SEQ ID NO: 47797 - DNA, 1030 bp, Homo sapiens
agcagtttcttggttatcttcacctctccctgattgaaaacatgttattgcagttgattcccacgttttcctttcatacttgcagccgtttcattgggtcatcgctagccacagacatgtgctgctggtgggggcgggggtgggggggttgggtaggtgggtaagcaggattagccttgcgtcccaggaggtctttcagcaggttggctcatagtatccacctaaatcaaacacaagggagagacagaatctgtatgggcaggcatgctgagtgccagctgtgcttggtgaattccccatgtctctgtgggtgggtgatgctgtatgcatcttaatatttggggatgggaaacaattggggcaaaagatccagcctttgctgatcactcactcaaagtcatttggaaacacatacacatttatcctcacagtttttgtttacagttaagattctaattgaatataatatgggttgttgtttttttttctagttttgacgaagtatattatgggcagtacatctctttttacatgaaacaaatcttcttcttggatgacagtgggccgccatttggccacatggtgctggccttgggaggtaggagtcatcaggagagtagcccctacccttcaggacctcaaatacatttaaaacttatcagtgcatttcttacaggcagaaaccaggtcttattattgatgcatcttgtttattgcttgccacagtactctagaaatatttgctgaatgggatagttactgattaatcttctgtttcaggttatttaggaggattcgatggcaattttttgtggaacagaattggagcaggtaaaagataattttcatttcccttttaatgtgcgcaggttagaatgaagagattgtgacttttgtaaggattaacaactgtggctttttttttcctttcatacctagtcccacagaaactgtgccttattaatctgagtccagaaaataataaattggttggatacaaatgaaagacttctggaaagtctggttaaaa

SEQ ID NO: 47798 - DNA, 1103 bp, Homo sapiens
agcctctgcgcctagtgctagatatcttttggtcctctaatattttgggggttggcccttggcttgtgacttcataaatacatcttcatttttctataatttaaactaacaggacaacattttctgggcaaaaagaaaaattctgctgggatggatactttgggagatgggaattctttcttactgcccctgtggctcagcatggccagccgacccagaaagatttctctgaagaatgtggagcttcactagccttttggaaatgtgtctgaactatttctgtctccatctgctttgtttttattccagccctttttctctgagctggtggttctggctaacactgacaggggtcgcttgttcctgtgcagtggggtgagtttgagcctctggtcttgggcagtgtcctcctccatctccttatgttttcctgtctcatgttaactccatttctgtcatgtctttgcagcatcaagtacatgggtgtgttcacgtacgtgctcgtgctgggtgttgcagctgtccatgcctggcacctgcttggagaccagactttgtccaatgtaggtgctgatgtccagtgctgcatgaggccggcctgtatggggcagatgcagatgtcacagggggtacttggtgaaaagactccaatcctcaatgttttagaagcaggcaggcctgggcagcctcgcctcttggcctctgcaggtgcctctgtatgggaggccagagtttctgtcactaactttttctaagctcacaatgtctagaggtgggtacgcttttccacgcagtggaacatgacttttctttgaatctctggcaggtctgtgtgttctgtcacttgctcgcccgagcagtggctttgctggtcatcccggtcgtcctgtacttactgttcttctacgtccacttgattctagtcttccgctctgggccccacgaccaaatcatgtccagtgccttccaggccagcttagaggtaagtaagcagtgggcatcgtggccactggagaaggaagatgatagtggacccagagttttcttacaaacacatcaagtgaacattagcacttgaatcaaaacatgaagaatccacatcc

SEQ ID NO: 47799 - DNA, 1865 bp, Homo sapiens
tggcttcaagcgattctcctacctcagcctcccaagtagctggtattacaagcacctgcaaccacacccagctaatttttttgttttgttggtagagatggggtttcaccatgttggtcagtctggtctggaactcctgacctcaagtgatccgcctgcctcggcctctcaaagtgctgggattataggcgtgagccaccgcgcctggcagctgggagcattttaaagtcaagtcttacaaaccctgggcagtttcacccgccttaaggaccacactcaactgtgaccttcattcctatgaacctcgcagcagtggtagaaggtatcagtagaggtggtcaggactgtggttcctgaagtcagccaagcctgccgacggccagtgctgtagtgctgtgtgtttcagcaagttgtttggctcaccctagtcttggttttctcatctcttagacagacatcatcattgctcttacctcattggatgcttgtaaggactgaatagggtgcgcgtggaaggctgaactgagtgcctggcccagaggcagcatttgatcagacttagtgctcattatggttctataatgtaacgtgatgtgattaaatgggagatcattaccactgttacaagaatggccaccagcctaaacatcaccccagagggaggagtggccatcgggaaggctggcttagggtcatttttctttctgtctctcactcatcaaccttctgcttctgtctcagggaggactagctcggatcactcagggtcagccactggaggtggcctttgggtcccaggtcactctgaggaacgtctttgggaaacctgtgccctgctggcttcattcccaccaggacacctaccccatgatgtaaggtgatggttttactttgaagataattaaatgctttatttgctcgtagatttgcttatcttagcaactttccctttctttgaggaagtttgtttgcaggacagaaagaagttgagcagcccgggtgctgattgccagtgagcttcgtggttcccgggtgttgctggagggacttggcgtgtggcagggcccagggtcggccccagctctgtggctgtggctgacctcagcactgcctgcctgaatcatctgatttcggctccttgtctgtggtatcttcattttccctgaaaccccttgctaggttgtatttgttgaaatctgcttccctttgcagaaactttaggagaaaggcgtgtgggcccgatcgatgacccacttccagatacgtttctttccctttcttttctttttctcataaatagacacagggtctcactatgttgcccaggctggtctcaaactcctgggctcaagcagttatcctacctcagcctcccaaagtgctctgattacaggcctgagccaccgcgcctggcccagatacatctctttgttgacttcacacagatatgagaacggccgaggcagctcccaccagcaacaggtgacctgttaccccttcaaagatgtcaataactggtggattgtaaaggatcccaggaggtgagtgcaggtcctgtgactccagagcagagctcacctcctggcctggccaggcgagaccctgggatgcagtcctgggcccccttctttccctccctcactgactctagtcaccgtcatggccttgaacaccagctcagtgctgagtccaaggtcagaggaatagatcatgagaccctcagtgagcagcctgctcagtagctgctctgagaagtttccaggcgagcctcaatgccccgacctgtgtccctctcccttcctcataaaaacaagaacccccctcctgcaaaagtagcatcatcttgcacacatcccagctagagg

SEQ ID NO: 47800 - DNA, 1040 bp, Homo sapiens
tttctggttctccctggaaagggcccagtagctgaggcatcacctgactccttcccctcccctcccattgcatgttgattccattgggagatcctgtttctcaaccttcagaaccagccctgggtaggggtccttccttctccctctactcccacctcctggggcctgacctctctacctcgcagcagcctgtccggcctgcggaccgtgcacaacccacttgcgttgttcctctgtgctcagtgactcccgtcacccgccaaggtccctggtgaccctgacacacttcacccccgccaccctggctccccccagccctgaaacaaccacctgcgggccccttgggggcttcacacttgctccctctgcgagaatgttcttggacttggctcccccatggcccctctatgtaggggtctgctgggatgtcactgcatccaaaagtgcctcctgggtgctgtcccccaccatttgttttattagtggcactcctacaggtgcacgctctgcccaccggcatgatggctgtttcccagagggctgtgagggccttgtcttgttcacagctgggtggctgctcctagacagtgccaggtgcatggtgcggtaccacatggttactgagtgtgtggattaagaggaagtgggtgttcctgaccgggcgtgctggctcacacctgtaatcccagcactttgggaggccaaggtgggcagatcatttgaggtcaggagttggagacaagctgggccaacatggtgaaaccccgtctctactaaaaatacaaaaattagccaggcatggtggcatgtgcctgtaatcccagctagacaggaggctgaggcaggagaatcgcttgaacccaggaggcagagattgcagtgagctgagatcgcgccatttgcactccagcctgggtgacagagtgagactccatctcaaaacaaaaaagaagtgggtgttcgttaacattgaggttgatagccttttctcccagcttatctgctgcgtccccaggccagctgggcgcaggggcgggcag

SEQ ID NO: 47801 - DNA, 1301 bp, Homo sapiens
gccggggacggcggcaccgggcgggtagggacaagactaccgcgcgtgcccccgcctggtggcagcccctctctgcgtccctcgcggcctggcaaaattacattcggccgagagttcacgctggggaagctctctgaatgcctctgagaagcgagatccggcgccatctcaccgacgagcctcccctttaccgccccgtgcgtttcctcagcactttaggaactaaagcctgtctgggtagctccctaacaggctctggagctcaatccctgggcagggaaaagggggtcctcggggctccccgctcgctgtcctttttctggacaggcagttccttggccacctggtagggccgcgttgcctggcaacggcggggtccttcttggctcggcggcgctcggggcctgaggggagaaaaccgccgcggagggcgctgggggtggcggcggcggtccgggaggtggtcgcgcgactgcgtggagcgccagggcgtccgacctctgcacctgagagaagatgaacacggccgaccaggcccgggtggggcccgcggacgacgggcctgcgccgtctggggaggaggagggagaggggggcggcgaggcgggcgggaaggagccagcagcggacgcggccccggggcccagcgctgcattccgcctcatggtgactcggcgggagccggccgtgaagctgcagtatgcggtgagcggcctggaaccgctggcttggtccgaggaccaccgcgtgtctgtgtccacggcccgcagcatcgctgtgctggagctcatctgcgacgtgcacaacccgggccaggacctggttatccaccgcacctcggtgcccgcaccgctcaacagctgtctcctcaaagtaagtcatcccccgccatccctggggtcttcccctgtccccctctcgcggccgcatcatccgtcccaggggaatccgatcccacactctgtccggggatttccctcttcgcaccgagcgctggggatttattaagcagccagggttaccacagcttaaaaaaaaaaaaagaaaagctctgcagctgtctgcaccctgtttccccaggtcacccgccgccgcaaacacaggtacacacccagggggcttcccggagttgagtcccaggaacccctccttcgcccctccgtcgggcccgcacatggagcgggttactcgatggtgctttctgagactccaccccctgtagatccaacccggggcctgcctctgtcgttgctgctattgtttggggccgactttccgaggttcttggctggctttgtcta

SEQ ID NO: 47802 - DNA, 1130 bp, Homo sapiens
ctcttcatgcaacacaattgagtcaggaatcacctctcccagtgtattgttttggtgggaatatgagcacaataatcgaaaaatgagtggccttattgtggggagtgcttttggacccataaaaattcttcctgtcaatctcaaagcagtcaaaggctatttcactttaaggcagcctgttatcttgtggaaagaaatggaccagttacctgtgcacagtatcaaatgtgtgccactttatcatccttaccagaagtgtagttgcagcttagtagtggctgcaagaggctcttatgtattttggtgtcttcttctgatctccaaagcagggctgaatgttcacaattcccatgtcacaggccttcactcactgccaattgtctccatgactgcagacaaacagaatggaacagtctatacttgctccagtgacggaaaggtgaggcagctgattcccattttcacagatgttgcattgaagtttgaacaccagttgattaaactctcagatgtgtttggctcagtgaggactcacgggatagcagtgagcccctgcggtgcatacctggccatcatcaccactgagggcatgatcaacggcctccaccctgttaacaaaaactaccaggtccaatttgttactctcaaaacctttgaagaggcagctgctcagctcctggaatcttcagttcaaaacctttttaagcaggtagatttaatagacctagtacgctggaagattttaaaagataaacatatccctcaatttttacaagaagctttggaaaaaaagattgaaagcagtggagtcacctatttttggcgttttaagcttttcctcctgaggattttatatcagtcaatgcagaaaaccccttcagaagccttgtggaaacccacccatgaggactcaaaaatcttactagtggattcgcctgggatgggcaatgctgacgatgaacagcaggaagaaggcacttcttccaaacaggtggtgaagcaaggcctgcaggagaggagcaaggaaggagatgtagaggagcccactgatgactcgctccccacgactggagatgctggaggccgtgagccaatggaagagaaactcctggaaatccaagggaaaatcg

SEQ ID NO: 47803 - DNA, 1026 bp, Homo sapiens
ggccgggcacagtggtcatgcctgtgaccccagcactttgggaggccagggtgtgaggatcgcttgagcccaggagttcaaggccagcctgagcaacatggtgagaccctgtctctacataaagtaaaaaaaaaaaaaaaaaaaaaaaattatcctggtgtggtggcacaggcctgtagtcctagctacttgggaggctgatgggggagccatgttctcaccactgcactctagccggggcaacagcgagaccctgtcttaaaaaggaaaaagaaaaaatagaggtatgtatgggaggaattctgagtagtttttgtcactgtatcattatcaggatgtttggcctgtctagaatagcagagtgagtttggtcatctttgctgttagggaccatatgttagaattcttaagactgaaaagaaaaaaggccaaaaattaatgggatttaaatttgtagaggatatacagaagaggtaagatagctggcttaccaacttctgagctagtaagacaccctttgaaacgtaagtgaactaattttagtgaattaatccaaaatcttgtggattcatccataagaggttaagcagaaatggattcgaaactagaagggcgctatcactagtaagagaagacaactcttgagggttgtgtatcccagcctccaaattacatatccagtgaagttttaaaaaaaaaaaaagaattggattcaagttttcttttcagacttttatttttaaacagtataatctttttttttttttttttttttttactgagatggagtctcactgtgtcaacccaggctgatgtgcagtggcgcaatctcggctcactgcaacctccactcacgggctcaggcagatccttctgcctcagcctcctgagtagctggaattacaggtatgtgccaccgtgcctggctactttttgtatttttagtagagacggggtttcaccatgttggccacctggtctcgaactcctgacctcaagtgatccacccgccttggcctcccaaag

SEQ ID NO: 47804 - DNA, 1133 bp, Homo sapiens
aaccgtgtctctactaaaaatacaaaaattagccaggcgtggtggtgcacacctgtaatcccagcactttgggaggccgaggcagacgggtcacttgaggccaggagttcgagaccagcctgggcaatatggcgagactccgtctctactacaaatacaaaagttagcctggcatggtggcgcatgcctgtaatctcagttactcaggaggctgaggcaggagcatcacttcaacccaggaggcagaagctgcagtcagccgaggtggcaccactgcacttcagcctgggcaagactggagactgcctcaaaaaaaaaagaaaaaaaatgttggtacttagatgataccatgacggcaacctccccacccccaccccgcattgataggtagtgcagaccagcccttggaggcacttctaaacagtctgctcagaaatgttttctgtttcctattcaaattgctgttttgtctcctatgtttaatcatgtatttgctattctgcttatttttctcatttggtggtaatttcaagaagagcgtttatccactattgattttcaagaaagaaaccaagcagcattgaaatcatgagtaacagaattcagaacattgtatggtggaagtcatttgtgtctgcagctgttttttcactttacaataaataagagtaaaaattgagatcatgtcaaaaaattattgcagttttaatcattatggcatagtttcacttcccctccccccattagaatcagtggagatttgttcttactagggaattttggactgctgccatttaaaacttaggtttttatttaaagcagttgtgcatttttgagaaaatgtattgggagtaactagagaggatctcccaaatttttttgtatgtctctctaggagtaaacatggcaacagtttttctagaacgtggactcactgcagggactggacccaatggcattgttaagaccctaaaatctagccaccacctgcctcccccaggtttccacacacccagttggaaggcctttccctgcccttgtccctgtctcacacccatggaggttaagctacagagctggggaaacaggagattttgagttaatggcagcctcacaaatagtgcttctgaatt

SEQ ID NO: 47805 - DNA, 1697 bp, Homo sapiens
ctaggtaagaaattgatagcttgttatgcttggtactcattctgaaatccctgtgtgtccaccaggcagacttcaagcaatctctacctactattatatctgccaaaactaccaattatttttcaatgtcagaagttattagagccactggcaaagctcatggttgaatatgacatttttctgcttttccctctaagaagtttttgagaatgttaatgttgaagtatgcaggctggacctaccagcaagtttaacacgttaattaggttaaaaagaatattaaaaggcaataattaaatatttcaattattttgtaattataatggtatcaaataagatgcaaaagaagttgatgcttattggtgcttaagagaattacaatactggttttatgagcatcttttctctgcaacagttaaactgcctcagagtttgtgaattgctgcaattcctggaatggaaacaggaattagggtcactggttgattggcacaggatctttccatcgtttctgctcctgacctctctctcttgcctttccttcccccagacaccctcttggtttccattcctttagttccctctgctttagaacacagattacatgttggaaagaaaaatggattaatggtaaaatttctaaaagctaaattgtacagtggggtctcacttcctagaagaaactattggtaatatttctttctaaaggtaatagtattaattgtatctggttttcttcaaaacttaactataatttccttgtcagggtgctcagtagctcttggtttgactttgggctaagggatgtgaaattttagctccttcccaccacctgtttcccctcactcccacccccagccaatattcttcataagcaaaaattatggttaagctaagctgaatgggttatattcaaagtaagtacagacggcaaataggcagacaaatacaggaatgtctttacaattagcccaccatggactgttttgagtctctgcatggtttccataattcattatgatgtatctttatgctctttcactgctcttctgtgcgttggagtttagcaattcagtgagactggggagtgtctcaagaatggaacctttgccttcaaggttgggtcatcaaaaatccctctaaaggatctaactgtaatgaactgtttttatttttgccattagtgcaagtatcaactggcagcctcaaacagctttagactatgtctcaggtctctcatagttatacttagaactgctctttcttgaagctaaaagaggtttttggagtaaagatctgcttcatgtctgctagcatggtatctgctgttcaacctagtatagagcatgtgaaatgcaactgtcctttaatggaattcagccaaactccaaaaatactgagttgcttctagttatctaaagtagtacagaatcactatcccgatgaagaagtggggtttttcagaagattgtaaactcatttccatggcacagatacaaatcatcgtcaggacttgttagccagtccatgtctcattgataggatgtagcctgccatctgcatagatggtttaacatggtgctgtttttgaaaacttgctgtggaaataaatttgacagacgagtagttatttgtaaagctgtcctagaaagaggttaattcttttggtatatgaatatttctcctccaatcctttt

SEQ ID NO: 47806 - DNA, 1054 bp, Homo sapiens
cctgagtggcggggtgagtagttttggtgggaaggatggttacagagcaggtgactcaggatgactaaggacagagcaggtgatagaagctaggaaggggttgtttactgaaactaggggcaaggaggcgtaaagaacgaggggttaaactttaaaatggagaacaaagaacagggaagctgaacatactgacatattggttctttgaaatggaactcataactcattgtatttattaattttccccctcttgaatttaaaggaaggtaaaaggctaaaatctttgaagtggaatttactgtgtcctataggctggtcttgaactcctgagctcaggtgatccacccgtcttggcctcccaaagtgctgggattataggcgtgagccaccgtgcccagcctggaatgggtttttatccctaaggcagtcagtccctgtttttgtgtcctgtccctgctggttggagttggaccacacaatctaagctaatctcaattggctattttaaatagaacaggggtgtgggttacagtgacgggacgagcgatttcggtgggaagactagtttcggcgggaagggcagttaaacagagcgggtaactaagggcaaggaggcacaaagaacaaggaagttagactttgaagatggagaacaaagaacaagggagttgaacaagctgaacctttgaagaagaattcactgtatagaacagtttccccctcttgattttcatacttctttctcttcaaacctttttagcatgtctcgactttgctgttcttggttttctaaaagtagaagtttgtctgaataaggcggggggaaattggaggttagtgagagctgtctccgtaagtctttgtattaaccctcaggcacagggtatgatacaacatcctacgagaataaacacgtttattacaatggcaagggacataaggatcgaggacataagtcctttccacctgccgaacaatcttcccgttagatcagtgaagagatcgtttatcccagaattttaagctagctcattggataaagcagtaagacctt

SEQ ID NO: 47807 - DNA, 1041 bp, Homo sapiens
aggggcagattcatgggtaagctcttggaagggcttaagctcactgcatcctgttaggtccccaaggaatgccaaattttccctgtcacaagagacacaaagtaaaattggcactgggagacagaagctggatagccctcaggggctgacccgcagggtgttgaacctcagggaacagcagagagagagctcggcacgatttatcaccccaggctgtggggtcctggaaaagagctaccgtacagcccatgcccactcgtctggaggaccatccaagtggaaaggggacagtctgggcttctggtctactgtgtgcacaagtgtaacaatcacttttgtttaaagtgcggacagaatatttaatccattccatccaggcgtttgcatctcagtaccctgtttcaattgctagagtttgctttaggtctcttacttctacagctgctactttggctgggtcgttgtggagaccggaggggaacactgggcctgatatgtttggggagagcgttgggtcccatacgttccctggactctgggtctgggtttcttcattgtttttaaccgccgatggtccagtcaaccttagagagggttcctatgggatcccgtcctgtaacatctgctcctaacccgtaccgtccgaatacagagggttcttgggccattgtttggggattatctataattagcaataaggggttacaccgcagtggcttacaatttggtggagtggagcgatggataagttagagtttttgtttgagtttccgcaacttatttaaaggaggggggttggctgtccgcctcccatattgactggtccaccaaacatttgcccagtcaccacaggggccctttaaggctccatacttatacttgtttgactgtctgcgatatggacatggatacttaactacatcggatagctgcctttgagcttgttcgtatctgcacggggtaagaacaagtgtcgaactgaagggtcaagggatggttagcctgagtcacattgatgacaagatgaccttatgttggaaa

SEQ ID NO: 47808 - DNA, 1026 bp, Homo sapiens
cctttgctgccttcccagtgaggggcgatcatgccacagcctgtgcggccttccttctcgaggcctctcctaggaggccgttatccttactctagaactacatggctgggtacggaaaggagagagcaaacactcactaagccctgcttttcccagaaaagatgtcagggcagcccatagggggacatagggtgacaaattagcagcagtgggtgagggataaggtcagagtgcaggagggcacagagagcagagcccggcacaaggctagtgccagccccatgccatgggcgccatggcctgctgcacgggcgggctcaccgtttccagtggccccaggagggcctgggtgctcctctgcctctcccagagcctcctggggagttggacattgttttttccccaactcctccgtggccttccagcctgtctgcccaacctgctcctggtgaccagccagctccctggagagaccccatgggagcctacatggagtctgcaacactggcagccccagggctctggctcaccttccctgtctctctccccctttgtcaccaggactctgtctacatcttccgggaaggggccttgccaccctatcggcagatgttctaccagttatgcgacttgaatgtggaagagtacgtatgggaggggccctgagacactgaggggggcccgtgggacccagggaccaaagcggtctctgaactcttccacttcacgtcggccttcatctccggcaagagcactcgcctgtctgggagtttggtgctgccgagagccctggcatgctggtggccctcgtagaggcggtgccctatagaaagccgtggctccaagctgcgcagagacagttcttactgttatgtccttgctcctcttccactgtccacataaaggccccatgaggtggttctcaatcccaggacccatcagatcccagaaaccttttatcgacttgttctcagtgatgtttaaagaattgcagggaaagggcactcactgggatgagaggagatg

SEQ ID NO: 47809 - DNA, 1025 bp, Homo sapiens
aggcaaaaagggaaacagttgagggcctataccttgtccaatctaattgaagaatgcacattcacttggagagcaaaatatttcttgatactgaattctagaaggaaggtgcctcacaatgttttgtggaggtgaagtataaattcagctgaaattgtggaacccatgaatccatgaatttggttctcagctttcccttccctgggtgtaagaagccccatctcttcatgtgaattccccagacacttccctgcccactgcccgggacctccctccaagtccggtctctgggctgatcggtccccagtgagcaccctgcctacttgggtggtctctcccctccaggagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacagggtaagacgtgggttgagtgcagggcggagggccacagccgagaagggcctcccaccacgaggccttgttccctcatttgccagtggagggactttgggcaagtcacttaacctccccctgcatcggaatccatgtgtgtttgaggatgagagttactggcagagccccaagcccatgcacgtgcacagccagtgcccagtatgcagtgaggggcatggtgcccagggccagctcagagggcggggatggctcaggcgtgcaggtggagagcagggcttcagccccctgggagtccccagcccctgcacagcctcttctcactctgcagggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctat

SEQ ID NO: 47810 - DNA, 2938 bp, Homo sapiens
ccgaaaggaaagaaggccaagggaaagaaggtggctccggccccagctgtcgtgaagaagcaggaggctaagaaagtggtgaatcccctgtttgagaaaaggcctaagaattttggcattggtaagtaacaaacggcagaatgaaaacggtctatgtttttctcaagggaaggtggtaattgggttgtgttgtatcttgtaggttttagtgggtgtaaagtggtcgcagtccttaatttgtgtctcttagagacgggggcaatgatacatgcttcttgctttcattgggagttgctgagcgagcattcagctcaatatggtagtggccttgaattcagcttagccatctggaaacaagtacagtagcagtgtcgcagcgaggtactaggactgcaattctgctgtacttcgtggcaccttggcttcttgttagatgaggaaaagcatcgtgctctttgttctcaggtgtttgtgtgcagatgatgtaaaagaatatttgctatctgagagatggtgatgacattttaaaccaccaagatcgctgatgcaccaacacccttcctagtggccccagacatgaacttgacatggaatttgagcctcactcggtgtcaccctttacttctcaggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacaggtgaggttctgtggcgtggaaaggagtttctcaggcaaggattccttatttcatccagaacatgagggggatggtcttaggcttcttgaactgcagttgtcattaaattatagtcatatagcaggaccgcagtccagcatttgttattaagtgttaagtgacaaggattagaaccttgactccaagcctaaactgaagagtgtttttccagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggtgagtaggccccaccttagggtgaacactgggggcgggctgttgcagtgatgtaaaatttcttggcctgaaattactgtgaagagtaaaaccgagctttttaacactgagtcagcagctgagcccagcagcttcttgtgactagagcaggccctgtgagtgctcacaaagtggttgtgtgttctaggagttaacaccgtcaccaccttggtggagaacaagaaagctcagctggtggtgattgcacacgacgtggatcccatcgaggtgcgtttgcctgttgactgctaacccaagggcttctggcagtaccaggaagagagagtagacctaatgccaagtcagtgatgggaccgaagtgggtgagggcagtactgacacagatccaacacatgcgtggctcttgcaatgatgtgaatctctcactgaattcaaccttgaagtgcgaatccatgagctttttaaccctgagcaattgttacaagctaactgaaatttgctgcttttggtcaaaatacagtcttcagctaatgctttcttccagctggttgtcttcttgcctgccctgtgtcgtaaaatgggggtcccttactgcattatcaagggaaaggcaagactgggacgtctagtccacaggaagacctgcaccactgtcgccttcacacaggtgaactcgtaagtacacagcctggccccaaacttccccccagttcatttaatccatgcctcacagttgtttccttttgccttaaaggccaatcttttagtttaagaaatatatttatctgaacttttgccaatgatggttaagaatttcttcacctgaataaaccatgtggtcagcattgcatctgaggcaaaagactgtcttgagctaaaaggtatttttgcattctaaaagggaaactaaggcaaaaaacccacttttgtttcccctcctgccttttagggaagacaaaggcgctttggctaagctggtggaagctatcaggaccaattacaatgacagatacgatgaggtaagaggcagctttacaccaaaatactgtcattcacaaatctttctcccaaataactggctggcttaacctatgagaagttctatctgacgatcagcttggaacagccaaacagaattaacgcaactaataaccttgaaaatctcagaaaacagtaagccaagctaactgcctctttttgtcttttcagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttcagccagtgtctgttgagtatctcgggttgaatcttacttggggttagcaagtatctttttgagacacagcctcactctgtcgcccaggctggagtgcagtggtgtgatgtcaaagcaaccttcgcctcccaggtttaggatattctggtgcctcagcatcccaactggctggcccatatttgtgtttttggtagagatggggtttcaccatgttagccaggctggtctgagctcctgaccgcacccggcccttcccacccttaaatacattcttaaaccaggcattttgttccctagagatgtaacttgcatatcaagttttgggaaagttctttggactgaaaccaagccaggattttatgatgaaccagtcatgagctcatttaaggtagaaggccagaactttataccagtagcacatgatccagcataaa

SEQ ID NO: 47811 - DNA, 1033 bp, Homo sapiens
gcccgatgtccaagccgcatggtagactgtccagggatgagtccaagacacagccaccagtctgaatccttgctgtgaactgtccctacaaatttggtctctctgctctgtaggcaccagttgttctgcaaactcaccctgcggcacatcaacaagtgcccagaacacgtgctgaggcacacccagggccggcggtaccagcgagctctgtgtaaatgtaagtcccagtggacccccatcagtgcatcgccatctgagtgcatgcccgccttgccccagatggagcgtgcttgaaggcaggtcgtccttcagcgatccgtgttgatgcatcaggcctgttttttggcacagtgaagagagggatgatggcccctgaccccacagcttttagtgcaggcaggcacagagccagaagcaggctcgggagtgagtgagtgtgcgtggcaatgcgaggtgtgaaagaaactgggcgagggatgtggggtgggcttgcggagacaggagggctggggagactcgctgagggattcgctcgaggctgaggctggagggatgtggtggcagtggggtcgggggaacagcaccccagggagaagccagggtccatggaagtctgaggcaaaaatgtgttggctgaggtaggctccaaaggactggctgggctagtgtgcacagcccggatgacccagagaccaggccaggagcactgcagtgggtgtgtggagagggttgggtgggggctgcatggacagtgtgcatggttgagaagggaggactccttgactgcggtcatccaggaaaagacggtgggttttggggggagaattcagagtccctttgaaggttttaagcttgagctgtattaggaaaggtgtgtattagggaagtatcgggcttttgaaacagggacacccgtgctggatgaaggagatggttgcaccgtggatctgggtgagcacccggcgagagtttagagaagggagagaggcctggtcctgagccccaggaagaggctggaagtcctcccgtggta

SEQ ID NO: 47812 - DNA, 1041 bp, Homo sapiens
gggcaacagagtgagacactgtctcaaaaaaaaaaaaaaaaaaagtatggacgttgtgcattctgtggcagctaccctcttctctcctgctcaagaaatcccactgagagggacacaagtgaatgagagggatggtagttacatttggaaaatctttgactttggtgtatatatgaggtcaaaaaccatttgcaaatgccagtgcttctatggagagcagagacttgagccctgcctccctctggcttgccccactgtgctggagaaccttggacccggtcccttctcccagccagggcagagccttggcaggtggtcctccagcctgcttttaattgcccccatgacaggggactcactgctgctggagccagccccatggcattgttcaatttttcccgaccagctaagatcagctccctttgtctgtggtgtggtggctgtgaggtccacgcatctctccttcttttcttctttctagaatatgtcacatttctgacagttacccccaacctgaccagtgtctacattgccaaccacaggcctctcttcacacacttgggtgagttgactggaggactcccacccagttagctagactgcaaaggtgcagagcactgttgccaagatgccctcacttctgacatcacccgcaagttcagggggttccccaaaccaccctcaggcttgatagttgactaggaagactcccagagctcactgagagctgtggcacatggctgcggctccttccagaagaacacaggttagaattgtccaagggaagagatgtaggcagagtctgggagggtccaaccaggaggcctgatgtctcagggatgtgacacccttctagcattggagcgtggccatacgcatggagtattgcccacacagaaagcccactgagtgggagttgagagtttttcctggggtttgagtgcaaagacatgattgactaattggccaggtggatactctcagtctcttggtgacccagcccctatcctaaatcacatagttggtctttctggtacagcc

SEQ ID NO: 47813 - DNA, 1049 bp, Homo sapiens
tccacctcagggactgagggactcaggaatcggcctgtggcatgcagtccaggagggcacactgaggtttggttgctcggcttcaggtggtcaggcttacctggatgaaaagcagtggctgctaggaggagccaggcagcatctggtctaggggccgccaattcatcaccgttcccgtaaccttggcccccgctttcctcaagatcaagtctccaaccttcctgttctctcaaaaggattgttccacagagacacctgagtgttcatgaaaatgccaagccttggcccggcgcggtggctcacgcctgtaatcctagcactttgggaggctgaggcgggcggattgcctgaggtcaggagttcgagactagcctgggcaacatggcgaaactccgtctctactaaaaatacaaaagattggccgggcgtagtggtacgcgcctgtaatcccggctaaactggaggctgaggcgcaagaattacttgaacccggaaggtggaggttgtagtgagcccagatcgtgcacctggactctttggactgtgtctcaaaaaaaaaacaaaaacaaaaaaaaaacacgccaagcctagaccccaccgacgtagaaacttggtgggtgtgttgggtcaagaaattgcattccccgccaccccccgacggagtttcactgtttggcccaggctggagtgcagtggcgcaatcttggttctgccttctggtttcaagtgattctcctgcctcagcctcccgagtagctgggattacagggaccgaccaccacacccggctaatttctgtatttttagtagggagggggtttctccatgctggtcaggctggtcttgaacttcctgacctcgtgatctgcccacctcagcctcccaaagtgctgagattacaggcgtcagccactgtgcccagccatcatattcttaaaagtcaagttaaggttgttttgtttgtttcttttacatgttcatgttttttgagcccaaaggttggggcaggttgggcttgagctgggaggggctggacaccttttttgtaa

SEQ ID NO: 47814 - DNA, 1039 bp, Homo sapiens
cagggcctgcccctcctctccccctctcttgtactgtactcggccctagatgcagcgtgatccatctttgcgcagggaatctttgctgcaggtgaaatggagcggtggccacacctgttctctgcaaagtgggtgttgtaatttctctgccttcctcttggatgaagactttgagacatgctttttaatgccttccatttcgcgttagtgttacaatcagcctgtgcaagatttcagttccaagctccaagctagaatttacagtgtgtaaactcattagattgatggtagtgctagcttctgggattccgatggccagtggtatttgcaagcatgtctcagtggctttcccttttaaaaatgctgtccctcctttccaagtaacctgttgtgcttttatgagatgtattgaagtaatgaatctattcccatggtagaggaaactagctgcttactgtacagatttgggataattttcattgtcaaggtgaaaccgattgaactgcagtcttttttcgttcccctgcagtgtgagtcctgctcgtagaatatcgttggtgtacttgaggctgcttttccagaaggcaggatgtggaaattccagcaggcagagctgcctctggcttgctctcatctctgtgttttgtggctcctcactgagtgcgcgagccctgtgagctgttagcatgctggaaggcagcctcgggccagcagcctgtgcatggaggcactggagcccccccatgaggcgtagaccactgggtgcccgtgcttgtgttttcaaacgtggctgtgaacgtgattgcgtcacttggggtgcattttaggatttggatgtgatcccaaatttctacaccctgaagctcagtcttctgtcatttggcgtgttagctttctgtcaggaaaccttttgctgttctttttttaatgtgtccagggctctttgaagaaaactgcattttgtttgcacaaactgctgcattcttacagacttctggataacaaaataagaagcacgcttgagggtggggtctttcat

SEQ ID NO: 47815 - DNA, 1059 bp, Homo sapiens
ggagtcggtccctctgtggtcttctactttgcttttttaggtgcatattttccagggtagctcactcctgtcctttaaataactggtaccacatcacagctgctgctccgtagctgtctccactccacagctgctgctctgtagctgtctccactgcagagaggtttgtggggctttgttttttttttttttttttttgaaacagaatctcactctgttgcccaggctggagtgcggtggtgcgatcttggcccactgcaagctctgcctcctgggttcaaggggttctcctgcctcagcctcccaagtacctgggattacaggtgcccactaccacgactggctaatttttgtatttttagtagagacagggtttcaccatgttggccaggctggtctcaatctcctaacctcaagtgatccgcccgcctggtcctcccaaagtgctgggattacaggcgtgagccgctgcgcctggcctggggcacctttgatgtctgcgcacatctatgcccttggattgctggtgtgggcctgctgtgtgagcaaggactctgccagtcgcctctcagtgagtgcttatgtgtaattctcactttgacaaaaaggagtgcagtgagcatcctgtttgcatctgtggccgtttgtgcgggatggctttggaggggaaatgcagtagtcaggatatgtgtttagctttttgacaggtacattttggagctttagagacttagaggcatgtggccccctgctcactgcctcccatccctgtcccctctctggccagggtttgccctctctggctagggctcctcggctgagggccgctgccgacccccatcatccacagccctcgcgccctccttgcacccgggacctgtgtttttcctgccctggagcttctgctactgcttgtctgcccaagtcgactccgcagagcacttggagtgctccttggctaggggccttgccatcccctgctgggttctggctgattaccttctctgtttctttctttcttttttttttttttgttttttaatatttatttatttattt

SEQ ID NO: 47816 - DNA, 1065 bp, Homo sapiens
gtggctgtgggactttaggtgggtgcagcccgtcccacgtcacggcgagctctgtttcctgggctggggacagtgaggtcatcgctgccccatcctggaggctctggctcctttcgggtacctgttccctctcccagagagaccccccagctgcatgcaggcctagtgggctccacggcggagctggttcccaggctacctggggttgccacctctgtgggtcccggctgccctctgcagccgccgctacttcctcaccctctggccctgcatttccacgtctcatggagccaacgagagcagggggttcgagcccttgtggaaatctggggaggcactgcttctccctccctgtgagcagcttcacccagcctggggtcagtgcttacgctccacggcgggcctgggccttcccctgggtcctcgccggcgttctggggttctttggtttacgtagaagctgtaaacactttgatgtggccgaccttgcaccaccagtctgttagttctgacctccctgcttgggtggtggacttgtccttgctgtgacagagccagccctgtggggtgctctggggcttagcattggggggaggcggtgggagtgggcggctcagggtccgaggagaagagggacattgtcgataaaggactgaggactgtgaggggtctgactgcagtccttgtgcgcgccagcctctgagccagtcctgctgccgcgctcctccttgtgggcgccgagctgctgttggtgggggcgtgtggggctcctggtctgcaggcagggctggcactccctgtggcctcctgcccctgtcccccaaccggctgtgtcgccctggtaccggctgctgtcccctcgctcccctcccctgggctccctgtgtcgaaggtgggcagtgggtgcttgtcctgtgacctcccaggtggcgggcaggcgctacccgcgtttctggagaaaggtggagctcagtctgggatggcgtccccgacccaggcgcagggatggctctggttctgactgtgtctttgttttcagatgtcgtgatctcaacagcttgtcac

SEQ ID NO: 47817 - DNA, 1050 bp, Homo sapiens
cagaccacaccagaccccatgcgcctgtggagagacccggtggcaaagctgtaggcccgctgaccactcttggagttggggcacttgggggcctgggtgagcttgcagcctgtgtgaggggcttctggtaacatcagagcccttgggacccaaaatagagcacattccggggcctcccgaaataacagggtcatgtgactctcaggaggctgggcttggagtcccgctcgggcctgacgagggcgtcttttagcgcgggcgctgcccgacggcagggtgtttgttttggtaaactctggaggggccctgtttgttgactggggaggtgtcagggagagaaaaatggcccagtccgatggtggccctggcttgctagcctccaaccttgcctagggctggctgctgggcctggacccgagcatgcagctgtgaccctctgcccagatgtggatgggacgagctgggcccctaggaagggctggtggggggcgggtgctctgagtcccttggggtgtggggtgcaggttgagccggcagccctggtcacgcgggcagctgctgtgactggctcccggctctgccagcacctggtggttcttccagctgtgcctgtccttcagggcctgtggggggctcacctccaccaggaggcccctctgactgccctctcttggcccctgccccatctcccccgtggctgtgtgggaggtcgctgtcagtggtctttgtttcctcccctgggaaagggtgcctgcaggatttgctgtggaattactgtgggaacagggggtactcaggggtgtgcccctctgcccctggggcctggtcgtgcatgtggcagggggctctggcatcaggagagggtgggacagacctcagctgcatggaaggtggtgtgggggcggggtgaaagctttacaggtccacccagtgccagtggaggctgcctggggagtttcctttcttgggtgacgtttggttttgccatgggtcaaatgtttcagggctgggacctcgagtggtgagcaatgcctgtcctctggagaagag

SEQ ID NO: 47818 - DNA, 1057 bp, Homo sapiens
ggactttatttttgggaccttgtggaggtgtcacagagacaagcccacttagtggatggggacactgaaccctgggtgaggtctgtgggccagcctttgtgtcccgctgtggggcctgctttttctccggcacttgactggcgggggccgccttgagctccagctgggaggacctgtccccagggtgggggctctgctgcccctggtcctcctgcctctcagcatcctcagaggctgctcaccgaccaggctgggtctatgccccatgctggttcccaggagccccattgctggtcttggcccgagtgagtgaggtttttgttcagtggggaccctggtggagggctgaggtctcaccatgccagctctgtgccctgggactgggcatcttggcctcttgtgctggttgaaggccctctaaggagtggcgaccccttgatcctcactccagggttgtccttggcttggggtggtggctaggagaagtccccactcccaggtggaaagctgtagttgggtgagcagcagaggcccagcctggaactgtggcttgcccacctcctcatgccaccagggcagcactgtctgcagcaaattcctgaggtacctgggggagtggacggagtgagattggacccccgggtcccagggcagggcagggtaggggcacagttctttctgaggtcctaacccagcacacgcggcccaccccatgcatgcaggcgtccgccgcagccttcccagggtgacctggcagagccttgacaaccctggctggggaggcggggattgctggtgggcttgtccacacgtggcttagggagcgcccgctgggtgctggcctggtcctgctgcctgtggaggaggggtgggggaggggtgcccagaggtagggacagcaaggtctggcctggagggggtgaagagggtgaggacgcaagggtggggttgcagggctggaaccaggagggggttcacgtgtgaggtgaggctgggtagggcctgtgtgccgggcgtaggtgcatgggtgcccggagactgggggatcccagtgtgg

SEQ ID NO: 47819 - DNA, 1005 bp, Homo sapiens
gtaagggccaggcccagggctgagaggggctggtggagatggtgggggctgggtggggcaggacaccatggtctatgtggcgcccgcccttctccctcctccatggccacaaggcccctctggtacagagggtggtgctggccttgagggatctggccggcaggtaggcaagtgaatgacagagcccctcaggtggacttgggggtggggcctcctggttctgcctattttcttcagcggccctggttagggctttgaaggggcttcactgcaaattagccccgacctccccggggtgcccagcaggggcgcactgcaccttaggtgctccgtcgtgaagtggccacaaggtgcctttggtgtgtggggcccacaggatgagttggatgcagcctcccggtgggggctgctcaggtggtgatgaaaactgtacctgtgggcaggtgaagccaccgctccctcggtgtagcagtcagtgtgccctccccacgtctcctcctctccttctgtccctggacccaggagtttgggagaggccagcgggccagctgggcactttggtctctgtaatgaggaccctcccaccccaccaagatgcacacatgccctgccaggatgtgggggggcgcagggcagtgggctgagccaaggtgtagatgctgggaggtaaggttaccctccccctgggctggcgtctgcctccccgcctgctgctgcccctgtggccggccgcatgtggggaggaaggaagaggtttgggtggtgtgtgtgtgtgtgtgtgtgtgtgcgcttttgactgggctcggagggctctggctgggacccaagctcaggcctttagcaccttggctgggaggagtgaggcctggggagacagtgggggccaggagctgggtgctgaggagaccagagctgggggctggggcggggccagggcagctggtaggaagtcctgcccttgcagccggtcctgcgagaaagcccctggctgctgtcttggctttg

SEQ ID NO: 47820 - DNA, 1040 bp, Homo sapiens
cctcctcggagagtcacatccgccacctggccggtcctgtcgtggacgccctcagctcgctcccgtcccctgcccctctggatggcacagactgcacgttgttgccatttcacggaacccgttttcccggatttgtcaggaggggagagaatggtggaaatgcagttttgctgggttccctgcacacgtgggcgctggctttggtcacccccggggggttgctcgtgggatccagagaagtggacgttggtgaggccaagcaggctgggaagggtgctggacagggacagcagaggcctggccccagggggttagggggccagggcttgggcgcctctgtcccgggctgggggctttggactttgggggtataatggggagccctgggacagcagagggctagccccagagggctagcggggccagggcttgggcatctctatcctaggcctggggctttggattttgggggtgtaatagggagccctgggaagttctgatggtgacagagtggacattctgccaagtgaccagtggaggggacagtggtggagagggtgtgctgagctggccttagcctggcctgggcaaggtctggacttggccatgtctggctctgcctgtacagagggggctggcagacgttcctgcgggaggcactctgtggatggggtcacccagagtctggacagagactccatagctgcagctggcctctccatccctccccttccttccgaggcccctgggggctgccggctaggctgggagttaccgtgcgtgctagctgcagccccgtctcaggttcttggggctgggcaccgaggagcagagaagctgcctgccacctgttcaccctcgcatctgcaggccagcggctcgtcccctcctgctgccacagtaccctgatatgtgccgattggtgggattgggaggggacacagcgaggccttgggtcagagccttgatgaggatgggggtggccgtcctgggggcagcaggccggagcctgcgcttgcctgcattccccggcaggattt

SEQ ID NO: 47821 - DNA, 1050 bp, Homo sapiens
gactccgcttctttccacggggactctgccaggactggggcttgactcccgccctcccaccctcctagcctctgccccaggcagcagatgggtggtctgctcacgatgccccggggggaatggccgtacaggggcacaggtcagcttaccgagtgtctccggccttgtggctggaaagcagctctcaggactctccggggccccttggcatctttctaggtgggtggccctgagcccacctcctccctgtacccccatggcaggagctcctttttgggaaccagtggagcgagcgtggctggacaggcctggccccagagctgcgcgatttccatcacggctctcctctggcttcctccttggcgctggctgggccaagccctcctgacttctgggtccctgggatgggtgggtgactccgtccatgaggctacctgaattctcgcttaccctagccatctttaggctgggggatgtgggtgcttcctggtaaaatcagatgccctgtagctctcctaaaagggccagcctcagatttgcggtccctggtcctggcccctgggttcaggacttcattttggccgtgcgggttgcaccttggggatgggcgtcccttgaggtttgtgccagtcgtgggagtggaggagtagcggctgcgttgggaacccgtccctgggcaggcactctgggatggggctccgagtcccacagtcactggccggtcattgccagcccctcagccctctagggacagaccctgcctgctcgtccctgttaggggccagttctgcaggtggttacttggcttcttcttaaaaaaaaaaaacccatcctgccctgggaaacccgggaatcatggggaagcgggaaatgacagtagggaattgacatttcctgagccagcgtctggggcatcggaccaagtgcagggcgagctgggcagggaggggtgcagccggctctgccgtcagcctaaagccatgagcgacctgggcgctcttctccctgtagcactggggcacacacagggtggtgaagggggcatgacac

SEQ ID NO: 47822 - DNA, 1045 bp, Homo sapiens
cgagccctggagggctgggcagggccttgtcccctggtgcctcccggagcccagcacggggcagggccagctgggcacttagtttggacgagctctgtccctccaggggcttcactttcgccttctgcagcgtgggggatcatgtgtgaccttggccagcccctgacctccctgagccgcagcctctgcatctgggacacccagggtttcccatgcagggagtgtcaagtgtgggtgcaaagcccaggcaccgcacccctctgcagacgtctggggctttctcttgccccttcagttccctcccttctctgagaagcgcacctgctgcctgtggacatgaacactgggcatttggtgagtcacacagtggccacccgcttctccagtgggagcttcatggcacccccactgtgctgagttgtcacgggggacctcctggcctctcgcagcccacctgagtcctgcagggaccaagcatccttgtaaagcctcacagcccacctgggcagatcgaggaagaacctagaagccagaacaagctggggctggaagactcattccaggcaccgaggtccatgtgaaaggaggctttgcggtggtttctgctttgcttgcattgagcctcaaactcttcctgtcccgtgagaaggggggatgggatttggaggcctgaggaaggaaggaggggagcttcctgcgcacaagcggcggcaggggtttgcagaagtggaggctgggggctgcctggccaagcgcttaccgccctgcgcagccaggctggctggcaggctgcagcgggaagcgcctgtgggtcctcggcgctgactgcagagctgggtggaggcagcggaaccaaaactgctgtgtcactgcacgctgcagctgttgccagggtgaccgggtgagtttcccacgcttgcccgggcggcagcgtgcgggccggcgggtggggcggaggggtgtgcagagaggccagtggtgtcgtgccacccgatgcccgggggtgtccactcccctctcctgggtcacgtgaccagggcccctg

SEQ ID NO: 47823 - DNA, 1023 bp, Homo sapiens
tgggcagctccgcccactggccttggtgtcaagtggtccctcggcccggtttgtgatcagacccctagaaacaggctggagctgaggcgtcgcatcccagtgcagtgctgcgagggagtcgcctggggttggtcccagggctggctgaaggcaggatggcccaggtgcccccatgcggtgactctgcccccggcaaaggcccactctggctctggggcagatgggttcccacccctatgcggtaggataccacaggctgatagcatctcaggttgggcaatggggcctgcacgcgcaggcagccaccaggagggactcgttccgcagcattcccgggaccaggggtgggcagaggtggggggacgtgcagtggtgggtgttggccctctgccaagctgagcctgggcctgtttgctgaagccggggagggggcaggggttgggggtcccgcagggacacgtgctctgatggggaagacaggcctcacccttgggggttcccagtccgatggaaaagacctagcttccacccagggtcgtcgggggagacattggtctagagggggcagtggctgtcccccattctgcttcctcctcctccctcaggaaggctgcttcccatttccttcctgcctgcctttgcttcctgtgcccaccctccagctctgaaggactgggtgtggaaacagcagggtctggcgtgtgtgcacctatgtgtgcacgtgtgtgcatgtgcgtgcactgcagggatgtggctgacccacaggtctctgctgtgggaagggagccccggctgggctcgagtgtggccctcttgccttctggcctgtgaactgggcaagtgaccttgcctcgcccagtcctcaggttcctcatctgtgatgggctgggggcatcaggaagacccctgcgagcttgggggtggatgagagtgctgtgcgtggctggtggtggggttggagagcagtggtcacgtgtgggtgtgggtgtggtatgtctgtgtggtgtatgggtgtgcgtgtgg

SEQ ID NO: 47824 - DNA, 1050 bp, Homo sapiens
cggagcacgagtgttcccacctgtccctccccaggctgcctaagcatccacgcctctgcagccacgctggcccagatgggcaggaggtgcacccagagggccaaggaacacacgatgtcacccagctgccccaataacaacaagttaatgatgccccatctgcattgtctcctgtgataaacgccctctgtctccatgctgtctggggctgggctgctcccggcctggtttggtcttcgtgcccggagccctctcatgcacctgtgtccagccaggcaccctccccgagaggcaccagacacactgaagatggggagtggggctctgaaggtccaggtcctgccctgtggtggtgggcagaggacagtgtggcctgtgcccagagctagggtggctcccgggtgagacttaaaatggaacggcctgccacctgaaaggcagggacttcctgatggcactcccctcatgagcacacacacattcacacacgtgcatactcaaacacgggcacggacacgctcacatggaccctcgcacccattcatacgcatgcacacaccacgtgctcacacagatgctttggcatgcacacccatgcagaactgctcccgtgcacacacccatcgctgcccttgcacacacccatgcatgctcccatgcacacacacccatacaggctcagttgcacacacccatacacgctcccgtgcacacacccatacacgctttcatatgcacatacatccatattcccatgcacacacacccatacacactcccatgcacacacacccatacatgctcccgtgcacacacacactcatgaacatacacacttgcactcagccctggaaggatcgacagaacagtgggggtcttgggtgcggggctgagccagcctcccttggtggagtcaggaccccacaccaacattctccctcttcctgggaacggcggctgtgcggctgtgctctgaaactctgggccactccctgggcccccaaccatggctgaatggtgggtgccacaggagtctcgactcactttgcc

SEQ ID NO: 47825 - DNA, 1059 bp, Homo sapiens
gtacagtttgtggagagagaggtgaagggagcaaaggcctcgggacatttctagagtgaagggacagctggcaggagctgcatgaatggcgccaagtgcactatgctgtaggaccccatgcagggtctgccagggtgttcatcacggtcagttagtggcaatggctgggtgagtccaggagtctttctcacgtgggccccttaaggccgcaggtcttacccagagccccgattattggtggcctatggataaagagcccctcctgtggattttctggttgttagttctggttgaggggtgcggtctgaggcatcaggcttcttgatagggccccgcttccagtcttttagatgggccctagggctcctggaagagtgtctgtctagctcttggaaggggctcagtaggaaccctctcaatgaacgaacgaatggtgggttcatttctttgggatcctcggacaattgatgaccaacttggggtttaaagcaacaggaatgtcttctctcttagttctggaggccagaaatctgaaatcaaggtgtaggcagggccgcaccccctctggaggctccaggtgagggtcttcctcacctcttctggctcctggtggccactggccgtcctctgcccttgtagcttgccggcgcatctctgcagtctctgcctctgtcttcacccagccctcccctgtgtctctgtcactgcctcccctcctcttcccttacaaggactcatcattggatttaggacccaagatctcatctcaagatcctcactcccatcctcaaagaccccaagtaagggcacagtcacgtgtttcaggacctggatgtacctttgatgagagacccttcagcccaccgcgcgtggtcatgcacgtacgtgttctgcacagccaggagatgtccagcaggaagtgaccactgagagcttctcccagccactcccgagctgggcctgcccagggtcgggcctggacagaaccacatgcacacaaaggttctggagagacgcctgcacactgccctcctgctccagctctttccgagagtggaa

SEQ ID NO: 47826 - DNA, 2031 bp, Homo sapiens
tctggctggccacctgagaccacaaggcggggaggtgccagaaagacctgagcaacccgctgggcccctctctttttctcctctgtcttccaagtaagaccaagggacggggttgaccaggttcgaccaggcttacccaggagcaaggtcgggatcagaacctggctccagccctctgtttcctgaaaaggtccctgtgcttccaggtctttcctggggctgctgggctcccggctccccacctcggtgtcacagaaggcacttgggagcaggggtgggcgggaactgcgctctgcctgtctctgctgccaccggtgggagacgcagcgtcgctcctcctccctgccgtagatttcaacgacaagattttgaatgagcccctcaagcactctgacttcttcaatgtcaaggaactgttttccgtgagaagcctcttcgatgcccgagtccatctgggacacaaagctggctgtcggcacaggtaggtgacacccccatctgagcccggggcggttcccaggaggaacctgggacctgctctggttctagggccacttttgaactggcctatgtcagttttaggtgattacagccccatcctcctccacatgggaatacagagccccacagagaagcaggagtttattcctcagcttggcggacgctcttgtgtgccttggtgtggcgctcacagcccttgatagggcaggcctgctgggggttgcaggactccacgggttcagaaatggaaaggctgagggcagaacctgtaaggttggtccccccggatcgggctgggccttctgggctgcggggaggaggaatgactggtcctgtattctcacatggtcattttgactgctgtggggggaggggatgggaggggcaggtgggaggccagggaggaggttggtgtgggcgttcagggtgaaggtggcggggcttaaatcgcagtagcggaagagctggagcagcaggtggacatgaggcagcagggcagagccagtgggccttgggctggggtgggaggtggctggggccgaagggatcaaacacctgctcttcgggtggagcctggtactggttactgagatggtgaaaaccaggggagacctgggggacatcacaagcttggttcctaccaggtatgaaccctttgctgccccagtggagaggtcacacggttaccaggagggatgggcctgggcccagggagccatcagcatcgggggctggcaggtgtttccagagcatcggaaaaggaggtccaaggtggagccctgggtgctccagtgtttggagtcagtgaagagggacagccgggggtaggggagatgtggttctctgttgatgctgctgagaagtgaattcaaggctgtgaccttggcaagatggaggtcgccagtgccttgatgggcagggttgcttgagaggaagggacagaacccagtgggagtagactggaggtgaggacctgggaaccgcaaatgtggatgactcgcctgtcacgcaccgagaggcgggggtgtctcccatgccccgcttttctcagcccaggccagcagtggtccagtgctttggatcagggttccccgcccaggcttggccactcctgccctgatcccttaatgcttttggcccagagcaccccgctaagtccaaccccagaggggcctcatccgcaaagcctcgggaagaggacagtgacggaggcggctgccctgtgagctgcacggggcagaatgtccttttggcgtcatgttggatgtccacacatccatatggggtcagttctattaggattccttcgggaagaggtagagggtaggaggggttaagccacgagacgaggcatgcagaggggtggcctggatgggtctgcactgctgtccatgcacacggggagcgttgcaaattgtgcttcccagcccatagtgcccccacagaggagcccgggagtccctggtgggcgtctgtgttcctgcaaggagccagtggagatggccccgtgaactctcatcccccttgcct

SEQ ID NO: 47827 - DNA, 1013 bp, Homo sapiens
actgaaggagggctgggctgggctgggatgggagcctggctggttttcccctggtggccctatgactggttaagggcagggcagaggcacggcaggttggaggcacagaaggcccaagatagttatctgggctggatgtggggcggtattctcgcctctctggggacatcccttaagtggacaggaagactgggtggttcaggtgtatgtccactcaccaagaacacaggatgaaggtggggcctagacagtggctgttttgaccagggcagaacagttgagggcatgtgagagggcccatgctgacgccagacctcagtggggagaggggagagtccagggaccagaggtccccctaggcttaaaggacaaaccacaaggagaagaggaagaagtctctatgtcattaaagtttcattatcagggctgctataatgcttctcattgcttattataaaacccaattctgcaagaccagcctagccaacatggtgaaactctgtctactaaaaatacaaaaattagctgggcgtggtggcatgtgcctgtaatctcagctactcaggaggctgaggcaggagaattgcttaaacctgggaggcagaggttgcagtgagccaagatcgtgccactgtactccagcctgggagacagagggagactccatctcaaaaacgaaacaaaacaaaaaaaaaaactaattctggcccagcgtggtagttcacacctgtaatctcagcactttgggaggccaaggcagaaggatcgcttgagcgcaggagttcaagaccattctgggcaacaaaataagaccccacctctacaaaaaataaaaaaaatagaaggaagcaatagtgtgcacctggggtcccagctactcaggaggctgaggtaggaggatcacttgagcccagaaggtcgaggctacagtgagccgggattgtgccactgtacttcagcctgggtgacaaaacaagaccctctgactcaaaaaaaagaaaaagagaaaaata

SEQ ID NO: 47828 - DNA, 1056 bp, Homo sapiens
gaaaccccatctctacaaaaaaacacaaaaattagccaggcatggtggctcattcctatagtcccagctgcttgcagagctgaggcaagaggatcgcttgagcccaggaggcagaggttgcagtgagccgagattgtgctactgcactccagcctgggtgacagagtgagactgtctcaaaaaaaaaacaaaacaaaagagtagaaagacaacctacaaaatgggagaaaatatttgcaaatattgtatctgaaaagggattaatatccaagactcctaaaactcaaaaatagaaaaccaaacaacgtggttaaaaaatgagcaacagacttgcatagacgcttctccaaaaaagatacacagatggccaagaagcacatgaaaagatgctcaacatcactagtcagtagggaaatgcaaaccaaaaaccacgagagaccccctcccagccactggaatggctgctaccaaaaaactagaaaatagcaagtaccagggaggatgtagagaaacgagaagccctgtgcactgttgctgggaatgtaaaatggtgcagccactgtgaaaaacagcatggaagttcctcagacaattaaacagaattaccatgggaccctgtaattgaaagcagggtctccaaggggtgtttggacaccccagttcacggcagcttattccacttgggtggaaacagctgaagtgtctgtggacagatggataaggaaaatgcggcctcaccacacaagaaaatactactcagccctaaaaaggaagaaaactctgacccacactacaatacggatgagccttgagaacattatgcagagtgaaatgagccagtcatgaaaggacacatcctgtagtcccactcattggcagtccccagagtcatcagattcatagagacaagaagtagaaaggtggctgccgggctggggaggggacggaagtgagtgtttcatggggacagagtgggcagatggagagttctgtggagggagggaggtgatggtcccgcattgctgtgactgcttaatgccagtgacctgcgcacct

SEQ ID NO: 47829 - DNA, 1088 bp, Homo sapiens
ctttacaatctctgcaggatctctcagtgagcatagctaccccaagcccctgagaatcgtgaatcccagagacagatgcctggagctgcttccagccctggggcaggcctcaaggggctacccactaggacccgtggccctccagggatgggaatgattgttttaatcacttttattttctaaatattaaagacattcttccttagtgaaggatatttggaaagcattgaaaagtgtttagaagatagcggataagcagaaatcaattccccaatttctgtgtgcctatacgtatgtacaccaacatatatttgcaccttttaaagcaaaccctgcatccctactgaattccaggcccgtgctactgagtatgtacaccttaccgcatttaacgttcacaacagtaccatgaggtgagctctgtttattcctttttttttttttttttttgagtccgagtctcacactgttgcccaggctggggtgcagtggcgcgatctcagctcactgtaacctctgcctcccgggttcaagcgattctcctgcctcagcctcccgagtagctggcattatcggcacgtgccaccacgcccagctaatttttgtatttttagtagagacggggtttcaccatgttaggcaggctggtcttgaactcctgacctcaggtgatccacctgcctcaacctcccgaagtgctgggatcacaggtgtgagccactgcgcccagccttattcccgttttacagcttagcctggggctcactcaggggtccccagcagggcctgggctgagtggggctcaccccgggtgcatcctccgcatctcctccctgcatttgatcttgttgattcctggctgctacaagggcctgggggccacagtctcaactgagcatagcagcaccgctgctatgggtctccagctcagggaggccccatccgggatccaggcctgagttctcacggccttgcaacttgatttttccccttccatccagaaagcattgggcagggggtaaggggaggtcacaagccacatctgcagacactgcagagcccctgggtgcgctcaggagtcatacaca

SEQ ID NO: 47830 - DNA, 1803 bp, Homo sapiens
aggcaggggcttgcgaatgggtggcagccgtcagaggcaggcctggctccccagagcgagggacactattgtcctctggacatccctaaaacctggtgacctccctgataggggtcccagcagctgatcccggggggcgcctagcctggcccccaaggattctctggccccagccaagcagcaagcctctgcctggggcacccgaaatgaggtactggtggcggcacggcggacagaggccttgctgcctccggtctgctctctgctttggtcccagacacagccccattgtgccgtcctggatggagcgctgagcccctagcctggctcctgggccccacgcaggggaggggcgtgagggtgattttgctggcagctgctgccaggggcctgccctaaaggattttcaagggtttcctccgctgatctgatcggctgtgcagggccgcatgtgctccagggcggccgtgctgtgagggggatggatagcagccctggctggagtgagtttgagtgtgagtgtgtggagctgtgagagagtgtgtgtgtggagctgtgagagacgggtgtccaagaccttagccttgggtgaggcctgcacagctgaccatagagttgggcattctccaggctacagctagaagcctggggtcccctggggacacgccaggcaggagccagcccctggcaggggcagtgctcagggggaccactcagagagaccccagacccagccttgcatccccctaagcagggagtccagttgagctccagggtggagtcaggcccagacttgggggaagcgcgccaagccctccagcagggcctgtgacgaggtccccccgggagtctgcaccccaccgtgtagccacagcccggtttgggcaggcggttcctggtcggagctggcttcagagcatggatgcctagacgtgttctgggccagtggaagctgcgggccagacgggagggccctttgctgtcatgctggggctggagagcaagacacggaaaagtctcctgtctcctgaaacccgagtgctgggggcggcccacctgctggcgtgggcggtgggcatgtggatgccctggaggtgggcggaatccgtgtgggcactcctcacgtggctgtactggggtccctcaatgtggatggggctccaggttggcccaaggtctcctctgccccgtctactgccttcccacactgacattccttcctggagagaggagtttcagcttttaaaatggggaactgtgcctggaaaacacactgacagcgaggcccatgaatgtgcccatgagcccactgggtaccctgaggggccctgggtgctgggtcggtggggacgggcccctgggttctgggtcggtggggacggggccctgggtgctgggtcggtggggacgggcccctgggtgctgggtcggtggggacggggccctgggtgctgggtcggtggggacgggcccctgggtgctgggtcggtggggacgggcccttgggttctgggtcagtggggatgggccctgggtgctgggtcggtggggacagggccctgggtgctacagttaatgctcagaattctggcccacttgccaggggctccctggcccagagcagggctttggggtgaagaggcctggcggggacaggccagtggctgagaaggccccggaaagtggggaaaccctgggtggtcgtctcctggcctcccacctgctttaaggccagctgagtgctccccggggctggggccgggaaggggcagcagagccacccaccttggggtgaccctgtta

SEQ ID NO: 47831 - DNA, 1050 bp, Homo sapiens
ccctggtgggtcgctgggcagcgacgggccctaggaattcctggcaagcctgaccccaggtgcttcctacagctgggtgaccttcagtcccctctccagtgattccagctcccgctgtgctcccagcccggtcctgcgcctcactctctcccctcccctggccactgaaggggagtcggtgtggttttccctgggggtgtctggctgggggatggggcagatagagccagctgtgagcagagtctcttcagcatctgctcaggggccagcatgtaggtgacggccttggggaggggcaggtgccaattctgttagcagggctgggactgagggacacggctttcgggtggccggaggtagtaggagttgcagtgctggcttgggaactggccttggtgatggcaccccagccaccacggagggtctgagggttcagtctgttgacgaggactgggcaagggagaggcattctaggtcctgccccgcctttggccaagctgtcctgaaggtggacaaatggtctggcctgagtaggacccctgagcccacaaggcctcaaggtaaggaggagagagcccagggcctgaagacccccacctgtccttggattcctgcctctgctcagaccccgtggccgtctcagggataagacctgcccccccagtcccccgcctctgtcaggttccagcctcctcatgggccacaggtggctggagaagctgggagcccagctgagaaggacgccgggggcttgggaagtttgaggaaaggagccaggctaggggaacgtggtccatgcctcccaagccccacgacctggggagcggcatcccccaggccccacgtggccctgaccccgtcagacctggggccctgttcgcaccttggccagtcaggtgagggagagcacagagggcccggcagacgtggggctggcatggtgaggactctgagcccccccccccccgctgccccatgctggcaccgtgggctggtgccagggaggctggggagggggccaggtggggtcgggtggagcagaggaggcac

SEQ ID NO: 47832 - DNA, 1066 bp, Homo sapiens
tcaggaggatggctagggtgcctggcccctgcagcccgtacctctgggatttgggtgaaggcagggtatgggggccacaccccctgcaacaccggcccctgggcctgagggtcttgccggggtcacaaactcacacctttgccccagtggcgttcctgaccttggccgcacaaggggtggacaggaggtgctggcagaggtgtgctggctggggcgcccttgggccgcacacgtgcttccaggcctgtatcccaaagagacacttaggtctgtgagcacagatgtggtgtgtgccctagcccacccaggggcgtcgtctgtagtgaagccacggaggtgctccggccccggggcgactttgccagggctgggccatgacgccaagttcctctgcacaggatggaggcgtcctgcctagagctggcgctggagggcgagcgtctgtgcaaggcgggcgacttcaagacaggcgtggccttctttgaggctgctgtgcaggtgggcaccgaggacctgaagacactgagtgccatctacagccagctgggcaacgcctacttctacctgaaggagcacggccgggcgctggaataccacaagcatgacctcctgctggcgcggtgagtggggacggtcctgctggcgggtgagtggggcggccctgctggcgcggtgagtggggacggccctgctggtgggtgagtggggcggccctgctggcgcggtgagtggggacagccctgctggtgggtgagtggggatggccctgctggcgggtgagtggggacggccctgctggagcagtgagtggggcggccctgctggcgggtgagtgggggtggccctgctggcaggtggacgcttcctgtcctcagcagttacagtttgaggagggggacagggcaagcagggtctaagggaacgcagtggggaagccctcacctggagggcagccagggctctgggaccccggcagggagctgggtttcagctgacaggcgtgagtgggtctgtgtgtctgcgtgtgagagcctgggctgtgacccgcgtgctgtgcgtgagcact

SEQ ID NO: 47833 - DNA, 1057 bp, Homo sapiens
gcccccaccacccatgtatgtatgtaaatatcactctctggagagagacaggctggcaaaccacaggcccctaagtactgtcttgtgtgcaggtctggggtgggtggtggccggaacaaggggctcagagccacaggcctgtggcctttcacaggcagcagagaggagaggtcttttgaaaggctgccctgcctggaggcttaaaagtggcccaaggttttcctttgtggcgtggtgaggagaatgttctggaatagacagaggtgccggttgcacagcatgaatgtacaaaatgccagtggatcgtccacgtgaaaatgatcaaattcctgttagacgcatttccctccaatataaaaacaaccccctcacccagtgacttggagggtgcccgtaagggtggagggagtgcaagggaggaggcttgccggccgccagggggcgagcgaggccaagggcccagaaactgcccgcaaaggcagagccggccacaggccaggttgcttggactctgcgctaatccttttaatgggaaggaaaaaggcagagctgattggggcttatgcttgaaggtggcagaatttgtgggaggtccagctgggggcattatcctgtcatccggccaatgccccttgggcctgggggcccctgatgaccctcgaagccagggtcatgctggggccgtgaccaccaggggaggggctggggctgggggctggcctggagagggcgggtatgaatctggtctccctctctggcagagtgggcgagggccgggcgtgctggagcctgggaaatgcctacgtgtccatggggcgcccagcgcaggccctgaccttcgccaagaagcacctgcagatctcccaggaggtgagccaggcctgcccccagaagtcccgggcactgcccagcccactccagacgggccgggtcccctctgccccgagcgagcgtgtgcgtgcctgggcccccctcatcctttcagggccattgcagctgcctggtccttccgaggcctggtgatgacatgtctaccatgcccgggggtttttcctgc

SEQ ID NO: 47834 - DNA, 1064 bp, Homo sapiens
atgtttttatagagatagggcctcactatgttgcccaggccagtgtcaaactcccagcctcaagcgatcctcccatctcggcttccagaagtgctgggattataggcgtgagccaccgtgcccagccatcccctgggtttttgtgccacagtgctcatgggtttctgacgatgacctctcctgggaaattgggggtgcatgtcagccaccgcagaggctgaagacagaggaaggagcagaggctctggggccctcagcgagtccgtgggacaaggtgctgtgaccgatggcagtgggtgggtaggggatgggctggaatgtgccccccaggatgtccaggcctatttctacccatggccggggtttcctaagggtggggagctctgccgagagctcctgcggcacccctagtaccctcctgtgtccctggctcggcactgccaccatctgggaccccagcagcaactggcagcagggctgggagcagctctggaaaggctccgcggaggctgcggctctgggtcctcccgacgttttctttcttggagccaaggaaaaggggggccggagtgggaggacgctggaacaatgcagcttctgtccctctctggctcctctgtgccgccccgagtgcgggaccccttccagccggccggacgcctcctcccccagggctggggaagggtcctcctccccgcccagggcagcccggcagcctggctggggccgccgcccggctgccgctgtgggaggcaggctgcacacctagagcctgggcggccctgggtgagaccccggctcagctgagcctggcagggacagggccttgaggccgggagtctggacccggcgttgcgggttgggggcgccacggaaggacccacgcagcctccccattcggcaggtgcggagggcggggtggatctgcgagctgcgggaggggaggggggtgcagagccgcgctagagcctggccgtgcggagggggcgccagggctgggggcacaggagggcgctgcccagcggggtgtgggcagggaggaggaagtcgtctggaggtggggc

SEQ ID NO: 47835 - DNA, 1268 bp, Homo sapiens
tctgaagcccccagtgcatcctcatcactgccattcactaggtggcagcaggacccccttcccaattgggggtggaggcttggactccatttggtggcacaatgctcagacagcagccccccagcaagacccaggcctgttctcatccgcagcatgggcctgtaagggagaccctgagagaccctgacactcgggcccatttcctccctccctcatggtcggggccaggctcatatttaaatcagggccctgctgaggctggggtcagggggatgttggctgagtgacagctgtgcaggtgaggctgggaggggctgtgtgtggggcccagtgcctgaaatgaccgagtgactgcccgcctgagccggctctctccctctgtggatgttgtgttccccggcagggcccagaacccagggctaacggtggggtccgggtgcacctgaggccccggcaccctgcctggccattcatgctgctaactttgacgagtgccccaaccctggtggctgtgctccctgatgcagtggggcctggacagggtaagggggtgtctgggcctgccccccgacatctgcctgatgcaggcagccaccaagcagcttcactttaggagctgagcctctcggcgggatgagtgcggaggggaactgcccggcccggcccatccatgccggcgcagtctgatgaggagggcgctgagctccgaggcgtagtaatggggccaagtctgatggtctggaggtgccaggactggattctcagagtgcccactgatgccagggctggttctggccccgccctcggactcacactgggtgtgcgcagggctcctgggcacagcccgtgtccagtgtgtccatgggtggagggacgcttggttcccaggaagactgggtaagggtgggcataggggggtgggagctgtgggtgagcagggaggaggatgagggtcctcccagctgcgagagtctccctggagatgtgccaggcgtagggacagcagagacagggtcctcagtgtcagcctcgttccgccgtcgtcccctctgcctagaacgttctgctgccctttccacagtggctgtgcccctgtccgtcccgccgcctcctcagggaagcgcccgcagaccctggctctcagccacagcatcgggcccttcccacagggcttcctgcctggttgaggacattccccacttcccggattccatcccatttttccgttcgccaactgatttctgatctgccaggtctgttgtgccctg

SEQ ID NO: 47836 - DNA, 1051 bp, Homo sapiens
gctccgctgagtctgcagctggccagtgttgggtcaggcagctgtgccccaccaccccactgcggctagaggggatgggggtcccttgggtggagacacggccagtagggtgagccccgggccaggagggatggacaggagcccggggaaggtcccacggcagagctggtctgggggattcatctgaggcctctgcgtccccgaccctggcctgggctgcccgcagtgagctgggagtggacccacaggcccgccccacctgcctccggggcacagcatgatgcaccctcaggaggggggattgggtggcctcacagaggtgaccaggggccacaggaagggtgatccaggcagagggaacagcaggactgacgggggaggccctgtgtgcggcaggggagaggcctgtccagagccgggcccttccagcacagggagccaaagccagaccccacctggccccagccaggacgcgctctgtctcgacacctgtcccctttgactctgacagtacagtcggggagacgcagaggacactcagacatggcgctcgcctccacaaggggggctggctgtcagaaagccatggccgggctggtccttggccccccagagactctggcctggcccacccaatgcgaggtgccagggtggtgctgggctgaccgggtccctctgtcttcaggggccagacccaagaggacgcagaggctgagcgcggagacctgggacctgctgagactccccctggagcgggtgagccagggacacgggaccgatgtcagcacagccgctgccagagcatgggcagcggggttaatgaggcagagccaccgccacccacctcagcccctgtctgctgggagataattgtgccctcctcggcctgatgccctgcatggcccatctgccacctgctcacccatgtccctcagcgtctggccagctgtgccccaggcgaggcatggtcctcacacatttcaggcccccatactccacccagctgctatgccaccacaccctcgggagcccacagacaggggcacccact

SEQ ID NO: 47837 - DNA, 1011 bp, Homo sapiens
agccctccagtgtgcccgcccacaggcacggggagggggaggttcactgctgcacttgctgggggagtgtttacggagtgcgcctgtgtgtgagtgcgagcccacgtgcgtgtgtgtgagcctgtgtgtgtgcacgcactcaagtgagcaggggcgggcgctaggagggccgagcccttgcccagggtcctatttaagcctcaggcatcccagcattgaggcagcacttggcactttgggcagggcggtggtggccctgggcaccttgtgtcctgcctgcgctctgtgtggccaagcacccagcgtggctccctgctgctgtggagacagcctgtgatccgcgtgagtctggggtccctggggtcctaacaggtggaggctgagggagcacacgggcctctgtgaagccgggtggggtggtcttgggccgggtgcattcccctcctccgcaggagaaactgggcttgtgccaaagcaagagagactagagtcagactgcaggagggactctgaggcctccgggaaggagggagccagggcttggggcaagggagaggttagagcagggaggcggaaccccgagtcccactggatatgttctactgggacataaatgcaggggaaggtggccttggggcccagggtcctgcttctgaggggctccaggagccccaaactatccagagcctttccccgtaccaggcactgagccacggttttgcacctgcagtcgtgggcccctgcccccatgtgagggaggcatcagcccctcaacagctggccccagcctcagggaaggggagggctgcccgacataggaccctgagaggggctctgccatggggcctgggacatggcccctgacgggtcctgcctttcccaggagggaccttgctcagtccacctgggccccgggtcacctgggggagtccagattgggccagaggcagaggccccccgcggctgtgccctaggtcatcatagcccaggagccagttccttttagaccag

SEQ ID NO: 47838 - DNA, 1026 bp, Homo sapiens
ccctccccacagactgggccaattctcccctccctcctggctggggaatccgggggagtgggggtgttgccttaggcctgagccaggctgcaggaggagagccctgcggggagaagggggtgctagaactctccctcctcaggtctgcctcagggacaggaggtacctcaggcttccgtgacagctggggactgactccaggggccagagccaggtggggtctctcctaaaacagggctgtccacagggccctcggctcagctcaagggtctgaatcccagctcttttttgctccagcatgaccttgggtaggtcacacatgtctctaggccccactctcctgtgccctgggccgagtccagcagaaaactggaagcaggacgggagccctagtcctgggctgtgggggtcaggtgtcgggaattccagttgtctgtcagacagctgtccgtctcctgggctgtgggggtcaggtattgggaattccaggcagcatcggggacccgggaggtgccatctccaccaacattgcgtctcttgttaactcgttcagctgtgagcccagcatttgcagacctggaagaggccaccagccgtgagatggacaggctggggccgggcaggggctgccagcgccggtcgggaggtggacggggcttggaaccatcacaaacacccttcagccctggggcccggaccaggccctgtgaggctgggtcacggggtggacctgcttcagctgggccccttggggggccacaggagaccacgccctccagcctcccttgtttgggtgtgtggactgaggcccagggcggggttcattccttcgagttcattcacacagcagacaccggtgagggctgtgtagggcatggacacagggagctcatggcagggctgacacagggtgtggtgggcacagggacaggaggcacgggaggcttcccgggatgtctgggaagtgttccaggccaaggctggggaggctggcccagggcaggtgacggacagaggcctggactg

SEQ ID NO: 47839 - DNA, 1062 bp, Homo sapiens
gctgcccgccacctgacgtactgccccggggccctaccatgccggacgaggacttcttcagcctcattcagagggtgcaggctaagcgcatggacgagcagcgggtggacctcgccgggggcccggagcagggggcaggcggcccgcccgagccccagcagcagtgccagcctggtgcgagctaaggccctgtgcccaccgccaggcccaccctgcccccactcctggacgccggtctcacagtcacagccacgtcctcccgaggccattgccgaggacaggcactgggcatgcagccccacggcctccccgacccagggcgacaggctcaggccaagctgcccgtggtgggagggcgtgcttccatcccgggctggcccccatggccctcagcttcctcccttctgcccctgccgcaggccggacggggccttcggcatgtcggccccgacctggtgctgtcagactcccgcatcctctcccccaagcccttcccgttctgccctgccctgccaaatgtgaaaccctgctgtctcccccaccctccccaaaggtgtctctgagccgcctcttggggccaccaaggacagggccatgttctgtccccccagagctggtcttgggatggccgtgtgacaggcatgctccacccctccagcttcgtcctggggcagggctccctccaagcctgtctccccactccccggccagaggtcagcaaccacagaaggccccccagaccacgcatggcagaccaggctgcagtggcagccctgaggtgccccccgccgagtcccagggccctgcaggggcctcgacaggagccgggcctatctctaaagcagagggaatggctgggcatgaacttcgacattccaaaaccccaagccaggaaaaagggcagggcctggtcctagggatgcttactggcagcaagagcagtgcccagtcagggtgggaggtagcaccaggctctgtgaccctcacccaagtgggggggtggtcagtggaagctggggaggcttcactcagctcaaccctgcagaccccccatatgagaac

SEQ ID NO: 47840 - DNA, 1082 bp, Homo sapiens
atgtgaggcccaggtcccctagctcctgctccctgtagcagtccccctcactcacacaagcacccagtctgcccctagatgaaggcagaggtgactgccaacagccaccaacaggcgacactcaggccagcacacaagctgtgggtcactgctgtgttcctcatctctgcctgtgcagactcagccctggcctttgggttctcttgcagatgaagaagtcgagatgacgcggatggcggtccagtttgagctggaggacctgaacctgcggcctgacccagagccacttctcaccgagatgattcatgaagtaaaatgtcaaactcgagaatgcccccgcatctcgaacagtggtcctcgggacaccaggggtggtggggagggtgcctccgtgatgttgtccttgcaggttatggatatatacagaacatttttttgttttttgagatgaggtttctccacattgcctacgctggtcttgcactcctgggctcagctcaggtgatcctcctgcctctgcctcccaagtagctgggattacaggcgtgagtcaccgcactcagcttagaacattcttgatttctgagtctgctgtttatacaatgttcgtattttccagtttttatagtaactaggtctttactactaaacacaattaatcttaggctttttgtgaatttgtattctggagaggcagattttactctttataaatacgcacgcagctgctattgccagagtgcaagtaaaatatcagcttgcgtcggattttcccagggctggctgcagatgggcgctggtgctgcttgttggaggaagcctggtcatgctgtcttcagtcacctgtgtctgtggctcttccccattaggcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagag

SEQ ID NO: 47841 - DNA, 1071 bp, Homo sapiens
gggagggctgggaggaaaagtccagcctcggcctaagccagcttcacctcctgacacctcacaattcaagacaattcccgtgctgttgaagggagaggaccgggactgaggcgacaactcaaaccccctgcacccctcctggagctcccaaacagttttgttaaaacaagtgcaattttttttcccccaggaacaccaccttcgaggtgctcttgtttctaaactgcctcttcctacccagtaccgcccctccataaaggaagaggcgcctggacagtgagctgctggggaggcctgggctgcggggggccctggcgtcggcactccttacctctcctccctgggaaccctcaggcctggaggaggggagttcagagccagggagtgacgctgcagagcttaaaacctgccgaggaaaagaagaattgcagcaaccaaatcccagggaatttaagtctctcacaccaggccaaaaaatatgaaactgttctggcctgggttacaaacgccctcttccacgtaaagtgctcctcagagagaagtgaaaagtgcctcacacgtgggtccagccgcacaaccctgttgactctagacccctgcagctctctaccaggtgcctgtgtgtgcccatgacaggcttgcaatctggggctactgttattcccattttacagaggggaaaactgaggcttagacaggtgagtgactgccccatgctttacacagctgatgaatggagaacaggattaggcccaggcctgtcccaccgtacagagtgcagtctgagctggtttttttttttttttttttgagatggagtctggctctgttgcccgggatggagtgcaatggcgcaatctcagctcactgcaacctctgcctcctgggtccaagcgattcttctgcctcagccttctgagtagctgggattacaggcacccgccaccacacccaggtaaattttgttttttttttagtagagatggggtttcaccatgttggccaggctggtctcgaactcctgacctcaggtgacccgcccagctcagcctcccaaagagctgggattac

SEQ ID NO: 47842 - DNA, 1035 bp, Homo sapiens
tcgagagctgcaggactggccatggggcagacctggcattgtcattctagagctgggcctggggggtggctggtgcagtgcagatctcaggtggaggccacctgcccgtcctttccacgtggctcagggctcagacccacctgcctgtccctggaagcccctagactgctcagagcacagacctcagtgggaaagacagtagataggcctgggtatggtctcccagccctgagaagtggggagcccactcagacctttccaggaccccaggtcccctcagcagcccacagagcgtgggtggagcctgggctggggttgggtcacttgggagccaaaggcccatttctgctgcttccagggagtcccagggagacggcagaggcagtgcctggctggggccctggttggcgtgccgtttgaggggtgcatgcactgggaagttggccaggcctgcccaaatcagggggcttccaggaggagagacatcaggaggatgggcacagaggcggcttagcaccagggctggcacctccaggtaggggctgtggggggctggaccagacagggaggctgtcacgatgcctggctgttggatgggggcacagaggctctgagtggggtggcagagcttggccaccaggtccatctgcaccccccatgccccctcactacccccagacccccatgatcccaaactactcagtcccagggacccctgcagagcctgtggtgggggtgatcttccaccctgcctggcccctgcccacctcacctcagaactttctccaaaaagtaagagccccgggggacgaaacttcgaggctccaccccttgggctctggtacaaaccccgagcctcctccgagggctgagtcactgggaaagccgggatgggctggcccctccccctccctctccttccttcctccttccccctttctcggtctccctctttttctctttgctttacttctctttcttgcctccctctctccctctcttctttcgttcctttcatcttcttcccttcctccg

SEQ ID NO: 47843 - DNA, 1050 bp, Homo sapiens
cccggtgttaggagggcgactgttccccaatcttccagcaacgctcctgctgcttttcttgaaccccgagcaaagcaccaccttgccgcagagcacccactccctagcagctgcccccacagggtgctggggacccaactgagctggtgaccagcctcccccgcccacagcaatatgccagccgccatgccggaacggagggagctgtgtccagcctggccgctgccgctgccctgcaggatggcggggtgacacttgccagtcaggtgaggctggctctaccctggggggccctggaagggtcctgggcacctccttgcatgtcctggggttactgctggcccatgagtgggtggttgtgaagggagctgtgtgggcaggacccctcccgcaggcatggccgcctgacaccccgtttcctgcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggtaaacagccctggctgtgcctggcctggggaggcgggcaggcagtggacattgccgtgtggctgttaggcatggtggggggcactggaatctgggcggaaggcggtggggactccctctccagggagggaggatggggagggaggataggtgggttcccgagaactgggggcaggttgcccggagcctcatatcagccaagaaggcagaagtgccccgtcccggggtcctgtctgcatccagcgcagcattctggaagacgccacgcctccgctggcgacgggacattattacttttggtacgcgctgtgacacttcaaactcgtaccgtgagtaataatgcgccgtccacggcaccgcatcgaaaacgccgctgagacctcagccttgacctccctcagcgtggccgggaccctgagcctctgcgcagagccacccgccccgacgtacttaggcggcatag

SEQ ID NO: 47844 - DNA, 1013 bp, Homo sapiens
ggccgctgcgggccgggccgggccggggctgaggccgagcgagccgcggggcccgcgcagccccggccggagcccaccatgcggcggctgcggcgcctggcgcacctggtgctcttctgccccttctccaagcgcctgcaggtaagcgcggtgcgcgcccgccgcccccggccgcctctgcctggggaggccgagctccagccccggagtgggccgagtacggagcggggccccgggttcggacacgaagggttcatgagcccggggtgggcagcggggagggggcgagtggctccggaaggacgggacgctgggggaggggcggtggcggcgacaggagggtccgggcgcggggatgctgcggcctggaggccctcgccccgacctgcaggcggtccctgccccccaggcccagaaaccacaccgaagtcctttcttcttttctccacttaaaaaatgaggtgtgttattctgcggtagaaaacttgggacgcacagaaacgccctggcaaggacatgacctccccgccccctgccccttcatcccatcagccagccgtagcgcggggaccctgccctgaccccgggatgaccttgaaccaccgtcccctccaggggcctggccgggtccgcaggggaggcccgggccgccttgggttccagctgccaggagccctttcaccttctgctttggggagatgcaggccaggcccatcaggctccaatcatccggggcccggcctcggatgggatgccctcccagaccctccaggaccccagccatctgccggaggcgccagtcctggtcagatttgcctgtatctccccggcccccgcagggtggtcctgggtcagcaggaggaaccctgcctgcgtcctgcctgagctcagggcctggctggcctcagctccccttctgggaagagcgtatggaacctggcaacccacagattgcagcgagaccctctgtgcccacttggggcttcaggttgtggtggtcccggctcagcctt

SEQ ID NO: 47845 - DNA, 1059 bp, Homo sapiens
tggctcggggccagagccctggtgggagcccagcctgcccctctagtggcgagggcctcagtttcctggccttgtgaactgcttttctgggttagtgctgtggggctcctggcccacggtctgagcctgctgggctgaggaccactgtgctgttcccatcccctgggtgaccttccctatcctccaagtggctacaccgggagctggtccccacctgcccctgcaaagccccagcccaggtcctggatggtggggccacctccacactcaagctttgcccgtccatctgtgccaggcccgggagccagggtgggccagggagcactgtgggggccttgcagagcagctgcttgggaccccaggatccacagcagggtcagggatggcagctggggaagatcaagacctaggggagagctgggcaaggtggctcctgcctgtaatgccaggccttaatgggagggtcacttgaagctgggagttcgaggctgcagtgagctgtgactggaccactgcactccagcctgggcaacacagcaagaccctgtctcaaaagaacaacaacaacgaaagagctgggggatgaaccagagctggccaggcggaaataggccctggcccaagcccagtcggggctctggggagcagaactgggtaagtccctagcttggtgtcactgtccccagctggggtcagccctaggcccgaggccagctgcagcctccctcctcctggctgtcctccgaggccccgcccatgctgggcctccctgcatggccctgccttgggcacgttcaccccagacggagccatccgaccttatcctgccagaacaacacccaccccccattgtttctctgctttcctgtttttcatcttgagcaagtctgccggaaacagattcagtgcccaggacaagtggtctgagggggcggagaccaacctgggcctggagggctccccacaccggagccacgccctctgctccaggacccccaggaccccactgctactggaggtctgggcccttccccagctgctgggggtcctccctctgta

SEQ ID NO: 47846 - DNA, 1033 bp, Homo sapiens
ctgttggtcaggctggtctccaactcccgacctcaggtgatctgcctgcctcggcctcccaaagttctgggattacaggggtgagccaccacgcccgaccttaatttttaactgcggtaagatacacatggcataaagtgtatcatcttaaccctgtttaagggcacagtttagtggtcacctccctctgtccgcagagctctccgccttcccaaactgaagctctgtctgcatcaaacgcacactcccagtcccttcccagcccgcggctccctctactctccttcctgtctctatggttttggcgactctggggacctcgtgtaagtgggtcctgcaggatttgtgctttggtgacgggctcgtttcactgagcctcttgtcctggggctcctcccttctgggtggacatcagatctccttccttctcaggacacagtcactccgcagtgtggataggatagacgcagctgctcttccatcccccggctgtgaacttaaggactgcccacccctgggctgttgtgaacatcggtgtctgagtctgtgtcttttttttttttttttttttttgagacagggtctcgctttctcacccaggctggagtgtagcgtggggtcacagctcactgcagcttcaacctcccgggttcaatcaatcctccagcctcagcctcccaagtagctgggactacaggcgtgagtcaccatgtccagctaatttttgtatttttagtagagatggggttttgccatgttgcccaggctggtctcgaactcctgagctcaagcaagccacccacctcagcctcccaaagagctgggatcacagggtgagccaccgcacccagctaatttttgtatttttgtagaggcggggtttccctatgttgcccaggatggtctcaaactcctgggctcaagcaatctgcccgcctcagcctccccgagtgctgggtttacagggtgagccaccatgcccggcccgcctgcgtctcttaaaggcttccaggatgtggctgcgttgggctcc

SEQ ID NO: 47847 - DNA, 2138 bp, Homo sapiens
cagtgagccgagatcgcgccactgcactccagcctgggctacagagtaagactccctctcaaaaaaaaaaaaaaaatttcattcagcagaggaaagaatcggccaccctgtagtcccctggttttgacatttatttgtacctgcccataacactgaaaagtctgggcagcgcctgcccccacctccggcccctgcagcccctggtatgtgaccctggagaggcagagccaggagtgggtgtcgctgagctgggggtgattctagaagacgggggtgccagggggccaaggggatggcaggggaaggctggggtggatccggaggcccttcctgtgggaagtggggttgagagcaccctgagcctgggtgccccgagggcacctcctcacgcagccccttcccccacagggccggctcccaggcctcagggtccgctgcatcttcctggcctggctgggcgtctttgcaggcagctggctggtgtacgtgcactactcgtcctactcggagcgctgtcgcggccatgtctgccaggtggtcattgtaagtgttgcttgtgcgggctggggactgggccgtgccccctgctgcccaagatgctggggcaccaggccctggagacaccttcctccccagacccagggcccacgaggcacgtgggtttctaggtggaatctgcaaagctgcctcaggctgggtgtggaggacaggggtccaggggaggacgggggagacgtgcggggctgcctcaggctgggtgtggaggatgggggtccagaggaggatgggggagacgtgggggctgggggcagaaggcagggcagactccagaaatctttgggagggaggatgtttagcaggaagcctggggtgggcagctggcctcactgctccgggatagagacccccgtgtggtgtcctcactggatgggatagagacccccgtgtgctggcctcactggtccaggatagcgacccccgtgtgctggcctcactggcctgggatagagaccaccgtgtgctggcctcactggtccaggatagagaccactgtgtgctggcctcactggtccgggatagagacccccgtgtgctggcctcactggtccgggatagagacccccgtgtgctggccttagtggcctcgctagcccccctgggaccaggggtcccctgaggcaggtggcagggcaaggtcctccacagcctccacctcagggagatagggctaagtcccctggcgtatgtgagcatgtgtgtgtctgggagcaaacgtgtccacatgagtgcacaccaaggtgaccccctgcccctctccacaccctgtgactagctcagaggggaggtcatcccagctctgtcttcctggcaaaccctagactcgcccagaactgggcaggtcccccactgaattttgaccccaggctgcccgatgaccagggttccgatgcctccactccccttggggtcaggcctgggcatagaaggatctggcctgtagcagcggccactgtgggttgtcatagggtgattgggtgcagggagaccccaggttcggtgtctcctccgtcagatggggagagcacctctcctggcaactgggtggtggatgaagctagccgggtgggcctgggcaggcctgtgtcccacagagccatgtctgacgggggccacatgtggaaaggcccagatgtggcagtggaggactggggtgtggggtccggagctaggagagcttctgtgcccaggacttgtttggagcccatgccagcccaggggaggcctccgggcccctggaccaggccttgctcacccttgaagtccagggggcctctgagcccagcagggccggagggtggcacatggggctcgtcctggggccatgggtggggaaggctgtgccccgatcagatgcacccctggagctcctagaaggaccaaggaggtggaggggccggacctccgggccgggatgttgtgggtgggggcgggtgggggtgagcagaggattcacgtggccaggcaggttctgagcacctactgggtgccgggccgcaaagcaggaggaggtgcccccacaaacaagaggaagctgcagcgtcggtttcccagggtgccctggccctttgcccagtggg

SEQ ID NO: 47848 - DNA, 1029 bp, Homo sapiens
aggggaccgatgtgcggcaagggccctgaggaggccaagcacacgcccgcctcagcctctgaggaagcctctccacactctgctaggtgctggtaggtgcccaggaccatggaggcagctccatctccccacccctgggggaccctggagccccagccccagccccagcctggcagacagcagtgtggcccacaggctccttccccagcaccactgtgtgccaggagcagggcagcctcctgcggtcctggggctccgggcacaggggctggtctggggctccgggcgcaggggctgtgtgatctggggctccgagtgcagggggctgtgtggtctggggctccgggtgcagggggctgtgtgggctggggctccgggtgcaggggctggtctggggctctgggttcagggggctgtgtggtctggggttccaggcgcaggggctggtctggggctccgggtgcagggggctggtctggggttccgggtgcaggggctgtgtggtctggggctctgggtgcagggagctggctggtctggggacgggagtggactccggtggcaaagggcctgcctgcaaggtggagggttggacaagtgtgcagttttccttcattttccttttctgtcttgacgaagagccggcgttttcttgctgccgggacagacgctgccttcatgactcacgtggcggggtcctcggcctccagttggcccatctcacttctgtccccatccttggtgtgtggggggcggggaccctccctcctccccaaccctggagggcggggtgttccgcagctcccttccccagctccctccaagcctgcttggccaggctccatggcaactgaggctgtacatccaggaattctcccccccccagaggggcgggccagctccatccctccatcacctcccgtggggcgctgggattgaggggctgccaggcccctggagctagggtgggggctgaggaggggcggcagccagccccaggcctgatgtaattactgctaacaaagtctc

SEQ ID NO: 47849 - DNA, 1082 bp, Homo sapiens
gtgaggccgcagcctgtcctcctgcctcagcctggggaaggctgggccgggccaaagagggaggccaagtccttgggacaggaggagacccacacctgagattagtggaaacccagccagaagctgccatgcaggtgtggctctgggcatcaggatctgtcgtgagagcccccatgagtgcccagtgcagaatggctggcagcccgccctgacggggagcagaggggctggacgcggtgcccttcacgggatgacacccagctgtttgccctgtgtccagggggttgcttctctgacagaggccctatggctcgtgtctgactcctgtccaggttctgccagcctgaccatccatcgctctggcaccaagagcccacccttttgttcttcctggcgtcccagggaaagccctgcctgggtggggcagctcctggcccttcagatggaagacgcagtccagtcagcaccatcataggaaacaagttcagaaatgtctcacttactattccgggcagggagggcgccatgagtcagggggtgcatcctccctcctggcgtcacccgaggcaggaatgaagagtcaggcagagagcgcgcgtgtggcagctggtggtgtagatattagggactagtgtgaattctagttcaccggccaatgcctggatggtccagagctgggtcggctgggcggagagctgcctccaggttcctgcctctggccctggcgtggggtcgacactgggtgtggtgtgtgtctcatgtccaggcagtggcctttgctgtgccgtcctgttacaggagccaggatggtggggacgggaccggaccggagggttggcggggctgcccctgcagccgacagccccatcctgcagccaccaatggcatgacccagggccccggcactgcctgtgtgaggggctggcagctttccaactgcagcaagtggaggcccctgccagcttcgggcctgtgggcaggggctcagtggggcaggggtgtggctgccccgcccggcacgcctgcacctgtctcctcagtgtgaccagtaccgcaaggggatcatctcgggctccgtctgc

SEQ ID NO: 47850 - DNA, 1013 bp, Homo sapiens
cagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccaaccctccctcaaggaatcctgtcagaagatgtgaaatgcaactgtgttgcaaaatcactcccctaccgtcagggctctggattccagcaccacagacatgagaccccagctcggagcaaaggcggacatggacatcccggcaggagagtcctccaagggggtttgttactctgaagaacgtaatgtcaataaacagcttttatgtaatgcccagggctgagcaccctgagcccccatcgatgctgtgtgtgggacccttcgccccgctgtggatccacccagcccaggcactcaggctggggttgagcccctgaatccttcctggcgaggcagccctcaggtgttagtccaaggtgaggtctattgcagagctgcctgcccttcaacccacacacacctctgaagccgccagggcagttccccaaacacagcggcttctgaaacagtcaatgaccagtaccccccaaacctgggctgtgcacaacagaccaagaaaaaggtgttccagtaagaaaacagatatatgcggtattttaaaaactgattttacaaaatccagccatgagatgtacaactcattccctaggaaacagcccaggaatggccatcttctccagccccgtacgctctccccagtagcccagggca

SEQ ID NO: 47851 - DNA, 1066 bp, Homo sapiens
aagaaccaagaggggctggggtgcccctgagattgagaggaagggtgcagagtgaagggtgtggcaaggccacagcagccacgtgggcacccgagaggagtgaggctggactgagaagccccgcattggacccaggcctggcctccactgcccgttgtccttgttacggaacccagtttctgccatgataaaatgggcacagggatgcccagccacgatggatgtggttcgagcttgtctctctttgccttttacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacctgggacctgcccaggaggttggagcagaaagggctctccctggggtggtgtttctcctctagggtattgggatgcatgttctgcactgccagcagagagggtgtgtctgggggccaccacctatgggacacggggtcgaaggggcctgtacactctgtcatttcctttctagcccctgcatctccaacaagtccaaggtgacagctggtgctaggggcgtggggttaataaatggcttatccttctctccacccaagtttccacctgaccaggtgaaaaacaaatcagaagggtaagatgatgacaggtcacatgaaacctttattaccctacagttgatatatgaggatcacatgcaagttacatactgaggatgtacagggaagttcccagcgctgaaccccagaattagacgttcgcatcagccccgtaggccacgtgacaccaccacagcctctctgtatgggggtctgcctctgtagcacttggcatgtaggggcagagcaaaaggggccaggctggccagagcctggctgctgggagaggagggacttgtgggccacgcccacctgcctatcattccccactcatctattagccaaagtcactccccagaggcag

SEQ ID NO: 47852 - DNA, 1849 bp, Homo sapiens
agtcaaaacaaacaaggaaggtattacccttgaaatgttgtctatacgaatttccaaggagaccacaggactgtagactgtcttggaatgtcctcagagagctctgtcattgatcaggtaacggaataaaaaccccagcgtcctttctttcaaatgggagagggaaagacaaagggacagaagccgttcaaactttgtcttctttccttgtggcttgtggtcacctctgcctccccagaagctgcctcgcccaccaaagccttcctggcttctgccaccacctcatcctccaaagcttcctctacctccatcacaaccccaaagccaccttcgcccttaggtttggcccagtccaagttacctttgtttccctcaatttcaccatcttccgcggcctccttggcgcttttggcatcctcctcactgttgccatctacagagccaaagcctttggggcacccggtttcctggttggtgactacccttgcccaacaaagctgtcgaatgactaaagcctcttcagtggtgtcctcagacaggcctttgacagacagttttagatggctggctcctggcatcaggtggtccttgcaactccagcctgattgccctgcccccagtttcccttttattacaggaatttaaagctgctttatcatcttcaaatgaagcgaactgtaagtgcatgcacaccctttagatttgccattttggttctggggcactttgataaaagttgccttgtctcagattctttctgaagagtttcttctgttgcactgtaggagaggttgcttaaaccagagtttttgattcacccctccaagtggtctctctagtcttgatttagacctttctctccatgatagtgcagggaaatagatcggccatccatctctgttccctgcgtttcttcagaagttttctctgcattagcttctgtcttaacctcaatataagcagtccctttactcttcccatccttgctgactaatccaatctccacagcatcttcaaacacttttttgttttttgagccagagtctcgctctgttgcccaggctggagtgcagtggccgtgatctcagctcactgcaagctccacctcccaagtttgcgccattttcctgcctcagcctcccgagtagctgggactacaggcacccgtcaccacacccagctaattttttgtatttttagtagagacagggtttcaccgtgttagccaggatggtcttgatctcctgacctcgtgatctgcctgccttggcctcccaaagtgctgggattacaggtgtgagccactgcgccactgcgcccagccaaaacacttgtaattcatcctgagtgactttgtaagggagatttgtagccaaaagtattctcacatcttgctctttcttactgtcttttccttttggtttctctagtttaatttcattgccaaagtctttcaaaccagcgagttccaaggctctttccaggtcttcagcagcttgaaaatccacatagtcagatttccttgtcatacccattctgacatccacaacagcaagatcatttttagcaaaaatatcatggatactagtttttgtttttctttctttttcgagacagggtcttgctctgttacccaggctggagtgcaatggtgctcactgcagcttccacctcccgggttcaagtgattctcctgcctcagcctccccagtagctgggactacaggcacgcaccactacgcccggctaatttttgtatttttagtagagacagggtttcattatgttggccaggctggtctcaaactcctgaccttgtgatctgtccacctcagcctcccaaagtgct

SEQ ID NO: 47853 - DNA, 1185 bp, Homo sapiens
catcctcctcctcatcgctgtcttccttcttggcgttcttgccgttctttgcccccttggctggggtgtcccttcttgccaggagctgctgccagtgctttgcctgctatggctcccttcttggcaggtgtggcgactgctttgcctggagtgacagttgctttcttggtgggtgtggcacctgcagccttttttgttcgggaaactgtcaccttcttggctggggttgcagcagccttcttgcctttctcctgaggtgtgacagtctcttctccacagctgtcatcttcttcatcttctgacatttcctcatcttcacttcctccttctgcctcctttgggggagcagccattttcttggggtcaccttggtttttacctgcctcgacaccaagtagtctgaagctgctgaggatgggaaatctttgcagggtgcagagtgggagaggagcaaggtgtggctgacaccagctgcagcacaggctgtcagggtggggaggtggctgggcccttgtaatgggcccaggagatgctgctggcactgtgagagggcctggttaggagttaaaccttcatgcatctgagataaatcataagctcttcttggtatgaaaatgtaagaaaattattccatattttgcaggaaagctgcaggaatgtgaaggagttaaattgaatcagggtaagaaaggctcagggcctcaaatagagctctgtgttttctgcattgtatcttctaaaacaagcttagaacagaggtcgtgttcacatcccgtttagtaaaagagcaggtttaccatgaggttaagtacaggtaagtacagggcttcttagcgtttcttggatgaatcctaaaggttttccaggagaatcacttagcttattgcagccaacatttaagattctgaagttaagcagaaaaaaagaaaacccaagatcaagggaccagcaggagaaaaaaaagattctgaaattgattttatttatttagggtcttgctctttcgcctgaactggagtgcagtggcgcaatcttgactcactgcagccttcacctccctggctcaagcaatcttcccacctcagcctcctgagtagctgggactacaggtgcacgccaccatgcctggctgagttttgtaatttttgtagagacagtgtttcaccatgttgcccaggctggtct

SEQ ID NO: 47854 - DNA, 1045 bp, Homo sapiens
ttattattaagaagaagtgttaacttcagacttcactgcagcagatgtgagtgttgaaaacttaagggttcccaaagtgtagaaacaggttgcaaatcttccaaataaataccaggtagaaagaatactttctgaaaaccaccttgtccaggccgggcgcggtggctcacgcctgtaatcccagcactttgggaggccaaggcgagtggatcacgaggtcaggagatcgagaccatcctggctaacatggtgaaaccccgtctctaataaaaatacaaaaaattagccgggcgtggtggcgggcgcctgtagtcccagctactcgggaggctgaggcaggagaatggcgtgaacccgggaggcggagcttgcagtgagccgagatggtgccactgcactccagcctgggcagcagaacgagactccgtctcaagaaaaaaaaaaaaaaaaaaagaaaaccaccttgtccagctttaatcaaaggcatagaaggctgggggaggggcaagggaaccagagctgtaactaaaaatcataaaataacatggcagcagcagttgtcagtaaacagaactcaccagctcgaaagaatgtgagattcgaggaatttttttttctttaatttggctatgtggtgtataagagacacatccaaaacataatggtgtcgaaaggttgaaagttaggagttggaaacaagacactaggtaaacattaaccataagaaagctgctctagctatagtcctagtgctacagcgacagtgatgccatatgcagaatatacttcaaaatgaaagagagcgggtagaaatgtgaagggttaccgcaggctcagagaaagtctctggacctgaaggctcaaggaacattgattaaagtggaccatcctcactggtgccgtggcttatacctgtaatcccagcactttgggaggccaaggcaggaggattgcttgagcccaggaggtcgagaccagcttgggcaaaaagcaagaccctgtctctaagaaaaaaatagtaaaaaaactaggcatggggtggtgg

SEQ ID NO: 47855 - DNA, 1048 bp, Homo sapiens
cctgttcttccagcacctccgcaggctgggtgttcttagtccagtcgggtgccaggtccatccccatctccacccgttctgagccacctcccgcctttgctaagtccgtgctcccctcccagctgccctccctcccccatcacattttcaaaacaagctgggcagtggcctctccaacccagccccggagcaagcaggcccaggcccggggctacccggcacacacgcgttgtgcgtgagctgggatgcaggccccgcgttctgcagaattgtgcactgaagacgccagggctcgcagtggctcacgtctgtaatcccagcactttgggaggccaaggcgggcggatcacgaggtcaggagatcgagaccaccctggctaacacggtgaaaccccgtctctactaaaaatacaaaaaattagctggacatggtggcgggcgcctgtagtcccagctactcgggaggctgagacaggagaatggcgtgaacccgggaggtggagcttgcagtgagccgagatagcaccactgcagtacggcctgggcaaaaaagcgagactccgtctcaaaaaaaaaaaaaaaaagactccagggctgcagaaaacctggttaggagcaatccgcagaagcctggggtgctgtggagagctcctcaggtggtgggccctgaccctgagggtcaccaggggtcccaggggtgggctctagggcagaaccacgtcctccaagtagaaagcctgacctggctccaagtagaaagctgccccctgggcccggttcgccgttgatgctctgtgtgctgccaggtgtcctcctgatgggagaggttgccatggtacccacccatcgtcttcctcccctgcctgccggtcacctggtctgattctagcaagaaagatgaaacaggtggcagcagaaccggctctccttgtagttgctcttaaagctgcagcttgggttcggttcgtttaatttgccttttctttttctcttcccgtccccagtgaagatagtgatccggggagacaggaacacgggcaagacagcg

SEQ ID NO: 47856 - DNA, 1049 bp, Homo sapiens
gccaggagggtccccttccagtatgctgaggccaggaggggccgtgcccaggatcggggcccgggagggaggggccgtgcccaggatcggggccggggagggaggggccgtgcccaggatcggggccctggagggaggggccgtgcccaggatcggggcccgggagggaggggccgtgcccaggattggggctgcggagggagataccgtgcattcagtttgtcactgaagctgtgtctgagcgaaggcctgaaggagccgccatgtggtcgtctggggaggacacatcccctgcttctggacactcggaagtcctggtgggagccggtggctgcggggcacagacaaccacaccagctggaccgctttgtgccaccttgggaacttcatgttgggcactaattttaggattctccctgtttcagccacggatgacatcgtgaaggttgaagtctgggatgtagtagacaaaggtgaggcgtctctgttctgtgtctgcttctctctgggactgtgtgctctgcgcagagaggcttcctttctttcccccggcgcccatgcatcacccaccatcctcgtggacggtgcccagggtcttgctgctctgctcccctccacatccagtggcgaccccgcagcgtggcgcagcccctcctgtggcactgcatgctttgctgctttagcatactccccgtctctgagtgaccgcgtgcacggtggcggcaggtgcagccggggggtgtgctttgagccccaaggcccagggtgctattttgggagccctcctcctgcactgcctggcggagtagcccagcaccaggcggccccctgcccatagctgaggacccagctcctgcgctcctgtccctgccagggatccccagccacacagacctgcactctggggaccgtgggagggcagcaccagcccccggggtgtcctcgacatcgttggtctcctcctcagccacaaggtcatgagttcctctaagtcctcagggtggagctcatggccctccccggggcccatggtccgtgtgcatgtgtgg

SEQ ID NO: 47857 - DNA, 1664 bp, Homo sapiens
gaccaggcgcaagcccccagagtccactgtggagtcgcatgggatccactcagctcctcaggagtgcagtgtcccccaggacgcaccggagccccagcgggggggtgctgcggacgcacacttggcacaaggctcctagaagaacgagggccgcgtgaagaccagtgtcctggtgcagggcccctcctagccacagccagtgcccggagcaccaggagcagcatgcccgacacgtccaggcatctgctcttcccagcagtgggtctggcctgggggcctagtcagcagcttctcttacttgggaagacccccacaccagggttaagcgtaccgcctgtcacggggccgcacactcagcacgcatcagcagcccaggcctgagggcggcttgaagcacctgaccagccatgctctgggcctctgccaacctttgccaatgctgggaaccatgcctgccctcccagccttcagcaccaccaccaaggactgaccgcaggcaccctcaggagagccctcggtgggggtgtggcacacggatggcaggagaaccacacacggggctggcggccccaccccagggcacgagttcagctcgggcgcacacgctggcctcacctgggcgagcagtggtgctcctctccctccggcctctcctgtctaggcagcaggccagcctggtgggtgggaagtggcttttcccaagcgaagttgagtgtggacacagtgtggcctccacggcacctcccactgctgccacaggaacggcctggagggagctgcagccgcctgggctgccgtgcgaggagtgggcgggagtgacagcgagacttgagccagcctgagaagacgcggcaaaggcgcttacctgtgggcccggagaccctgttggcagcaccagcctgggcaggcgatgcctatggtagcaatgctctgtctggagcccctggtgcccagcaggaaggatggaaaacactggctcagacagcggcttcaagcaccacgcaggcccttcacagccacgagaggcaggagacaccagaaggccacctgcttaggaggccagaggtgcccctgggccggccttggtgaggggcccgtttaaatgactgcgtgtaaatgaaagaaaatgaagttagaaacaggatgttgcattttttactcccttatgttggctttcagtcgtggggaagttttgtcacttgaagcgctggttatttcttcacaagccatttggaaaaccacgcagctgggaaactggcagttccacgccaggcagactctggagacttgccgtccgtgccaggagatgtctgcttaagacaaggctctccaaacagcccgcttcaccggcagccgcagaggcaccccagggtgtcctcggctgccccggtgggcagggagcctggaggaccagccacagggtcgacaccaaggggcacagaggacagtgcggaatgagggtggacacagatgaagccagaggtggttttgtagggatgcggacatggggtgctctgagggaaggcagggacaggcaggggcgttccagtgtggggtgcggtcaagtacctgccgtcagggagagggacgggcgggggctgcaggctgaggggtgcgaaggccctcgaggcacttccctctagctctgcatgcacgaggcatgc

SEQ ID NO: 47858 - DNA, 1729 bp, Homo sapiens
cctgtggcctcaggagcctgcaggaggagggagggcagtgcggacccacagctgtgggcccaggggtgatccttggcaccagggcaagggtctttctcttgcatcttttttcctttctgaaagcagacctccaggttcctcctacttccgctatgctgagtcttccatgaagaacagcttcggcctaaagtaccttcataagttcttcaatatcccatttttgcagcttcaggtaagcactcaccacgtggggtggagtggctgctggtctctcacctccttccaggtgtctcctgtgtagcaacgggtctccctcctaacccctgagaaagctgtggacctgctcggagattggctgctggcaagggcccagcgttctactgcacctgcctgctctgggtggcagagggtacagggtcctgagggctagacccagtcccaggagcccctccacctctgcggggaccccttgctcagtttcccccagtgtttttggttgtttttgtttgttgagataaggtcttgctgtgtggcccaggctggagtgcagtggcgcaatcatggctcactgcggcctcaaactccggggctcaggcaatcctcccacctgtctcccaaagtgctgggatgccaggcgtgagtcaccgaggtactcgctgttcacatctcacatttccctggtgcttgtgtcaaaaccaaggaaccaactttggcctacggactaaactcactttcctttgtagaaacaagggccaggccagctgtggctgcaaagtagcccagcaaatgatgaggcttgaacctcctcgccctgggctgccctgattgggtctgggggacctgaacctcctcgccctgggctgccctgactgggtctgggggacctgaacctcctcgccctgggctgccccagctgggtctggggacctgaacctcctcgccctgggctgccccgcctgggtctggggacctgaacctcctcgccctgggctgccccgcctgggtctggggacctgaacctcctcgccctgggctgccccacctgggtctggggacctgaacctcctcgccctgggctgccccagctgggtctgggggacctgaacctcctcgccctgggctgccccagctgggtctgggggacctgaacctcctcgccctgggctgccccagctggatctgggggacctgaacctcctcgccctgggctgccccgcctgggtctgggggacctgaacctccttgcctgggctgccccgcctgggtctgggggacctgaacctcctcgccctgggctgccccagctgggtctgggggacctgtacctcctcgccctgggctgccccgcctgggtctgggggacctgaacctcctcgccctgggctgccccgactgggtctgggggacctgaatctcctcaccctgggctgccccagctgggtctggggacctgaacctcctcgccctgggctgccccagctgggtctgggggacctgaacctcctcgccctgggctgccccgactgggtctgggggacctggggcccagctgcagctgcagcagccttggtctttctccagaaggatgtcaggcttgcccaggaaaggggctgtgctgtcgtcctggtgtcagaagaagtgaggatgcctgcaggctgggactgctgctggggacgtttgggttggaaggaaggcggcagtcagacttgtcctgtgccggcactgctgg

SEQ ID NO: 47859 - DNA, 1045 bp, Homo sapiens
gagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaagtaaaatagaacttgaatgtagcggctgccgttgcctccttgtaccggtagcggggttggggacggaagccttcggtcggtggagaggagaaagggagaggccttcgggcggtggacggggaagagagggagtccttcgggcggtggagggggtggagagcgaggccttcgggcggtggagagcggggaggggggaggccttcgggcggtgggagggggagagagggaggcctttgggcggtgggggccacggggagggtggtcttcggactacgtgcgggacaggaggtcagggctggcaagtccctcaggcctccctcgttgccccagcctcgcgggccgcctaactgccccgttccaagggtgccaccggaccccgctggagaggaacttctccgttggctggatttcatcaccacccattcccgattccacgtttcctttaagcggggctggcggagccgcaaggcggcaaggaactggattgcgattggtcagcacgtgcctcggtcggcggtacaattggctgaggcgctgggcct

SEQ ID NO: 47860 - DNA, 1041 bp, Homo sapiens
ccgtcctgctgcggaggcgccgaggggagctggggaccgcctgggtccgagaccgtgttgacatccagagcgcctaccccttccaggtagggaacagcaagagggtggggtctggggagccgcactgtgggcaggggaggggaacccacaaggtacccactgcgggtggacagggaccagaccccagggggaaataggctgggcaccccctgagcccctctgccctcagatcctcctggccgggcagacaggcccggggggcgtcgtgggtctggacgacctcatcctgtctgaccactgcagaccagtctcgggtgagcctgctgactctgccctaccctgccttgccctggagaggcacagcactccccatccctgcctcctgacaccagttctgcccccacagaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggtaaaggggctcaacctcctgcagacctcctgctgcggagccaagggggtaggcgccggggcaggctgaggactctgaggactctgccattcagtgccggctgctgttccaggcaccacagactttgagtcccccgaggctgggggctgggaggacgccagcgtggggcggctgcagtggcggcgtgtctcagcccaggagagccaggggtccagtgcagctgctgctggtgaggcccaaggcccaaggctcaagcccccgcccgggtgtgagcagcgtcctcagaggggtctctgctctgcctctgcactacagagggtctctggactggggatccctgagggacagagtggggccctggaagggatgaggctctgagcaccatgctcttcccctagggcacttcctgtctctgcagcgggcctgggggcagctaggcgctgagg

SEQ ID NO: 47861 - DNA, 1060 bp, Homo sapiens
atcagcctcctcttgttcccaggccactttgccttctttgaaactggcgtgctgggccccgggggccgggccgcctggctgcgcagcgagcctctgccggccaccccagcctcctgcctccgcttctggtaccacatgggttttcctgagcacttctgtgagtccggctgggccaatgggtgcctgggcaacgggggcagcaggggtccaggagcagaggtggggaggtggcctccccagcccgcccctggttaggcgtgcaggagccccaggaccccaggcctgacacgccctggccctgctctcagacaagggggagctgaaggtactgctgcacagtgctcagggccagctggctgtgtggggcgcaggcgggcatcggcggcaccagtggctggaggcccaggtggaggtagccagtgccaaggagttccaggtgaggctggctgtgggcaaggagcctcctcctcctccacccagggcccacacaaactcctttccttctccatcagatcgtgtttgaagccactctgggcggccagccagccctggggcccattgccctggatgacgtggagtatctggctgggcagcattgccagcagcctgcccccagcccgggtgagccctgggctgcagtggaggcacggaggagggcccaaggggccagcctggctcggggtttgccaggcttaccagtgtgtggtcccaggagctgcgagcatgctgcacccagacaggacaagagagctgccaggcccaggccctgtgccctcctcactctgccctgctcacccctggggccgctgcctgggctgggctgtccctggggtgcagcctctggggcctgccctgcctggctgtggcctctgtgctccctgtgcccacacccagggcaaggtccatcctggaggaaccgccagccgggtcagggcagccactgactgctctcacttggtgagggaaagaatctcgcctggggccatgagccccaccaagtctgcagacagcagctgcctgtctgccaggccccatccttgtggtagcagaaccaataccc

SEQ ID NO: 47862 - DNA, 1031 bp, Homo sapiens
agcgcggggtcgggtgcggggtcgggcgcgggcgcggggtcgggtgcggggtcgggcgcggggtcgggcgcaggcgcgggcacctctcagggagactccgggccggagcgggagcgggggcgggagaggccgcggggcgggggcggggccagcccgaggggatttctctgagccgctgggccggaaaccaagtccgagcgtggctggcgcgggaaagttcgggaacgcgcgcggccgtgctcggagcagcgccagggcacggtccggggttttgcgcggggtcgcggctcccagtaccgcctgaggcccgtgggcggcccacccggccctgccccgtcccgggtccgtcgctcccccgcaccctgtcgcccctccacgctcagctgtgggcccctcgtgtccccgaagccccgcaccctcagccggctgcgtgctcgggagggtcaggggcgcctccgacccctgagtttgccagcgccccccagccaggggtcggggaagaccagtgaggctgggggcggagccgactctgctgccttcctgcccagtggctggggagacccaggctgagcctgggtgaaaagtccctctggctgctgggagggtcgggggcagcaaggagccagtgcggggatgggctgcggtggaccgggccgggatcggggccggggcctggtcctggcagtagcaggggatgtttgtggaaggtagagccgagaaaaagaggagttgcaatgtctgcaagaatctggcgtgagcagctgaaggctggtgcttcctaggccaagatgaaggagtcacagcgcccatggcctctcgggaggcggccagatgggcagcctggggtcaggggaacggtcagggccagagctgggtattttggagttgtcattttgaggccccgagggctgagggtcagtgcagaagagcaccaagcctccactcggtgtagggccgacagggggtggggtgtctggcagccggtgaagacggggctcggaggaggagggagtctggtctgggtcaagtca

SEQ ID NO: 47863 - DNA, 1025 bp, Homo sapiens
tcagctcactgcaacctccgcctctcaggtttgagcgattcttctgcctcagcctctggagtagctgggcttacaggcttgcaccaccatgcctggctaattttttgtatttttagtggagacggggtctcaccatgttggccagcctggtcttgaactcctgacctcatgatccgcccgcctcggcctcccaaagtgctgggattacaagtgtgagccaccgcgcccagccatttttttgtgtttttggtagagacagggtttcatcatgttccccaggctggtcttgaactcctgagctcaagcaatctgcctacctcggcctcccaaagtgctgggattataggtgtgagccaccatgcctggcccatttttgtggttcttttatgtctgacaggcatgcctagggcagggagggcacacctctgtctccaccttcaagagcgcatttaggaggaatgtcgatatgaaaagaatcaagctttgtctgaaagatgcaccaggacactcttcagtgacattgggaaaaaagaacgctcaccctgaatcttttttttttttttgagacgaagtttcgctctttgtgcccaagctggagagcagtggtgcgatcttgactctctgcaacctctgcctcccaggttcaagcgattctcctgcctcagcctcccaagtagctggaattacaggcgtgagccactgcactcggctaattttgtgtttttagtagaaatgggtttctccatgttggtcaagctggtctcgatcaccacctcaggtgatccacccgcctcagcctcccaaagtgctgggattacaggcatgagccaccgtgcccggcccattctgaatctgtctaccctagcaaaacgatcctttattttactttcttgccccattcgtacactggcatgactgcactcatagggttcttcacattttatatcctatttaacatcttataataagtataaaataggattttgtcctaaagaatgtggtttaaggccaggcgcggtggctca

SEQ ID NO: 47864 - DNA, 1114 bp, Homo sapiens
tcgcgccactgcactcccgcctgggcgacagagcgagactccgtctcaaaaaaataaataaataaaaagaatgtggcttaaaaaccaatgatacttaaaaatagaaaatttctttgtccaaagtggattagaagccactttgttctaaaaccattaaacctttttaaactgttagtggctcagccaggcacagtggctcatgcctataatctcagcactttgggagattgaggtgggcagattatctgaggtcaggagttcgagaccagcctggccaacatggtgaaaccctgtctctactaaaaatacaaaaattagccaggcgtggtgacaggcgtctgtaatcccagctactcgggaggctgaggcaggagaatcgcttgaacctgggaggcggaggttgcaccttagatcacaccgttgcactcccgcctgagcgacagagcaagactctgtctcacatgaataaataaataaaccattagtggctcatgaaatcaatgtaatagcttctgaccagaacaaaagaaagaaaatagaacactcagaatgcctcttatgaagactaagtgtagttctgtgaaccttttagtgacgtacatgtatgtagcacgtctccacatgtcatgatgaatgtgcgctgagggtgcagtcctggtgagcaggctaccacctcagtttgccacggctggtatgcatctgtgagctccggaacatccacatagctctgccgcccacaggagcaggtgcacccaccttcgagaaagtgggagaaacaggtgtggcgtccccaccgagggaccttgagcactgggcaggcagagccccagcgtcccttctgttgggtggttggaggagtaagtttaggttataagcatgttttctgaactctgaagtgccacacgaatgtaaggtctcactaaattacagattcagaagctgggattgaaagcacaccactgctggctttggggggcagacaggtgactgacagtctcgtcacagtttctcaagagtcagccctattcaggtcagtgagcgcaggtcagggatgaggtcgctgcactctgcgttccccagtcctgtatgcggcgtcagttttggcagtccacgt

SEQ ID NO: 47865 - DNA, 1030 bp, Homo sapiens
atgtttgctgtccggttgtgtttcgagtctgttctcttgggcgtctgtgccgtggaagttccttgtgcttgatagggccagcacgtgtgaacaatcttcacttcagctagaagctttgaagtctttggactcaagctttacccaaaccgcttataaggttggggggaaccgagtgcctgtctctccccgcttttttttttgagtggagtctcgctctgtcacccaggctggagcacagtggcgcgatcttggctcactgcaacctcagcctcctgagtagctgggactacaggcgcccgccgccacgcccggctaattttttgtatttttaatagagacggggtttcaccgtgttagccaggatggtcccgaactcctgatctcatgatctgcccacctcggcctcccaaagtgctgagattacaggcgtgagagttgtagttcgttgagagggagacagacctcgaggaaatgcttggtgtgcctgccgggtgactgctcgctctccttgtctgctcactctgcccagtgaatgggtctaggcatcctcattgttcccttcctctgtcctcaacatcagcccaaccctgaccaggccccttcctgaggttcccacacaacaggggctccatgttcagaaggggagagagaaacccacctggggatgctctgtaaggagagcagagcccagtggagtctctgcccgggacgctgagggaggaagagctgcggttaattcaaaaggaagggtgaggtgcaggtattggctggatgatgctcagagaagcaggaagagtgggcatggcactgagtggctgaggccatcactggtggccttggtgcttaggcagaaggagagggcatggtgcagggcgctgaggccgtctgtggctgccttggtggggcttactgagttctagtggacagcaaggtgccagggcagggctggcacatggagggctctgaaggccatgtgtatcgtctgaagtgagggaaacccgtggtagctaaagggaatgcactagccagc

SEQ ID NO: 47866 - DNA, 2058 bp, Homo sapiens
cttaggggccacccttagagtcatcagatccatgggtacaggaagtagaatggaggagacaggggtcattgttcagtgagtaccgagtcatacattggaatgaggcagtaccttgatgccatccaatccagccccaggttggtgaggctgtgagggctgtttgctcagaatcctggctttctgcacttaggggagcttcctgcccgggccagagctgggatctcctgctcagccggaccctggggtgttaccggctgggttggaattggacctgcattactgtgtgtttctcctctcctgctccccgccctgtgagcctggccacgcctccctcttctcctcgcccactccccaccctgtgagcctggccacacctcccacgatcttttgacagactctgctttgtggtctttgggctccaagtttcgttttttcagaagaactgccccagctgtgtctggggtgaacaagatgtgctttcctccctagcacggggattgcgtcctggacacggagcggtagctccagggcactgccctagagtgagactcctacctctgtgggcagagatgccagaccgccctcagccacgacgtgcgatgcaaagctttctaggctcctgtgtggctctgccgcacaaacggctgtggcgcatggcattgtaccccccactccctgctccttgaaagagatgcagcttggtcattgcccagtgctgtctgcaagggagatggctccctggggaggtggcccagggtcagggtctccctgggagggttggggtaccagctggctgcagggagtaggggtgctatgcgccatgccaccctttgagaggactgaggagtgtctgggggacaggtgggataatagtttccagctctgcactggaccctgagtcctctggggtctctgccacctccaggctcatgggatgccacattgacaattatgagggcctccggctgagggccaaggactatagccagcccctggcctggggcgccacgcggtcctgcaggcacgcagggtggaaagtccctggctgcacctttgagagctctggaaagtccctgagaggagccgggtttggtcatgtgggaggggcgggcactgctctggaataacttggctgtggcctttgattttgttgataaaacctctcactggctgtaaatgtcacacatggggacggaaatcaacccgtctatacagttgggagccgctctgcccctcggagccgcctctctttgctctccgggtgctcggagtgtgctgctagttggggccttattgtaaacacagtacggaggctaaggctgcctttcctccttgatggtcggaactttattggaaaaggggaaaatcctgcttagcttttgaatgtttgtcctttgcaatgatgcctttctaggaactgaatgattttatttatttatttttatttttttgagacggtcttgctctgttgtccaggctagagtgcagtggcgtgacctcggctcactgcagcctccacctcccaggttcaagtgattcttctgcctcagcctacaggcgcctgccaccacatccggctaattttttatatttctagtagagatggggttttaccacgttggccaggctggtcttgaactccttacctcaagtgatccatccaccttggcctcccaaagtgctgagattcctggcataagccactgcacctggccaaatcgaataattttaaaactttaggtaaatgttgatggagtgcttgctgagtgccaatagcagaactgaattccccagtgggcccctgagctactcgttctggcagctggatgcgggggtgcggggagactttccagagaggacataggctggctgcacgagcagcggaaaggccaggaaaagccaagtatgctcggcctcatggacattctagtgacattcagagggatgacgactgtatttgcgtcaaatgtgtagtttgaattctggctgaataaatattgatttttttttttttaaactgtgtctgctgtgggtggggagaagactgagacagatggt

SEQ ID NO: 47867 - DNA, 1120 bp, Homo sapiens
gaggaggacagtgtaaagggggatagtgttcgtgccccagcaggttctagcaggtcctggagctttagagcccggacaatgtagaactccatctgcaaaccccagtccagtgtggtttaggggaggctctggcccccttcatttctgagtcctgtcatctaaggggcccaaaccctggaaggtcctagaggccaggccgtgggcaggagcctcttctctctgatgggagggcagagtcagccatggatggggatgtgcatggcctggtgtggcttctgagcacgcttgctggcccggagcttctgtgtggacttggagccaccacctcttggcgagggtggggttgggttcttgtgtgcagggagtggacatgagaaacatggagcccaggggtgcccaagagcactgtcctgctggagatcggtgggtgtgggaggcaggggctcgtgcccgcacccctcctgtaagagggaaggtggtcttggcacccggcaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccaggtgtggttctaggacccccacctcactgcagctgctgtttacttggcacctgggtcccctcacccctgtgaccacataggatggctcccaagggtggggctgggatacgacccccagtgataccgggagcagctacacctccctgagtggcaagtggggtagctgaatatgggctggccggtgggtgccctcgggcaggggtcggggtaggggggttgggccggctgccctcctgccgtgccagccctcgaggtgtgcccctcgtcacccacagcctggtcctctggcacacagccctaaagcagacattacatcaacaggctctcctgcctgatcacagctcccaggaagacagggcgggtgggggtggctgtgggggtgggacatggctctcagggccttggagctgagctagtctgatccctcccaggttcattttccacacgg

SEQ ID NO: 47868 - DNA, 1086 bp, Homo sapiens
ctgatagaatcttaggttctaggatcaaggccgagatgctgtaggcacctttcctgtttgaatttagcctggcactgctcgtgaaactcagcactgggggccatggcagtcctgtgctctggcgccctcgaggcggaaagagacccaagcgtcatctggaggggccgccacattgtgtggtgcctgctgccaaggccttcagcagggaccagaaacaaaactcacactctttcttctctgagttgagactggaaaaatgaaagattgttttaggggaaacttgagggaacagtctgggcagcctgcagggcatggccctgttcctccagggctgggaaagtcagcactgctttctggtggcgaccttccctctgcagctgctggctcagccgattgtatatgctgggagctctgcactaagcgttgggtgaagggtcagcattgtggaggccctgccacggaggtggtcttcttgggagctgcactcaggcaagaggacctgtttgtgtggaacatctgctttaagcaatgctggtgaacacagcttgtgtgcggcacgcgtgcaggctgaggacaggcagaatgggcctgggggcacggtggaggacgaggatggggaggatgggcctgggggcacggtggaggacgaggatggggaggatgggcctgggggcgtgtggaggacagggatggggaggatgggcctgggcacgtggtggaggacggggacggggaggatgggcctgggcatgtggtggaggactaggacggggggaggatgggcctgggggcatgtggaggacgaggatggggaggatgggtctgggggcacgtggtggaggacgaggatggggaggatgggcctgggggcacgaggtggagaggactaggacagggaggatgggcttgggggcacgcggtggaggacgaggatggggaggatgggcctgggggcacgcggtggaggacgaggacggaagggtggtcctggtgctgccacagtggggtccctgcgtgcagacctttgcacacagtgttctgtcatgtgacttggaaagcagcctctgccgggttctggctgtcact

SEQ ID NO: 47869 - DNA, 1047 bp, Homo sapiens
ccatctcctctcctgggcctccccagggactcctgtgagagcagaatgaggatgagccagccctggtcctgcctttctgtgcacaggctccaccgagcatcctggctgcacccggggggtcctggccacaccgagggtcctggctgcaccgcccctgtggtgtgtttttgggacagtgcaggcaggcgtaggcacggcttcacactcggtgtcagggcagccgtgctgggacctactgggcatctgtatcggggtccaggataaagtgctgtcccctctcgacgtcttcacgcactgctgtagtttgagaagttgaccacagaaaagtacagaaaataactcaggcacggagctgaccgacgggcattgtctgtgttccgtgagtgtgtactgggcctaaagagcaagcattgcagagccctgctgttccctttcccggcctcacctcagctccccaggccacgtggcgggaattgaggcgttccggttctctttgggctttagaattttgcatctgtacgtttctgtattcacaaataagaatattgcattaaaaatgcagaaaccatccactgggtcagctgcaggtagctgggcttttgactcagcctggctacttttaatgcatcttgtgctgggcactctacatggtggattctgactgccgtgtgtgagttccctagagagcaccttccagtctcttcccgtgtcttcagggtttggtgactggagatagccagacctgctctcgtgggtctcctgtcaacctggaaggagggttggtggtttctaggcctcccctttttagcagttgccagcttgctttgcagaggggctgcatccggtccttccaccagcaccagggggagggttcccatcactcccatccctcccatccctgcccgtgcttcgtgttgttggaattgagatgctgcagcgtgctgtgtgtgaagtgaagtggcatcgctgtcacgtgcgtttctctgatgactcggcggagtcaggcgtctttaccacgcttacctctcccttggattctctcccgtg

SEQ ID NO: 47870 - DNA, 1044 bp, Homo sapiens
ggctcccacgaagcagaccaaggcccttgagggacaaaatgctctggagcagccccgtgggcaggcctggcccagccgcctcatggccttctggggaagtgacaggctctgtgcaaacccacagaggtaccatcgtcactacctaattttgggacatttcatcaccctgcagagaaaccttcccttagcagtcactgttccctcccgctcagcccctgacagccagccataaacctaccttctgtctctatagatttgcctactcaggacattcatgtgaatgtggcctttgcttttactcagcaagatattttcatggttcctgtgtgttgcagcatgcattggagtttcattccttctaatggctgaataatctcttgtatggatgcaccacaccttatttatccattcatccgttgctggacatttgggtggtttctactttttggctactctgaaaatgctgctgtgaacatttgtgaacaagtttttatggggacgtgtatttgttttcatttctcttgaatatttataccgaggagtagagctgctgggccgcttgttcagctcttggaggaattgccgaacttttgtgtcaccttacatctccctcaggaagtgttttttttttttttttttttttttgagacggaatctcgttctgtcttcctggctggaatacaatggcacaatctcggctcactgcagcctccgcctcccaggttcaagcaattctcctgcctcagcttcctgagtagctgggattacagctgtgagccaccacgcctggctaatttttgtatttttagtagagacagggctttaccatgttggccaggctggtctcgaactgctgacctcaggtgatctgcccacctcagcctcccaaagtgctgggattgcaggtgttgcacctggcccctaataacatttttaaatttcacgtagtaaaattgatttgttcttttgttttgttcatggaacattcaattccatggatgttcacacctgtgcagatgtgggtaagcaccatacctgggagac

SEQ ID NO: 47871 - DNA, 1032 bp, Homo sapiens
accacgcccggctaatttttgtattttttgtagagatagggttttgccatgttgcctgggctggtgtcctggactcaagtgattcacccacctctgccttccaaagtgctgggattatgggcataaaagtcaccacacccagccagtatacatatcttgtacatgttttagtaggtttatgcttcagtgtttcttttacttatttattgcttcctatcccacagcttactttgtttcttgagctgttgtaagaggttgttttttgaattttggtttctgactgtatatttccagtgtttaaaaacaaaactgatttttatgtgttgttcttatacctcataaccttgatgaattcacttactggttgtaggagattaggattttgtttgtttttatagatttggggggattttatgtgtgaacaatatgtcatccattaataaggacagttttatttctttttattcaatctctatgccttttatttcttttgcttgccttgttccattggctgacttcccgtttataaggttgaatagtaatggtaagagtctatagcctttcctcattcccactcttggggaaagctttcttgctttcacaattatgtatcatgttacccacggggatttttggtgatgctgttttatcaggttgagcaagttcccttctacttctagtttgcttctagggttttttttttttttttttatcatgactagacattttatcaagatgtttttcaatggctgggtttggtggctcatgcctataatcccagcactttgggaggccgaggcaggcggatcaccttaggtcaggagtttgagaccagcttggccaacatggtgaaaacccatctctattaaaaacaaaaattagctgggcatggtggtgcactcctgtaatcccagctacttgggaggctgaggcaggagaattgcttgaactgggagacggaggtgacagtgagctgagatcgtgccattgcactctaacctgggcaacaaggaaactgtcttccaaaaaaaa

SEQ ID NO: 47872 - DNA, 1028 bp, Homo sapiens
accagttctgcgaaacttgggatcttgctgctgctccctgacccagctctctggcagctgctccaggccccgtgcacaagtttcatagctgcagtttcacagagttcactctgtcgcccaggctggagtgcagtggcgcaatctcagctcattcccgggttcaatgaattctcctgcctcagtcccctgagtagctgggattagaggtgtgtgccaccacgctcggctaattttttttttttttttttttaagtacaaaaggggtttcaccgtgttggccaggctggtcttgatctcctgacctcaagtgatccgcctcggcctcccaaagtgctaggattacaggcatgaaccaccacgcccggcctgacctcagcatatgttttctgaggacttctgttcttttgctaattcagtcactttctctttaaacactgggtctccacccctgccccgtagatggggtgggggcatgcatgccgctccattcccctcccagggctgtgtttctttcgtctcctctgtgccatcttctgctgcctggtcctctcgtcgagtctgtctggtccagcactttccacatatcaagatttttttttttttcttttccttttttgagacagagtcttgttctgtcgcccaggctggagtgcagtggtgcaatctcggctcactgcaagctccgcctcccaggttcacgccattctcctacctcagtctctcgagtagctgagactacaggcgtccgccaccgcgcccggctaattttttgtatttttagtagagacagggtttcaccttgttagccaggatggcctcgatctgacctcgtgatctgcccacctcggcctcccaaagtactgggattacaggcgtgagccaccgcgcccggcctacgtatcaagcttttgatgcagtcactcgccctgtcattttccagtgtctaattggctccctttttattttgaaatgtccaagtcctcttgatttctgtccccacttttgttttatggtgcataggaatgttt

SEQ ID NO: 47873 - DNA, 1794 bp, Homo sapiens
acacacagaccccgcccccaaccagactccgccccgcgcaagctccctaagcccgcgactggcctgcacccggctccggaagtcgttcttccgcgcaggagccctgagcccgcacagccccgcccctcccggcgcccaagccccgccccgccgggttcccgctcgcccggcgccatggatccgctgtcgccgccgctctgcacgctgccgccgggccccgagccgccccgcttcgtgtgctactgcgaaggggaggaaagcggggagggggaccgcggcggcttcaacctctagtgagtgggggtccgcggggaggtaggggtgcagggagctccgcgggcggccccgcctgacaggccttctcccccagcgtgaccgacgccgcggagctttggagcacctgcttcacgccggacagcctggcggccctcgtgggtaactgggcgggtctgggagccgccacacccctccttgcagtgcagatcgtctatggggcgacagacatctgggattccccagaaggctctgacaccctctgcccgccctgtagctgtagtcctcccattggctagggctctggggtcgggcaggtttcgggtgcccccagtgggcctcgggttccaggcagctcgtgacaagcccctgtgctctctagaaagcccgttttggcctgagtgcggctgaggacatcaccccccggttcaggtgagacccaagcagggaggaaggacgggtggggaggaggagggtctgccacagctctccgcacctctcctctcccagggcagcctgtgagcagcaagctgtggctctgactctgcaggaggacagagcatccctgacgctttcaggggggccctcggcactggcctttgacctctccaaggtaccaggcccagaggcagcccccaggctgcgggcgctgacactgggcctggcaaaacgcgtgtggagcctggagcggcgactggcaggtaggattgggggtgggcacctcataccttcactggggtcccctgctcttgcccccactcctggcactgagtggggttcccatgggctttcctccccagctgcagaagagacagctgtcagcccgaggaagagcccccggcctgcagggcctcagctcttcttaccaggtaaggcatgtccgcctgtgactcaagtagggctgtgctctttaacctggaactcagtttccccccaaacaagactcacgctccagagagaatgcctatctattcggagaaggttgtggttgggatgctgccaggttcaggagctgcccctgtcctgttttcccccagacccagatccccagagaggtggccctggacctggagtcaggaggcggtgtccaggagagtcgctcatcaaccccgggttcaagaggtaccctcccacagcccccttcctgcgcccagggtccaatcctggaccccacccctttctccacaccatagtgccatagtgacacccctcttccctcccagtaagaaaccagctggtggcgtggacttcgatgagacctgaaggtgcagcacaagcgtggccccgcggggagtccgcctatgaggggagaggcagtctttgaggcccccatcagagaccccccgccaccacctccacctgcctgtcctgggccaggactaacacggctcctcaaattccttccctgtcaaataaacagctcccttggttggaggctctggtggggctctgactcctggcactggcctgggaagggatcagggaacacccctgggcctgtgttctgggtgtagggccaca

SEQ ID NO: 47874 - DNA, 1057 bp, Homo sapiens
agcctttctgtccccacccctccctgactccaggcagacctgggatcgcacctggggactgtggctcttggtgtggccagaggggctgtgacccgccaaaaggtgggtacttggccattgtcccctgctcgtctccagggtttagaagtgtacctgcaaggccgggagttccagtccccgctcatcctggatgaagaccaggccagggagccgcagctgcaggagtcctgacccgcccagactgtccccagactcccccgagacctgccagccccggcatcctggaagtcccgactccccccagacctgccagccccggcgtcctggagctgggggctacagcccagcctgagctctgggtgggaaagcagcctgccccatgcttccagcctgcagaacacagaatgaaacatgctggtagactccacgagggcagggcctctcctgtcgcctctggacacaagtggcgacagcctgctgggggctctgtggctccattcctggctgtggggtctagtcaagaggcagagggacttgggacctgggagaatggggctgagaggaggcttcgggttggggcccaagggaggtgtggtgtcatctggggagaacaggagggcatgtccctttgggagcccgccttgtggatccaccacaccccaccgagcactagaagctgcataagctacacaggatgtgcttctgcagcctacagatgcagaaccagaatgagggggacaattccacccactcgagggctgccccctcttccttagcagacgaaccagtaatgggggcaaggctggggcatcccagcccacacaccctggatgcccagcaaggccacagaaagagcctgatgtccatgatccaggtggctctgagaagcttggcctggacacctgagcctgcggccggtactcctgccttctccccatctatccccaaggcctctgcctctcagcctcttccatggtcggtttaggctgctgagttttctgtgcttccccaagaaccagtgggatcaatgccggcggcctctgtgatggttgctgac

SEQ ID NO: 47875 - DNA, 1062 bp, Homo sapiens
gatttagaggcactgggaggacagtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtctttttttttgtttgttttagacggagtttcactcttgttgcccaggctggagtgaagtggcgtgaccttggctcactgcaacctccaggccagcctcagcctccctagtagctgggactacaggcacccactaccacgcctggctaattctttgtatttttagtagagatggggtttgaccgtgttagccaggatggtctcgatctcctgacctcgtgatccacccacctcggcctcccaaagtgctgggattataggtgtgagccaccgcgccgggccggttgctggcatcttaatgttctgtaggtggaatatttccaataaacacaaggtgccgtaattgactgctactctggcaagtgcagtttttgggcagtgcacgggtgttgggaacaaggatcaggtgttcacagctgtgtcccagggctggagctcactgggggcccccttagggacaggagttcacacatgaaggccaagactacttggggtgccaaggaatccccccgcggtcccatcccactcttcaccagggtctcaggagggcctgagacaacctgcggtcaggaacctcggggcgctctccagggcaggcttctgcatgctcagctctgacagcctggagactcgctctcctgcacctgcatccttgagatgccaaggtttccctgctaaccacgtgaggatgcttggggtactccagggactgacaagagtgagtggtgtcaacctaaagagaaactcaggctctccagaataaatgaatttaatcaagaataacacataattgcaatgcagagtatgcaa

SEQ ID NO: 47876 - DNA, 1061 bp, Homo sapiens
tagacgaggcctctgggtgacctgaacgttggttctctactctgctcatataccaggaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggtaagggggcaggctttctggctggatgcgcctcccctggagctaccttttgctcatcacagcaggtactgtgtgtgtgtgtgtatgtgcatgtgtgttttcaggttttttactgtgataaaacacacaaaacgcaccaccttaaccatttccaggcgtggtcggtggtgttacattcacgctgttgcaggcgtgcaggtcggtggtgttacacacattcacactgttgcaggcgtgcaggtcggtggtgttacacacatttgggctgttgcaggcgtacaggtcagtggtgttacacacatgctgttgcaggagtacaggtcggtggtgttacacacattcatgctgttgcaggcgtgcaggttggtgctgttacacacatgctgttgcaggagtacaggtcggtggtgttacatgctgttgcaggcgtgcaggtcggtggtgttacattcacgctgttgcaggcgtgcaggtcggtgctgttacacacattcctgctgttgcaggagtacaggtcggtggtgttacacgtgctgttgcaggtgtgcaggtcggtggtggtacacacattcatgctgttgcaggagtataggtcggtggtgttacacacattcactgttgcaggcgtgcaggtcggtggtgttacacattcacgctgttgcaggcgtgcaggtcggtggtgttacattcacgctgttgcagacgtgcaggtcagtgctgttacacacgctgttgcaggcgtgcaggttggtggtgttacattcacactgttgcaggcgtgcaggtcggtggtgttacacacattcattctgttgc

SEQ ID NO: 47877 - DNA, 1046 bp, Homo sapiens
aggtcggtggtacattcatgctgttgcaggcgtgcaggtcggtggtgttacacattttcacgctgttgcagacgtgcaggtcagtggtgttacattcatgctgttgcaggcgtgcaggtcggtggtgttacattcacgctggtgcaggcatgcaggtcggtggtgttacacacaacgctgttgcaggcgtgcaggtcagtggtacacacattcacgctattgcaggcgtgcaggccggtggtgttacattcacgctgttgcaggcgtgcaggttggtgttacacacattcacacttgcaggcgtgcgggtcggtggtgttacacacattcatgctgttgcaggcgtgcaggtcggtgttacacacattcacacttgcaggcgtgcaggtcggtggtgttacacacattcacactgttgcaggcgtgcaggtccgtggtgttacacacatgctgttgcaggcgtgcaggtcggtggtgttacattcacactgttgcaggtgtgcaggttggtgttacacacattcacactgttgcaggcttgcaggtcggtggtgttacacacattcacacttgcaggcgtgcaggtcagtggtgttacacacattcatgctgttgcaggcatgcaggtcggtagtgttacacattcatgctgttgcaggcgtgcaggtcggtggtgttgcacattcatgctgttgcaggcatgcaggtcggtggtgttacattcacgctgttgcaggagtacaggtcagtggtgttacacacattcatgctgttgtgcagctatcacttccatctccagagcccttttcatcttaaaactgaagctctcccatcacacagtgacccttcatgtccctccccagtccctgaaaaacactgttcaggtttttcttcctggacctcattgtgtggagttcctcgtgtgagtgcagtcacacacgatttgtcctttttttgttttcgtttgttgagacagagtctcattctgtcactcaggctggagtgcagtggcgtgatctcagctcactgcaacctccactcccagg

SEQ ID NO: 47878 - DNA, 1054 bp, Homo sapiens
agattgtcattttcatgaagcacagctggtcagtttattgttgctcatgtatttggcctcatgttcgagtccctgtttttaatcatgagctggacacagccctctttagagcaactgtgaccacttgtggtgagaagtgcagcccacaccatccacgtgaggctcccacacgccatccacgtgaggctcccatgcagacatttagaaggcgttttcactgcagctcagaaaatggccccaggcccccatgggcacccccatgtcaccagggcctctggttgctgccggtacacagggataggcagccaggcctcgaaggtgctgggcatgggtttgggtgtctgcgttgggtagagacccggagcgcccttgctgggcgtgccctaacatcccggtaccctgtgcccctctgtgggccaggacgcctggtgctgccagctgggcgtaagccctgaggagctgagggtggctgtgacttggaggatgagtaggagctcaccaggagggcgtggagccgaggcgtttaatatcatcaggagcaacactgggctcagaaggcaggcacacttgccgtccctccagagccatggctgacggccaggcctggtgggctctcgtgaggacagtgcctgtggttgtcagatgctgtcccttcgagtaagggatgagagccatcctgaagatgggtcagctctgtggtgaccacccgttgggagcagtgacattcaggtgcgttgcactggtggctgtgtggctgtgtggtacggccaccaggagccatgtgggcaaggacagctgtgggctgggcacagagctctctctgctgggagtcagtcggtgctggggcgaggggaggcagagctcacagagcccctctacagctcaccctgcagctcggccctggccagtaaacccaccatccccctttctgccgcaggaggcagtggagaaggtgacacagcacatccacggcctgtctgggaagaaggatgggctggtgcccatgttcatcaatacccacagtggcctcttcacccacctgggcgtattcacg

SEQ ID NO: 47879 - DNA, 1024 bp, Homo sapiens
aagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaccgcgatgtcgcctgtgtctttagggatctccatgactggaaagtctgggcggacgttggggagaaggtattcttcaagtcacgtctcagaattcggtttgctgagactggactctagctgtcccctgctggtgggcagggagaggccacggggaagctccgtgtccctggccccacggggcagatgcttggcgggaggcatccttgcgcctgcgtttcacacagggcctgtttccctgcagggctggcactgaggcgcacagctgagggatacacgggccctcaggtcaggcagctcccagcagcctggcatggctatggccccgagccctgggctgtggtggcagagttgtcctcatcatcactctactgctgtccctatcccagggctgaccctgggccttggctgggttccccccgaccctgaaccaggtgacctcttaggaccacgccccctcgctctcccctgtgaaaaatccatcaccttcacttccggaagactccccttccctgggaagccagagccggtggcggcacagggcagggctacccggacccagcccaggattgccagctccgcccctcgggacgtccgggc

SEQ ID NO: 47880 - DNA, 1099 bp, Homo sapiens
cccacagacaggaaggacgggacatacatggccaggcctccaggcgtttattcagccccttccctctgccgccagctgcttgagtgaagcccccactccatgaggagccttgagacccctccagtcctgtgctcagaggctgagtctgggccccccacgcagagctggctgctgctcacgcctggctgcctttacccactcgccgatgatggtggcctccagcttccgcgcctcaaccacggaagcaggatcttctgggtgggaggctctggggagcgggcacagagggggcccgtcagccccagccctcggtgagcctgtcccgcccgacccgcgaccaccgccaggccacctccctccgcacctgaggtcgaggtggtgcgctcccccctggatggtgacggcgatgactgaggcactcaggttcctccgaatctgtggtcagtggaaagaactccatcaggtgaggaacgaggcaactgcccagcctccgtgggcccattggagaggagacgtgagagggcgagccgagactcagtgcccatcaagcaaccagagagaaccagccagagacggaggtgggaagtgacgagatgatgggggcaaaaccgggtgagacaggagcagggaaggggcaggtgtgaggcctgtgatcccagcactctgggagtaagacaggagcagggtaggggcaggtgaggggcctgtgatcccagcactctgagggtgagacgggagcagggtaggggcaggcgaggggcctgtgatcccagcactctgggggtgagacgggagcagggtaggggcaggcgaggggcctgtgatcccagcactctgggggtgagacgggagcagggtaggggcaggcgaggggcctgtgatcccagcactctgggaggccatgcggggaagatcgtttgagcccaagagttcgagaccagcctgggcgatatggtgagactgtgtctctacaaaaaaatatttttttaaattagctgggcatgttggtgagcgcctgtagtcccagttactgggaggcttgagcctcagaggtcaaggctgcagtgaaccctgatctcgccactgtattccagcctgg

SEQ ID NO: 47881 - DNA, 1053 bp, Homo sapiens
cagccctccgtctacccaggatgcaaactgggcactgagaggctgaccaacctggggccactggcagacagacctgcagggccacttggcaggggacatccagtttggtgccagcgctgaggagccagagggctgggctgtgcagccaggcttctgggtcccccaccttctccaaattcctcctgcccagagtccacagtccttggtaacactgccttaaagcacaggggtcgccccagccaggcccaggctcttctgggaggatggaaggccccagaggcaggaactgagacagaggctggaacagccaccttcctgaggctctgaaagccctggcgtgccccctcggcacccaaactgctcctcccaggtgacttcacctctggccatgggaaggtgggggtctcattcctgtgccctcaggcacgacctccttcgcctctctgggcaccagtttcctcacatgtgaaggagagaagatggccttacccaggaaagcagccagtggtcaaatgaaaggcgggggaaacggatgcccctggcccagagcaggccaaagggagggggcacagctcacagctgcaccctggccttaccacagtctctacactacaaccaacctgtgcccaaaacatgaaccggcaaggccaggtcagagctagtccaagacctcaagcacagcctgccttgccaccacgtcaccaggtggatagacagaagcaggggacatttttgcaccccaaggcactgccccaggccacaaagagggagcaggtgaaaaataacctggaagcctcagaggaccacaagatcagcaagagtccacagggacactgaaggaaccagggcttacctggacagacacagagaactgaggcagaggggggcagagcctgctccactcccggccatgccacggcactccgtggcagcttgaagccaggaaaagcaagccagggcaagcaagcaccacgctctcgcctggggagatgaggcctttagccccaagagtgaattcttcttcatacatagagttgtttaaatttgggagga

SEQ ID NO: 47882 - DNA, 1050 bp, Homo sapiens
acctggaggaggttggaacctgaaagagaagacggtctggctgctcacataaatccctctgccctgtcagcctgagtaaaggagaagggggtcaagttttgggaaggacgcccggtccttacagccggaggtcttacgtgtgtgtgtctttttgttgaggtgaatctgattaacgagcccctggtgatatttgtttgtgcaactacaggccaaggagacccccctgacaacatgaaggtaaggctggcctgatgtggctcctcagatccctgccctcgaccctcaccccgttttcattgcctggcgtctaggtgcagtaaatagctctcctttatctcatgcaccttcagaggtggatttgagagaacgtccgtgagtggggctgggggctccggttgccctctctaataaactcgtcgtagccaccaaatagccttattatccgttttaacctttcttatttttccagggctatctatatgtgcatctagtctgggtcttgtgtgtatttctagactgtatgaccctcagggaacgttgctgaattctctgaccatcttttaagcacatattctattcttggcacagtctggtgctggggatccagctgtgaacccagcagccatatttccatcctggcagagttcacactgtagcagaagcagctaacgggcaatgacagtgccagcaaacacctgctgctggggaaagtagcatatgtcacaggagcactgataaggggcatcgagccttatctcacccaaccttggggcccaggcagaggtttctggaagaaaagagtgtaagctgagtcacggaaggatgcgtgagggctagtcaggcaccgaggaagaaggagcagtcagcgcagaggaaaaagatgatttggtttgtgtgaaaagtggaaagcagctcagggtggccaagctgaggagtacactggggcaagaggggaggagaagagaggcaggaagccaggcccagtccaaagagcctgagtaaccacagcaaggcagatgggcttgaaatgaagggttgtcggaactgtag

SEQ ID NO: 47883 - DNA, 1046 bp, Homo sapiens
gagggcacagaggggagcaggcagggtggcaaagggctgggctccagccacgctgacgtcacacaggcctacctggcgccggtccccacttttacaaaaaggcgtgctgtgaagtgttgacgactttgagcctggaggaggaccccgtatgctcctgccaccccagaggccacctctgccttttctcctgggcattttcacagtgctcctctgcaccctaagcaaggagtggcatgttcagtgtgcaaatggcatctttagaccccacaacggtgaaaaccccgactgtccacgtagggcccaggtccgctgagcaccgagcatcaaaagccgtttgcatagccaggtgtcagtcatttcagatgaaaaagaacgggaagatcggagacagctccccccggttctgccgggaggttttgttccgtgcgtgacgtaggtccgtgcatgacgttgtttcctgcgtgacgttgttctgtgtgggacacagtgttcgttcaagagagggagggaggccgctgccgacagcgttcccagggaggagcgtgacccagagccagtcatgcctcggaaccagagtgagaagagaaactgacccccgggaagatgcctggctctctccccagcacagagtttctcagctgaggagtgacccacatcttggctgggggcctggaggcctcagctgcctcaagtccctgcccagggatgagggcccatcagtgggacgaggccgcctgctcccacccacacaggctcattctctgcgagcagaggacctgctgcttggcaccctggcagctgccctggtctcggcagcccctggcgtgtggaggccctgccccctcctagggtgcggccagcgtggagtgtgttttccacccgagggaggccctccccaggctccactcttcgcccgggctccactctcccgggttccactctgcctgggcaccactctccgcccgggctccagcccaggaccagcctcactgtctccacaggttcaacttcgtggccaagaagctgcaccgacggctactgcagct

SEQ ID NO: 47884 - DNA, 1032 bp, Homo sapiens
gcgtggtacccgcctccacagtctggtctggccacacgcagggtccgctcaggccagcgcacgtgctccctcccaggcccgacgctgctgtggacccctggctgcgagacttgtgggacagggttctggggctgtacccgccgcctccgggcctcactgagatccctcccggagtcccgtgagtgtgggccccgggtcacccacaggcgcagcagacccaacctggcctggggacctcgccctgggtccctcccgtgtgggtgggcggcccctggggagtgggtcctggtctgaccagcgtgccctcccacagcctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcaggtggggactgctggggaccgaggagggcaaggtgaggtgggccgtgggtctggggttcggaggaggctgggccgggctgcaggggatgacttctatccggggccccgacatcctccctgcggcgtccccacagccctggtggcttcttccacacagctttgctgctggtgatgtggtgctgattcagccctccaactcggctgcccatgtccagcggttctgccaggtgctgggcctggaccctgaccagctcttcatgctgcagccgcgggagccaggtgagcccagcctcggccaccctgactctctgccctctcccgtgccctgggcccccaccccaagggctccgccgcagcccacggaggcctcccactcaccctgcagatgtctcctcccccacgaggctgccccagccctgctccatgcggcacctcgtgtcccactacctggacatcgccagcgtgcctcgccgctccttcttcgaactcctggcctgtctatccctccat

SEQ ID NO: 47885 - DNA, 1057 bp, Homo sapiens
cctctgccctggggccacctcggctgctgcagcctgcccagcagcacattccagtcactgcccccgcactcccacagggctcaggctgggctcagaggccactgagatgccagctccttgagagcagtgggggtgtcccaggccagagcagcctcttcctctcctggtcccagaaaaacccttgcagtaaatggtggcctctgggtggttacttctagcgcaggcttccttccttcctctagctcctcccggtgccctgggtgctgggtgctggatggatgggcgtcctctagctcctcccggtgccctgggtgctgggtgctggatgggtgggcgtcctctagctcctcccggtgccctgggtgctgggtgctggatgggtgggcgccacggtgcacccttgttgggctgcctgtgcccgagtggcctctgcagctcttatgtctgcctctaatgggatgtgcgccctgactgcctcgttcttaagggcatagtgggtcggctaagatctgatcgccaggactgcgttctgggcaggtgctgggaaggcggaaccaagccgtccgtgccgctagggagccgagactgccggaaagaggagcggcaggagggggcgtggttgtgcagccccacccccgggaggggctttaggcactgggaaggaaagtcctgttggaggagttcggtggctgttcacacccgcctcgctgtcttggagtcttgatctgtcgtcggcgggtcgctggcacaggactaaacatggctgaggctgggctccagccagatctggctggggacagcaccgcgtgggcccaggatccacccagagcaggcaggccttgctggggccccagtcaagtccacttccagtgaggagagccagccgggaggtcagtgccagagctctggtggagcccagaccctgccttccctgagggccgcccctgtcgccgccctggggtccctgtcctcctatcctgactcctgccccagggccaccacccctgaactgtgccctggggcccccaccctccacctggccgactccagctctggg

SEQ ID NO: 47886 - DNA, 1647 bp, Homo sapiens
gtctacctggctgacaaatgattagctgtgttctctcacaggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgtgtggtttcgctttgcccattccttccagtaggccctccgggtgctgttgccgaatgtcagggcgtagttgtcctgcatggctgcggggagccaggctgcagctgagctgggcttatgtgcccaggaccagcatgggctggacacccaggcttcagagaagtgtggggctgccctgggccctgggtatctgcttggtggggaacttgcttgttgaaggcaggcctgtcctgttccaggtacccaaccttggggctcggcctgtgtctgggacttaggtgggtccagtgaccccccttccaaaaggggtagggaggatggcagacaatcctaccccaaccaaggtgggaccctggtaatggtcagacaggtggtcctgaaccagcaatgaagggt

SEQ ID NO: 47887 - DNA, 1376 bp, Homo sapiens
ttccacgcttatgtacacgaaattcactcggctgcgacgacgtccgttcccggagcagacggaccctgagtccgccccccacgccctcacccgccctcttctgccagaaagcccgggcgcgggcgggaccgggtgggcgcatgcgcgctgggctggctgggcggggtctctcgcgccgggtgagggcgctgctcccaggaacctgcgcgcggccccggcggcgtttcccgggggccggttggcgggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccaggtggggcggcccccggggcggggggagcccagttggagggccgggccgcctgctcgggagtcgggcctggcggaggcgccggaagttttccggctttctgctggtggctgagtcctgttctgggggtggagtccggagccagcacccctttgctggacggctgggtggctttcggtggctgcggttaccgccagcacggctgggaacacctgggtgcgtgcctccctgtgctctcaggacctcggggtgcccgggcgcactgggctgcgtttgaggtttctcttggcttcctcagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtgggtcagcgggaggggtgggcaggtgagatgtgcagccggcctctcagccttggatcgactcaggggcatttattgtccttttggctccacatccttgctcccagaggtggcctgggcctgtgtctgagtgaccccttgacccatgtgtcctgggcgtggaggcttgtcctggtagctgttatctgtgtagggacaggcaggtagctgctgcgatttggcgcatcgctgcaccatcaatcctgtgagttgttccaggtacaagaagctggaagaccttctggagaagagcttttctctggtgaagatgccgtccctgcagcccgtggtgatgtgcgtcatgaagcacctgccc

SEQ ID NO: 47888 - DNA, 1052 bp, Homo sapiens
tgttggtatttagcatgtctgtctgacatgctggggccggggaaccagtcataggtgccctgtggggtggagcttagctcgaggtggtctctgcggggctgaggcctcttggcttgtcttgaaggagacccagggacacaggtgccactcacaggcagcctgtggtgtcatgtaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtgaggggacaggccgtgtgcggggtggggcacctcttggggatgccacggctagcgccttcagctgcctggggatcagcactctgctgccctgtgaatgatcgggtggttctgcttcttggctgggtggtgggggagggctggcttgtacacatgctggaaagaaagttggttgtttttctgtttgcattttacttttcgttaaagtgatatatggacaacatttaaaatctgcggaaagcccgctcatgtgaagttaatcccccctcccctactttttttctttttctttgagacggagtctcgctctgttgcccaggctggagtgcagtggtgtgatctcggctcactgcaagctcccgggttcactccattctcctgcctcagtctcccgagtagctgggactacaggcgcccgccaccatgcctggctaattttttttctttttctttttttttttttttgagacggagtttcgctattgttgcccaggctggagtgcaatggcgtgatctcggctcactgcgacctccgcctcccaggttcaagcaattctcctgcctcagcctcccgagtagctgggattacaggcatgcatcaccacgcccggctaattttgtatttttagtagagatgggatttctc

SEQ ID NO: 47889 - DNA, 1043 bp, Homo sapiens
tgctgtctttgttgtgttttggtgtctggcttcagaaaagaatgtggaagagtttcgttctctttcctgtggttcagtgtagctggcagtcagggagaactctctgcagctggcgccggccctgtatttgttaggcttgtttctcctgggctcggctgctgggcaaggccttttgggactggaggagcacctcgtttttctgtctccttcttcctccaccctcctcctgtccccgggctgtctccccctccctccaccctcctcctgtccctgggctgtctccccctccctccaccctcctgtccctgggctgcagctctgcttccctgccacaggtcccaccccctgcctgcctctgtccacttcccacccccctcttcacctgctgagaccctgtgcttctcatctcagaacaactgagaactctcatgtgagcacccccagaagtaggttctgaggtctttgaggacaagggtgccctctggggtgggcagggtgagtggcactgggctgatgcctgctgtgtctgcagtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggtaggcctgctgggtaccatccggcccgctctgtcctctcagctcttgtccgtagcagcctgagaggtggctgctgtccccagcctggggcggagggtccgcaggtgggtctgttgggcaccagggctcgcatgtggccctgcagggtgcctgggcacagctggggagggtcccaaaggctggccatgtcctgtctccaggggccttggccacctgcatctgggctgggcctgggcagacagcagggcctgcctcctgccccagccctgcacggccttttccaggaaggagaacgtgcaccggcacgcgctgcggctcctcattcacctgcaccccagggtggccccgtctaagctggaggcgttgcag

SEQ ID NO: 47890 - DNA, 1009 bp, Homo sapiens
aagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccagtttgcaggtgtggccttgtttctccttgcccagcagtgctgccttcagcggccgtgacggggccagctggacacacggtgagattttctcgtatgtaaataaaaggcattttggtaaacgtggaggctgagatgtctctgtgcctgccctgaggttggatgtagctcagatggacacaggcatttgtgctatggagccaatacttggggctttgtgggccacagcctctctggactgctcagccctgtctgtgaccagcagctggggacgatataataatttctgggggaggttgatataataatttctgggggaggttgataaaatttctgggggaggatataataatttctgggggaggttgatataatttctgggggaggatgatataataatttctgagggagg

SEQ ID NO: 47891 - DNA, 1064 bp, Homo sapiens
cccgagtcgagcgcacacggcgggcgcccctggcaagtgggactcctccggccccgaggcctgaactcagcccggagaccgcgcccaccagcgccggtgtccccggaggggccccgctagttccctgagcagaggtcctgcggcttcccggagggtgtcctgttctctcccccgcctcgcatccattctcgccctggtggttggtgtctgtggtcgggggcgagggccgtctagtggagacggggattcaggccgcttgaaagtctgggatctctgggcggatggcagcggctccgcggagctcgagctcggcgcgcaggtcctgggcccagggcgggagcgctagcgagagggctgccccgtcctgcccagagggtcctgaggactcccgctgctcctggagtcttggggaggggtccggctccacggggtgggggtgggggctaccaggaaacctttgcctcctggggctgtgcaggaccggctagccagcgctgggaaccagggctgagttcagcccagctctgtccaccccaaccccagggctaggggaaggagctgggagaaggagccccacctctcccaggcgagtatctgtcccaggagcccacacagagggacacccagctctggtctggccttcgtgttggcttcaaggtggtaacagagagagctgcagagtgggggtgtgtttgccagtccctgcatgggtgaatgttggggtgcccactgctccccaggcaggacccccaggactgtcagctccccttcccacagagcacccacctggaggtgtcacctgccggcaagcgtgggccattcatccacctgtcagtcaacaacacccgctgagcatcggcttgtatcaaaaggtccagacctaaggggaaattttatctctttctttctttctttcttttttttttgacacagagttttgctcttgttgcccaggctggagtgcaatgacacgatctcggttcactgcaacctctgcctcctgggttcaagcgattctcctgcctcagcctcccgagtagctgggattacaggcgcccgccatc

SEQ ID NO: 47892 - DNA, 1046 bp, Homo sapiens
gtgggactctctgcccagctgccctctccaatcccagagccctcgagggcagaaccaggtctgggtcccccgtgggccacctcagctggcgtgttggacacagggcccagccttaaggggtcagcgtgggcagccccatagttgccccaacccctgacctgtccatttccacatccacatttccctgatacctgcgcctcccactgccctggggcaggtgtggccctgaaagtggcgagggggctggagcaacaccactgtgtgccttgtccagggcacaaaacgggcccccatggctgcattattattattatttttgagatgcggtctcattgtcacccaggctggaatgtagtggcgcaatcacagctcactgcagcctgaagccccggggctcaaatgagcctcccacatcagcctcctgagtagtacaccaccacactcagctaatttttgtatttttcgtagagatgaggtctcacgatattgcccaggctggtcttgaactcctgggctcaagtgatctttccatctgggtttcccaaagtgctgggactccaggtgtgtgccacgcccagcccctctgggtggtttctgagtatgaccaacctgccaggcttactgcgatgctgggggtgggggcagggaggccgggaggctaggaccagcttacacccgagtcctgacttggagcggggtgcacggccttcccagtggtcacttcctggacaaagagacgggtcagatacccaggactcccctggcaatgccaggagggggctgggtgcccactgagagccaggtcccaggcaggcacctgcaggtcctgtggaggtgtggccttcccgtcacagcccttctgatgtcagagcaccctggggaggaggtggggcttccaggccatctgtgcaggggagcagggaagaggaggccgagatccatggtcacatggctattccaggacccctccccatgcaggggctttgggttgagccccagatgacatggctgccgcaggcaggtggcctcgaggcccctggagcctc

SEQ ID NO: 47893 - DNA, 1053 bp, Homo sapiens
gactacaggcgcgtgccgccatgcccagctaatttttgtatttttagtagagatggggtttcaccatgttggccaggctggtctcaaactcctgacctcaggtgatccgcccacctcagcttcccaacatgctaggattacaggcgtgagctaacatgcccggcctgtaatgcagttctttagctgctgactctgggatctggactgcgttatctcgtctccagtatgtgacagccaaggttgcctgaggtcaggagtttgagaatgtcttgaacccagaggcggaggcagcagtgagccaagatcgagccactgcactccagcctgggtgacagagcgagaccccgtctcaaaaaaaaaaaaaaggatttttaaaagacaaaaatcttgcataaccccactccccagaggtaactattattaacatactggaacacttttttctggcctctgtccttgtgctcatggtaaacacattggttttagcagcacctcagtgggctctgcgccttggacgggttggggttgggtgggctgtggcaacctgagtggcgacagccctgcccaggcaggggctccgaaggttcctggacaggagcaggaggggctgtggggggtccccaggggctgacggaattccgtggccctgtcacccatcacgctgtatctgtgatgctgcgtgaccaggttacagaccttggcatcccgtgggcatttttgtccccaggcatttgaccaagccgtgaccaaggacacctgcatggcggttggcttcttccagcgaggagtggccaacttccagctggcaaggtgagtacaggggtgccttgttccttctctgacggccctttgtctccctgcagagtccactcctgcacctcctcctcctccctctccatccactccctcctcttgcccaccccctcctccatggttcctggctccagggaaacctgagactgtggccctcgcctctgctgagcgccacccttggacacaggtcgtggggtcctcactgcttacctgggctctctgcaccatgtcccttcctaa

SEQ ID NO: 47894 - DNA, 1024 bp, Homo sapiens
aagatccatcaaaggcttcagggaccaccacatacgcagtcgcccagagagcccggatctggagatattttacctttcagaaaggcagatgaacgaaaaagccatctcttcctttactgaagagtcccagcattcgggattatggctgtgggactgtccctttctggattacgatccagacccctctggggcagcctctccttcacatcggcgcgggaagcccgcctggaggagaggcctctccggcaggcgctggggagctcccagcaaggcttggaaggaggctcagagtttggagggggagcccccatggggtggggggcctgagaagcaggagggaaataaccagggctctctgcacggttcagaagagaggcttgggggcgggcaggggcccaggaagctgagtctgagctgggaaaatggtggagccccagcacacagtgacccccacacccactcagcacacatgtgcatggacccctggcccaccagacctgagtgtgcagacctaggcaccgcactgccctccctcaggtctccttggaaccaggtgttgggggcggctcgagcggggctggtgtgaaagctgcctaaccacagccccatctccgccctgtgctgctgaggggaccccggctgcccacaggttccaggaggctctgtctgacttctggctggccctggagcagctgaggggccacgctgccatcgactacacgcagctgggcctgcggttcaagctgcaagcctgggaggtgaggccgggcagggctcactgtgctgctggctgtggggtgtccacgggcggtggcactgtcacaggagggccctgtggactggggagcgcctctggccgaagctcttggtgccatggaataccctggccactccttgacccgcaggaggttctggtggcagtggaggtggagggaccattttgtgccatttcaggccaccaggggtggctccacccagaaggagggcagaggcgaaaggctgctgggtgggcagggagcaggca

SEQ ID NO: 47895 - DNA, 1038 bp, Homo sapiens
ccaatttcatgagatgaagaagcttccggagggagatggccctagtgcccagtttcgggtgccaggcgggggcttcctgtgacctgcgggaagggggtggggggcccaagcggccccttctgctccaaggcacaggggctctgcggctgcaggcctggttggtcaccccgtctgcatctgctggatacccaccccctccagagacggggctcactgccgccacggcaggtccccaggggcgaggtcttccggccccaccggtggcacctgaagcacttggagcccgtggatttcctgggcaaggccaaggtaaaggtggggacggcgtcctggggcatggcggctggtgctgagccctcgaactgtgttcccagggatggggggaggtgcagtccaggccaccgtaagggccaggagggtagagagtgggcccacagccatcctcaaactggcgcccacggtaggggggcggtgccccaaatggggctgtgagcttgaaggcagagcccactagagccggctgcataggagggggctccagctctctcaacaaggaccctgcaggtgccaccccgcccccagactgggccatggccacagccacagccttgcagcctcccagagtccctgcgtctctctgcgtcctttcatgcctttgtgtctccctgtgtccctgccacagacagcgaggtcccgggggggtccctgcgtccctgccacagatagcgaggtcccgggggggtccctgcgtccctgccacagatagcgaggtcccggggggggggggtccctgcgtccctgccacagatagcgaggtcctggggggatgcctgtgtgcctgccacagatagcgaggtccccgggggggtgcctgtgtccctgccacagacagcgaggtcccaggggggtgcctgtgtccctgccacaggtagcgaggtcccggggggggtgcctgtgtctctgccacagctagcgaggtcccggggggcgggggtgcctgtgtccctgccacagatagcgaggtcccggggggtctcc

SEQ ID NO: 47896 - DNA, 1053 bp, Homo sapiens
acttcaaccatctgataaatctaataataagttacaatcgaggccgggcacagtggtctgtaatcccagcaccgtgggaggctgaggtggaaggattgcttgagcctgggaggtggaggctgcagtgagccatgacagtgccactccactccggcctgggcaagacagcaagaccctgtctcaaaaaaaaaaaaaaaaaaagccaggcgaagtggctcacgcctgtaatcccagcactttgggaggcctaggcaggcggatcacaagatcaggagatcgagaccatcccggctaacatggtgaaaccctgtctctactaaaaaatacaaaaaattagctgggcatggcggcgggcacctgtagtcccagctactcaggaggcagagccaggagaatggcgtgaacccaggaggcggagcttatagtgagccaagatggcgccactgcactccagcctgggcgacagagcgagactccctctcaaaaaacaacagcaatgcctgaccctcagggtctagccagcgctgggctgtgactttgtgacttgcagctggtgaactggtctcctgctcagtgcccaactcagggcacacggttaatgtcgagcccacacagaggccggggcccagggactgggtcctcagcttcctggggtcactggggagcccacccacctggagctgccacctcggtgggccttgggggacggggcgctccctcctggtgacaggcagcctctaggtctgcagggacccagccccatcctaaggcagccgacttgtggccagtgccctgaattcaacacccacagaccacctgctgggtgctggccgggcacacaggccacacccttggtgtgggctctgcgaggacagtaccggcctccagcacctgaccgccccagcccacccagcctgtgcttctcttgcagaggccccaggtggagcaagttggcaaacaggctcctctctccccaggtatgggcgtcctcagcggcggggtccccgggtgaaggaggaagctgctggtgcatgggtgccggctgccctccac

SEQ ID NO: 47897 - DNA, 1028 bp, Homo sapiens
gaggctggaagaggggggaggtcaggagcacattcgtggtgcaggggacatggcactgatgttcacccatggggacgatggtggaaagggatgaggcattggctgcagaggagaggggatgacgagctgtgtcggacagggcggtgcaccttggcagtagccaatgtgaaggttctagaaaggctagtaggtgtgttggtgggagtttggggaagttcttttttttctggggtgaaagggtccccctctgtctcccaggctttagtgcggtggtgcaaatacggctcactgcagcctagacctcctggggtcaagcaattctcctgccttggcctcccaaagcattgggattagaggcgtatgacactgtgccgggccaagagagtttattcagatcatctttcttttgttactttcactttctcataaataactgaaagaagtcaattggccctttaaactctatgtcaggaaagtcagatcacagcatgcactttctgtccgccacgttccacaggcaatggtcttgctggaaggtaaatagtctacactttctccagcctgcaatagcaactttctcatgacccctcctgctgcatggttccaaagtcaacgccatatttaaaaatttttggggccaggcgcagtgtttcacacctgttatcccagcactttgggaggctgagatgggcagatcacctgaggtcaggtgttcgagaccagcttgacccacatggagaaaccccatctctactaaaaaaaatacaaaattgtcagggcatggtggctcacgcctgtaatcccagcactttgggaggccgagatggggggatcacaaggtcaagagatcgagaccatcctgactgacatggtaaaaccccatctcaactaaaaataaaaaaaaaaattagctgggcgtggtggcacatgcctgcagtcccagctactcaggaggctgaggcaggagaattacttgaacccgggaggtagaggttgcagtgagctgagattgtgccactgctctccag

SEQ ID NO: 47898 - DNA, 1020 bp, Homo sapiens
gtgttggcctggcgcagtggctcatgcctgtaatctcagcactttgggaggctggggcaggtggatcacaaggtcaggagtttgagaccagcctggccaatatggtgaaatcccgtctctactaaaggtacaaaaattagctgggcatggtggtgggtgcctgtagtcccagctactcgggaggctgaggcgggagaatctcttgaacctgggaggcagaggttgcagtgagctgagagtgcatcactgcactgcagcctgggtgagacagtgagactctgtctcaaaataaaaaaataaaaaaaaaaagaaggccggtcacagtggctcacacctgtaatcccagcactttgggaggctgaggtgggcagatcacaagatcaggagagcgagaccatcctggctaacatggtgaaaccccatctctactaaaaatacaaaaaattagccaggtgtggtggcaggcgcctgtagtcccagctacttgggaggctggggcaggagaatggcgtgaacccgggaggtggagcttgcagtgagcagagatcatgccactgcactccagcctgggcgacagagcgagactccgtctaaaaaaaaaaaaaaaaaaaaaaaaaattatggcagtatctcacttctgagcaccaatttctgttccaattatatctattgcttcataacaaaccaccccaggccaggcgcggtgactcacgcctgtaatcccagcactttgggaggctgaggtgggcggatcacctgaggtcaggagttcaagaccagcctggccaacatggcaaaaccccgtctctactaaaaatatgaaaattagctgggcatggtcatgggtgcctgtagtcccagctactggagaggctgaggcaggagaattgcttgaacccaggaggtggagattggagtgagccgagatcgcaccacttcactccagccagggcgacagagtgagactgtctcaaaaataataataataataataataataataataataataataaacca

SEQ ID NO: 47899 - DNA, 2414 bp, Homo sapiens
tcggcggcgccggggaggtccgggcggcgccgcccttccgcgtctgcccttcctgccctctcgccgaggggcggcggggtcccggcggggcctgaagcgggtccactgtggaggacgccctgagcgcgggcgcacgcaggcctgcgaccctccccgtccgcgctcgcacctgctgggctccttcccgcaccctggctcccggcgcaggcgctcccgctgcagagccgctcctggcgcgggcgtgcggtcccggcggggtgcagacacctgctgcggctccctgcgccccctgccacccgccagcaggcctcgccggccccccgccgaggtggacgcctgggcctcggggactgggtatcgggttgctgcagtggccgctggcagggcgccctggaggtgagggccggcccgcgaggtgaggctgcctctgcccggcccttggctgtgagtgccgcgtccctgccggggacttctctaccttggcctcctgtgggaaccacctgggctgcttggcctgtgccacagcccctggacttgccgctggaccttgaccgctgggcccgcgcgtgggtaacagcaccgattttgtgcctgctgagaacccacagtctctgttctgtcctctcagcctcctgggacaggtgatggtgctgtggccctgaccctgcaccgcctgaggctgtggggcctcggaagaagccgggtggtaggtgcttctgtcaggctcctggccccactgggcctcctgggatgaccccacagcctcccttcctctgtcccaaccttgagtttggggtctgggtgggggcaggtgtggccgtggcagggcagagatagcacacacatctcttgggtacaggtgtggtgtgtggtgaggccggctggatcctggttgagggctgtgcaggaccctgtcgtccttcccctggcgtggcctggggtgagcaggccattgcttaccacagggaagggacggccccgcggtgcgtgactggcctgggtgtgcaggctcccctggcctccgggtggacgtggtgggtgggttgaatgctcacgcctgtaatcccagcactttgggcagctggcccaagagccgagggagcactggctgatggtcctacctcacagaggctggtctgaatgagggagaaaaaggagggtcgtgagctaaggagtaggagatgggccctgatgggccagagagcacatgattcaggctgctgcaagtgaggtgggagggtgtaccggggcccccgggggtttcccccagccctgcctgggatgggaacagaaggaccatggtttcttttcctcattcagaggatgcttgtcaatcctgctaggagccagtagggaggccctcagcccccaggaggacagcagccctgcctgggccccagagcttgctcacttactctgccgatgagtgtcggtgacagtcagcacccagccgtgaggacaccggctgtctaaagggctgacgcggagggaggcctgggagggagcagttttctggagctcaggctggcccagtccagggctggggttcaggcaggaccacttcttgttctgctgttactgggatgggcgaccagggccgacagtggttctcggagcactcatggtgggcccgatgcaattctctccacgtgccacgggccagcctcagttaaccctcagcgccctggcaagtggcacggttgttactctcatgatacagatttggaaacaggactgggggagtggcttacaggtcacagcttctgtggcaggcgtgagtcctttgggatgaggatgaggagtgggtgggtcttcatggtccaagtgcaggtggtgcaagggaggggctgctgaacaggtgggagccccagctggagaagaaagttccagtggtcacttgagaacgcagcccagtcatgatcttccttagagtcagagaggcctgcagcctccagcagcttgtccttgcttgtgcatctgaacacaggaaacattttttatttttatttttttaatttattttttcgagacggagtctccctctgtcgcccaggctggagtgtgccggcgcgatctcggctcactgcaagctccgcctccccggttcacgccattctcctgcctcagcctccttaagagctgggactacaggcgcccgccaccacacccggctaatttgtgtatttttagtagagacggggtttcaccgtgttagccaggagggtctggatctcctgacctcgtgatccgcccgcctcggcctcccaaagtgctgggattacaggcgtgagccaccgtgcctggccaggaaacattttttaaacctgcatgggggaggagggacagggcttgcagggcccctgcaaagaggtgcaacgttcaagtccagaaggcggaagaagtcacactctgac

SEQ ID NO: 47900 - DNA, 1033 bp, Homo sapiens
ggccctgactcagccctgcagggagaagaggggctggaggtgcaggtggcctgccactgtctcccccaacccctgcccacctgggtcttgtgctgtgtgtacttctgctgcgtctgtcctcccttgtgaccagcttctgctggacctgattgtccagccatgatcttctgatcatcatggtttctggacacacatctgttggactaaggaatttgtgttcctggccacagaacagtgccacctctgcctcaagcagttcctggtctgggcactcccccagggaggccggagaggactgagccgtctcctgatgcagaaagtcagccccgctgggcagtgctcgcccaggaagtagggccccacccaacggtgtgctgactgtggaacactgtgtctgcctaggcgggtctggccacattcctgcagcatgatggttggcagttagcttcctggagtgtggacgggtccttccctgcctgactgacttgtccacagggcagcaagaagatgcgccccttggtgtgtcccgagtgtctcctgtaggcagctgagctttcgcaggtctggctgggagccaaggttaccaatctggggggtaacccagccatcatctggatgagcgttggggtctttctgctctggattgcagggcagacgtcgttttgtgctggtcaggcccctcgcctgcctgattcccttggagccccccaagacaggagatgggcagatgtcctctgaagtggcatgggctgcttgctcactggccttcccaggaccctgcccaggtggtgctgcttggccccaggtcgaattcctgtgctggcagcaagcaggggcctgggccgtcggctggctggggctcatgcagccatcccctttgcagccatccgggtgacctgcataggttcctgcggggtctccaacaaggctaatgacacagcgtgggtagtggaggagggttacttcaacagttccctgtcgctggcagacaagggtaagtttgggagccagttcccgagtggtgacccctggg

SEQ ID NO: 47901 - DNA, 1047 bp, Homo sapiens
cagcgatctgcctgcctccgcctccctaagtgctaggattacagacatgagccattgtgcccgtcctgttgtttcctgtttagctgaggaggaagggttagataacttggccagtcggttgtaggaccagcactagtacagtgttgggcacgtagtaggtgtttaatacatgaccgatgagcaaatggctccagatgtctctggttccataggcagccttgaatagggctttacacacctgatgagaatgacagcctgtgttgactgagccctgacttgtgtccaaccctgccatagtgccagtgccttgcatgaattcaataatttgagcctagcagcaaccttaagaggtaggtactgttacctccccgtttataaatgagaagacaggcgcagtgaggcccaagattgaagagcttgtggccaagaagatggagttgcaggtggtttggccatagagctgatgcttgctaaatgtgttatatctgtgatggtcattttaggttaataaaagctctgtttttagattgataattctaagggtttatcatcaaggtgtatgagaaggtgagggagcccctgtgtgtagcgcagcaactctggccttctggacagtaggtaggcatgtgatcactgttgtcactaaacctgggaaatgattcctgggtcagggttcattaattgccaaatgattaaagtaataaagctgacactggaaacttatctaacttcatttcttttccttgatttacaaagatagtcaatacattttcctaccaaaaagaactggccagccgtggtggctcatgcctgtaatcctagcagtttaggaagccgaggtgggcggatcacttgaggtcaggagttcgagaccagtctggccaacatggttgaaaccctgtctctactgaaaatacaaaaattatctgggcatagtggtgtgtgcctgtaattgcagcctgggcaacggagtgagagactgtctcaggaaaaaaaaaagaaaaaaaactactgaggtagttgaatatatcctccattccccatttg

SEQ ID NO: 47902 - DNA, 1021 bp, Homo sapiens
tctgatcacagtatatttaagatgctgttttgagcactttctgtttatgcagtgcaattctaggtatttgtaagaggacatacaaagttttgagattgatccctgatgttacaaaatttaataatagaacagagcaaatattactgagtaggaaatgagagtcagttaaaagtaaacaagaagaggctgctggatggccacaattgctgcggccacatgtgtggggaaaagttccttgaggaagatgagttagtctaggtcttttttttcctttaacagcttcttgtccaacacatagtctaggtcttaaaggatgtgagacatgaattggcatgagaaggtggacaaagtgtacattaacaaaaattaggcattttagcaaatttagaaatcaaacctagaaacctcaggatgccatatatttgtcatctgtttttttcctgatcctcgtgagtgtatgtgtttttatttaaaattggtggtaatcagtgattatgtgccgttgtacttcctctgtcccgtattgtctgacgtgcattcgtatcttcagtgtttttggtagctgcatggtgtgtgacatagaaaagtcccagtttcctcgactgtgatttgggtgaggtctgtatcctttggtgcacagtggaattacaaggtcagaaggggatagtggcatgagatgaagctggagaggcagggcaaggttatccagggccttgttaccatggtaacaagttgggaagtttcataaccactgtagacagtccttgaagattttaggcatggaatgatactttaaaaagatgaccctggctgctgtgtggagagcggaagtagggggccagtgagcaggcttggcttgagtggtatgggttagtcatgatataggtgtttagatttaattttttgagcatataggacagttacatggttcaaaattgaaaaagtatggccgtgtgtggtggcttatgcctgtaatcccaccactttgggaggccgaggcgggtggattgatcacctgacg

SEQ ID NO: 47903 - DNA, 3148 bp, Homo sapiens
tgttgcccaggttggtcttaaactcctgggctcgagcagtcctcccgcctcagcctcccgagtagctgggattacagatgcgtgccaccacacctaggtaatttttgtatttttggtagagacagggtttcacaatgttacccaggctggtctcgagctcttggactcaagccatctgcctgccttggcctcctacggtgctgggattacaggcgtgagccactgtgcccagcctagaccactttttagggattacaggcgtgagccactgtgcccggcctagaccacttcttcaagcatttaatgactgttcctttgatcatattcctgggtatagcatcacacggggcaggttgctaacctaggtgggctgatggagctgtggagaccatgctaatgattctcgtccttgcaataagggcagtaggagggtttcaaggcagggagtgacctcatcaggtttgcgtgttaggctctggcttccttcctggtcttcctgctgctgtgtgaagaacggattgtagacggatggcagtggaggcagcaaacgcagtcctcagggagtgggtggtcaccggttatgtggcagatgaggagggcacaaggatgacttgtgggactaggccggagccaaatgctgggttctctgcttgaacggaagggtgggtggccgtgccattcacccggacagggaaggcatgctcaggtcagctctggggtggtttattccaggggtggcaaactctttctgagcaggctggatagtatttcagactcatgcaccaagaagcaaaatcaaggataactccacaaatttttgttgacaaagatcaaaatataattgactactttttttttttttgtaatacagatctactgattagaagaacagaatttttggggggataacattttgcttaattggggttcaatgttaatgttccccatcataaaaattactggagctgttcatctgttaagtgcttactgtgacacagttttctgtttcatctttgaaaatgtcttcacaccgatagctgttgccatattccagtatcagtccaggagcagatgatttatttttattgagatgtaattcatttactataaaattcacattttaaaatgtgcacctcagtggggttctttggtatgtctggagtggtccaaccattaccactacttccagatcattccgtcattaccactacttccagatcattccgtcaccccaaaaagaaacctcatacccattagcaggacttccctaatcctccctccccgacccccgacactgctctacttttttgcaaatattttttctcattctgtgggctgtcttttcactttctaatttttttttttttttttgagacagtctcgctcttgtcgcctaggctggagtgcaatctagtctcactgcaacctccgcctcccgggttcaagcgattcccctgcctcagcctcctgagaagctgggattacaggtgcgcaccagcacgccggcttatttttgtatttttagtagagtcagggtttcaccatgttgttcaggctggtcttgaactcctgacttcaagtgatccacctgcctcggcctctcaaagtgctgggattataggcatgagccactgtgcccggcctaatttttattttcttgatgccttcctttgaagcacagatgtttttaatttttgatgaaatccaccttcttgttttccagttggtttctttgcttttgttgtcgtgtctgattgcccaatccaaaccagggagtttatgtttccttggaaaatttgcatagttttagctcttacatttaagtctttgatccgttttgacttaatttttgtatatgatgttaggtaggatccaggcttcattcttttcatgtacagttggctcagcagcgtttgttgaaaagaccatgctttccccattgaattgcctggccatcgtttttgaaaatcagttgaacataaatgtgatggttaatttctgggttctcagttctattccgttgatgtatatgtctgtcctaatgcgagcattgttgcagcagtgtaataagttttgtaatgaggaaatgtgagtccttcaactttgtctttttcatgattgggtcccttgcattttctttcatttcttttcttttcttttcttttcttttttttcaagattgggtcccttgcttgcttgcttgcttgctttttctttcttttctttctttcttctttctttttttttttttttgacagagtctctctctatcgcccaggctggagtgccgtggtgcgatctcagctcactgcaacctctgccttccaggttcacgccattctcctgcctcagcttcccgagtagctgggactacaggcgcccccaccatgcccagctaatttttttttttttttttttttttttgtatttttagtagagatggggtttcaccatattagccaggatggtctcgatctcctgacctcgtgatccgccggcctcggcctcccaaagtgctgggattacaggtgtgagccactgcgcccggctgtcacttggattttcgtatgagttttaggatcttgttgtcaatatctgcaaaaaagcctttcaggatcttgaaagggattgtgttgaatatgtagatcagtttaggatatcgccatcttaatagcaagtcttccaattggggaacaccggatgcttgtccatttatttaggtcttctattttattttattttatttatttattttgagacagagtcttgcactgtcacctgggctggagtgcagtggcgtgatctcgggtcactgcaacctccgcctcctgaattcaagccattctcctgcctaagcctctcgactagctaggattacaggcacccatcgccacgcccagctaattttttttttttaatgtatttttggtagagacggagtttcaccatgttggacaggctggtcttgaacttctgacctcgtgattcgccctccttggcctcccaaagtgttgggattacaggcatgaaccactgcgctcggccttcagttttctttaacattttcagagctgggcgcggtggctcacgcctgtaatcccagcactttgggaggccgaggtgggtggatcacgaggtcaggagatcg

SEQ ID NO: 47904 - DNA, 1055 bp, Homo sapiens
ggccccaaattttttaatctattcccccagtctctacttttcatgtgggacaggtaatgcgtttcatctaatgtaattactgaaaggtagggtttatacttgtcgattttgtatttgctttctgcgtcttctgtcttttttgttactttctgcctcagttagtttttgttcttcatggagatggagtttcactatgttgcccaggctggagcgcagtgagtattcataggcatgatcatagtgcaccgtggccttgaactcccgggctcacaggatcctcccacctcagcctcctgagtagctgggactgcaggcgtaccacaacgcctgactcattgctttcttcttttgtgttagatattttctagtgtataccattttaattcccttgctgtttatttgactgtattttttatttgttttcttggttgtcctggggattacaatttagtatattaatttttgataatgtagtttgtattaatactatattacaatactatatgaaatatttatttgggcatagcttaatttcttttgcccttcttgtactgttattgtcatacaaattacattacactgtgtgcccatctacgcagatttatagttgctgctttacgcaattgtctttcaaatcatataggagaaaaaacaaattataaattaacaaatacatttatactgtcttatgtagctgcttttatactttacctgtgtagctgcttttactggcgctcttgattgcattcccctcccctcccctcttgacagggtctcgctctgtcacccaggtgggagtacagtggcacaatcatagcactgcagccttgacctcctgggctaaagagatcctcctgcctcagcctcccgagtagttgggactatgggtgcgtgccactattccctgctgatttttaattttttttttgtagagatggggtctcactgtgttgcccaggctggtctccaactcctggtcttagaagatccctcctacttgagtcttccaaggtgttgcggttgcaggcatgagccaccgtgcctggccttggtgc

SEQ ID NO: 47905 - DNA, 1056 bp, Homo sapiens
agacaaacaattacacactttggtaattgctattaaaagagataaacagggtgtgatagaagcagcgaagaggggcctcctgtaggtggttaaaggaaggctgtctgtgtttccatctctgctgcagactgatacacaagtgtctttttcactcgattccaaatggaatcttagagaagggttggcttttgtacttgcagcgctgagtggagaggtggctgtgatctccagaaacgtggctgcagccccacgtgggcctcagacccttgaaacatggccatatcgaactgagatgtgctatgtgaaatgcacactagatttcagaggcttagtacgatagttcacactcttttggtactaattattttatattggttacatgttgataatgttttggatctatactgagttaaaggcaatttattaaaattagttacttctatttttacttttttttttgagacagagtcttgctctgttgcccaggctggagtgcaatggtgtgatctcagctcactgcagcctctgtctcccggattcaagcagttctcctgcctcagcctcccgcgtagctgggatgacaggtgcccaccaccacacccagctaactttttgtattttaaatagggatgggatttctccatgttggccaggctggtcttgatctcctggcctcaggtgatccgcctgcctcggcctcccaaagtgttgggattataggtgtgagccactgtgcctggcctatttttactttttaaatgtagatgctagaaatttaaaatgatgtctgtggcatttcctgtctttctgtgggacagtggtacctggcctgaggaacatttcaagtttgtgctgcgggcaagaatcctgtgaccacggggagaggacgagggactcattctctggacaatgggctggaaagtaagagggctgaatgggagccccgaggagtgctcccgttttgtgggagagaggagctagtcagcaggtggaaagcagccttggctgcccaaccctggagcctgggggaggcccccgagcgtgtgggctggggtg

SEQ ID NO: 47906 - DNA, 1100 bp, Homo sapiens
gctttaacattatctcctactgtctttgaaaacacggctattcatgttcagcttcttccttacctttctgtaccttaaattccagtccctcaggtttccttctgcctgtgctgtttccagtccccacgtggctgagcccgctgcagcaggctttggtctccactactcctcagatgcccttttggttatggtcaccattgacctagacattgtcattggttagttctcagccttcgtcttactggttctttcaccagcatttgttatcataattcaagcaaaaaaaacctgggattagttgtctccgtttggcttctagaacactgcactcttctggtttcctgccgcctccttcttcccagtcctgtttggaggacccgcctcttaagcctgacttctaaatattgacgtgcccgaagtcccaggctggtcctcgtgttgtgtgtgtccttattccctgagctatccagtcctctgttgaccccaggctcgtgccccaggctgacctctttgctgtggctccaggttgactccatgttgactgcatggaaaactgataggcaccttctgcccagcatgaaacgcagctctcttggtctgcctctcgccccgcagcgctagacaccatctgtagaatggcatttcccaggagacgctgtcggctctacctttatgacacagcttctgcactccatggctgtaatggggtcccagcttcttctccctgctttttggtggcccctgtgctctctgctcaggggcagcagtctttgccaggcgttgctgctctgcacgcagacttcctgtgccttctgggctctgctcttgccttttttttttttttttttgagatggagtcttgctttgtcacccaggctggagtgcagtggtgcaatcttggcttactgaaacctccgcctcccaggttccagtgattctcctgtctcagccttccgagtagctggcattacacgcgtgcgccaccatgcccagctaatttttttgtatttttagtagagacggggtttcaccgtgttgcccaggctggtctcgaactcctgagctcaggcaatccacccgcctcggcctcccaaggtgtt

SEQ ID NO: 47907 - DNA, 1489 bp, Homo sapiens
agagggaagtcccttatcagatataggaccccccgcttttttttttttttttttttgagacagttgcactctgttgcctatgttggagtgcagtggggtgatcacaactcactgcaaccttgacctcctggacccaagtgatcctcccaattcagccccccaagtagccagggccacaggcacatgtcaccacacctggctaatttttgttttttaattttttgtgcagactgtgttgatcaggctggttgaactcctgggctcaagcaatcttcccgctgccatatgaatatgaatatgtgcacacccgtggttccagctactcaggaggctgaggtgggaggatcacgagcctgggagttcgaggctgcggtgagctgtgattgcaccactgcactccagcctgggtaggtgacagagtgagaccctatctcaaacaaaacaaaacaaaaccaccagtgttgacgatgatatggaaaaactggaaccctcccaaagtgccgggattacaggtgtgagccactgcacccaggcagatgtaggacttgtaaatattttttcccattttgtgggttgtgttttcactttcttgatagtatcctttgaagcacaaacatttttaattttgataaagtctaatttatccctttgttctttgttgcttgtgccttttgtgtcctattttagaaacacttttgaaattcaagattatgaagatttgtgcctgttttcttctatgagttttacagttttagctcttttaattagatctttgatctattttgaattatagtcacaggccacataatgatgtctctgtcagtgatggacaacatataagatgatggtccagtaagattataatggagctggccaggtgcggtggctcacgcttgtaatcccatcgctgtgggagggaggccgaggcaggcggatcacttgaggtcaggaattcaagaccagcctggctaacatggtgaaactctgactctaccaaaaataaaaatacaaaaaattagctgggcctgttggcacacacttataatcccagctacttgggaggctgaggcaggagaaatgcttgaacctgggaagtggaagttgcagtgagccgagattgtgtcactgcactccagcctgagtgacagcgagacgccgtctcaagaaaagaaaaaaaaagattgtagtggagccgaaaagttcctattgcccaggacatgctaaagctctagcaataggcattatgtgtcctgctcaggtaaacaaacctactctgctatcagttgtctaaaagtctagcacatacagttatgtgcagtacctaatgcttgataatgataataaactcctatgttactggtgtatgtagttactattctgtactatacttttttaccattattgtagagtgtactcctacttatttaaaaaaaagttaactgtaaaacagtctcaggcaggcccttcaggaggagtctagaagacactg

SEQ ID NO: 47908 - DNA, 1226 bp, Homo sapiens
aggctggagtgcaatggtgccatcttggctcactgcaacctctgtctcccaggttcaagcgattctcctgcctcagcctcccgagtagctgggattacaggtgtgtgccaccacgcctgggtcatttttgtatttttagtagagacagggtttcaccattttggccaggctggtcttgaactcttggccttaagtgatttgcctgcctcagcctcccaaagtgctgggattacaggtgtgagccaccgtgcctggccacccttttacttttgtctgttcatcctgcaagtgcaaggtacctgctccatgctgtggtctggggggtgtagcagtgaacaaaacagacggaacttgtgtgttatggccggtgtagacaaggaagggcacatgggcagtggtgtggggagcgtgtggctgcagtcttgaggaagcagcaggagcaaggcgtggggcagccagctcagctgaagaggggtgattgtctcataggcttctcctagagggaccactgggagattctgagcagaggagtggcggaatgtgacttctgttttaacagtgtctttctcgtggcagtgttgagagttggctgcaggggtgcagcaggtgaggtgagaggctgtcgcgctcgttaggatgagagggtggtggtttgagtggaagtcggcctcccagggtgttgggattgtaggtgggagccagtgcacctggttgcttttttttttttttaataaaaattttttattttcaatttttgtgggtacatagtaggtgtatttatttatggggtacatgagatgttttgatacaagcatacagtgcataacaatcacaccagggtaactggggtgtccatcacctcaagcgttgatcctgttttacagaccatgcagttctactcttgtagttattttaagatgtgcaatagaccattgttgactctggtcactttgctgtgctatcaagtactagttcttactctatgttttgtgcccatgaaccatttctacccccactccccacctccactccactgcccttcccagcctctgcaaaccatccttctactttttttttttaatactgcttctacaagtgatagcccctagacgtccttctactctaccatctccatcagttcagtcattttaatttttagctcccccacatagatgagagcatgtgaagtttgtctttctgtgcccagctgatttcacttaacacag

SEQ ID NO: 47909 - DNA, 2066 bp, Homo sapiens
ggaggatgacttgagcctgggaggcaagcagaagttgcagtgagctgagattgcaccactgccctctagcctgggttacagagccagaccctgtctcaaaaaaattttttcctcatctttcttcatgtgtataatcatttttcctagctttaggtattgagcaagccctcctttcttcgtcagcctgtcataccgtatcccacagttcaaatgtgtgggggtttctgttttgtttctgtttttttagagacaggctctcactctcttggccagactggagtgcagtggcgttctggatatttttggccacttattcttcaatattaactctagaatcataaaatttcatgaacaatcctgttcggatattaattggaattgcactgaatctatggatcaattttgtgtgaatccacatcttcacaatatatctgactatttgtgagcacagtatatttctctcttcatttagtttttaagaaatatttctatgaaattttacaatttttcctgtagaggtcttgccatcttttgcaggtttctttctagataactgatgattctctgatgccatcgtaagtgatggcttctctttaattacagcagctaattgtttactgctgttgtagaataaccacacagctgactactgagtatttaacctttcctaccatcatcttgctaagctctactattatttctaatactttgtagaacatataatagcagttttatttcttcctttctaatcccaggcctcagattccttgtctaattgtgctggttaggacacgatatgatgtcgaaaagaaacaatgctagtggatgtttttattcttggttttgtctatttttatgacttttttaaatttttagtttgaaataattttagacttacaaaaaaagttgcaaaaataatacatagaattcccataggtccttttacccagataccccaagtgttaacattttaccacatttgctttatcattctatatatctatccatctctctagtttctgtttgcttttcatgattattcttgattttaaagggaatgtttccaatattttcctatttaggatggtgtttatttttttaatacttgaaaactatttttttcctagactgctcaacagaactatacttttttattggagtaaggaaatgctcttccattcctaatttactgagttgtaaaaatcatacttgagtattgaattttaccccaggtagtttttgtacatcttttttttttttttttttgagatggagtcttgctctgttgacaggctggagtgcagtggcgcaatctcggctcactgcaacctccaccgcctgagttccagcaattctcctgcctcagcctcccgagtagctgggactacaggtgcgcaccaccatgcctggctaatttttgtatttttactagaggcagggtttcaccatattggccaggccggtctcaaactcctgacttcaggtgatccacccacctctgcctcccaattaaaggcgtgagccactgcacccggctgtttttctacatctttaaagaaatctattttttttctcttttttgagatggagtttccctcttgttgcccaggccggagtgcaatgctgcaatctcggctcactgcagccgccgcctcctgagttcaagtgattctgctgcctcagcctcccaggtagctgggattacacgcatgcgccaccatgcccagctaattttatatttttagtagagacgaggtttcaccatgttggtcaggctggtctcgaactcctgacttcaggtgatctgcccacctcggcctcccaaagtgctgggattacaggcatgagccactgcgcctggccaagaaatctattaatggggtgagttacccaacaatatctgctgatagtatatatatattttttacacattgttgaattcaaattgctgatatttttgtttagatattttttttccagacagggtttcactctgtcacccaggctggagtacagtgttgagatcttggctcactgcaacctctgcctgttgggtttaagtgatc

SEQ ID NO: 47910 - DNA, 1043 bp, Homo sapiens
acactgatactgtactagaaagcgtgggggagttatagaatagcatttatagagaaggattggtgttatttactttcatgtgaccttaaaaatagaaaataatatttgtgcttttattttgcagtttgcctggaacctgaatacactattttaaaaaatattccctatttttatagaaaaaggacttcaaatatttattgttttgtattaagagctacaaacaacttggtcttgattggagagctggcataggtgtataagggcctctccctgtaagaaatttggagctggggtgggcataggaggtgatgtttaggagcagcctgagtgtggggagactgctgtgctcgaacctgcgtcgtgcaggtgcgtcctggagctactccttgtggcagaagcattgccctgagacccagccctggtatgcttggcactgggacaggagctccggtgggaggtgcgcattgcgagctggtgttttctgtttgctttcctacccactgtcatgttgtgggctcttggccccagaggtaaaatgtctctgtgagttgagttccttgtgagagggctggtccccagattccatgtctaggtttttgttagtattttttcaacagagctaatcctgagaggccctacgagcagtgattgctttgtgggatgagctgtgttgatggtttctgtggagggacccttcacgttttagggtgaaaacaataaatgtctcgttaaatggtttccatctgagaacactgattgttttaaaatggttgtgaatgcgagggtttaagcagcttccgaggaggcctggaggtgcctgggcggccgcgtgcagctctggaatcctgccgctggggcagcctccatttcgtgagatggctctggagcatgcccagtgcgtggagctttcagagggagccgccgagctgggctactgtgatttctctgcagttggccgcagtcaacaattgcactaagacaggaggaaaaaagtgatggggtacaagcaagaaacgtggtatttggtactttttttcttttgc

SEQ ID NO: 47911 - DNA, 1013 bp, Homo sapiens
agaatgaaaagtttgggaattgttgttttaccgtaaaccaaagcgcctggcgcagtactgcagtgaactaaccaaccaaccaaccagtttctgcctctcgtagagctgacattctgattggggataagtttcacatttttgtgtcatatccttcaaaatagtcaactccttaggtttaatgtctttttatcaacatggagattttgaatgaaattcagccatgagtgtgtgtttgttttcccatgctatctcaatcgtattacagagcagtgttgtggaaacatttaaaaaacaatctctgacatgagtaggaatgtggtcttctaccaggaactttaccgattgcagagaatttattaatattactactataccttgtggttttctgcatgcaggtttaagcctgcatttacacttctaaccacaaggtggtgcttttgttctaggtccgaaggctgacaccgggctggatggagcttgagaaccagttttatatgggttgcttttttgccaatttaagatgattctgctttgaagtgcttagcaaagaaccttaccttccttttgcatcagggttgtctcatcttagagtgacatcctagagtgtgtaggaacctcccagcaggtgtttattgagcaccccttacttgtgtgctagtctgggtgcctggtggtgctcagagctggcctggaccaagtccccaggggtttgtggtccctcaccattctcgactgctgcttttatatttgttgtatttctgataggaccgttgctcacgttgctcttctgatctgaaaaaagaaataggcttctcattttttcatggtgtgtaagttctgtacagccttatttttatgtctcatgttgttctgaagaggagatgggtgtcctgggaggcagggcagctgtgtccagctgcagtgtccctggtggctgagctgaaggcagtgtgaagctccggcctcgaggatgtgccagggagtgtgtggaggtcatgtctgtgtccctccct

SEQ ID NO: 47912 - DNA, 1050 bp, Homo sapiens
agaatatatcttgtttcttgtttattttattttattttttttgagacagagtcttgctgtgtcgcccaggctggagtgcagtggcgcgatctcggctcactgcaacctctgcctcccgggttcaagtgattctcctgccttagcctcccaagtagctgggattacaggcgtgtgccaccacacccagccctctcctttaaacattcccgtgttggtggtcattgtgatcatcacttgtgtatgttgctgttacaaattgcactgctgctttaaacagcatcatatattcttccacatgtacatgtccaagagtgtttctagataagcaccatgaagttaaggtgctgggtcatacagagaggactcatttaaacatgttttaaaattatgacaacatatacataacataaaattcaccatcttaaccatttttaagtataaagctcagtattgttaagtatattcacattgtgctgctgttaccaccatccagctccagaactttttcatcatttcaagctgaaactctgtctccattaaatgccaagtctccattcctccctcccctcagctcttggcacccacctttctatttcctgtctctaagacttggactatctagggaccttacacaagtggaccatacagtatttatcttttgtgcttggctcatttctcatagcataatgtccttaaggttcatctgtgttataggatgtgtctgaatttccttcctttttaaggctgaatagtatatatgtaattatatatatatatataaaatatatttttttttcttaaaattttttttttgtagagacagagtttctctgtgttgcctagtctggtctcgaattcctgagctcaagtgatctgcccgcctcagcctcccaaagtgctgagattacaggcttgagccaccgcgcccagccgtaatgttctgttgtatgaatggactacattttgtttgtccattagtggatgtccgttgatggacacttgggttgcttccaccccttggctattgcaagcaatgctgttgtgaacatg

SEQ ID NO: 47913 - DNA, 1032 bp, Homo sapiens
attttcatcttaatttgctccatattaaactcagggaaggagtagatgttttccagtttcacttgggcgggtagaggctgtaagtctccacagggctgtgctctgagccatgtgccagtcagcagcccaaccatggtggagacgcgcctagcacacaggcaggagctgttagcaggaggctggcgagcaggtgatcaggcgcgaggcctcggggtgcccttgacccggcgaatctcctggaaggcaggccatcagctcggcaggcccaggaatttgatgttgcaggtaaaccagattgtcagaattgtactctcggtcttgaaggagatggtagataaactagagcatcagcatattagtggcggtaagaacggcaagtagccgtttccagcttgactgcccttagagcacataccctctgacctcacactcaccagttatgtcaaggcacccgttctggtcatggctactttttggttttggacctgaaagactctaaacagacaggttttggctgatgggaatttggagtttttggggtttttgcaggcaggtgctcacaccctgggcacctggattaccggccgcccggccctgtgtgcctcccctcggcacgtgtttcttctgtaaggagcacttagactgctcacgttcctggtttgctgatcttctctgttggtccagttccctgagggtacagactacagccgttgagcctaggccttggtggcaggtgagccccagagcttggattgctgtgagatctgtgtgtcgggcctgtgctgggagcatggacggagccctggagctggggtttgctctgacccctgctggcgaggggaagaaggtcaggacaaagagcattgctttccttgtctcccgccagggactgcactgccctgaaactcggtggctgaaacaacaatcatcatttgttatccctttgaggggacaggaattcagacggcacagaggagatgactttattttggtcaatgagtctcagctggaagactcgaacatgggggtggt

SEQ ID NO: 47914 - DNA, 1051 bp, Homo sapiens
tacagctccttttttgtagtttgactttttgagtaaaatgtgattgcatattctggtccaaagggaggatggcactgttgtgagggcagcgtgtgagggcggcgtggctcgcggaggcctcactccccactgttgtgagggcagcgtgtgagggcggtgtggctcgcggaggcctcaatccccactgtcgtgagggcagcgtgtgagggcggcgtggctcgcggaggcctcactccctggctttcactccagcctcctggtagcatgcagagacacagtgtggaaacggaggccactgtcacaagcgctgaggaggatcattattactggtttgttgacaaaacgtggacgcattttgtcttatccagcatgttgtagaaaagcagggattgccgtggaaactccacactttgactaggaaaagaaatgatcacttctgaggtaactgtgatgtagatgtattattgtagacatggtaaactaccttattaatcttcacctcatggtggtattgactgggcggattgtaaaatgccattgtttgctctgtctttgataaacatgaaggatcaggtgtcatctctttagtgggtgagaaagtctctggaagaccattgaagctgcctaacaccaggtatcgctgaaaggatttttaaagctagtgagcaggttgccaggttgttcaaaggtagagtgggcagggaggtggctggctatccccagggcccagatgcagatgggcaggggtccttcctgccagcctggaaccttaggtgcaccctcagtctgtttcagggtcaggcagggcctaggtttaccagcagccatgaaaccattgagtcttttcttcatgacataccagtggccagtgtcgcagtcaacacagttccattggttctttttcctatctctttaaaatttaaatttataaaattatttaaatatttttatgggcttgtctttgaataattttaacagagattatccaaaatatgtctagtccttatttgtctttgaattttaggaatcttataaagggcagtgtctcagt

SEQ ID NO: 47915 - DNA, 1022 bp, Homo sapiens
aatgcgttcttattgttaagaaactgtcttcaaaaatagaaatacaggagaagtttccttggactgtgttctgaatgccagttcttctgctggaggcgactgtaaccagctggcaggagtaaatctgactgtccagcagctcatggtgaatgttgtaactacgattttttgactttttccaaatgatgtccatttggaaaagcggcctcccactgaacccggctgacggctgttgtttctctctaacaggcagttccggcgaggggggagcctcagcaggattgctgtgtgaaaaccgagctgctgggagaaggtgagggcggtgtgcaccgagggacaggagcagcgcctccctccagactagaaaacctgctgctcttcctctcttattagtccccgtcttctgactttctttgcttcacctaggtttatggtatagtttctaatctatcccattcctaaatagcacagttgcacagacaaacacaaaagctctgccagagaaggaacacatttgtcaaagtatgaaaagcaaaaatcctgtatatccttgtcttaaagtacacccagaaaattaaaagtgagtggccacacaaatgtttatagcagcattgtcacgtcgccgaaaaccggagacactccggtgtcctcagttgataaggaactggataaacagatcgtggtacatccacacagtgggacagcggtcagcagcccagaagagcacacagcatgactgacgccgcgccatggatgaagcttttgtacggtttgttaagtgaaggaggccagacccaaagggccacaagctgcatgactccaattttatggcagacacttggagaacagcagtggttaccaggaggtggagggagtggtgtggaagcaagtgtctgcagagaggcagggtgaggggagttggggcgaggggagtcggcggggctgcacccctctgtaaggcgtggcgcacacatagggttcggatgttcttggagagcctgcaccaccaagagcgcccccag

SEQ ID NO: 47916 - DNA, 1683 bp, Homo sapiens
agcttttgtcactcagcatagttctcttaagatcatccaagttacgtcattagcccgtcccgttctctgctgaggccttggtgttctgtggggtgtggacagccttgtacgtcggcactcacccgctgaaggacactgggcatttttactttagagctgctcggggcatttacgtacacgttttggatgtaagatttacttctgtgggtcaaacacacaggagcataatcactgggttctatggccttcgggtgtttcattgaacgaggaaattgctgaaccacactccagagtggctgcagcctttcacacgcccaccggcgatgttgcagtggccgcctttctcccctcctcgccggcgtcctcgccagcgttagctcttacccactttttatttagcgcttctgttgggtgcgctggtgtttcctcgaggcttcagcgtgcgtatccctgtgactgctgatggggagcatcctctcccagacttctcacactcacccctcccagacttctcacactcaccccctcccagacttctcacactcacccctcccagacttctcacactcacccctcccagacttctcacactcgccccctcccagacttctcacactcacccctcccagacttctcacactcaccccctcccagacttctcacactcacccctcccagacttctcacactcaccccctcccctctcaccccctcccacgcctcaccccctcccacgcctctcaccccctcccacgcctctcaccctctcccacgcctctcaccctctcccacgcctctcaccctctcccacgcctctcaccctctcccacgcctctcaccttctcacacgcctctcaccctctcccacgcctctcaccctctcccacgcctctcaccttctcccacgcctctcatcctctccctctcccacgcctctcaccgtcaccctctcctacatctctcaccctcatcctctcccacgcctctcactcttgttccctccacgcctctcacgctcatccccttgcacattgctttgctgtcggtgtgtcatctttggtgaaatgtctttcagacttctgctcgttttatgattgcattgttttgttagctttgagagttctgtatatgagtgtttgtcagctatgtggtttccagtattttctgctggtctgaagcttctcttctttctctcaaaaggtctttcacagagcaaaggtgtttcattttgatgaagtccggtttatcagttttctcctgtggattgtgctgttggtgttgtgtgtgataactcttcacctagccctagatctcaatttctctaattttttttttttttcagtcttacgtgaactttaaatctgtgatccattttgagttaatgtttgtataaagtctgaggcttgggctgaggttgaatttatttttgcctgtggatggcgccccagtcacagttttaaaactcacgttagaaactgtacatcattcgtctctctgaagttatgcttttattacagtcctacttccaggattttattctcatatatttttattcgtgaggatcttttattgtcatcctattacattcctttagggaaaaaaagcaatttgaaatttttagaaaattctctgaccatgaggcttatttaagtgatcgcttttttctggattgagtaattaaag

SEQ ID NO: 47917 - DNA, 1072 bp, Homo sapiens
aaccccgtctatactaaaaataaaaaaattagccgggcatggtggcgggcgcctgtagtcccagcttcttgggaggctgaggcaggagaatggcgtgaacccgggaggcggaggttgctgtgagccaacatcatgccactgcaccccagcctgggcgacagagcaagactccatctcaaaaaaaaaaaaattttttttaatttaagtattttcagacctccagcaaagttgcaaaattctacgaataagtcctgtgtaccctttattcatttcaccacatggcacaatctcgcccccggcccccccatgtattacttttttttctgagacatgaatgtaagttgtaaacattgtgcccttttatccctgaaaactaatgttatttcctaaaattactgtccctcaacataaagacattctcttagatgactacagcacagacatcccggtgaggaagtataccgcgacgccgctctctaatctcagtgtcctgttccgcatttcccattcccgactgtcttttagggcaaaggacaaataaaatctggttctagagcttcgagcacctagttgttgtgtcttgctagtttcctttaatctgaaccattctcagccttctttgtctttctgaaccgtggtgttttgagtacaggccaggtctttcatagaatgtgtctgatgtgggtttgcccagtgtttcccaggattgtgtgcaggtcgtggagcgacgcaggtgactgacaagtgtccttaggaattgaattgtggtggttttttgtccatcttcaagttactgctcaccagactgcaagcatgtcttgcagggagagaccctaaggtgctgcatgtacctcccatcacatcccaccagggtcttcagcatctgccatggcccacgcttagctagtactgcacggtgggtgccaaatggtggttttctaactccatcatttcctctcttgattatttcagtttctgctgtaaggaggtgcttcactttcctgtccgtccacacagttatctgtccatttactttacaaaaaaaaaaacttaaaaaaaaaatagagatggg

SEQ ID NO: 47918 - DNA, 1024 bp, Homo sapiens
aaggtggagaagagttttattgagcagcagaacagctctcagcggagaggagacccaaagtcagtagctcctactggcagggaggcagtcctgttgtgtggctgagtctgggggtttatgtgggctcagaatggaggaagtgcatgaagtgcatgctgattggtccatgggtaggtctggaaaaaacaccatttgattggctaaaaggcatcaaggaagttctcactccaggttgtggattctgccgggaactggcagcccggttttcaggcttcaggcggcctttggcttgaaggtcaggtttcaccggggacctgctcctatctgcctaggaatttgtctgccattatcacttttatttcttcaactgtcactccattgcctgccattcattgttgcctccctgtgggaggggtgttggagccaggttatcaaagaaaggctgagatttcttgtcacgtctttctgttaatttttaattactgtggcgatgatcacagatggttctgctctttccctcctgctacccccttaagtttaccacaggcaggaaagaagagcagagtcacatgttggtttcaacgtgcattgtactcctgaagtcatagcagagcccgtgtgtggtagcttgttcccatgggcagctgtaattcttagttttagatggagggtggctgtgattctcttcgacctgttctgcaccctccaccctgtagtatcagaaatgaaagatctgtgctgtgcaagaaggttgagaacatgcgtttatgtgacagccccaggctggggatggccgtgctgaatcaggatctcaggcacccagcattgttttaggtgagcattccttctttttacagagtggactggcatctttgttagcagcttgttctgtatctttcccacgtgtagcggttcacaatttaaaaacaatcctcgcagtaccaaaaactgatttcagagggttctagaaagatagtggggcaggaagaccaggaattcatctcctcacctagacaacagttcc

SEQ ID NO: 47919 - DNA, 1966 bp, Homo sapiens
tcttgtttggaaaccactgctccagagcccccagacatttgcttctccctctcagcctcttatcttttaatagagagctggaccgtagctccaggcactgtctttccccttagtcactggattgcagcgcaaggaggatggtgttggggagagggcctaggaggatggtgtctgggtgttgggctgtggagtcacaggggtggacctggcacagagcttgtgtcctaggaagactggcctggcctggcccctgtgctgggaagggaggctgggctcttcctgctccgcgctgcgtcctccctgctgcacatgctgttcacgttggtctgttttgcaaagtgagaggacttctcaagggtagtcattccatgtgcaaagccaaggggactgggaggaggagtcgcttcagagccctgctactgatgatttgtggctttcctgcctccaaggtggggtgataatgtttgctccgtgttttgttgtgaatggaacagatgaacagatgatccaggacgtgtttctgattctctgtgaattgatcgtgagggaaggatgcctgtcactgtgctgatgacctgcgggcagtgggcctgttgtgatggggtttgctggtgattttggtgatcaagttttgtaaactgtctcttacctttgaaaaacatttgaatggtgtttcttttcctttcttgtccccttttgacttttttttttttttttagcttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaaggtaagagacgcatttgagtgagttgccacgtgtgcgtggaaatgcgtttctgtgttcagggcctcgttatcagtaatttgggtgacctcagtccccgggaaggtgccagtgccatgaagctcctctgccataggggcagagtgttcgtgtccaagatcattgtgggggactccaccccgtcctccctgccctcctcaccacagcccacctgtctgccgggctcttctccaggtggcaggggcacctcttcgtgtgtccccgcctccccacaggcccttgcacctcccagtcacccaagactcctcagtgaaagcaagtttgttcatgatgcgcactgatcctgccttggggtatacacctgcccgtgttctagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaaggtatgtgttgctgtcttgggtgacagcacaaggaaagagcatcacaaagttggccgtggttctgaaaattaacagtctggtcacttctagaccctgataaaatcccctgtttacaattggcttagatttttgtattttatttttcttgatttattagattattttcattcaagaagtatttatgtttctgtacatcattcattgaagtaaacctcttttttttttctgtgttttctttctttcttttttttgagacagggtcttgttttcacccacgctgcagtgcagtggcacgatcatagctcactgcactcaacctcctgggctcaatgatcctcccatcccagccccccgagcagctgggaccacaggctcacgccaccatgcctggctaatttttaaatttttttgtggagacggggactcgctttgctgcccaggctggtcttgagctcctttgctcaagtgatcctcccgcctcagtctcccagtgttgggaatacagccatgagccacggcgcccgccc

SEQ ID NO: 47920 - DNA, 1038 bp, Homo sapiens
tgcttccacgagtttcctggtcttattggccagcggatccatcttcagctcgattattgcgtcttagctgcacattgtggaagtaagtgagctgtgaacaggacaaccatccgtgtagcaatgctgggcattattccaagccttttgcgtagggcgctcctccaggtccacggcagcctgtgcagcatcggccgtcgcccaggtgatacaggtgaggcccgtgagaggggccaggtggcgcctccagactcactggcctgctgtgaggaaggcaggaatgggagccttgttccaaaggtcaggcccgaccgctgtgtcggggagcatgggcaacacccgggaggagcgggcagagccctggaacaggccagtcagtttcgcccatggccctcaccctggtgcctgttggcgtggccggggtttctgattcagcaggtctggcctggctgggattttgcttttctaaagtgttccccgtttctcctgatgcttctggtccagggaccacactttgagaaccactggttcgcctcctcttctccttctccgtaggtgttaaacaggatccagtggagtcagatccccgtgtgacacgtgcttccctgtgacttttctctctgtatctccacgtttccggtgcacatgcctttactcagactccgacactggcgttgcttttgtctcatcccagctaggcgacgtctgcgtcagcgcctctcatctgtggcacgtgtgcccagcgggctccctatgtgacggcttttcccacctctgagtgttcatgtcactcgctgcatgttctgccacactcggcccctctgcagagcctctcacttgtttcaaaagaactttccatagtgacaagtgagggcgcagttagcctttggaaccctcgactcggctcctctgtcaccagcgttctctcccacccttctttcttggttttgaactacttactgttttaaaacaaaccccattttactactgaatagcacagtgtgtttctattaagatcaaaaatggaccattgtctcacat

SEQ ID NO: 47921 - DNA, 1056 bp, Homo sapiens
gtcagtacctgtttcagctgctttctgtcctgaaagcacagcacctccctgtggtgggctcctttcttgttctggtccctccttcaggatccggtcagcagtcggtgaatctgtactctgctgtggtgaacccagggtgcccctcccacccatggtgacctcagtggggccaccccagtgcatctgtgtttttcccaccttgttaaaggattccttgttttatctcttttttcccaaccctaactggatcccattgtcatttatttgatatatccttcccagaacatctccttccttacattctcctgccgttctgcctggaccccctaccccgcagctcccttctgtgtttccttcttacacagcacagagccagaatcatacagcattatcgtttttatgattgtaaaaataatgcatgccgattgtaaaataatccagatactacatacatgcatgaataagaaagtaaaatcacttcttattccaaaactgagggaatcattcttagtacttttgtatgttctcctagacttctatgtgtataaccacattgaatttttgaaaataacttgtttttcctttaatgtaaacatttttcaaagtcagtaggtacaagtgccctgcagccgctggtcctgaaccagggagtcactgcagaagcatttggtggtggtggtgtggagggggcattttttcaggatgtacatgccctggttctacgcctttcaggtcttgttccataggtttggggtggggcccagactgtcttttaaaaaagttgcctgggtgattctaatgcagcctcatttgggcatcgagaagtctcttgctggcttcagggtagatcatttatgccacctgggcgtgccctgcagccactcttctgcaggtagacaggttggttgttcctacttttctgttattgcaaaagctgggtccttctagatacatgtttgtgcacttaattatatcttcaagtggagtcttaagaatatgtatttgtaattgattcatgtctccaagttgcttgctgtgaagtttggacagaactca

SEQ ID NO: 47922 - DNA, 1088 bp, Homo sapiens
atttgcttttaaagaaaggtttatttatgttgaccagcagttttaatcattttgtcatggacttcacaggacacctgtgaaggtcacctcactgctccgttgctcaccgtcctctcagacctcctgggaattgaccgatgctcaggcctctgtccccggccttgcttgctcccctagggtgtgtctgccctggtcagccgcctcactgggcctggggcggccatggccaggccacacagaaacacagaaggaacctcagagttagagcagggtggtaaagggaagagcgtgccttgccgagttagttctgacagagggacctgcctgttcaattccgcaggagactagcacactcaagtctcaagtccagaggatggtgctgtgggcgggttccggcgtggctcgaggtggctgtttatgtggaggatggtcatttgtgagtgcttgccagccatcgtgacagtcctgagctggagtctgtggctacatctgaaatcattaataaaactgtgtttgttcacagtggacggaattgaccccaacttcaaaatggagcaccagaataagcgctctccactgcacgccgcggcagaggctggacacgtggacatctgccacatgctggttcaggtgcggcggcacggcgccctcctagggctcttcacctgctctcttttatttttaccaaagtaaaatcataccacgttcgcggttcttccagtgtaagagttccgtagtgctgtgaatcgggcacagagtcagcttttctgcccccgagtcctgcaggtggatcagtgcttcccgctgtttcttccggcatttaccacggcctttgagaagagcatgccgccatttggctgtttcttgatttgctttctttggttttggttttggttcttcacactcatgacgtccctctgggggagccaagcactcgcagaggcacggacgcccctcccccagccccgttgactggctcccattttgtttagatcagatcgtgtgagcattttcaagctgaaccacgtcgtctacagggtatgttgtgtctgtcgttaatcactggcttgtgtttctgttggttgagt

SEQ ID NO: 47923 - DNA, 1244 bp, Homo sapiens
ttcttgtcttttggttctgccttctaggcagcattctcaccttcagcttccagctcctgggggattcttaacatgtgtggtcacattttcaaatcccagtaattcctttctgctcttagatagttcctctttcagtagcctctttttcttcccttatttctctgatggtattatggttattttgaagttttatgctgctgtgttttagtttttcttatctaaaggttttcctcaaatgcccagtgattctcgtttatatttaaagtaaactactgaaaagctggtggtagctcttgcttgccgggggcttgtcagctgtagggtgatctgcaggcctggctgttttgttggggcccccaggccccactgtctgggaaggacctgtcttctcggactgcacctgtctctgcctttcttagggccaagaaggagagagcgacggggcgcaccgtctgctgtgcccacactcacccgctgtccagctgcctcagtctgtcccccgtttccggagtcataactgatggtgttttgttactatttgcctggaatgatttttccctccttttattctgaccttttccctcgtttttggatatatgtattttaaacgtagaacttgatttttataaatttagtctaacagtcttggtattttaataggaacttttagtcctttatttatacctaatgtcttatattgtagttttaatttctagctgtcttagtccattttctctagctataagagaatacttgagaccgggtcatttataaagaaaagaaatttatttctcacagttctgcaggctgggaagcccaaggtcgaggggctgcctttggtgacttatggtgaggacctcgtgctgttcccgaacacagccaggaaccacgccaagaggaagatgctccagcacagccttgctgtggaccaggccgcccacagggagcaggtccattcctgggggctgactccgcctttcagagaggcgtggctccatcttcacagcctcgtagcctcttaaaggcccagcctcaaaacctcattggggcccccagccccggtaaataaattgcattcagaccatagtgccagccttttgaagccaatacttttttggtcgttcgtgcatcttttgaattggttttatttcgattttgccgtttctcttctctctggaagttacagactttccactttttggtcgttcttgcgtcttttgaattggttttattttgattttgcc

SEQ ID NO: 47924 - DNA, 1033 bp, Homo sapiens
gtcttggttgtgtggagtcatctccctccagctccagtcttggtcgtgtggcgtcatctctccctccggctccggtcttggtctcatgtggtgtcatctcccctgggctcccatcttggccgtgtggcctcatctctcccgggctcccgtcttggtcatgtggagtcatctcccctgtgcacagacagagaaatccattgtgcaaaaagtgcttccctggcagccgacctggagtccaccccagcctttcgccggtgctggggacatcagcgttctggctcccaggctggggagtggctccgaggatcggtcacggagcctcctgggtgtccgagctgcctcaagcgccccggggtcttttctgacttgatctgtgtttttgtccctgcggaggagtcgggagctgtgcctccatctgctgcagctctggggtgctgctgccctctctcacctgctgcccttcggtgtcctggtccctcgtgttgcaagatttcatgccgtgtctgcagtttctggagagcactgagcgaggtgccacacgctgccatccgaactcaccacagacactcatgttttcatcggtctgctcttctgtcatctctcattaaaaaaaaatgttgtaaattcctttactgttatctcccccacgcccctaccaagaccacgtagggtccagtcttgattccctaaccccttttcctgaaaaggtactacctccttcccaggctgcatctgccattcggtgacggctggtgacggatggatgggtagtgggctgagaagaggggactaggaagggctattccaggctcagccctgcctcccacagccttgcctctgggtgtaggggaaacagaggcatgactgaccagggccagggccgtgcccagctcggccacggccacacgtggggtagttagtaaacaccatggactcccagcaaggctgctgcctggtgtttcgaggctgctgtggtcgcagacaaccgcctcgccttggctccctggcaacaagctgggggtggaagcgggag

SEQ ID NO: 47925 - DNA, 1291 bp, Homo sapiens
gtgtctctcatccgcatgtgtgagtccatcatctgcatgtgtcattcgtccacgtgtgagtcgtccacgtgtgagtcatctgcatgtctgtcagtcgtccatgtgtcagtccacatgtgtgtcagttgtctacatgtaagggtcagtcatctgcatgtatgagtcagtcatctgcatgtctgtgagtctgtcgtccacatgtatgagttggtcatccatgtcagttgtctgcgtatgtatcagtcatccgcatgtgtgagccagtcgtccacatgtcagagtcagttgtccacatgtgtgtaaagtcagtcgtccagatgtgtgtgtcagctccagggccctctcttttgatgcattgatctgcatatctgcctttaggcaagtactgtcctttcttgactgatgtagctttacagtaggtcttgcaaaatcatttttctcctcccaaacttgatactgctattctcctatattttacacatatatatgttctgaacaccataatagccatgtagttattctgtttaaacagtcagtggtctttttttttttttttaagatggagtcttgctccgtcgcccaggctggaatgcagtggcatgatcttggctcactgtaacctccgcctcccgggttcgagctattctcatgcctcagcctcctgagtagctgggattacaggcacgagccaccacgcctggctaatttttgtatttttagtagagacggggtttcaccatcttggtcaggctggtctcaaactcctgacctcgtgatccactcaccttggcctcccatagtgctgggattacaggtgtgagcgactgtgcccggcctggttttttctttttttttttggagacagtctcaccctgtcacccaggctggagtgcagtggtgcgatagctcactgcaacctccacctccctggttcaagcgattctcctgcctcagcctcccaagtagctgggattacaggcacatggcaccacgcctggctaatttttgtatttttattagggatgggggtttcaccatgttggctaggctggtttcaaactcccaacctcaggtgatctgcccgctttggcctcccacagtgctgggattgcagaaatgagccaccacgcccagccgagtggtctgtttgaaagactgcagaagagctctgcagttgctcctgccatccccatccctgtccctgccacgcttctccaccttggtgggctcatgctcctgatgttgcttcccttccgctggcctcactccctttaccttttctgtggtgttg

SEQ ID NO: 47926 - DNA, 1108 bp, Homo sapiens
cctcagcctcctgagtacctgggattataggcgctggccaccacgcccgggaaatttttgtgtttttagtagagatgggtttcaccatgttggccaggctggtctcaaactcctgacctcatgatccgcccgcctcggactcccaaagtgctgggattacaggcgtaagcccctgtgcccagccctcttacagctctttaatgcctggaaagtccttattttgctttcatctttgaaagatattcttagaattctggatgcgtagttatttcttccaatgctttaaatggcggtttccctgggtcctcacctgcagtgtttgcagtgagaaatccagtgccaccacacagttatttctctgtgtataatgtgtcttttttatatggctgcttttaaaatgttttttctgtatctcttggttttagcaattggattttcctctaagccttagtttgtctgtaaagcaatttgattactgaagtgctttggtgttattttgtgtgtgtgcacgtagggttcattgagcttcttggatctgtggatttagggtttttgacaaatttggaaatttttcagtcattatttcttcaaataatgttttctgcccaccacgctttccagtattccagctgtgtatgtaggagttctcagagtggttccacagctcactggtgctcttttcaatttttaaattattattttttccctctgtgtttcagttgagcaggtttttgttggtttgtcttctagtccactcatcttttcttctgcacgtgatgctgttgagctcatccggtctgtgtgcttacattctaggcattgtcgttttcagctctaaaagttctgttggagtctttcaaacatttcctaacatgtttctacttaactttcgaacctatagaatacagttataccaatggctttatttacttatttatttatttatttatttatttatttatttatttgtttattttaaggcagagtttcactcttttgcccaggctggagtgcagtggtgcaatcttggcccattgtaacctccgcctcccaggttcaagccattctcctgcctcagcctcccgagtaactggaattacaggcgcgc

SEQ ID NO: 47927 - DNA, 1991 bp, Homo sapiens
ggaggcggttccgatgctgcccctcgtggactgtgggtgatgggtccggaggcggttccgatgccgccccgtgtggaccgtcggtgatgggtccggaggcggttcggatgccgccctgtgtggaccgtcggtgatgggtccggaggcggttccgatgctgcccctcgtggactgtgggtgatgggtccggaggcggttccgatgccgccccgtgtggaccgtcggtgatgggtccggaggcggttccgatgccgccccgcgtggaccgtcggtgatgggtccggaggcggttccgatgccgccctgcgtgaaaggcgctcctcgcacggcgccaactggaggaggcctcagtacctgggagcctctggtgatgacgaagggtcagggacaggtgggcatcaggcttaggaaacagcgtgggcgtgttcctcattccgtttatcgctgttttatccctggggcgatagagttagggatacttcattgttctgatttatattcttggctgcctggcagagttgaacattttcttatgtttaccgttcatctttttcttacctacgttttttattttcttctcctttgcacatattttttcagaattacagtgttctaatttactgtgtgattataaatcatctatattttacatgtggcacaagtatttctccaaattttatttgttttatttaaaagaggccttttttaaagtaaaattttttgtttttttttttgagacagagtttcgctcttgttgcctaggctggagtgcagtggcacgttctcggctcactgtaaccctctgcctcccgggttcaagcaattctcctgcctcagcctcgcaagtagctgggattacaggtgcccaccaccacgcccggctcattttttgtatttttagtagaaacggggtttcaccatgttggccaggctggtctcgaactcctgacctcaggtgatctacctgcctttgcctcccaaaatgctgggattacaggcgtgagccaccatgcccggcccaaaattttaatttaatcaaatttgcacgtccttttttcaaatctttcaaaagcattatcctatcctatgactatacccctgcttggaaatgaatataatttttaaaaatacatgaaagaaaagtgcctccaagtgttaatatgttgagtgtaggttgatataattctggatgaccttttccctatttttattctttactgtgattatgctacttttataattatgttatttttacaatgaaacaaacaaaacatgaaacgaagtgccttccagagttgagatgggcgctaggttcccatccggtgacctgtggcaccctttccacctggccctgctgcggacggccacgcatgctccagagcctctccccgggcacatgggctgcagctgctgtggcccagccccagcactgtgagccagcaggaagcctgcactgagctctggcttgtgtctgttcaggaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtgtgagtgcagtgcttcccccagcgcgggctggcgctgacctgacctgggcgcccagagagaccgcttgacagtcttgtgttcacacttggggcgtgagtggacacaggccctctgttccttcgtgtggaagtccatccttggtgttccacacgcagagaagtgtctttcccagtccacgtttgagatcagctgtggtttatttctgggttagggaggattgtcatgaaaaaattcccaagttggagtctcagacctgatactcctcacatggctgaggggcagcatgggaacagccctgctcccagcagggacctgccagctcagagtccccgagaggctcagggtgccttctggga

SEQ ID NO: 47928 - DNA, 1098 bp, Homo sapiens
aagcccctctgggagcaggcacatccctggcgtacagcagcgtggggtgggggccacagagaccctggccccgagaaccaagctcgtgctgtcctcagtcctcttgctgctgcccgtaaccagcccaggagtgcatttaagaaggcgtggtccagttaggaaggcgtggtccagttaggaaggcgtggtccagcatgggcagtcatctctaggggaggaccattctgggttctcaggtaccagaccgcagacgcagagctttcggtatcgttatcatcatcctccggaccctcagctgaaaccccagttcaaccctgggcacacctctctaaacatgttccctgcatgttcttctggtgtgccctgctctttccctgtggctgcggagtctgggctgtgcttgtctgtgggcagtgctcgctgccttccagggcctcacctgcaccgcaccctctgcaggtatgttggggagctgatttcagactcagaagccgacgttcgagaggaagattcttacctctttgatctcgacaataaggtaatgtgttttgtggggttggggccacgcagaacttgtgaactgtaaaacctgaatgtgtttgtcccagtagggctgggattcagaagagagctcttactgttgacaagagtgggcttgctatagacctgctgagtgccgcatttggagctggccttggttctgtgccctgcatggatggagggagggacctctgacttgggaggtccctgagcctgtgcagccaactgcccctttcttgtgagagtgggcctgagacccaccactccagtcctccaaaccacaactgagaatcttgggttggggcttggcaacccctgagactgcacagaggtgaaggacgggcgccgtgtaccaagactgtagagaggctgagggggggcgccatgtaccgagactgtagagaggccgactgaggggcgccgtgtaccgagaccgtagagaggccgattgaggggcgccatgtaccgagaccgtagagaggccgactgaggggcgccgtgtaccgagaccgtagagaggccgactgaggggcgccgtgtaccgagaccgtagagagg

SEQ ID NO: 47929 - DNA, 1496 bp, Homo sapiens
gaggccgattgaggggcgccgtgtaccgagaccgtagagaggccgattgaggggcgccgtgtaccgagaccgtagagaggccgactgaggggcgccgtgtaccgagaccgtagagaggccgactgaggggcgccgtgtaccgagaccgtagagaggccgactgaggggcgccgtgtaccgagaccgtagagaggccgactgaggggcgccgtgtaccgagaccgtagagaggccgactgaggggcgccgtgtaccgagaccgtagagaggccgactgaggggcgccatgtaccgagaccgtagagaggccgactgaggggcgccgtgtaccgagaccgtagagaggccgacttaggggcgccgtgtaccgagaccgtagagaggccgactgaggggcgccgtgtaccgagaccgtagagaggccgactgaggggcgccgtgtaccgagactgtagagaggccgattgaggggcgccgtgtaccgagactgtagagaggctgagggggggggcgccgtgtgccgagactgtaaagaggctgaggagcggctgtgtgttctcggtgactgagtgaagcagcagtgagcctcctggattgtgcacagaggccaacagacacgtcccttgtgtccccagcccacccaatccccactgcccaggcgctagaatcttgtgtgggagagagcaggggccactccgggagcctggttttgggagctttctgaggctagggcagtggtgattgacccatcccagccctcatgttccctttactgtagcctcgttcccatcattgctctggaattcatccattgtctattttaaaacctcttgaaacttgcagtaactccaagccagtggggaaataaaggtttttctcatctcaagcagcagccaccagaccacggaataaatcttatacctggagaatagggcaccaggcagccgtcttcatagcagtggcctctgtggactgccaacctcaaccccaggctccgtccctgcagccaccttctaagaagtgactgttggtgaaatgacttgtgtttcatagaagagaagctgggctctggaaggtcacagtgtacaggcatctccctgtgcagtggggctgagctctcaagggatggcaacctccatgtgtgcatgccgtgtgcagagttgtgaggctcctctgctgcgaactgcccattccagccttgctgtggaacgactcgccttctgtgggctggtgacacatatcctcacaaaggctgtgttgtcactcgtgtgtgccacagatgtcgccttctctctatgactttttcatttcctaatgatgtctaggagtgaacagaagttcttttttttattctagttcagtttatcagtctttttctaaatactgggttttcgtaatgtcttagtgatatttttttgaaaacttgaatatttcccagaaacggtcatgtttgctttcacgtggcttccatgtgtaggttgacagccgttctgtgt

SEQ ID NO: 47930 - DNA, 1094 bp, Homo sapiens
ctgtaaaccgtgaggcttacaaataacaggaatgtatttctcactgctctgggggctggaagtcccaagatgaaggtgttagtagatctggtgtctggggagggtttcctggttcgtagccagtgccttctcactgtgtccccacgtggtggagggggtgcagcagttctctggggtcccttttatgagggcacaattccctccactcccatgacctaatcgctttcccaaagcctcaccctaaccttggggtctcagcctgtgagtctggtcggggggcacacacattccaactgtagcacctgcagtaaccatcagcagaaatcgagaaaaaatactcaagtagatttcttattccttctcttttcttacacaaaaagtggtagagtgtagatagtgcacgagcccttacctttctcccgacaggatttggggagagtcatcatattgtccgtacatggaaatctttctccttctttttggggcattcaggttgatttcagcccttgctatttatctcaaataatgttgcgtacaagtcaatttgtttgactttacctgtcattaggcaaatctctgagattctgttcatccacccagtgatggcttcagcagccagtgaatttcgatgtagaatttccgttggattctttttctgtttctccgctgagacttctcatttctctgatattttcatgccttgaaatctttctttgttcttcattgaggacagccttaggagctgccttgaaaatacgtgtctgttggcccagtgtctggttcatctcaaggctggactcagttgagtgttctttcggacgtgttcgtttcctcagtgtttcaagcgtcaggtcccttgagttgttcctgttaacatgtggggaggactctggtttctcttctgcgtgggccttgtttccctagtgcgattggctgggccccttctgcaggcccggcctctctagtggtccctgtgctttcgcctcagtcctaggattggctgggctccctccacaggctccgcctcctacgtggctgctgcacttcgccccagtcctaggattggctgggctccctccacaggctccgcctcc

SEQ ID NO: 47931 - DNA, 1046 bp, Homo sapiens
tgttaatataacatctttaatttaaatacctcaaagttgttttatttagtatttgtttacatgtcagcagaggataaacatttttcttttctgtttacaaaaagtaactgattttcttactttatgacacacactgccaccatcctgtgatatccactgttaatattttgagctatttccttccttccaagctttttcggtgtgtaggtttttaaatacacaattgatatcaccctccagggctactgcgggcacccccctcctgtcgtgggcaggccacctggtgcagctgtgccggctggtacaagatgcagggtgagggccccacgagtgctcactgcacacagatgtctcagcatctgatgtcccggcaacccccactgccgagtgtcctctgaggagacgattctgccttgtgggcagaactctgtcagattcctcttgtcaagcatttgggttatttcctattttgcttttgtagataaaccaaaacgcatacctatatctttagacatctctgattatttccttgggacaaatgcctaaaagttggatgagctttgtttttcctgtaaattatactattaaaaaactcttcaccggtggctcacgcctgtaattccagcactttgggaggctgaggcgggcggatcacggggtcaagagatcgagaccattatggtcaacacggtgaaaccccgtctctactaaaaatacaaaaaaaaattagccaggcatggtggtgcgcgcctgtagtcccagctactcgggagcctgaggcaggagaatcacttgaacccaggaggtggaggttgcagtgagccgagattgagccactgcactccagcctggcgagagagcgagactccatctcaaacaaacaaaaacccttcaccttctcatcacttggtcgtgctctgcttcgactcatacgcatcagtggtctctctctgtccgtgcctgtggtctcgttgtgtagctcagaggaggggtttaatgtctcatgaagccagtcccgttctccttgcttttcttctttgaatcat

SEQ ID NO: 47932 - DNA, 1022 bp, Homo sapiens
gaaacactacaagctagaagggattggggctctatcttcagcctccttaaacaaaacagttatcagccaagaattttgtatccagcaaaactaagcatcataaatgatggaaagatagtttttttcagacaaacaaatgctgagagaattcgctactaccaagcaagcactacaagaattgctagaaggagctctaaatcttgaaacaaattttcaaaatacaccaaaatggaacctccttaaagcataaatccaacaggatttatataacaataacaattttaaaaacccaaggtattcaggaaacaagtagtatgatgactagaatagtatctcacatctcaatattaatgttgaatgtaaatggcctaaatgctccacttaaaagatacagaatggtggaatgcataaggattcaccaaccatctgctccctttaagagactcacctaacacataagactcataaacttaaggtaaaggtgtggaaaaagactttccatgcaaatggacaccaaaagcaagcaggagtagccattcttatatcagacaaaacaaactttaaagcaacaacagttaaaaaagacaaagagggacattatataatgataaaaggccttgtacaacaggaaaatatcacaatcctaaatatatatgcacctaacactggagctcccacatttataaaacaattactagtagacctaagatatgagatagacaggccaggcacagtggctcatgcctgtaatccagcactttgggaggccgaggtggatggatcacctgaggtcaggagcttgagaccagcctggccaacatggtgaaaccctgtctctactaaaaatacaaaatagccaggtgtggtggcaggctcctgtaatctcagctatttgggaggctgaggcaggagaatggcgtgaacccagaggtggaggttgcagtgaggcaagatagtgccattgcactccagcctgggtgacagagcgagattctgtcctaaaagaaaaaaaaagagagaga

SEQ ID NO: 47933 - DNA, 1030 bp, Homo sapiens
ttgcaatttcctaatgacatatgacgttgagcatcttttaatgtgcttatttgccatgtgtataattttctttgatgagattcctattcaaatcttttacccactttttattctggctgtttgttttctagttgttgagttttaggagttctttgtatattttggatacaagtctttcatcagatatgtgtttttgcaagcattttctcccattttgtggcttggtttttcattctcttaatgtctggtgttttcgattgctaaaaacaactgattgtctggtccctattattacttctactagaaacagaaatctaggctattagtttttatatgttgattatgtatcctgctacttttctgaatcctcaaattgtttattagtttcactgattccccctttttttccgagatatattatcaaaacttctgcaaatatacttctaactctttctaagtcttacaccactcattattatttttttgtctgatttcactatcagataacaatggaattactgggcattaccttgtttccgcctacattaaataaaattttggtttggggcctgagggatgtgtgtgtgtgtctgtttgtgtgtgtgtaaaattatgttgtggtatccattagttcctacttcagtaagtgtttttatctggaatagatgttgaattttcttgaagaccttttcagcatccatagagatcatatatttttttctccttagatatggggatttatagtaatgaattttttgatatgaaatatctttgcaatcttagaataaatccaagtggttattatatttattttgtaatatgccattggattctctttaacattttttgtaggatttttggattgatatttttaagcgagatgtgttctgtagctttcttttgtcacatttgaggatcataaggtttaaatatcaatgacatagagttatctattgcttaacttcacagctccattcctgaaaatcaaatgttctaaaagagggtctcatttccactcccccccaacctt

SEQ ID NO: 47934 - DNA, 1030 bp, Homo sapiens
aatttattagttggatactcagctcatgacattgagcttttctactttgctaatgtgtttaaaactttaagtttctctctgagagttattttagttatatattgaaagtttaaattttttgtttcaaatattttttccaagtgtgattaagaattcttgtttgattcatgagtttttaaagtaagtaggattttaaatttctaattgacagagatttctctatcttgttctcttttcctatgttttgcagttgattctgttattccttttcatatttcatcactccttatatttcggatcatccattgggtttctttcccccccgccccttctgcctgaagaacagctttcctaatttttttttttgtttttgagacggagtctcgctctgtcgcccaggctggagtgcagtggcgcaatcttggctcactgcaacctccgcctcctgagttcatgccattctcctgcctcagcctcccgagtagctgggactacaggcgcccgccaccacgcctggcttattttttatatttttagtagagatggcgtttcactgtgttagccaagatggtctcgatctcctgacctcgtgatctgcctgcctcggcctcccaaagtgctgggattacaggcgtgagccaccgctcccggccttcccctaatttcttttagtgaggtttgatggtggtaaattctcttggcttgcctgaacagtctttattttgccattgtttgtgagacgtggttttacatcgtagaaaattctcatttgttatctttatttcaacatattgagactgctccactgtcttctgccttctgttgtttctgttgagaagccagtcattcgtctaaattttttttcctatgtatgactgtcttctctctggggctgcttaaataaaatcaattttattgtggaaaattgaaacatacgggaaagtggagaaaatgcggtgaactcctgtgctccgtctccacccacattttgccaatgttgtttcacttacgcttcttcttgctttcttgt

SEQ ID NO: 47935 - DNA, 1033 bp, Homo sapiens
ctttattaaagcattaaagaagttgagtcaataaacaatcttcctataaagaaaacaccagattctagtggtcttatacattaggtttctacttaaaatataaggaaagatcattccactcttaaacagatttttctagagaacagaaaaagagtgaacattctctaactaactagactagtataatgttgacattaaaatttttttaaaagaagagaaggctgggtgcaatggcccaggcctataatcctagcactttgggaggctgaggtgggcagatcacctgaggtcagaagttcgagacgagtggataacattgtgaagccccgtctttactaaaaatacaaaagttagccaggcatgatggcgcacgcctgtaattctagctacttgggaggctgaggcacaagaatcgcttgaacccaggaggtggaggtcacagggagccaagattgcgccactgcattctagcctgggcaacagagtaagactctttcaaaacatataaataaccagaactctggcactgctggtgggcgtgccagccagcacagcatctgggagggctcagcagcccctcgaaagttggacatgtgcatacaactcagcaactgtactcctaggcaggtgtcccagagggtgcctgcacagataacccccagaggcattttcacacaagtgttcctggcaccagcgttctgccgaccaaacagaggcatctgagtgcccatcggtaacagaatgtgccagttgttagggtctctgctaacgtagtgaaaatacgcaaatgatgtgaaattgaaacacagctttggggggtttctgtgtgtgcacccctttccagtgacatcagcacagtgtggatgcttctcagaaacagtttttggtcagagcataggtgtgcgcaagtcaaagaagcctgcgggcagcctgatcccacaacaaaggccagggacaggcaaacatagaatgcatttccagagtttctggtaaagctgaaaagacaagccatgattaacaagaagggaaggta

SEQ ID NO: 47936 - DNA, 1010 bp, Homo sapiens
cggtcggttatcctgttagtctggcagccgcgctgaaggacaggcctgacccgcggcgggggttacatgctactggggaaaactgcctgagaatgtgagcaggagcgcatcggatccttgcgctgggcaaacttggcttgcataatttagattttctttattttagaaagaacacattgtcagctatttgggaaaaagcatttaaaaaaacataaagcagtgtcccagttataaatctttggcatctgaccacttttccaacagcagggacggaagagggacccgagtgttaatttgttatcgaaggtgccggtgtttcaaaggttcacggaaaactgatttctaaactctatttcagggattgaagagttctcttgctttaaaatttgcagagatctgatgctgtttaaataaatacatctttttttcctgctttggtctgtggatgtacaagagcacatacgttactgatctttgtggatgtgtcatagttcataaatttgcagccagattccagattttgggctgagtacaattactgacccatttgcatttcttactgtggaaaagtcagttaaaatggctaaaaagcccgttgtactattgcatatgttttaagaagacattttcccatgatctgtcagacctgttaccaacataatgcctgctttggagtcgctgatgatcccacttgaaaacacttcctgtgttacgtgtggcagaggcctcacaaacttagctcggggccgttcttgtgagtgtttcggacttgcatctgtggacaggttcagagctggagccggcacatgtgtagctacggagagggcgtctatactgggaatgcacactggcctctcccgggtgggagttctctggtgtggggcagtcgcccatctcacgtggggtccttgtacggctcgcacgccctctctggctcggtccacctggcgcggctcctgcagacccagcagggtccgtgccattgctcttctccattgcaggtgtttggg

SEQ ID NO: 47937 - DNA, 1216 bp, Homo sapiens
tcttatatatagaaaaccctaaaagctccaccaaaaaatccttagaactcataaagtaattcagtaaaatcaatgtacaaaaatcagtagtgtgtctgtataccaacaacaaactagcagaaaagaaatcagtctcatttacaatagttacaaaagaaataactaaggaagtgaaagatctctacaaagaaaactataaaacattgatgaaagatactgaagaggacacacaaaaaatagaaagacatttgatgctcatggattggaagaattaatattgtgaaaaggaccatgcagatttaatgcaatccctatcaaaataccaatgacattcttcatagaaatataaaaaaaatcctaaaattaatacagaaccacaaaagaccctggatagcttaaataatcttgagcaacaagaagaaagctggaggcatcacactaccaaactttgaaacagcatggtactggcataaaaacagaaacatagaccaatggaatagaatagagaactcagaaataagtatttgtatttacagccaactgatttttaacaaaagcaccaagaacatttattggagcaggacagtctcttcaataaacgatggtagggaaactagatatccacatgcagaaaaatgcagctcaacccctatctctcgctatttacaaaagccaactcaaaatggatcaaagacttaaatgtaagactcaaaaccatgaatctactagaataaaatacagggaaaacacttcaggatattggtctgggcaaaaattgtatggagaagacctcaagagcacaggcaaccaaagcacaaatagacaaatggggttgcatttcagtaaaaagcttctgcacagccaatgaaataatcaacagagtgacaacttgcagaatcagagaaaatattgcaaactatttatctgacaagctattaatatccaaaatatacaaggtgaaactcaacccatcagcaaaaaaaaaaaaaaaaaaaaaaaaaaaaaaaaatcagattaataaatgggcaaatgaactgaatagacatctctcaaaagaagacatacaaatggccagctggtataagaaaaagtgctcaacatctctaatcatcagggaaatgcaaatcaaaaccacagtgagataccatctcaccccagttagaatggctgttatcaaaaacacacaaaaaaaataacaaatactcatgagaatgga

SEQ ID NO: 47938 - DNA, 1655 bp, Homo sapiens
gatgacaacattccccaatctttatgagctacgcccgggccttccacagtcagccgccggcaagagcagaggcaggaagaacgggaagtggacttgggccagatggcagcttggttaccatgcacagtggtaccataccaaagccagagtctcagagcaggggtccttagaagacataggcagtcggggatgtgagaagtgcttactgaagagtaaacaacagaatacaggcctcaccccagagatagcacgcacaaaataacacacaaaacctgcgggccttgagatagcacagacgtgacctgtgagcaacacatgattctgcccccacgagcagcctgggctcaccctacgtagtccaagatggccaggacaggccgaggggcccagcagaggcagctgagcagattgggcctggatcctgtgtcctgagcagagcacagggcaccttgagcctttttggtagcctctgtgacaaacgcagtgatgtagtcatttcccaggggaccactctatggctcctcgttctttgggagaaactttgaaacaacaacaaaattttatgagatttcctgagttgtgtgtgcacatgtgtggtgcacaaacaggacatgtgtgcatgtacatggctgtgttgtgtgcgtgtttgcacagtgtgaccacatgtgcactctgtgcatgtgtacatgtgtgttgtgcacgcatgcacacagatgtctacatgtgtgttttgtgcacatgtgcatgcacaaggcgcgcacgtgtgtgcatgttgacgtttgtgtgtgcacatatgattgtatatatgtgtgcctgtgtgtatatgtgtgcaagtgaactgaatgtgcgtgcatgcctgtgtggttgtatgtggatgtgtgtatgaatgacatgtgcacctgtgtgtgcatatgcccatgtgtgcatgtgtgtgcctgtggatgtgcacatgcccgtgtgtgcctgtggtgtgcacgtgtctgtggtgtgcacgtgcctgtgtgtgcatgtgcctttgtgtgtgtgccaccgtggtgcgtatgtgcctgtgtgtgcctgtgggtgtgcacgtgcctgtggtgtactcgtgcctgtggtgtgcatgtgcctgtggtgtgcatgtgcctgtggtgcgcatgtgcctgtgtgggtgtgcatgtgtgtgcctgtgggtgtgcacatgtctgtggtgtacacgtgcctgtggtgcgcatgtgcctgtgtcggtggattctgaaggcacgaaactgttcaccctggtgctgcttttcccagccttcctattgttgttgcttcaaccctgtggtgtgaagcctggtgacttgagaggagaattgcagtcacacttcttgcagcaatctggctgctcatttctgtgtccacccatctgtctaataacatctcctgggcatctgccatgtgctggggcaggggcccaaaggtgaaacaggcacatgctgtcagaacactcagccaggcttggcagtgagaccacatggtgactgtagctcaaggccagggcatttctgaggaaggagaggccatgtctggcctgaagaatgagaggaggtgccatttgagctgaacttaaaggaataggaaggattgagcactagagaaataggatggattgagctggggatgggaggtggggc

SEQ ID NO: 47939 - DNA, 1330 bp, Homo sapiens
cttgctgaggggtgcttgctggctctcccagctcctctccctttcagggtgcccggctgtctgtctgccgctctgctgtgcgcccccggctgcctcactgtgtctttctcttcagccccatcccagcttccttcccagacagagggatgtggccaccatgatgtctcactggcctcttgtccccacaacctgagctgccccctttgagagccccctggaggctcaggaagacagaactagaccctcctccctgccttttctccctcccttcctttcctaggaatgaggggacagaccacttgtttgacagagattgtttttgttctgggctcagaacaaagccctaagcccctggtatggatggagctgtccagccctctgggtctggccctgggggcaggtggggcctgcagggcctctggtgcttctgtacaaccccctccccagctcagcaagtgcagaggctctctgggcccaggctgcagtctccagggactttctaggctccatggtggggaagaggcactgtggcactgagaaggaaaggggtgctggggagaggcatcttgctattattcctggggcctcagagggctgctggaggatggggatggcctcggggcccaggagtcatgggatgctgagttgccaagaagggggtaaatcgagggatgcctccaggcctccctcctgggtgggcaagcagatcacatggcccagccctaaaactgttccatctgcccagctgtccccagtcccacctcataccctccatgtgtaagcaccttcgttcccccagcacccacccacctactcaagagccctcctgaggcccccactgctctccggcaaacggcctgtggttcagccaacacgtgcctagagcttttctgatcctccctgaggaagactttcctgagtctgtctgaggaagcttcctgccagagctttcctctctggtgctgtggacagctgttgtccacactggctctgtgccctgactctaggtctttgtcacccgactcagtgcagcctgtgggagccaagtggctcctccaagccatcctcagcccctgccctgcccctgcattgtgcctgcctgggggttctgcatgcaaggctgtagctttgtccccaagaaggagagctctgtccacacttggcgccggggcaagcaggcagggccatgatggagcagcctttggagccccacccagctgtgctggctgactccaaggttctgggcatggagagaccaagggaggcctcagggtgggggcagaagggccagatgagctgaggagggtccaggagatgcccagagcactgc

SEQ ID NO: 47940 - DNA, 1212 bp, Homo sapiens
ccaagcaccccggtgagagtctggatgctatatcagtattgcagctgtcatatcagtattgagggtgtcacttgagtcttaggggtgtcatagcagtactgtgggtgtcatatcactatttcggatgtcatatctgtattgtgtgcatcatatcagtattgcaggtgtcccatcagtcttacgagtgtcatatgagccttacaggtgtcatatcagtattatgggtgtcatatgagtcttaggagtgccatgaatcttgtgggcttcacatcagtcttatgggtgtcacagcatcttgtgggtgtcatatcagtattacgatatgccgtgatatgttataccagtatgatacctcttctgaaaacaccttcacagacatacccacacatagtgctttaacagctctccgtgtattccttaatctggtaaagttgacacctaaaattaaccatcgcagtatttatgcctgattcatggctaaaatttcagaatttttaaaaattttagaatgaaagctgggcaccgtagccagacactgtccctacataaatattaaaaagttaactggttgtacttgcacacatatgtagttccagttactctagaggctgaggtgggaggatcttttgagcccaagagattcatgctgaagagctaggattgtggcactgcattccaggctgcgtgacagggtgagactctctcaaaaaacaatcaacagtaataatattatttggaataaatttaaccaaggtacaagacttgtacatgaggctgggcatggtggctcacgcctgtaatcccagcacttttggagttcaaggcaggtggatccacgaggtcaggagatcgataccatcctggctaacacggtgaaaccccatctgtactaaaaatacaaaacattagccaggcatcgtggcatgcgcatgtaatcctagctacttgggaggctgaggcaggagaattgcttgaacccgggaggcaggggttgcagtgagccaagatctcgccactgcactccaccctgggtgacagagtgagaccccatctctggaaaaaacaaaaaacaacaacaaaataacttgtacatggaaaatttcaaaacattgctgaagtaaattcaagaaagcttacataaatttaaagacacctcatgttcacgaactggaagacttaataattcttaaggtggcagtactacacaaagcc

SEQ ID NO: 47941 - DNA, 1069 bp, Homo sapiens
agtgatactcctctcttggcctcccaaagcattgggattacaggtgtcagctaccacgtccagcctgttgatttttaaaaatgtaatttctttttctttctttttcaaggcatggttttgccctgttggccaggttggagtgcagtggtgcgaacgtggcttattgcagcctaaacctcctgggctcaagcaatcctccctcctctgtcacccgagtaactaggactacagatatgcaccgtcacacctagctaatttttaagttatttgtagagagagtgttttcctgtgttggccggactggcctgaaactcctgggttcaaaagatcttcccacctcagcatctcaacgtgctggtattacaggtgtgggccaccacccccagcctgggatggttttcataattacattctcatgttgtttgttgctagtgtctggaaatacaacagattactgtgtattgacattttgtgttgtagtttactagttttaataatattttgggggtttgtcgtgatatttctgtacataagatagctcctgtgatctgtgagtagctgtttttactgcttcctaacacatataagttctctttacttctttttctctcctatttgttgtgggtggaacttcccgtacagtgttgaatacagtgatgaaaatgagcattggtgccttggtcctgatcttaggagtaaagcactgggccctgacaatggagatggtgctgaagtccgattgtggtgtttagaaaattcctatccctggtttgttgggtgttttttatggtgaaatggtgttgactttgtttaaagtacatgtgggtttcttctttattctgtttatttcatgttcctttgcagtgatggctttagtatgccaaaccagcttgattttctgagaaaaggatgtagtgatcatgttgtgcaatcctcaaaatacgtgctagtatgaaatgacaattattttcttgggcattattattattattatttttaatttttttgagacagagtctcactcttgtcgcccatgctggagtgcagtggcgcgatcttggctcactgc

SEQ ID NO: 47942 - DNA, 1030 bp, Homo sapiens
gtaattatggtgtgcaaaaatctcaaatagagtaaacaataaaccagtaaaaaataactacaacatatttccaagacatagacagtaaaatagggaaggaagagaaacaacaaaaagtttaaaagaatggcaatggagttaaagtgtagagtttttattagttgctttgcttgtttctttgtttatgcaatcaatgttaaattgtccacagtctaaaatgatgtgttatattatattcaagcctcatgaaaattttaaatcaaaaagcataccacagatgtacaaaaagtaaaaagcaataaattagataatattaaaggataaatcaccttcactaaaaggaagacaggaagaaagaaaagaacgatgagaggacaaaagttaatcagaaaacaagtaacaaaatggcaggagtaagtgcttatcaataataacattgaatgtacatgaacaaaatactctaatcaaaagacaaatagtggatgaatggatagagaagcaagacaataatctgtgacctgcaaaaaaaaaatactttacctataaagatacatttagactgaaaataaaacgatggaaaaagttattccatgccaatagaaaccaaaaaagagcagaaatagctttacttataccagacaaaaatagatttcaacaaaagactgtaggaagatattaagaaggtcattatataataataaagagatcaattcttcaagaggatataattggaaatatatatgcacccaacactaaagcacctagataaacggagcaaatactataagagctaaagaaagagacatcaatacaataatggctgaacacttcgacaccctactttagtcattggatagaccttccagacagaaaatcaacaaagaaacatcagacttaatctgcactgtgtaacaaatgaacctaatagatatttacagaaaatttcatccaacagctgcagaatacacattcttctctgcacatgggttattttcaaggatagaccatatgttaagtaacaagtctaaaa

SEQ ID NO: 47943 - DNA, 1079 bp, Homo sapiens
tctctaggttctgttcctaaaacatctgtgaagtgtatttctgtagattaaattctgttttccattgaatgttatcttaatttcagaaaatttctgtgcagggttattttattaagctcatttttttttttttttttttttttttggtgagaaaggctcagcagctaatagactcagcaacaggcagccaggagctctgaggctcacagctggcagtctagttccactcagtctctactggagaaattctttctttggaagtacagcagaggccttaggtgagtggcttgtctgctatggcagagattagaggtgctgccagactgccataagtgttaggcagtaacagcagcagctgcttatatgcatgtgaacagctggggaattaatttggtatgcattctcaggagccactcatctgctggcagaggtagcagaagaatgcccttagtgtaagtcctctacaaccatacaccaaatgtgctccctgcatttcaaattccattgtagaaagtctctgataatctcacttatactatgagccattcctcagtatctgtcctcttcctgttagtgttctacaattcctttctccttaatttttctccgctttacaaaatgtcacacagacaagtgcataatacttaaacaagcttttaaaaataatgctcataaatagctttggttctgtcataatattcgtatttataaacattttaagtcaattctcttcttttgttttcatttcagaaatatccatgtcctgaataaaagttgtgtcttgattagtttattatgtaacaatttagtgtgtttgacatttctaacttttatttctaacatttgctttattatagaacaataaacatgcagtgattgatttttcttacttcaagtggatgagtgagcaagtgactaaaatcttctgtgaattattcagtgtatggtgcttgccagtgcatctgagaatctagggactttctgaaatagtacttccttgctatgaggactgaagttgcattagaatccttttcaatgaagatcagatgtcctgagtacaattcttactattgggtcct

SEQ ID NO: 47944 - DNA, 1033 bp, Homo sapiens
actccgtaaaatcttcctagttataggaagatctagttatatactagaaaacttaatgtatttcagaagacatgtatagcctacatgtaaaagtttttagcagcactgtaatagtaaaacactggaaacaaaccaaatgtccaacaaaaaaaaaagataaagaaatgatatagtcatacaattgaactacaatactatgcagttaggattttctttttttcctctatgaattttagtgtgtacggttcacaagactattttttttctactggagattgacatattgggttttatatgccacctgctggataaagttggtatagctttatgaatttatcttactgaacattctgtccattgttgacactacctggctctattccccatttcataaaaacttttatagattgtttaaagcatactataagtagccatatagtcagcctgaagttgcgtcttgttaatgttgaaataaaaggtcattataaataaaagattgtgtgtaaattttagggaaggttaggctaggttgaagaagctgtttcaacttgtaggagtgtttgtaaatatttataaaattttatgtctacataaagtattttgcaacaggtttcgaaggatgctttaatcttatcctctaggatattctatgctaaaataatatatgaaaaatagcacgcaaattctcaaaaacgttaggattctttatatgttttttgtatctttaaaattattttgaatttttttatttacaaaaaatatgttttataggtgctgggaagacaacacttctgaactatattttgacagagcaacatagtaaaagagtagcggtcattttaaatgaatttggggaaggtaagtaaagttcaataaatgtcatgttgcaagattttgtgtgactgtttattcctctggtgaattgatattccatatttaaaaatgaaaatgcaaggtattgtattgatgtggatagctttagaaaagttggattaatttctgttaagatttatatgggttgagatactgaaat

SEQ ID NO: 47945 - DNA, 1057 bp, Homo sapiens
aggcaatgagtgggctgcaaccattgtcactgaaaaattaattctgctccctcaggtttctaattcagctaaataaatccaacctggcttgacacttactttatgaagtgccaagaccagagttagactgcagcatttttaagtgactagaattttttaaagacgattttagattttcttttctttctaggtttaaagagtcatgaaagaaaactggggccaggcgtggtggctcacgactgtaatcccagcactttgggaggctgaggcaggtggatcactaggccaggagttcaagaccagcctgaccagtatggtgaaaccccatctctaataaaaatacaaaaaaattagccagatgtggtggcatgcacctgtagtcccagctactcaggaggctgaggcaggagaattgcttgaacccaggagacggaggttgcagtgagctgagatcgtgccactgactccagcctgggcgacagagcaagactccatctcaaaaaaaaaccaaaacaaatctgaaggacctattcataatacaactctgtaatattgccaccttccttcgataccagagatttgtccttttgaataaacatggtctcctgttctgggcatgatatccaacatatttcattccacactgtttattatttttattaaacaatattgaaattcgatttatcagattgcaatggccaatctcaatgagtttcactttattgcattggctctcagggtaggataggccaggccagtgccaacttaaaagtttagtaagttaaactaaaaataataatatgaaaccatcatattttataagcccttttcagcttatgaaaatatttccccaaatataagttttatgaaagcatctttcagcatttccttctgaactgcaacccaaacaatgcctaagcacatttctaatataataaagtgttgttgggaaaaaacactgttagggaatggctttcacttggcattagtttgaatgacttggcattgtcaccaggggtggtggtattttaaacacagaacattctgcacagtgatt

SEQ ID NO: 47946 - DNA, 1066 bp, Homo sapiens
agtttctgatccaggtgaatgttttaaaaactttctgtgtagttatttaaactagagtgcatattcctttctatgtgcctctggcattgctggcacagcctacacgttcctcaatgcatcgtggaattcagaggtcaccctgtttcttggaatatcattttatcttccttacaccaaagcataaaggaacttcctcaaccctatgtgttcatgccatcaaagcccttgcttcatgctctttttgaagttatttaagaaacaaaatgtaggcactgttttaaaaattaaaaagttctacaatgattataatgaaaacctgtggtcccttctctcacctctttcccacccttgatcccagctacccagagacaagtactgttaacttttactacccttaatgctagtatttcacttcattttctaaatgataaaattttactactaaatcttattttttattgagttagagattatcaattgacttgttactatcaaacgtgagaattttactcacttaaaactcctcacagctctgcctccatgttcttcttctctatccttctattacacaatgtttgattatagtaatcgagttgtagattactattattaatagttgtatttatatttttataacaatgtaaatcttattcttgtttttcataacaatgtaaatacgaatcgtgtgtattttaatttttcttgtacaattactttttattttcttgaaaataatcacctaacttggtttggtaaatctttctgagaggatgcatggctgaaaatgtgtttatttcacccctctctcatttgattaatagtttgattggatatagaattctaggttaaactaatctttcttcagcatattaaagccattccattttcttctggtgtctggtgttgttgagaagtctagtgacatatggttgtctgatctatttgtggcctgttttttatttctggaaatatttatgatctccactttgttctcagttgtctgaaatgttgtggtgatgtatcttggggtatatgtgttttattgtgctggacagtcaggtggcgg

SEQ ID NO: 47947 - DNA, 1040 bp, Homo sapiens
gtaattttttcatattttagtagagaaaaggttttgccatgttggccaggctggtctccatctcctggcctcaagtgatctgcctgcatcagcctcccaaagtgctgggattacaggtgtgagccaccatgcggctggcctaagattgtttctgatgtctaccttctgtaagtaatgctgcaacatatatccttgtacatttgcatttgtgcacctctgtgattctgtttgtagaataaattcaaaaaagtgtaatcagaactaacaattcagcacaaatataagtaaagtttctaaccagagacttggctacttctgttacagttttaatgtccagatcacagcagaactctgggtgattttgaatcttttaagcaatcacctattaatagggatcctagaggatgtggacaaaatttgtaggtacaggcatgtctttactaccagtgtgcagaatggagaggaaaagagtagacaatggacccatcccttgtaggactctgaaggctccaaatgacccatcaggggtacagagtttctcttactacccacaggggttgattgcactgcacagatctggagaggacagagtgatggggtttgaggtaggatacaagtatacagtttgaatttttgtgattcaccaagattacgtccaaaaagatgatgaactatttttataaatgaaaatgtattttaatggcatagaggtactgtctaaatgaatcttatgaatcatttcatagagcaaatagttctcttgaagcattaaatgttttacaataagtcatattttgagttggcatgtgacaatttctgtttgcatgtataaaaagcttttgtacccaggataacaggtgccccaaaaagcacaaactgaagataatccaaaatcaggtgtatccaggtccagcaaatgacttagtcactccaggcttgtttctttacctcaaaaatgagagggttaggatatttgctctctaagcccccttgcagctttgggactatgcacaatgtggacagtcaagaaatgctcagta

SEQ ID NO: 47948 - DNA, 1028 bp, Homo sapiens
ctccatctcttcacttttttcttttctttttcttctcgtgctggtttcctgggtctgcttatgtttttcctcaagattactagacctttgtatttttttccttgaggatatacttattttatccttttgatcttccaggccattgaatttgaatatcatcagtgatcatcgtttccttaaattcatctagtgacttaaaaaaaaatgaatgcatgttttctaagaagtcttttgttatgtgctgaatttgaatccctttaaatactctttttatcatttactttttcatttttttttttttttttttagtacattgccctctgcctgttccagtcagttttatttcatgagggaccagctaatccttgtttatttttcctgtctctgattgttgagcccccttagcatctggttatttttctttgctgatcattggagttcagtggctaggataccttaactgggattgagggtggggtgagattgtctgagaaacagaaggtgtggtgatctgaccctgagaactggctgggctgcagtgagaagtcatcaactccctatcatggcatgaggaagggtggaggaggagggaggttctccgtggctttcccagcctcagggggagctctccgtccaccctcacagctcctcatgagcttctctgggcctggcgagactggccaatgtcaactttgtcaactttccctacagaggttcagcgatctcaggagatcaagctattcccaggagctggctgcttcagatccttgctttggaactaccttctgctgcctctgcctcccaggctcccacttggcccagagggtggacacaccacactggtgtgcaatgtgtgtaacgtgtgtgtgcagttttgccaattcactgcctgagtggatgctaggctgaggggagtgagagaaagctgaggaggagctgtgtgtctaggaaaggcaggagacaccaatgcactatctttctagattctcctgctgccatgctttctagaattattttaaatatttcag

SEQ ID NO: 47949 - DNA, 1113 bp, Homo sapiens
ggcacgatcatggctcaccccagcctcgacctcccaggctcaagtgatgctctctcctcagcgtcctgagtagctgggaccacaggtgcataccctacacctggctaattttttccatttttttgtaaagatggaggtctcgctttgttgctattttgacagattacttcttaaccaacaaaacctgtgcatttggattctggtttctgacattaactgtgtgaccaagtacaagtggcgtaacctctctgcttgcagtttcctcatctgatgaaaggatttaacaatgcgcaatttgcttggctgttttgaagttaggataagacaaggatgtgtcttgtacataataaaagatagtttccatccgatctggagccagcttccaccttctcagtttgtcctggagtgtaaagtggcagctactgcgagactaatcagtcttgataggagaatctatttagttgagctgatgcgcctcaatgttgctttgtaaaaaagatgctgggatacatattggtgcatataacttcataaagtactacgtgacaatgcataatgtagtggcttgggagctctagaagacaacaaaggagattgttgaaatgtgctttgcaaaatggctatgaatccaggagggtgtattagtggtatccctactggtccaccccagtatttatttaatatcaatgggccagctgtaggaaggtctcattatatagttggtaacatgatgtcatcatggttggattccacttgccatataagattccggaaggcagggatgtttagttagtaaattttgagctaagtagtaacagatcagtttttcctattttatgttgggggatgaagatacaacaaatgactattgctacatggaagaaagcaatctgaacaggagctgagaatttctgggttccaaattcaacatcattttcttgggtgacggtcatcaagataagaataggcgctcaaccaagaaagagcacccagatagcaagttttgtgctgaacactgagatccaggcttagccctctttgataagaacagaagcttagcaaagagggctgaagtctcatagttgccaaaagcacttttcaaagctattttct

SEQ ID NO: 47950 - DNA, 1047 bp, Homo sapiens
ttcttcccaaatgaatgtagaagcaaaggttattgcttccatgtgacaaagactatcaactagtcagttatggtagcttctatttattgcagacttactataggctagcagtttacatatgtttcctattacattagtgctcacaaataacctccatttgacagatgaaaaagacaggtctatcctacatcctaatacatgagcatttgtagacataagtgtccaggagggatttgttttgcagctgcaggagaattcacagtaatgaaaactactgtatttttcttaaatccttgagttgaattacagagaaagtttgcaggatccttggcatagagagaagaaagattattaaaagcaagtcagatttggtgttgtctgaaagtattaaaaatacataaaagaatggataagagaaactctctgtaatgtgggatgcatatttcacaaaggatacagccccagaatggtgaaataaaatgccaattatatttttctttatctcatctttaaagtttcaatttgtgagtgtatactttctgatatgtgtaatatatttgagcagtaatatattactgcaggagaaagattgcattattggaactaattctttacatctttctgtgtctaagctgtttgccatataactttgcagtgccctcctatggtgggtgggctaacctgccctgccctttgacttgcagcttggccatgtgacttactctggccaatgggctgagcaaatgccatgaaaagaaacttatgaagtgtttgcatgatggggcttgcattctctctcttgttctttgccacagccatcgacatgtggctgctggagtctgccagaggaatgcagacatgtggcctagtctctcccttcatgccagttgaccatcaggcatgtgaatgagtaacaagagcctcatgaaagagaagaaccttctagctgaaatcagagtatacgctgacttttaaattcatgagctaaataaacgcttgatgttttaagccattgaatttcagggtggttggtgatgtatcgttatt

SEQ ID NO: 47951 - DNA, 1084 bp, Homo sapiens
ccatttctccctagatgggaattaaaagctgaaggccccagactgacccaagtgacctcacagaatgagttgtcacattagcaggagttgggtttggaaatgtgaccaaaatttccgcaatccatcttaatatactgaagaaaactggctagctcagcaactctgcaaactggaagcttaaccattctgctgtaaacgtacatactttccttagccttgggtcccaaagccagaatgtgaccttcccctggcagtttactcactaaacaacaaatcctggcctgccatatattatgaggataagcatcaaatttttctccaaaacttgagaatacttggatttctcatttaacaagacaagtttgtttccctcataatgaacaaggaatggaatcaatcttggcacccagtagtccatgcattcaggaatttatgatcctagggaataaaacttatttttcaaaataacactctttctgttttccaaaggaattagaggtggtgaagatggatcttttttggataaaattattataagcctcaatacgtgttgtccttcaaaggatccagcttcaaaggctgtacttactcatgctattattgcaacaagtatatttggaattcctcttttgaattatagtctgcacagtagattcagtagcagcaagcggtcatatccaccttgatggtttactctaagtgtcgatcttaaactaaagtgtcttaactattttaaaatactgaatgtagccttaaaaagacaaagatttaacaacctagaaacaagtggatgtgtcacaaactctgaaggtaattcctcagtggaattcaaagaatgtcttgattagtggaatcactgttagaatgaggtcatgggtgactaccttcaggataataacaaccctcatctgtatattacagttctgacatgtttgtaagtggtacaataagcggtaggtgtgcacagctaaagcaaagccacaaatgtaagtttgagatctattaatctatccacagaaaggtgcgcaataatgatgctgtccacaccctcagcttccctgcatttctccgtgccctcaatgat

SEQ ID NO: 47952 - DNA, 1070 bp, Homo sapiens
tttaaggaggcaatttgagtaataataaaactctggtcttctgtttaggggttctatgtgtattaaactttctctatagcagtgcccttgataaatcggctctatctgggcagtgggcaaaatgaacccattgggcgattatactccaacaccattctctaattctcaggtactttaatacctacattagttagacttccaatacccttcaccttctcaccatctgtagttttcttctatcgtacttcagacactcactgccattactctaggtactttaatacctacatcagtgagacttccaataaccttcaccttctcaccacgtgtcattttttgttctatcctacttcaggcacttactaccattactctaaattatgcatgggaatggcaatcattccataaagtcaatttcatacatcccactttttgatatctttctttccagttcactccctctagtgtctgaacttcaataactctaccactgcagcatgacctacaatctgttacaccttcctctttgctgttcctcattccttcagtggcctcctcacatgccaggagtgctcctactccaggacatttgcacttggtgtttgctcttccccaggatacctgtggggttcagtcctcacctcctgaaaggctttgctccagtgtcatccttcacagtgaggcccaccccagtcattttattgaacatcgtgcctcactccagtattgttactccttatcctcctcctatgattgattttcctccattgtacttatcagtaaaatattatatattcctctttctatttattcctctacaatggaaggtttatgaaggcagggaagtttgttcactgtaactcagttgcctagaacagtgcttggcacacatatggttatcaataagtattagttgaatgaaaacaatgggctgggctagggctgtatttttgaacccaagttagttgaactagaaagttcctccttcccactaccccatgtcatttcaagaagaaccacagatataaactagactcgtgggaaccattgagttagaggcttttctaggg

SEQ ID NO: 47953 - DNA, 1031 bp, Homo sapiens
caggatgatgctggcctcataaaatgagttagggagaagttcttccttttcaattgtttggaatagtttcagaagaaatggtaccagctcctctttgtgcctctggtagaattcagcagtaaatccatcttgtcctgggctttctttgattgataggctatttattactgcctcaatttcagaatttgttattggtttattcagggattcagcttcttcctggttcagtcttgggaggatgtatgtgttcaggaatttatcaatttcttctggatattctagtctatttgcatagaggtgtttacagtattctctgatggttgtttgtatttctgtggggtcagtggtgatatctcctttatcatttcttaattgtgtctattttattattctcttttttattctttattagtttagctagtggtctatgaattttattactttttccaaaaaaaaaaaaaaaaaaacagttcctggcttcattgattttttgaagggttcttcatgtctctgcctccttcagttctgctctgatcctggttatttcttgtcttctgctggctttggggtttgtttgctctttgttctctagttcttttagttgtgatgttaagatgtcaatttgagatctttcttgttttttgatatgggcattttagtgctataaattttcctcttaacactgctttagatgcatccccaagattctggtacattgtctctttgttctcattggattcaaagaacttcttgatttctgccttaatttcattatttacctaggagtcatacaggagcaaattgttcaatttccatgtagttgtgtggttttgagtaagtctcttaaacttgagttctaatttgattgcactgttacgtgagagactgttatgatttcagtttctttgcatttgctgaggagtgttttacttccaattatgtgatcgattttagagcaagcgccatgtgacacccagaagaatgtatactctgttgttttggggtaaagagttctatagatattgtattcg

SEQ ID NO: 47954 - DNA, 1128 bp, Homo sapiens
tactttgcccatttttgaatagagttgtttggtttttgcttgttaatttgtttaagttcattatggattttagatattaggtctttgtcagatgcatagtttgcaaatattttctcccattctgtaagttgtctgattattctgtcaatagttttttgtttgtttgtttttgttttactggtttgtttttcctgtggagaagccctttagtttaattaggtcctgcttatcaatttttatttttgttgcaattgtttttggagtcttcataataaaatctttgccacggcctacatccagaatggcattttctacggtttcttcttgaggttttatagttttaggttttatttgtatttttttaatctaatttaatttattttacgttctgggatacatatgcgggacgtgcaggtttgttacatatgtaaatgtttgccatggtggtttgctgcacctatcaacccatcacctaggtattaagcctcacatgcattacctatttatcctgatgctcttccttcccccgcaccctcacaccaacacaccccagtgtgtggtgttcccctccctggtgtgaggtgtcccccctcattgttcagctcccacttaaaagtgagaacatgcagtgtttggttttctgttcctttgttagtttgctgaggataatggcttccagctccatccacgtctctgcaaaggacatgatctcattctttttgtggctgtatagtattccatggtttatatgtaccacattttctttttccagtctattattgatggccacttgggttgattccatgtctttgctattgtgaatagtgctgcagtgaacatacatgtacatgtatcttcataatagaatgacttatatttctttgggtatatacccagtaatgggattgctgggtcaaatggatttctggttccaggtctttaaggaatcaccacactgtcttccacaatggttgaactagtttacattcctaccaacagcgtaaaagtgttcccgtttctcctcagccttgccagtatctgttatttcttgactgtttaataatcaccattgtgactggcatgagatgatatctcattgtggttttgatatgcatttctctaatggtc

SEQ ID NO: 47955 - DNA, 1020 bp, Homo sapiens
tctttaacattttcccctcttcggtcacacactcagttaactgggagtgtggccaactattaaatgttactctcagtcaccacatactgttttcttctcccacgctcatctaaagattgcatactgaaattatcataggttattttcttatgatttgagttcatatagtttctgcccttcaattctcatggagatcatccaatgatttagtggctgctgacaagcatgtaagcctcttgaaagaatataatgtacaggggatattgtcaatatgactaataggagggtaataccaggagtttgagaaataccccaaagccaaggtcccccagagtcaagttttaaccactaacggataaactgattgggctttcccaattaggtggaatacttggattttatcttttaggtctccagattctgggcttacaattccttgtttatggacataaaaacagcatctttctccagtaagcgcacaagctcttccttgttgagtagttagggtatcaagaacttttctgttttgaagtacagaaggtcctcaacttatgatggttggactcatgatttttccacttaatgatggtgcaaaagagatatgtttcactaggctccttgacttaagataggattatgtcccaataagcccgtggtaaattaaaactacaagtctagaatgtgctgtcaacttaagatttttttttttacttatgatggccttatccagatgtagccgcattataggttggggagcatctgcactactgaggctaaactgctcattttagattttatcagttgaagagaatttaagataccattaaattattttgcaagagttgcagaaacattgataagtgatttttgtaattcaaacactcccatttgagggcagaattctctagtaagagaataagatccagaacttcttcatataatgaggttttgaggctaatgagaaacttatgggggcgggagggttctgtgtacaaatgatcctgttaagaatttgactat

SEQ ID NO: 47956 - DNA, 1099 bp, Homo sapiens
cagtttcttatctgcaacctaagtcttccgcctgatcctgtgattgtaccctctagagccacacagaggacatcctctgtcagaagtaagggctttaaatatttggagacagggatcctgtatcccctaagtcttcttttctccaaaacagacatttcctggtttcttcaactattttttgtaaatctttctacatatgtttttaggacaacctcatttgccttctcttgagtatttaatgtcccctataaagtaaaatgtcaagtactgtatacaataactacaagagtagttaagcagttatagctctacatttcataacttgatattcgattttcattcattcagtgatcctaagattacacctttttgagttgaattagaatttcttactctttttcacggatcaagtggtgtgtgttagtgggcatgtgttgtctttggatgcccaccattgatttctctttctcctggtaactgcatcatgatttttccttggccagtgcttttctaccctcagtctctgtacccggagatagaaataataacccaggactaaacaatcgtgttccaatccctgtcaccaaagtgaccggatcttttgcttaagctattggggttgcaagtgttgatatgataaaagccttaaattactactgaaggaagccaacatggaggaaagcggaactgagcaacacggggagaaaaatgaagtctttgtgacatcatttgagtccagcttccttgtgcctaaacctggctttaacctgtacttttcagtttgacaaaaataaaaccagatcaagttggaacaatttagaagtttttaaaatacaggccatgatctggggaacttcaaactgaaagcattaagaagctcagcccacagcagttacagcacagtttattaagtgagaatgagaaagaacattattccctatcatgatgggctacttgaaacttatcttttcaagccgctgtgctctataagcttacctattgatagctaattagctggaaattgtaaggtcatgctgacctgggaaagcttaaattgtgtttatggttacagctagtattacaggggaatcaggacagt

SEQ ID NO: 47957 - DNA, 2020 bp, Homo sapiens
tcaatagtcagtgtgcagattttaattaacctacctgctttcagcacagtgcctctccctcatgccctctcatatctggggccccctagtcttgagaaaatgagtcaacataagttcacaaagcacttcctcagcctgctgccagggttgggagtggtggtcaagcagtttgggccaatccccctgttttccattccaaggcttaccccagcattctccagtacctggcacctctagctgctggaattttctggtctaccatggtgagaattgactcgttcctctccatgcactaggtattccgctttcacagttctgccgccttctctactgcttcctgttcttccagatacttggtgctatctctcacccactgtggcttctcctctgtttactttgttcctgtgaatttatacaattttatttttctagtcttatcttactctttctgaaaggaacagagataaactcaacaatgcaccatttttaagcagaaatccacaaatggctttaaacaaactgaaaacaacctacctggcttcatggtggtcttcttttccatggatgaatttagcggatctgagaatgtcatttatttgaaaattcagcttgtcgtattttcagtttgcatcaaaccctgcttctcctaggaatcagctgatgttagaaggaaggagaactccattctccctttatgtctgctgtaataagcacttgcataacagaataaaggcctcttagaggaaatggcttcctacctgaccaaactcaaaagatttgctcttgaaaacatgagatggcacttctgtttctatatcagtgaaaatttgaaaaagttacgtcttaattttagcagattagtcacttttaagtctggcaaatttatggatatatgtatttagaataatggttaagagaacacaagatcacaaaacagcagcagttagtagggagcccataatcaaactatttctgccaaaattaatgacctaaacaaacataaaaatttgagacttgagctcgtcttaccttttgatagtgcttaacgtaaggaaactaagtttatgatcatcttcatcttttctgaacctaaaaacaccaccatccaagtgccccaggtcccctaacttcttccccagatgcattagtaaattttttttggagacagagtcttgctctgtcgcccaggctggagtgcagtggcgccatcttggctcactgcaagctccgcctcctgggttcacgccattctcctgcctccgcctcctgagtagctgggactacaggcgcccaccaccacgcctggctaatctttttttatttttggtagagacggggtttcaccgtgttagccaggatggtctcgatctgacctcgtgatccccccgcctcagcctcccaaagtgctgggattacagccgtgagccaccgcgcctggccgcattagtaaattttttaatgaatggccttaactaggagatacagtatgccctttggattgtgtgtcttttatgaatagtaactaaatggctgctctgccttccacagtgtgcagacagacactgattgctatgtatgtttgtaccgatgatgatgccctggatgataccacagataacagcctatgaaagaacagtgtttggaatatttttcatcagaatgttttatccagtttttaaacatgggctcatgcccgtggctgaatgtaagtggacagacagagctgcaaaaatgtgggaatgagaaattttggtctgtgctctttttcttagggagttaattgtaccttgggaggaaatgattagctcttagttgtgcttgatatgtgataactacttgagggaaaggtgagaggagtctggtaaggtcatgggaatcatctgactttgagctcttgatgactataattaaacataatgactaattcagatatcttaaaatgacttccagatgcttgacaacagactttccttttagatgaaaatcctcttgcatttaaaacttaggttcttattgatat

SEQ ID NO: 47958 - DNA, 1022 bp, Homo sapiens
ccgagtccggagggcccatttcttaaatcagtgacggatttaggaaggagcctgaccagtgaaagttggaagagagatggtattcctgggagggtttcttaggtctcttgggttgtagagagtccccttcctgcccgtcagctttggtatgtgcaggactaggcccagcctgcaagctagaagcctgacaggaaatagcaaatatgccgaggatggctgagcaaaggtttgtgaaaagagtctggaactttgatgatgttgagctgttgaataagttaactcctggagctgcgctagccgtggacttctggttatgtgagagaataaaccccagtttttcattttaggtcagttttgagttggatcttttgcaacttgcagccaaaagtatgctaacctggctgtctctaaataccaatttccacagtatccaacatgtcaagtcggcaagcatttccaccttctcctggagacacccctcctggctttcgggatgtcctgaagaactgctgctccttcaccatcatcatcgtctgccttcccttagtttctctcctatgaaaagtccatttctcagatcccatgcatctctcttgcttaacacccttttctcaacacggcacatcctctagtagcttcccgagaaagaatacattctaaagaccttgcaagtccgaatgtctttattctactctcaaacccagatgtctagtttagctggacatagaattctagtttaaaattaattttgcctcagaatttgaagatgctcgtcaatattgtctttagattgcaaagttgtagaagtttaatgtccagtgccatccttattctcaatcttcatatgcggcctttaagtctccagctttctcgtgtttcaggatcgtgtgcattggaaagtgttatgtatattttcttttccttctttatgctaggcacttggtgaaccattttagtcggaagagccagatcctttcatcctgcgagatgtttttccatggttttttttctgatttttttaa

SEQ ID NO: 47959 - DNA, 1030 bp, Homo sapiens
attgtgatgactttctttgggataggattgtgggaagaaacaagttggcaagactttcatgttacaaactgagtattttgacatgttccttgtgactttattacccttttgactccaatcaataatgattgtttttcattcttgtgacagagatgtgaggccatagaattggctgatgaataaagttgtttcacagaaatggaaacaggctgggatattgaaagtttgcttttgtttaatattttcacgacaactaaaatgtgcatagctgttccaaatggatttcaagagaaaccaaatttccttcatgatttgccagaattgtctgttaatttttttccaaagatgtatgccacttaaagttgctgttgaaaaagttttaattccttatgcttatcactttgattcccacaactgcttaacccacattcttaacgactttctcatacttagggcagctttccctgaatggcctgatttgccgatctctttcctgtaactgacaaacgttcaacaggttctgtgtattattaaactgtgtagctcgtgataaaattctggaatgctaattgcccttggatttttcccatcactcatccaccacaaaaacagttgcagtatgcagtgctttttaaaaataaccaggaaagcttagtgttgctaagcactctgttcagggcaccagacttcccaaaatgtcaggttgaaatcacagcctggtcagctgagctcttcgcctttcaaaatggatacgagctctttcttactactttcctaaataaacataaagtttcatccagtttacctttgcagtcaattgatatgcagacggtttgacagcaatggtcgctggaaagtaaataagtatactagccaattgctgtttgagggtgaataaatattgatgcatatttttaaagccattgtctttaaaatatacagaaaggtatgaataatacagtgaacatccagcctcccaccacctgacatgaaataaaacttgacaaatacagttcaagtttaagccctt

SEQ ID NO: 47960 - DNA, 1085 bp, Homo sapiens
tttccccctacattttacttttcacagctctgtacatattaatgagtaatctctttctcaaggtagcacttttcctctttaacacccttatttctttccttttcttttcctagttttgccagattttcccagagtcccttgcctcccattttacctttatccccatctccagttcatttggaagtcgtcccagcttctataacatgaacctcaataatctgacaatataagaatgatgctcttgtaataaggagacttctatttaaaacaatgaaattacatgtgtgtcaatattataatacacttaagagcttgaaagtgctaaaaagttcctttcaggatatccatatatcacttttcactacttcattctcctctaattaaattttcttttctttatgcatttaagataatttttctattgcagtataactggtttcctgtttcatttaattgatagtattacgatggcataattctctaattttttgtgtaaatggtggtttttgagatctacattatgggctaaatagctttcggtgggctgacctgataacttagctattgcatatagttgtgtttctgtatttaaaaggcattctgattttgaagttcctgactacttttcattttggatattttttttttctaatttaagaacatctctaagtgtccttagcttttttaattatagacttgaaatatctacattcgtttcacaagggaatatttacaatgcgctctattgttagtatattttcactttagagagtagtaaaatgaagtataatataaagtagtttgaaaagccagaataatgtgctgtggttttatttctctaagttaggttttagattatcatcttttcttggcaaaaactaactgccaagtaaatagtgagtttgaatttatggtaagaaatgaaattaaattccttcatggatactagtaagtttctccttccaattatcaacgtgcaaacaaacaaaaaaaacctctcctgctaatttcagctttatttgtaatactaaaatgttggaacaaacaaatgtctaactatgtgggattggttatgtaaataatag

SEQ ID NO: 47961 - DNA, 1058 bp, Homo sapiens
tttttttgataaggtatacactttctatgtaggtatgtatgtatgaaaggtggcattattccttaagttatccattatacaaatttgatgtgtgatttttattatactaactggtaaattaaacagataactgaattataaaaactgggaatagttgaaaactgttacaaaacaccaatttataatatcagttgtacatattaattttatactaaaaatattcatatttgaggttgttttgttaaggataaaaattctaaggtgatttttttttgttttgcgtttttttaaataagaaaattttcctttttaacaaaaggagtataaaaattaaaaaaaaagtaacttttgtatggaaaaatcacaaagtgatctcaccaagcccatattgattgatagtgcggtacttgtctaaatatacttctgctagtgtttattgtattaccttgaattgattattgaaaagtatatttaatttaaatccccgtctcaattgtactgaagatctgcttgactcacagtgaggttgtgattctcagtttacagtttcacatctgttactgtagtaaaattaacaaagttgaagtgccgtgaaacctatttaagatttcatatcatgtgcctcttgccaaatgtgagaaatgctaaccatagatttttgattgttttcactcctaaaaatcaagatttttttttttaggagatgccatgccattaaatgggatttaattgagtttatgtatatttttcttttactgtagaatcagagaaaagattgtatatgaacacaatctttaaagatttgttggtcaagactcaagccatttctttccaaacattgagcctatctgtaccatataagttcagtttttctcactgttctttagtgttcgacatataacctatagaatgactgatgcagcctactgtgcaatagtagcatatactgtggccgaaattcttgactgagaaatagtccgttgggtcactccttagggggctatcagtaagtgtaatgcatagtcaattaattcagttgatgtaaaactagctatgtt

SEQ ID NO: 47962 - DNA, 1050 bp, Homo sapiens
tgtgatctgtgtcacacagcaactctacctacaaagacaataaacgagctccatgctttgatttgtccatctgtaaacagagtaatactacctgtgtcatcaggttaatgggataaccaaatgaattcatataggtcaaggacttgcaatgctgagagttttcatcttctgctattctgtacaacaataaggactagatagagtatttgctttaaaaatgcacgcaccttctgtcatatatttttacaaaatagactagaagatgttaaccagggttatttctatggagttggatgtttggtaatttaaatgttccttttttctttaataaagtttattttactgtaaattttagatgaaaggaggatattcagctctttacaagtaatgctgcctaacagttgcatttaatcaataggggtttcttctccattgcttttgttagctttctccacttggttttgaccggctcctcaagactttgtaagctttgagttcagaacgtactgtaaacctttaacaagatgatctgagtagttctttagaggttcattaatatcttattttgctgttgattgtggcttagatagttattctcagtgtttgttctggctcagtcactgaatgtggccatcctgcaggggacaagtcactccagagcctcaggagatactgtattgattatttgttgccttcttgtttttttttttttttttggcacatagtagaaatatttatctctgagagtccacagatttcattactccttaggctagtttctgttgtagccacagaactttacagatgagaaagatccatatttgctggtttcagatttgacccaaggatatctttggttgtgcagatcaggatctaagggatttaaatggacagaatgctttctgacatcttggatcatctgaagaaaagaaccaggaatgaatggaggtaaggaagtaaaggaaagaacagtagtgatgaatgaaggcagttatggaaggatacaggggtttatagaaataattcctgactttgctgtggaacctgcct

SEQ ID NO: 47963 - DNA, 1043 bp, Homo sapiens
atctaggcactcaggccagatagtaaataattactaattatgtaggacctctcttctcatggggcttatcagagccttgttactcaaaaatacgattctctgaatagtatcgtcagtcaactatgagattgttagaaatgcagaatctcaggccccacccagatgtacagaatcagaatctccattgagatttcacatgattagtacaaatagtatagattgagaaacactgttctagagcagggtttggcagactatggccttggtgccaaatccgcctggctgcctatttttgtaaataatgttttattgggacagccatgcccatttgtttacatattatctatgactgctttcacaggcaatggggcatttgagtagctgtgacagggactctagcccacaaagcctaaaatatttactacttggccctttacagacttagtgtcccaccctttgttctagtccgtaaacaagtagcgtgacagatatttttacttatttgattgtgaaaatctttatggaataggcaatgtttgaacagttctgaaaaacattggtttaacacatttttagcctgtaatctacaatacaaatgaaatacagttgacccttgaacagtgtagtggtttggggtggcaacacccccacccaagcacagtcagaagctagctataacttttgactccctcagaacttaactattaataggcttgccaataacataaacagttgattaacacatattttctatgttatctgtattatgtactgtattcttacagtaaattaagctagagagaagaaaatgctaccaagaaaatcgtaaggaagaaaaaatatatttactattcattcaatgggagtagataatcataaaagtcttcatcctagttatcttcacattgagtaggatgagaaggaggaagagtaggggttggtcatgctgtcttggggaagtggaagaggcggaggaggtagaaggggaggcaggcacactttgtgtgactttatggaaatacagttgactcttgaacaacatg

SEQ ID NO: 47964 - DNA, 1042 bp, Homo sapiens
tcaaagtgcaatattttcctttcattaatgtggcagaaaacaactaaatatctacagcaagaatgtttttgacattttcatttgctgcttggaaaataatggatactatgaattgtgctataaaagaaaactgctaggattttgtcatttccatttcaacttcctaacaaaaacgtggattactcaatgagcaattttttttaaaaaaattaataggaagagttggctgcaggagttaccagaattgattgacattttgaggtgcttggcttgtaggagattcttagggagtttattggctcaggcttcttgcttgtcacatctccttccctgtatgtctgagtaatagaattccagttgggtgtgatcgtttcctatcctttctgtcttctcaagttcatttttatcccaaatattgcacagcattttgctctcttctcctgtttcttttgggttaaagaagtatttatttcaattagttcatgcgaaggattgttaactttttacttttaaaaatgtacttagggccagccaactggcatgtagtattttgaataattttggaactaagtgtccattgatgacaaatgttttgctggaggaattactgaagtatttattcattttaaggtatattagttttgacataaatactcttatctgttgatagtgtttatctttttactaaaaatataatgcttttataatcatacctttgattgctagactctagttattaaaaacttgaagatcactcaaaatttttccctcctgcaattttgacacactttctgggctatattcttgcttctgtatgttcttttataaactggatatgtttagttagaaaaatactggttgtaattaccagaaacccatttcagcctatctgaaaatggaaatctagaaggatattgggataacttctgaaatcacaaagaacaacttggcttcatgaagaattgtaatttgccataggtaaagctgttaggaacataggtaatactcttcccatcttttatgcttgcttctatctagatgt

SEQ ID NO: 47965 - DNA, 1035 bp, Homo sapiens
tctctcttctcattacttgaggcttgatttactcttgtactgatttctcagggtggaagcagaggctattaagttaagacctttcttattttctaatatagatatttagtagtataaatttccctataagtactgttttagtggcttactacaaatttttatttttattttttttaatttcgttcagtttaaaatactttctaatccccgtttttgtttcttctttgaccctttggtttatttagaagtttcatacttatctccaaaatatttggggatattctagagacctttctgttactgttttctaattcagttcaattgtgagcagataacatactgttatagcttgaatcattttaaatttcagacttgttttatggccagaatattataaatcttggtttctgtcagtttttgattcatatattttgagctctgttatttggtgcataatcatttaaaattattatgtcgtcttgatgaattgatcactttatcattatgaaattattctctgtattcctaataatagttctgttctgaaatcaactttctttctgatacagtatagccactctagatttcttttgactggtattagtgtggtatatctttttctgtccttttgcttttaacttatatgtgtctatatttaatgtatatttctcacaggcagcatgttgttgtgtcttgcttttttaggagtctattaacctctgccttttaatttttaattggagtatttagatcattggcatttactactattatttttgatatggttccttttgtcatcttgccatttgttctttctttgtcccatctgttctttctttttctttttctaccttctttctgtttttacaccatatttttcatggtttctagaccctttaagcatctctgttgtcctcttgacctagctccaatttatttaaagatagatatagacttactgtatcaagttcttcaagactgaagtctaatgtcgtgtaagtatttttgactgaggatttgtacaggtcatttcgt

SEQ ID NO: 47966 - DNA, 1053 bp, Homo sapiens
gagacagggtgtcgctcagttgcccaggctggagtgcagtggtgtgataatagctcactgcagcctcagtaattgtagcttcaatctcttgggctcaaacgatcctcctgcctcagcctctggagtggctgggactacagatatgcacttccacacctggctaatttttttcctttttagtagagacaaggtcttgccatgttgcccaggctggtcttgaactcctgagctcaggagctccttggcctccccagttcctgggattaaggcatggggcactgtgcctggccaattttccgtatgttagtttaactgtaaagaatagtcttttaaatcaatgtgaatagaaaagtgtcaaataaactgatagtgtacagttgtaattagaaagaagcacagcaccaatgaggaaaagaaccaggcaggtaaaaactgagggaagggtaaatgaaaccatctctaataaataagcaaacatgactagtgcatagaaaaactgtgtgaggcagagaagctccaagagctctgggatgaaaatagctggaaatcctcaagagggatggagcttagtgtagagatggggaagtaattttgaaatgttgagacctatgcttgaagagcctagaaacaatgatcttggacacgacagaaggaaattaagtgtctacagtatgctaggtgttgctctcctatgtattaatatgatatcatttaattcttacctctattctttgagggagggtattattagcaacaatttgacagatggaaaaaatgaggtacagagggggttgaaaacatgctgcaagtcacatagcaactaattgggggtaaactcaaagggcctgatttttaattttaaagtagtttggggataaagataatagacaaaaccaacaaggtgtagcataggtgcaaattcttagggcctaggtcacccatcagtacttctttggagttttctgggttgaattggttaaaagaaaagagttgaaaattgttacatttagatttaggtagtttattgcagtttaaaaatgtgggttatggctg

SEQ ID NO: 47967 - DNA, 1026 bp, Homo sapiens
gttccaaagaaaataataggaaaataatattttatcattgacccagtaaaaacaagtgcaaaacaaatttatgttcacaatcaagaataatgacctttctgcactttttagaacccagtattgagagatttcgtagtttatatattgactttatctttgacttattgaaaatattgttttcatccttattgggtgtcctggaaaaatacccaagttgatccttaaatttgaaaaaagaaaattcagaacgaagtatttctagattctaatggtactagactagaaaatagaagattggtaggtaaagaaaataatgtatatgaaatagtatatgaacacagaagcataacgtatttgtgttcctacattgaacacaaattcagtatgcattttctgtctttttgcagcagttcaactttggacatgtatttctttctttctctttttgttaaataaatgaacagaatttatcccttgatcatctgtaacatagtttcattgtaaccaatagtctgggctttcacttgaatgtttttttaatgaatttatctggagatgctttgcatttttctaaattttggctacactaattagagagtgggtattacgaaaaactgacaggcagttttaaaaaatattaaatgaattggttttgaaaagggatacaactatgtagttttacatttttcaacttgtttttacattgccctttagaatgtttaatattttgtaatgaaagtatgcggtttttcttcttttttttcttttttcttttttttttttttttcaaaaggaaaacaatcgggtaaaaatctgagaaatattttcagttgtccaaggctaatgttgacttaaataggtctaggtcttcatggttgacagctgcagataattagctttttctttcttaacaaagaaagcaaatggagctgcaagacattcattgccttttctgtcatcaaaataataatgtatgtatttaactcctgcagttccttaaattgatttagtgctaagctgcctaca

SEQ ID NO: 47968 - DNA, 1808 bp, Homo sapiens
acctatgtctttatactataatttagattaggacctaatgaaggggcaagaagctggtttactaaataagatcattcagtaatcgcagtgcatttggtagaaagattctgaagaagtgaagacagaattctaggcagtactgctgtctgttctataaattggatgtaaggagaaggctgatttataattcaacaaactcccaaattaggcatccctttttcccccttgctgggatttaaggaggattttttctaataactagccaccttattcttgatcattcaaaatctgggtgagaattttcttaaaagtcttagacagatatattttaaacgtaattctatattgggaacataagtgattatgccacacataggcataaacaatgctttcatgagttcaattatacttaatgaatttcacacttagagagacaagtttaagcagggtaggcatagaaatgtttcaaagatatgttgaagccaaacttgtaattgacagtcagatatagtgacaaaagaaacactagacttggaattaggagacctctgtttgagacttggctttaccattactctgtaaggatccttgagcaagtgatttaaattctccaagactcagttatttgtaaaatgatgccagaatgatattacttgccttattttattgcagggttgttctgaggacaaagttagggaacaggtgacaaaggtacagtgatgtacaaatggatgctgttattatggcagcatctaatatatataagggtaaatgtcctgagctgtgagtgggacagatttgcctttagaattgctctgctgtttagtaatttggtgctttgggccaaagcaccacaatctttttgaatttcagtactctcatctgtataaaataatcaacatcacagatttgtgagaattacattaatgtagatactatatttaaatttttgtaaaatagtgatggggtaggagttattatcttgaacagatttcagaaagttagaaaagaaatagccagagattttttatctgttcccaaacatcttaataagataaattactcatagaatgttagaatgctagaagagccctgtgaaggtcatctatcttatcctgctcatttaaagacaaggatcacctcctaatacttttgtcagttgtactctgtttatatgcatagatgataacatctcaccagcatcatcaattgtaaaggatagcaactgtctctcaatcacaatagatacagatttctgaaaatgtaaagccatgtcagagaagaactctggagctagtatcgggctgtgaaaagaatttgggctttggcccggtgcggtggctcactgcctgtaatcccagcactctgggaggccgaggcgggcggatcacgaggtcaggagatcgagaccatccttgctaacatggtgaaaccccgtctctactaaaaaaaaaaaagaaaaaaagaaaaaattagccgggtgtggtggtgggcacctgtagtcccagctactcgggaggctaaggcaggagaatggcgtgaacccggtaggcggagcttgtagtgagtcaagatcgcaccactgcactccagcctgggcgacagagtgagactccgtctcaaaaaaaaaaaaaaggaaaaagaaaaaaagaaaagaatctgggctttgttgtgaaaagttgagatggaatcttgccctgtcagttactagtttgtgacagtgaaatatttacttagtattttgtggccacatagctatgctgtttttttgttgttgttttaacctaccattgttgttttaacttacc

SEQ ID NO: 47969 - DNA, 1035 bp, Homo sapiens
tttactggtccaggtatgacttcttggaagccaggcttacaaataaaaacaagatcctaaaaaaaaaaaaaaaaaaagttctagcagagaactcggtggccacacactacggggaatacaggatctgtaaaattcgttcatgaaagtactaaagaatcagcatcaagaaaaacaacacactgatgattaaaaaatttaggggaataatgtggagcaatctgatatgagatttgttaaaatatattacctaaaatgttcagttttaacaaaaattgagaaatgcaaagaaacaggaaataaaacacacagagacaaataataaaaaacgaacaaaaaaagtccctgtgggagcctagattttagactttgtagtctttaagttagctattacaaatacattcaaagaactaaatgaaaccatgtctaaagaattaaagggaagcatcagaatggtgtttcaccagagaaagagtatcaataaagatagaaattattaaaaaacaaggaagttctggagcttaaaagtataataactgaaatgaaaaattcactagaggagctcaacaacagatataaattggcaaatgaaggaatcttttaactcgaagttaggtcaatagagattgttcaatgtgaggatcagaaagaaaaatgaacagagtctcaaaagacttatgtgactccattaaatgttgtgccaacatggacattataggattcccagaagatgagaatgaggcagaaagaatatttaaaaaaaaatggcagaaaactttccaaacttgctgaaaaatattactctgtgctacacatccaagaagctcactgtaatccaagttgaataagcccaaagtgatccatacctagacccatcatagttgaatttaaagaaaaatcttgaaagtagcaggagaaaaatgacttgttacaaggaatcctcaataggcttaatagctgacttacgagaaaccctggaggctagaagacattttcaacattgaaagtaaaagactgtcaaccagtaattctctattt

SEQ ID NO: 47970 - DNA, 1438 bp, Homo sapiens
catctttctctctttgaacttatacaattatatatacaatatttatttttaatctaggtttctatcctgaaaggccggttcaatgattatacttgcaaatatgcccaggcatttatgtctgaagtgagtcagctgtgcacacattttctcaagctgtgggccagagtctgttgaagacgagtacctggttatttctgacattaaaaaagtaaaaaattaagcaaaatttagtatctccacttgtttgtaccaccgttgtgtttatgaaaagatatgtgaggtataagagactttggtgaccaatgagtcttctctcatgtttttcctcgtaactcttttgattaggaaacatctaagcatattacagcatagagcagtttgatgaaatgatgaagtgaatttccatgtatccatcactctcctttaaagttaacaacttatggttaatctggttccagctataatcatttattccccacctatcttattattcccattgctttttacctttggaaagagaaccgacatagatgactcagggctaacattcacattgccagtccattgctctgccttgtatgttgtgttatctaccctgtggatggaagggtgaggaaaaaaaaatcgtgaaaataatgaaagtttctaaacaagtgttaaatttaatattttgaattgtgaagtgtcatatgtctgatgttagatttagagttggaattgaatactgtataatttttcaaatttagtgttgactgcacaaagactgaaagttctgtgagatggtattatttacctctttattaagatggcttttatgtttttgaaagattttctgtgtatttttctttcactaaaaattgtgaaatatataagtgagtttttggcattcataatatgatgtggctgaaattatcctttggatttatagaatgtacttcaaggtaccttttcattatcctcaattattgatttcaaaaatcagctcatttcagtatctcaagtttttagatatataaaggtgaatggtagtagttaaaaagtgaaagtgatttttttttttttcttttgagacagagtcttgctgtgtctcccaggctggagtgcagtgcgtgatgtgggctcactgcaagctccgcctcccgggttcacaccattctcctgcctcagcttctcgagtagctgggactacaggcgcccgccactacgcccggctaattttttgtatttttttttttttagtggagacggggtttcactgtgttagcaagaatggtctcgatctcctgacctcgtgatccgcccgcctcggcctcccagagtgctgggattacaggcgtgagccaccgcgcctggccgaaagtgatttttgatagaagttagaaaacgtgtttaactgaggttactcttatagtcagttctaatcagtatcacattcctg

SEQ ID NO: 47971 - DNA, 1083 bp, Homo sapiens
ggaattactacagtagtgagatccatgtttgcatttgtgatattttaattagggttgcactatgcgaaggtatgattatctgcctttatgtctgctacagagactttaccctgaaaaacctttttttttaaaaaaaaaaaaacagttgtccttcataaatctatccagccctcattttaattagtgtatattcattgtataccatctctcgagatgatgagttgctgaatttagtgccgtttgtgaagtcatcttaacctctttccagacttaaggagtgctcttcaatttctgtaagttttaatatacatgctcatttcactttttaaaaattatttcattcatttcttgagcaaatattggcacataaagtaggggccaagaagtgaactgctgtgaaggatacaagaatgaataaaactgatcattcttcaagggcctctgcccttgaaggaactcacattcaaacaattgggggtgagggagagagaagataaatgagtatgtattataatagatggttgtcaatgctatggaaaaaacaaatgtgagaagcaggggggtagagagtgtaaatgatatgtaaatgatgggggtggagaaggttgtaattttaaataggatgattaagaacaccttgcagataaggtaacatttgaacaaagacctgaaggaagttttgaatatgtcttcaaatgtggctttgtatatttataatataatattgatactttggtagctgctggccttcctgttaaagagtcctaatttttacatctgtcctcacacagcactttctgcctttctctttacccccttttatcatttttatatgcctttccctgaatattttattttatattttatataaatataaaatattttattttatattttatataaatataaaatattttattttatattttatataaatataaagtattttattttatattatataaatataaaatattttatatttatataaatataaaatattttatttatataaaatataaatatacattaatatatatttatatatatataaatataaaaatgtatatattcatatatata

SEQ ID NO: 47972 - DNA, 1049 bp, Homo sapiens
caacatatatactgactcataaattagaatggaaaatacaaatattgaaagtgtaattcaaatgaatagaaagtgctaaatacttgcaagccttaaattgggatttgaatatagagattgagttaccagagtaactaaatactagactgctgtatttgttggatgtgcagagaaggaaactcaaatatggaacgtggtcttaatgtcttatgaatcatttttacttaacttttaaaattcagattaatagagtcctctaaaaagaaggtttttttgaatttttagaaatagctcagagttttacgtttccctctgtcagaatcttttcaggattcctcattgcctcttcgtcagagtcgtttaagaaatatttattagttatcacagtgtcccacagaacaaccacagtctttgctgttaggaagcttatagtctcatgtccattttcaaacttgtatttcaccacttttctctgtacttccccttttttgaccagtctacatttcgtatctgtgggatctgcatttgtgaattcaaccagctgaggatgggaaacacttgaaaaaagaaaacaatatataacaacacaacaataaaaaaagtaaatacagtataacaactttatatagcacttacattgtattaggaattataattaatctagagatgatttaaagtatacacgggaggatgtgtacaggctatacacaaatactatgctattttatataagagagttgggcacccttttttaagatggaggtcctggaaccaattccccatggttacggagggacaactgtattatgtattggttaagagcatgaacttcaaaatgaacagccctgggtgtgaattcgagctctgccactgactagcagtttaatgttaggcagattacttaaattctgtgaaataggattaataaaatcaacctgaaaagattgtttcaaagacagtatatgacatagtcaaaatagcactgtgcctgacatgtgagtgtttaataaatggcaattgctattattatcctatatggtctgaattct

SEQ ID NO: 47973 - DNA, 1048 bp, Homo sapiens
ttcaccattctccccactcccgttaagtgtttagttatatgaccccctttgcgttatttttgtagataattagccccaacatatcaattagactgactctcagcttagccacctcctctgcttcctttcgccagtgaatttgacacagatttaaaaggaacttttgggaaaagtttaggaaatgtgatttggatggtcaggttatgcagtcatacattacttaatgatatggatatgttctgagaattacgtagttaggtgatttcatcattgtgtgaacatcatagagtgtacccaacacacacctagatggtatagcctgctacacgcctatgctatatagtatagcatattgttctcgtctataaacctgcgtagcatgttattggactgaatactgtaggcacttgtaactcagagataagtatttgtgtatctgaacatatctaaacgtagaaaaggtaatgcattgtgtcaagatgtttagttggttatgatgtcactgggctataggaatttttgagctccattttgttatgggatgtggtttgttgttgacagaaatgttatgtggtgcgtgactgtatggttattcttaccatttccgatagtctattattatcttacaatttctactcatctgactgtcctcttggacaaatttataaccttgttccactaactatgtaatttgagtgtggttttgattcagaaggctcccttcttagtcctggctatgtactggcctctggctaagtaccttagggttaaatctgtagtccataaacactgtgtttgcacaatcacagatgcctgctgttgttgacttttaattcctggattctcctttctcacttttattagaagcagtaatacccagctagtactgcttgcctttgctttagagtgcttggtcaagatttctgaaggttcttggtaattcctgtttaggcaaaaatgaggtattgggtaataggagttgagcttaggaaaactaatagagtgagacagctgtcctcaaaataatagtgtgttagttggtaagagg

SEQ ID NO: 47974 - DNA, 1041 bp, Homo sapiens
aaaaaactttttcaattcatttccttgtgattgctattttaaatgaagacgatattttgttctgaaagaagtctttctcagagcactcagatttgtttataattattcctcctctccccaaactgggttccatgcaaatctctaatactaacttgtatttttttttctgttcagatgagtgtcaaatgcctgaacacttttggatggtgaagctcctgggtcctataaactctctctgaagttaataggagttttgctgtcttgggacagtttcagaccttatgccatttacataataggttttcagttaagtaaattatatactataatgttatggtttaatattttatttacagtgtctgagaactttttttgaggcatttcactcatgtatagctcaggttttctgtgatttagattttcattcacaagttgatttgagagcagaacttaaattgaatttcattacttttccattttttgaagcatatatgtgggataaaattgctattagagctgctgtggaattgattaaataatcagaaacactgagaaatggtaaatttaaaaattaaacacaaggatagatacttagcatttactttattctttcttaatatttttcctagaagggactatgttatgtattgatactctcttgtgttttcagtttttatactaatagaaatttgtaaaagtgatcatgctttgaaactaaaactattaaatagaagtcacttgtaacttgttttgaatagtcaaatgtctgtgattcaatgtatgtcataatgcctaactcagtcgttttggtgtgttttgcctatgaattgtattaaatggtgtaggcatcatacatatacacatatatggcaaactaatgaatttctagaagttttgcatcgtttcacaatgttttcattaaaggttgtagtgatggttagttttttttgtattattcctccagtactcaaatagtcttgtactctgctttggtactcaaataaaaggttatagtttataagcttactgtgctttaacctg

SEQ ID NO: 47975 - DNA, 1064 bp, Homo sapiens
ctgtagtcccagctattcgggaggctgaggcaggagaatcgcttgaacctgggaggcaaaggttgcagtgagccgagatcacgccactgcactccagcctgggcactgagcgagactctgtctcaaaaaaaaaaaaaaaaaaagaaaagaaaagaaagaaatagaaaagaagtagggtaaaggaaactcctattgtttgacagcctcctgtgtgcatttaagcaccatagaaaccttaggagagatttcttattttcattttcaagcatgacagttgtgaaactgtggccctcagagtattttatttcatattgctattttttttatgtccaagatcacacaattggtagttaacggaactaagtttagaatagagttatttgtatctgacttcaaacaggcaacaatacccttagctccatgtcctgctggagattttcttagttcaggaacatttcttttctctttaagataaccttcactatttacaatttttgagcaccataatttccttaaaaagcattacctcacactcatgtcctactactgcccagaaacactgaaaataaaaggtattggcttttgctattataaatcatttcacctgataccaattttgaagacaaaatatgaaaaaattctgtccctgtgtcttactcttttccagtattccagcatgacaggcaaggtatgttctagacacaggcaaatttagaaatatagaaatatcatctgctggagaataattgatccttgttatatgtctgatcatatttctggctagtcatcttcagaacatcagatttaattaaatgtagtaactaattaaaggacagagtgtgtgattgaattcctggaaaattagaaaagaaaatttcagataggtagaattctcttcatttgttcctttttgggggggtaacgtcttgaccttttgttaaatacagtgcaaagagaatgtaattaatgcaagtgtgttttgtacgcccagtaatagatttttttcattgaaacataacttttataagatgcttctgttattactagctgtcaggcgaaaatta

SEQ ID NO: 47976 - DNA, 1079 bp, Homo sapiens
tttaagctgcttaacgtctgtagtggctcttcctctgggaagtggatgcactggtttttgggaggttggggatgtgggatgtcacgggccaccagagaacccaaatttccttacaggcatcaccaacagctacactgtcacagagagctgaagatgcccaaaggataccacatttttgctctatttccatataagaaaccagagacacctgtaatcccagcactttgggaggctgaggcaggaggatcacacgaggtcaggagtttgagaccagcctggccaacatggcaaaaccccgtctctacttaaaatacaaaaattagctgggcgtggtggcgggcacctgtaatcccagctactctggaaaccgaggcaggagaattacttgaacccagaaggttgaggttgcagtgagctgagattgtgccgttgcactccagcctggatgataagagcaaaacactgtctcaaaaaaaaaaaaaaaaaaaaaaaagaaaaagaaaaaaaagaaaccagagatatgtgaagatctaagatgtgaacaaatagaaggcaaagatcaagagagatggtggctagggtccaccggtccccacatttcctggcagctcataaaagaacatagtggttttcacaaaaatgtatggaagaatgtttttacacactagtccaacagaaacatgaatcacagtgtcctcaagaaattgcttgaatatctaaaaagcaccaaggaaaagtttatgtgcccagtgtcctttacaaaattattggaaggaagttagaaatgatcattgactgttttttttgtgtgtgtgggtctatttttttcccctgatacaggtaaaaaaagacatataaccatcaccgaaaagaatctggtttgctagatgttctatattggttcttcaaaatgtacattgactacttttaaccacactcttccaatacctaatagaaattcatcggtttgtttattcaccaggcatttattgatgttgctcatgccaggcattttggtgcctgctgtagagacatctgagctatggaaaacactgccccatacttgcattgtttgcagc

SEQ ID NO: 47977 - DNA, 1052 bp, Homo sapiens
tgtcttcagctctggctctctttctgccatagctgcagtggggtagtaacttcgataggactaagaatccactgcggtctgccccttttatttttagcccctctactggtctttatttctcctggagatcagcagttgatactcaaacgcaaggagtagggagggattttggcatcaagaatgagtcctccaaacggctttcctgaagttcctcctggtatatcacccacagttcttctcacacctctgttctatgaacaactagtaatcactatggtgggaattaatttgggagtcaaagttcaaggaaaaaattctcaggtaatgcgccgtttgctgggcacctatttagtaggtgagtctcagggcttaaggctgcaggtcttcacagtagcctctctgtttttcctctagcactcttggagtctcagggagaaaactgttttctggtttgagtcttatatcctcccattttggctactgatagaaaccgttaccaatttgggctgagttctctacttctttcacaacaggagtcttgctttcaattcaagttgtcaatcatttttcaaaaacccactctttatttatacatctgtttatttatatcctatcttgttctacagaaattaaggggagcagagaatagtaaaactacaagtataaagtagaaaataaagattagagaggattgaaattagagtagggcaaggcctgagagaaaaaaaaaagagatttgatttctgtgttcttagccagaaaaaataaaacaaacaacaaaaacaaaatgtaaaacgcagtgcatcccagaatttttgttgctggtgaggagttaaaaaagtcttcaaacggtaaaggaaaatcctcacttggggcttttttcagatggtaattccctgtgaaaagcactgaggtcttaaagatgaccttgaatctttcagcctagcaaggaatcaggcaaactgaaacctacagagtaaactccaggcggctcaaggccaagtcatctggtataggagcatgtaggaaagaaggattcattgtgacagagg

SEQ ID NO: 47978 - DNA, 1045 bp, Homo sapiens
atcttatctccaatcttgctctctcctggagatagcaactggaagatttctgagcctgagttttggaatggctgagaagccgatccaatagctcagctaccagccaggcaggctttccaatagtttcaggccagaatctgaaggagacccagaagagcaacctgtaagtctcaaaatctggaagacaaagtagccaattaattcccccaaccataaagttttagagctggccagtatcttagaaatctcctctgctcggcaggttcctacatattcaacagggcatttttattgagccttatccaaggccctcaaggcttcataaaactgtgagttttatagtattcctgctaatcccatacatttattggaactaactctattggcctgacatgaacaagccacttacttttctgggccttagttctccatgggtagggcaagggggttacattacggttgatttttttaaatcccttatttttctgataccctttaatcagtggacagaccaggatttattgcccaagtgtgcattgcaagaaattgaatagacatattaaacacacacacacacacacacacatgcatacatgcatgcatgcatgcacaaaaaataacaaaaacctgtagtcaagaaagaaaaaaaatcccttgacagtgctctttttcgaggttttcactgtgtgactaggctctgtctccttacttggtcttctgaggccatttgtatgtacatgttgactgactgactttgcaggtgatgacaaatgggaatgtctcttgtgaaattcttgctctttgagccccaggattttctctaatatttatttttggtttctgattatacaggttatacttggtcattgtaaacaaaatagaaaatagctataaaggatataaattcactgctcaaacacattttaaaaaacatcattagccttttttctttgcctacataaaatatttctttgccctttttgccttttgcaacttggaagttataaatcttgttttttcattcagattaattttctaattaaat

SEQ ID NO: 47979 - DNA, 1054 bp, Homo sapiens
cccactgcttttgtggatgatgcaaatctggcacctttggggttcttaggatatgatctcaataaactgcctgtgtttatcagagtcaggatttaaccaggagatgtttttcatattgagcaattcagtgtgcttcacattcaacaacaatagcactgcacataccgatggttgtttttattctaaaatattttatcttggcaaaatattttggtcagtatgcgaagctggtaaaatctctggcattttgcattgaattacccataaattcctgagatctttaatcaaaaaagagggaggaagctggcggaggtggtcctaagagatgcctcctcccttcctctgccttctcactgaagggtgtgctggtgatttctaggatagagtgagaagaccatcagctgagcccaccccttcttgcccaggtgggcactgaggcccaggatttcacctaggcctgtgtgtttccctgttccttcttctaggatggacatcctgttatgttatagatcttcactcaagcagagactcactcatacttttttttactttgaatcctggaaaatattttccttttgactcttaatttatggtagaggcaatatcagttctctgtggcttctggtggcaggcagatggaagaaaggatgttctgccccaacaagttggagatgtgcagctcgccaaacctttagggccctaatgggaggaagatttctgtgaacagaagccctccccatggagtaaggagtgatttgcttccagcgtatctcaccctttgtttcctttccacctttgtttgtttgtttatttatttatttgagacagagtcgtgctctgttgcccaggctggagtgcagtggcacgatctcggctcactgccacctctgcctcctgggtccaagagattctcctgcctcagcctcccgagtagctgggattacaggcgcctgccactgtgcctggttaatttctgtatttttagtagagacggaattttgccatgttgcccaggctggtcttgagctccagggttcaagcaatccacctgcct

SEQ ID NO: 47980 - DNA, 1090 bp, Homo sapiens
actcacagaagaccttcgttccaaagaggacagacaggaggactgctggctattggaaagggtgctagtctagagccggtaggagtaactgggggtaaatgaattcttctgctctgtttggcacttaccaaaaggactaaatcactgcaagaaaccttctgaacataattccagcatggctgaatgactgagatcaagtcgttagaaacttaaagttgataaaagttgcattttgagtcttaagcggtggcacatgcatgagccttctgtctgtgcacatatttcaggagaccctccccaactttacccactcaatgactccccccatcagttttttttttttttttttgagacagagtctcactgtgtcgcccagcctggagtgcagtagtgcaatctcggatcactgcaacctccgcctcccgggttcaagcgattctcctgcctcagcctccggagtagctggaactacaggcaggtgccaccacgcccagcgattttttttaaatttttagtagagacagagtttcaccgggttagccaggatggtctcgatctcctggcctcgtgatccacccacctcggcctcccaaagtgtggggattacaggcgtgagccaccgcgcctggctccctcatcacatttttattaagtccagtgaggtgcagctttccttgcataactgaggcaggactgatgccatggagtgtatgtggcgatgcctttttgagtccttccaactctagggactcttagggagcaaagagcttggactaagaggtccatagtcagataaacctattttctgaaatagttgcatgaccttgagcaggtcacttaagctctttatattaacaataaacacacaaatacaagcatacctcattttattttgcttcagtttattgcactttgcagatactgtgtttttgacaaattgaaggtttgtagcaaacctgcatcgagtaagtgcattggcactattttttccaaacagtatgtgctcacttcatgtctctgtgtcacattttgataattctagtaatatttcaaacttttccgttgttattataatatctattacgaagat

SEQ ID NO: 47981 - DNA, 1047 bp, Homo sapiens
gctgtgagctggcttgatcttctttattgccaatgtttgggtaaacaatgtgaaaaagcctggagaaaataagagattatctcattggacaatattcattaaataatattcataaaaaccaatgaaacacaatttaaagttttatgtcaggggtccaaaagaacagaacttgaaaaacccgtttaagaactccaaatagctgctacaacaggccacatgcagttttgttttaggaaatgataggaggtaaaggatgagaccagctcttacatataactttagcaccatttcatatcaggtagctgccttgagtcagtagcagttagtggggatactgaactccagtctcagtttggaaaatgctttgctgcagtaatgggctatggcttctcaagcgattactcacggcttatgttttaagggagacattagacatcctgaaacaactgcagatgtcacttagggaaaatgcatggaaatggtagccgtataagaccatacctcttgagttgtgaaaatatcttaccttaaacaagatcctgagaagtctacttcctgtctacattcttgggaatatcagtggcctgtttcttcctctgggcagtgactaacttcatataagttgatttgtgtatgcaaaggctcttcattgctgatcagcaaaagcatcactaaccatttaaatgaaatagttatttaaaattgtgtttaatttgtttcttttgagactgggttatgagactggataatttttgtatttgtggtagagacagggtttcatcatgctgtccaggctggccttgaactacttgcctcagcctcccaaagtgctgggattacaggcatgagccaccgtgcctggcctgaaataggtattttaagagggtttattgcttcttagcctcatgaatgaaatgggtcctactcacaatggatgtttccttttctggcagatagaggaggtagaaacacagccgagaattacttttctctgattttatgtagtttgctaagacagtctgaaaaaataaaaataaataccggagg

SEQ ID NO: 47982 - DNA, 1031 bp, Homo sapiens
agctagaaaaactggcagaagtttcttagaacattctgtgatcatatttataccccgttatcatcactgccaaaaataaaaattgcaaactagatcactgccagtttataatcaggaagcactcaaaagtttacatatttcaaaataaaagattttttcttcatgcagtctgacatctagaccagcactgtccaatagaaatacaatccaagtcacaaatgtaatttaaagttttctattagccacgttaaaaagcaaaaagaaacagatgacattaataaattattttatttatcttaacatatccagcctattatcatttcaacatgtaagcaatacaaaacaattattaatattttactttttttggcactacatcattggaatctggtgtgtattttacacttacagcacatctcaattcggactagccacatttcaagcactcaatagcacatgtggctagtggctatcaagttggatagtgcagatctagaccagtcctctcaagtctcaagctcccagacaaaaccagtgtaggattttgagcaaatgactggaacataaagatagtcctaattaatttgtgagataaatgtaggctgtcttagaaccttagaacctaagtttaaagaaataattaaaagcagagacaaaatgaaaatattttctttgtgaccactgtgttaaagaagagacattaactttacaaaacaagaaatattactttgaacattccttctggaagaaaaaaaattattttcaatagttttgggatataaatgcagaacagaaaataacacaagatgcaccccttaaaacaatatatacagatatagcaaatgactcagataaagaatgatcccattgtggagggggagaaaaagtatatataaattagtacaggcacagagaaagtcgagaaagatatgactcactgttaaagtactgatagggctagtggcgatgtacacttatctgtgtgtgttactgactgctgtagcagaactagagctggtccagggaaaggc

SEQ ID NO: 47983 - DNA, 1108 bp, Homo sapiens
taagattgaagaccagtgcctttccgttttactttggtaaagtaaatgtcaaacaatatatatgatttggccacattccattattttattaaacaccagtttaaacacatccattaatgtaagataaaaaggaaagtatgttttttactactcttaagtgtcaagtaaaaatttagaagagaccgggtgtggtggctcatgtctgtaatcccagtattttggaaggttaaggcaggaggacagcttgagcccagaagttcgagaccagcctgggcaacacagtgagaccgtgtctctacaaaaaattagctggggatggtggcatgtgcctatagtcccagctacctgggaatctgaggcaggaggattgcttgagcccagaagttcaaggctgcagtgagcaatgattgcaccactgcactctagcctgagtgacagagcaggaccttatctctaaaaacaaacaaaagtttagactagtcaccagaagcagcctagctaaaatatcaagtcaagcatttgctattaaagttcaactgtttcaggaaaatttcatattttggttgcatttcagaagagtttagggtatttaagttaggactactgccacattgagagtttttttttaatataaaaatataattttatgtttataataggaaatgttcattgtagtacatgaaaaagaaaacggaaattatttataatttcaccacacaagtataaccaaagttaaacttttggtatacttccttttaacttctaattgtatatgttcaaatatatcctatgtgcagaagagcatgtaaaagatatgcgcacagtttattcagcaaaacccccactatttacccatagaaattaggatatggatcattactaggatcctagaaaccagttcccaagagcattccccctccctccctgaggttatcattattgtaacttttgtcttcttaattattcctttgctttttagttttactgcttatatatgtatccttcaacaatatattatttagttctgcctgtcactaaaaaaatactttataaaaaaatacaaaatacgaacattgatactagatatatccatttagcatctatctaa

SEQ ID NO: 47984 - DNA, 1035 bp, Homo sapiens
aataacatgaagaatcatgctgttaactgtgtgaaagatgtgggaattttaataatcattttctatatttagagatcaaacaagtctaattcttcaaagcttatgagaatggtttcacttcatattagatggtgaacaatccataatgaacttatattcaccctgtgtccccctcccgacccccttggctcacatagtgagcaaataattttcagataaatcaacttctcagaactatgcaattgtatatacatgtccattacagatgagagatggatggatttaagggttttgttaaaagtatgtttgctataatggcaaaattgaaatggaaagcccatgaaatggaaagcccaacctcaacccagacaagtacctcggttctgtcccacaccaatttaagaactgaaatacatgattgacttagaaaagtaaactgacatttcgttctcctctgaaaatacccaaaggttaacttcaggatcaccttgcctaaacctacagtcaacttttttcatcctgttagaaaatccacttactaaaacagattcatgttctttgggcagcatgttcattttcatttttagatgttgccaggctggagtgcagtggcgccatcttggctcactgcaacctctgcctcccggggttcaagcgattctcctgcctcagcctcctgagtaactgggactacagccacgcgccaccatgcccagctaatttttgtattttgggtagagacagggtttcaccatgttggccaggatggtctcgatctcctgacctcaggatccacccgcctcggcctcccaaagtgccgggattacaggcgtaagctactgcgcccggctgttcattcatttttaaaagggtaataatatgatatgccagtctgaaagaagaggaggacctgattttcctaaagagaagttataagagattgtgagctcattaggcaaaatttgaaagagctcactaatggtataattggaagagaatgttacccatctacctaagagtaataattttaaggca

SEQ ID NO: 47985 - DNA, 2080 bp, Homo sapiens
attttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaatcataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttttaaaagaaatataggaaacacttcattctttataaaactttctataatgccttatttgaatgttaatcttatgtgctttctaaaaaatgttgtgaaataccaaacttatggattatcactaggttatcaagcatatattagtctttatcagaataaaatgaaatttcataactgtggctattactttgttcttggtccttcacagggcctgctccatcccaccttcctttctgctgcctgatgtctcaatggcttctgaatgactgttctaataaatgatcttaaaacagtccataggctggtttcagtttatgcaatacttcatctcctgctatggtagccataccggccttcataatacccttaggggatttggaaatcaaagtgagcagtggaagaacatggctatgagaattaagactcttatttcctgtgaccattccctccccacccgcaaacacttagcccaaagttttgcacatacattcattactttaggaatgaatatgactgtaatacaacttttttctttatttttttttagacagggcctcactctgttgcccagactagagtgcagtggcataattgggtcactgtaacgttgaactcctgggctcacgcaattcttctacctcagcctcccaagtagctgaaactacaggtatgtaccaccatgcct

SEQ ID NO: 47986 - DNA, 1031 bp, Homo sapiens
gatcagggcagaacagtatcttgggcagaacacagactctggagccagaatacctaagttcaagtcccagctcaccatcttcaccttcaccttctgcttaacctctgcctgttttttcctctgtaaattggggaagagaataaaggtttgaaagattaatatgggtaactcttagaactgggcctgacgcatagaaagcactatagaaatgttagctattgttattgttgttgtaatagcgtatgtatgcagtagaaatctgaagcaatagtttccaaactgttatttatttatttattttagagacagggtctcactctgtcacccaggttggagtgcagtggttctttcatagttcactacagccttgaattcctgggctcaagcaattctcctgtctcagcctcccaagtagccaggactataggcccgtgccaccagacctggccaattaaaaaaattttttttagagctggggctcttgccatgttgcacgggctactcaaactcctggcttcaggcaaccctcctgcctcggcctcccaaaacattgggattacaggtacgagccaccatgcctggcctttcaaaccatcttaattttttctggagcataaaattacaaggttggcaaaccattttttgtagtagctgttactataattttgtcatttgtttaatgaggctggttctgaaaattaccgtctcttttgccctaggcaagctatttaacctccatgccacaaatcccttatttgtaaaatcaggcaatattaaatagcatctgctttatagggttgttaaaagaattaagtgagagatcctggaaagtcctacaacagccctggtgtctattaaatcattcattgtcagcaattattgttcactctcttgacactgtgctaggcccttggtccacatggacaattagatccagtccctgtcaggctccaagaagctatgtttgtgggtgaggtggggagctgggtaaacagtatttatcatacaatatgatatgtgcttatattaac

SEQ ID NO: 47987 - DNA, 1986 bp, Homo sapiens
tgcctcagcctcccaggtagctgggactacaggcatgcaccaccacacccagctaatttttgtattactagtagagacagggtttcaccattttggtcaggctggtctcgaactcctgacctcaagtgatgcgcctgcctcggcctcccaaagtgccgggattacaggcatgagccattgtgcctggcctaacacttgtttttaaaggcatatgttgttttattgtgcttcacaggtactgtatctttttttacaaatctaagttttgtggcaactctgtgtcaagcaaggctattggccccattttcccaacaagtacgcacttcccatttctattttacatttttagtaacttttgcaatatttaaaatattttcattattattatatctgttaaagtgatctgtgatcagtgatctttgatgttactattataattgttttggggtgccatgaactatacccatataagatggcaaacttaattgataaatgttatgtgtgttctgactgttccactaaccagccattcccttgtctctctctcctcgagcttccctattccctgagacacaacaatattgaaattaggccaactaataaccctacagtggcctctaagtgttcaagttaaaggaagagagtggcacatctctcactttaaatcaaaagctagaaatgattaagcttagtgaggaaggcatgctgaaaaccaagacaggctgaaaccaggcttcttgcaccagttagccaagttgtaagtgcaaaggaagaccttgaaggaaattaaaagtgctgctccagtaaacactggagcacaagaaagcaaaacaaccttgttgttgatatggagaaagcttgagtggtctagaaagaagatcagaccagccacatcatccattaagccaaagcccagtccagagcaaggccctaattctcttcatttcagtgaaggctgagagatgtgttgaagctgcagaataaaaatttgaagctagcagaggttggttcatgaggtttaaggaaagaagccgtctctataacaggaaagtgcaagtgctgatgtagaagctgcagcaaggtatccagaaaatctagctaagatcattgatgaaggtgtctacactaacagattttcaatgtaaacgaaacagccttctattggaaaaagatgccatctaggacttccattgctggagaagagaagtcaatgcttgacttcaaagcttcaaaggacaggctgactctcttgctagggactaatgcagctggtgactttaagttgaagccaatgctcatttaccattccaaaaatccgagggtcttgagaattatctaaatctaccctgcctgtgctctgtaaatggaatgacaaagcctggatgacagcacatcggtttatagcatggtttactgactatttgaagcccactgttgagaactattgttgagagaaaaagattcgtttgaaagtattactgctcattgacaatgcacctggtcacccaaaagctctgctggagatgtacacggaaattcatgttgttttcatgcctgctgacacaacatccattctgtagcccacgcatcaaggagtaatttcaactctcaagttttgttatttaaaaaacacatttcataaggttcagctgctatatagatagtgattcctctgatggatttgggcaaagtaaatagaaaaacttagggaaaggatgcgccattctagatgccaggaagaacactcatgattcaggaagaaggtcaaagtgtcaacattaacaggagtttggaagaagttgattccaaccctcatggatgactttaaggggttcaagccttcagtgtaggaagtaactacacatatggtggaaatagcaagagaactagaattagaagtgcagcctgaagatgtaactggattgctgcaatctcataaaacttgaatggatgaggagttgcttttaatgaatgagcaaagaacgt

SEQ ID NO: 47988 - DNA, 1054 bp, Homo sapiens
gagaccatgtctctaaaaaagaaaatcataagaaaagaaaatagatttactgtttgttaaatggaagtggatcgtcataaagatcttcatccccattgtcttcatgtcaagtagactgaggaggaggaggggtcagttttgttgcctaagagtggcagaggcagaggtagacccatgcggttcaaatccatgttgttcaagggtccactctagaatttttatgaggagtctgttaagatgtaatgttaaatgtaggtaatcaaatggataaaagtttaccatatctccagagaacatgctggttaagagtctttgcatataattttgggagggggtaaatatatttgaaatgtaatatgttaactgcttagactcagattagggagttaagtctttttttttttttaagtaagcttcaattgaagcattataggctccaggttttaataaatattgtggataaatgcttattgatatagaaagttcatgatatagacaccattaaatactgtgcagccataaaaatgaacaagattacgtcctttgcagggacatggatggagctggaggcctttatccttagcaaactaacgcaggaaaagaaaaccaaatacctcatgttctcacttataagtgggagctaaatgatgagaacacatggacgcatagagggaacaattcacactagggcctttcagaggatggaggtggggaggagggagaggatcaggaaaaataactaatgcatactagcttaatacctgggtgatgaaataatctgtacaacaaacccccatgacacaagttcacccatgtaacaaacctgcacatatatccctgaaattataatagaaattataaaacaacaacaagaacaataaaataaaaacactttacatttgagaaagaatgacaatatcagtaggtaaaaccaacatcaacagttacaagaccatccttccagccaagtaaggcagtcaaaagaggtgtagatctggtagcagaaactgggtccataattatcaaagtggaagttcacagagcaattataact

SEQ ID NO: 47989 - DNA, 1652 bp, Homo sapiens
ctgcactccagcctgggcaacacagtgagactctgtttccaaaaaaaaaaaaaaaatatatatatatacacatatactatgtatatatttatatatgtatatatatatttatatatgtatatatatttatatatgtatatatatttatatatgtatatatatttatatatgtatatatatatttatatatgtatatatatatttatatatgtatatatatatttatatatgtatatatatatttatatatgtatatatatttatatatatatttatatatatatatatttatatatgtatatatatatatggggtctcaccatgttggtccaggcttgtcatgaactcctagcctcaagtaatcctcccctctttagcctctcaaggtgttgggattacaggcatgagccacagtgcccaaccttttaaaaaattaatattttttctttaataatcaattttagaacatacccatcaccccataaaagaaacttcatacctattagccgtcacttctgttcctaccccacacccctccacctgagcctctggcaacaccaactcacctcctgtctcttttgagttttctgtactggacatttcatacaaatgcaatcatacaatatgtggtcttttctgactggcttctttcatttagcttagtgttttcaaggctcatccacactatagcatgtttactacttcattcttttttatcgctgaatacaattccattttatggatgggccatgttttatttatccattcataagttggtgaacatttgggttgttttctctttttctgttatcttatgggtgtaccatagtttgtttaaataacttaaagaacaattttaaaaaggtaagcctggtcatgaatactgtctcaaagaaagtaggcttttgctagattggtattttttaacaaaataagttaggccttttaaaattccatggctagaatctagtagaatccagggagcttgtctctccatctatccatctcttcatccatctgtccatctaaccattcattcaggcaactatccgtggatcctttaagcatcagatatgtgctaggtagtggagacacagagagcaactgatttcactaggtgctcacagagtgtgggcatgggagcaggagggcagatggacatgtgtgttagtcagctcaggctgccgtaacacaataccacacactagggggcttattttcttatagttctggaggctagaagtacaagaccaaggcactggtagagttggtttctggtgaggcccttcttcctggcctgtctagttgccttctcactttgttctcacatggcctttcctctgtaagcaggcaaccctgatgtctcctcctcctcttataaagacaccaggcttattggattagtgccctcccattatgacctcatttaatcttagttacctcctttaaagccctatttccaaatatagtcaccctgggggttaggttccaacatacagatttaggggagacatacttccatctataacaacatgtaaacacggtcattggagtgatatgtgtctcaatagagacaagtctgtgacatttggaagtccagagggggagcttccagttccctaggaggttgagggacacttgaccatgaaggg

SEQ ID NO: 47990 - DNA, 1066 bp, Homo sapiens
ggcgcttgtaatcctagctacttgggaggctgaggcaggagaatcacttgaaactgggaggcggaggttgcagcgagccgagatggcgccattgcattccagcctaggtgaaaagagcggaactctgtctcaaaaaaaaagatgtttaattttatcaaagttgtatagttattaaacatttttattggacgcgtatgttgttaactattgtttgttgtaataaatactgttatgactatccctgcacataaacatttggcaaatctttgcttatttccttcaaataaattcctagtatggaatttctacaaatatggtactatcaaataatacaacagaaggattgtgccaatttagtttccagtcattgtttcatgagggtgctatattttataacccatggctgtattttatagctaaggtttaaaatcatcacaggagatatgataaggacactggaaactttaggcaactcattgacagtagcaaagctggaataactgtaggtcatcactgaaacttggagtcagggaacttgaatctgaccttaagacatttagtccagtcctctcttttattgtattttatttttttgagacagagtccccactctgtcgcccaggctggagtgcagtggcacgatctcggcttactgcgacctccgactcctgggttcaagcgattctcctgcttcagcttccgaactcaggtagctgggactacaggcttgcaccaccgtggctggctaatttattttcagtagagatggttttgccgtattggcaggctggtctcgaactcctgacctcaggtgatccaaccgccttggcctctcagagtcagacctctcttttagagatgaggagactgagttcaggagaacttgcttgatagtaaacagtatttattgggggattagggtgaaaacatagatttctccatgttaaatactcttttctctatgcagtatttcccacattgagattcatgagatagacatgaattagacgatgagattcatgagatagacattttagatagacaaaaactttttatttattttaaa

SEQ ID NO: 47991 - DNA, 1788 bp, Homo sapiens
taggtcgagctcgaagttcagagatgaaaggaaaccaccgggctttgtttcagaggcccaagtcctcccagtggcagccactcttgggggtccatcgagctgagccgcagcttgttcaacgtgctggtgcctttggaagactgtcattagccctgctagagtctgctcgttctgttttgttttctttgtttctttcttttctctttcttttttggtgtggttaagctctatgagatcttgtagttctgacctttcccccatattcccaaggccaagtattatttacccttgttgcagtcataaaattatctcattttgatatccttagatttcgtagacacgaaggctattcttgtgcatggttctataaaatattttgtttctcatgccaaataaattcttacagctcggcacgaaaggcagttaacaatctacactatacaatgggtgaatttgtggtatgtaaattctctcttaagagggttgtttttgaaaagccaatcgcaggagtttttttctcaaaaaatgttgaccttacttttcaaaatagaacccgttttgaaactcattttgaaacccatttacatagaaataatgcttccacaaggcctttttcttttgttttccttctttttttttttttttttgtaaggatagcaaacaggatagacgtgcatagcataaaaaacaacgccctctttcgttccctacctcagtcccattcttcggaggggaacagagttttccttctagaaaggtttactttttaagcgcagatacgtgtaccttttttctttttttctttttggtttgtttgttttttgagacggagtcttgctctgtctgcctcctgggttcaagcaattctcctgtctcagcctccctagtagctgggactacaggcgcatgccaccacgccgggctaattttttgtatttttagtagcgatggggtttcactgtgttagccaggctggtccccatctcctgacctcgtgatccacccggctcggccttccaaagtgctcggattacaggcgtgagccaccgcgcccggccaacgtgtatcttttcttgtatgtaatatgtgagcatactatgtgtatatactctgcactagtgtggtttcactttgtgtctgggatatatttcacatgaaaacggacaaatccatttcattctgtttttgtagtatgtattttctgaatctagtatgatttatttaaccagttcacacttgtaatcccagcactttgtgaggtcaaggcgggcggatcacttgaccttagcagttctagaccagcctgggctacttggtgaaactgcgtctctataaaaaattcaaaaacaattagcgaggcgcagtggcaggcacctgtgatcctagctactcgggaggctgaggagagagaatcgcttgaacctgggaggcggaggttgctgtgagtcgagattgcaacgctgcactccagcctgagcaagaccccatctcgaaaaaaaagaaagaaagaacagagattgtttgacttgcttgctaaatgttgttaatgcgacatactgaagtagttaggtaacattaaacagtcccagatactgctactggttggggtcaggttaaccaaagtctaggagagtaggcctggcgcaatggctcatgcttgtaatcccagcactttgggggctgagtcgggcaggtcacttgaggtcaggaattcaagaccagcctaggcaacatgacgaaacccccgtctctaccaaaaatacaaaaaattagctgggcatggtggct

SEQ ID NO: 47992 - DNA, 1052 bp, Homo sapiens
tcatgttccagatcttagagcaaaggccttcagtttttccacagtcaatattatattagctgtgggtgtgttgtacatgtttttttttcttcttcttttggtttctttcaaaattttctgtctttgattttctacagtttgaatatgttgtatctagctgtagattagtatttatcctctttgacattctctgcacttcctggatttgtggtttggtgtctgacatttatttgggcaaattattagtcattatttcttaaatgtttctcagttcttttctcctttccttctctttgtggcattcctacaattcatatgttataccttttgtgctcgttctacagttcttgtatattgtattccattctttaaagtttcttttttatttttgccttatcatttgagaggtttctatgacatatccttaaggccctggtactttccttgactgcattcaatctatgataagtgtatcaaaagcatttttaaatttctgttagtgttttaaatttctgtcatttaaaaaatctttcttagagcatctatcactttacttacattatgcttctgtgcatgcatgtagtcgactccattagagaccttagtacagtaatcacagttattttaaattcccagtctgatatttccaaaatttctgccatatctgggtctggtctgatgctttttgtattttcaaattgtattttttgccttttagtatactttgtaatgtttgttaaaagccaaacatgatgggtaaaggacctgatgtaaataggtctttggtatatttaacttatgttgtagctgtaagtctcagaggctaaaattctctgatgtctttgcttttgtctcccctgttatctttgaatattcccaaagacttcttaaataaggtctgaggcttacagttcttttgcttgtaagccactgttattatttagggtgcaattgatgtgattgcaaggtaggtgtgtggggggaggagatatgggttttatagtcctagaattaggtctcttatttttagtgagcccattctgctttctact

SEQ ID NO: 47993 - DNA, 1031 bp, Homo sapiens
aatgatggtttccaacttcatccatgtccctgcaaaggacatgaactcatccttttttatggctgcatagtattccatggtgtatatgtgccacgttttcttaatccagtctatcattgatggacatttgggttggtctttgctattgtgaatagtgccacaataaacatatgtgtgcatgtgtctttatagtagcgtgatttattgaggattttctcatcgatgttcatcagggtattggcctaaaatctctttttttattgtgtctctaccaggctttcaggatgatgctagccccataaaatgagttagggaggattccctctttttctgttgatggaaatagtttcagaaggaatggtaccagctcctttttatacctctggtagaatttggctgtgaatccatctggtcctggacattttttggtcggtaggctattaattattgcctcaatttcagaacctgttattggtgtattcagagattcaacttcttcctggtttagtcttgggagggtatacatgtccaggaatttatccatttcttctagattttctagtttatttgcgtagaggtgttcatagtattctctgatggtagtttgtatttctgtgggatcagtggtgataccccctttatcatttttcattgcatctctttgattcttctctcttttcttcttaattagtgttgctagtggtctatctattttgttgatcttttcaaaaaaccagctcctggattcattgatgttttgaaggttttttttttttttttgtctctctatctccttcagttctgctctgatcttagttatttcttgccttctgctagctagcttttgaatttgtttgctcttgcctctctaattcttcttcttcttttttcttttttttttttttttttgagatggagtcttgctctgtcgcccaggctggagtgcagtggtgtgatcttggctcactgcaagctctgcctccccagttcatgccgttctcctgcctcagcctccagagtagctgggacta

SEQ ID NO: 47994 - DNA, 1096 bp, Homo sapiens
tccatcttgtgcatcccttgcccttttggctgatttgtaaaatttgtatgcactaaggttcactctgtgctgtaaagttttatgagttttgacaaatgcagaatgtcatgtatccaccacgatagtaccatacagattaactccatcaccctgaaagcccctctgctcacaatcttttgagagttcccaggtaatctctttcaggttgatatctcaggttgatcttttgtgggaaaaaaaatatgagctatgagtctttcatttcaggtgacggttctcagtcccggctgcacacgggaactatctggaagcctttagaaattatggatgcctgattttacctccagatcctgacttaattgatcccacttggtttagttggtctgggaggtatatctggttactagacctttgaaaatctccccagatgctcatgatgtgcagcaaaggtttagaaccagtctggactcctctatttcttgtttgctgccttttgataaaaacacaaataattaattgctgtatttacatcactttgggggatatgatgaatcagtatgtaagttttgtaaataagtaatgtggcaaggatgaatttcacacactaatcttgtgcaaaaacacatctatttttaaactctaattgaactcaaaatgaacctcagtttctcttggtgacagcaaatttaattttgacaagtcaaagttactcaattacttctagtttaaaactcggttctttgggagaaaatagttgaattcagctttcctcctccccttctccgttcatcttttccctggtatgacctaggcttgggtccaggtgatctcaggtggcaccagcatcagggaaggcacatctagccagatgcatctggggatccccagacagagaattatggccctgcttcctgtggagaatgttgggagggagcaggtactgcagagcataaatggtttcagagcagacctcacagagagcatgcctaagagaggccacttccgtctccctcagcggccaaggggtgtgaagaaagtctgcaaggttctcacatcagctggagagggccagagaaggtagctgaagattgagagc

SEQ ID NO: 47995 - DNA, 1030 bp, Homo sapiens
ctgaaatgtcttcaaggccttttctttattgtcttgactattagacttggctcctctttacttatgcaaattgatgcagcctgcttgaattcttcacccagaaatgggcttttcttttctaccacatggctatgctacaaattttgtaaacttttatgctcccttttaaatataagttccagttttaggtcatttctttgcttgtgcatatgagcctaggctgctagaagcagccagtctacatctcaaatgttttgctggttagaaatttcttccaccagataccgtaaatcatcactctcaagctcgaagttgcgcatatcccttggcaggggcacagtgcagccaggctctttgctaaagcttaagagaagtgactgctccgcttcccataggtttttcatttccatctgagacctcatccacctggccatctctgtccatatcactatcagcatttgggtcacaaccattcagcaagtctctaggaagatccaactttccgtcatccttctgtcttcctctgagccctccacactcttccaacctctgcccatttcacagttcgaaagccactttcagtgtgaacaagataatatgattttatagcaaaatataatctaaaataaaactttttttcttgcccctccaaatttagaccagttattccctcagagaaaatttctacatgtctttggtgggcttctgttaaattccatgtcctggacttacaatagagttgtctatatacagattaggcaatgaaacactaaacctttgtagtagtacttgaaaatggcagcattaaatgctaatatcagtcatacacacacagacacacacacacatagttacagatgcaattaagagtggcaatagcattttgcttttcttttaaaattatggttttaaggtcaaatgttactatttttaagccaattatttcaagatcctatctaacttggttcctagggtttttagggtaaagtctccaaattctccacttctcctgttcttgagttatcacttt

SEQ ID NO: 47996 - DNA, 1029 bp, Homo sapiens
ctggaattatagacgcatgccactgtggcccggctaatttttgtatttttagtagagacggggtttcaccatattggccaggctgatctcaaactcccgacctcaggtggtccacctgcctcggcctcccaaagtgttgggattacaggcgtgagtcaccgcaactggcctgtttccatcttttcttgtctgctttcttttctcttatttgctcatgatgactactccattttttctttcatctctagtttcattatatacataaccagagagtaagttaagctaaatattatcatacaaatacccattttgtttagccatataacaattaatattatatcaagctgaagtaaataatgctgatttatttcatctagagtgttgtgtattggtctcaaggtaaaaggctgtgctttaaaaaatggagacaaaattttattgttcatttgtaaacgcttatttgatatactgatgccatttctaatctttctctgtggtacaggccataaacctgtactagaagtgaaacgttttaattttctactgtggatctgccttattccaagagctatgcaacagacaatagtgttagacaaagtttcagtatgaacaaattaattcattttttatagagaagcataatctaaaacataattttcccaaccctgcctgcttaaactgcttattgccttaattatgatttcaacatgattttggtgacttctgttaatttctttttcttttttctttctttttcctttttttttttttttgagacagagtcttgctctgttacccaggctgatgtgcagtggcacgatcttggcccactgctcactgcaacctctgcctcctgggttcaagtgagcatgtcagctaatttttgaacttttttttagtatagatgggggtttcaccatgttgcctaggctggtcttaaactcctgacctcaagtgatccacttgactcagcctcccaaagtgccgggattacaggcatgagccactgtgcccacccacttctgttaa

SEQ ID NO: 47997 - DNA, 1048 bp, Homo sapiens
gactggcgtcccaggctcaacatgagggcctagaagggaagaggctggctgtgtgcagctgtggctaaggcagggacctcctcctacctcatcaacccataggggtcctgctttgggaccaatgacagagcatgtgttggggaaccataagaactgtaatcttgtagcactgtggtctgtgtggggatcggaaccagcaaggttacctttgcacagtggatggagacatctggaaggaccagagattctgcatggccggagtagacagcaactgctcaaaaccagggccctctggaggactaacctagctgcctagcactggccctgtgggctaagtaagctttctggcagtttgtgggaggtggagaagtacatgctataagagggagacactgaacttcttgctaagatgggcatgtgggtacttgaggaatcaattggaaaattaaaagggatgcaatttaattggtagtccaagctattaaaacagatcctagacatgtgattgtgtgctgagtatactgaaagaagaagtaggtgctatggaaacatataataaggggatttaatgtaatgggtgtggtgcgtggaggtagaattaggaaagacttgatgaagtataagcttagctgagatttaaaagatgactccaactcaggtggacaacaagaaaaaatattttaagaagagacaatattgtatgagaaaactcggaattgaaagactgccatgcctctgaggactagaaaatcctgtgtggttagagctttagacaatgaaggtgatggtgatgcagttaaagctggagacatgagtcaaaccatcctgggctcgttggaacttcatccagtgagcaataagaagccatggagaaggtctggacagaggacacatggtagatttatgatttttaaaagcctattatagcaaaaagtgagaacagaccaagttggaggtagcaggagtgaatacagggaaaccagttaggaagatttctctgtagtccaagttgaaccacactagcggcagtgaagttcggccaataagc

SEQ ID NO: 47998 - DNA, 1045 bp, Homo sapiens
agatctactatcagttgtgcctcagttatattaactataattcccagttatgaaaaacagagacatgagaagaatttaacttgcccataacaactggcaaaattaaaacggaaggaagagaatgcagaatgcagactcctctgcttccctttccttttctctccatctttttttcttacgacccagtctcgcttaacctgaatctccacctgggagttgtagcattcctaggctagctatcactaaggttggaaaaaggaatgatcaagaaggcttcagcctggagatagtgactgaaaatcaccctggggcagctggaaaataaaaagaaataacccttaaaaaagatgctaggaggaaagaaaggtaatcccatctctacctgtcctagcttcactttcatcttttctgctttttttcttttgccaattcactgtaccattcggttatataatgtatatattgagcacctactgtctgtcaggcactgatacctgcattttcctagtaacgacagggctttctacacactttctgatctcccttgagaccctggcccttctccaaagcccgtaaaagccactgtctttcctgtgttaaatcttctcccgctgtggcctcaggtggctcattggaacagcaggaacagttaaatctggaaggcttcagggtttctgttatctgctcactcctctacatgtgggattctctgattctttttctctaaaggggatattaagggggaaaatatccaggttcaactggggttttagcacctgtggaaaataattattgaacttgactgagtgaagggctggctgattttggtggatccctgaggtcagagctcagttgattccctaaaaaccattgagtaatttccctcaaaagaagattaggttaaagagtaagtttgaggtgcacagagggaaactttgtgggagggaaaacagaagagaaataacaccattaccccaatctatttctgataaatcagcatagaaaatccataatgttgtaattctattatcaatggatgatagag

SEQ ID NO: 47999 - DNA, 1048 bp, Homo sapiens
taaggtgtgctttatgatacaggatgtggtctctcttgatgaatgttccatttcaagcagtatgcttgaaaataatgtgcatactgttgctgttggaagaaggctttatgaatgtcacttagatctaatcgattgatgatgatgttcagttcaattatatttttactgattttctgcctattgaatttttcagtgatggaggggtgttgaagtctctgactgtaattgtgaatttgtctttctcctttagttgtatgagtttgccaactattttgacactttattgttagctacatacaaattaaagattgttatgtcttcttagagaactgaccctttatcattatgcattgcccctctttatcgctgctaattttccttgctttaaaagtcagctttgtctaaaattaatattgctctcctactttcttttgattagtgttagcatggtataatgttctccatccactgactcttaatttatgtgccttcatagttaaaatgggttttctgtagacaacacatagtggggtcttgttttttgatccaccctgacgctctgtcttttaatttgtatgtttagacattgacattcaaagtgattattaatatagttgaattaatagctaccatattagttaactattttctatttgttgcccttgttttttcttcctgtttttgtcttccactctttttctgcctttagtagttttaattggacattttatatgatgtggttttctctcctttcttagcatgtcagttacactactattttttttttaaccttttttaatggctgccctgtcgtttgcagtacacatttacagctatgcaagcccacttttaaataatactattctgcatcacagggattatgaataacttaataacaaaataatcctaatttctccttccagtctcttgtaacattgctagcatttatctctcttatacagaagcgtgtgtgcacatatgcagtatgtacacacaatgcacacatataagtatacataaccacatacattgttgctattattttgaa

SEQ ID NO: 48000 - DNA, 1023 bp, Homo sapiens
aaatcagtcttcctcttcatatggactttgacgacccagagcagcatctcccagtgtccaagtagtttcccacctcccacactgggcaccccaccaggcctccagcacctggatctaacccaggtctttaggagcctctcaagtgtgtgcccacaggaactctgctaattggcatggcccaggcacccaagttccaggtatgagaagtgccatagtaactggtctttatgtggacaatgtatttattggggctaaattatcttttcttctcatcaggctgttttaaaacattttctccaactcagcccacaaagagaaaatagaaattaacactgactcatctactaaaagccaggtgctgtgctaaacattcattagcttattcaattctcacatcaacactggagggtagacacaatttatcatcccctattttcacagaagaggaaataaaaggcagaggatacatgactcgctggtgatcatacagagctagcacaaaacagaggctggatttgaacctgaatccgtctcaattatgttcgtgccctcccttccctaaactccccgctttgctccttgcagccctagggagaagtgtctgggctgaacctacagcaaagctgtggcattacttattgagaaggatcttgtctaagcagcagggtgccaatctgggggtctacaccagcctcttgggccctgtgttcagtgacccctgggaagcattacagttaccacaaagttaccacaaagaccctggaaacagggcctggagctgttcactccgggcaagcatcatcaattagctaacatctgcctgatcacagcatgatcaaaatcgacagaactgactctgttatctgtggttgtcaactcgctaagaaagtttctgcagagctgagtgacttacaagagactgagcagctacaggagaagcaaggtttaactaaggcttctgctggagagacttttgctcagtaccatctactggacaacttctgtctcaaggctgaggagaca

SEQ ID NO: 48001 - DNA, 1049 bp, Homo sapiens
gcagagcgagtgaagagaaatgtggtaacaggcaagagtcagagaggtaaggaggaaggaagccagatcatgtagatctttaagaattggagtttttacactgagttaggtgagaagccattgaagggttttaagcagggaagggacatgatttgatttatgttttaaagcaatcactctgttgggtggagataaatgtaataggacaaagatgaaagcagggaaaccagtatactatagcagtaatccaggagaaaaatggtagaggcttggactaggatagtagcagtgcagataccaaggagtggctggattctggatataccttgaaagtaggattggtagaatttgcttaaggattggatatgtggagtatgagagaaagtgaggaatgaaaaagatgatacccactatttttggtctaaacaactggaataatggaattgccattaactgagataggggaaactcaaggagtagcaaatttgagaggtagaggggattgaagagttggatttgaacatgttaactttgatatgctctttagacatataattggtgttattgaataagcagttcagtataggagtctgagttcaagggagtctggaggtacaaatttgggagctgtcagcatcttgattgtatttaaagacataaggctggtagaaatcacttagtatatgagcatagatagagaagaaaagaaaagcgagcattagaccttccagcatgtagaagtggccaagatgagtaggactcagtagaagagactttgaaggagtgctcagtaaaacaggaagatagtcaaggaagagaagtgttttggaaaccaggtaaagaaaatgtttcataaaggagggctgctcatgatgggttgaggaaatgagaaataagaatttattatttaatttggcaacatgaggatcatattaatgaccttggtgagctgtggtagtagaagagtggataaaagtcttagaagtctattcaggagaattaggggagagaaatggaagagtcctctttcatggagttttgctataagg

SEQ ID NO: 48002 - DNA, 1050 bp, Homo sapiens
aatttcctaggaagtttgttaaaaagactgcttttagacatgataacaaacctaccttttctcccttttccccagtctttgggaaagttacagtaactttactgaaatgacccatgtcatacttacttaatgaatttatataaatgtttgtgtttttacatatatttaacaaatgatttattaaaacatttacaattgatgcaattttaaaacatttttaaaatttttatcttccagttggatgaaacaggtttcagatttctctggtagaattgagaattgttacatatattgaataaaatttattacaggatattttccccctttctgcaagcttctgaagaagaaatacgtttttatggagtattggtgtttttgtattttactcagaaaataagttttgacatttacttttagaataaatctaagggatttactttaaacattatttttagggaaaatggtatcatcggaggcaagctgtaaaagaattacatagtacattgatacgtcttttaaatgaattgctgccatgggaaccaaagttaatgaaggctttccaaagaaacaggtaattttaatgttataatctgttttacttattttatggtccttaatttacgatttttggatgatgtcctggaatcatttagtagttttccagtcatttgtaattcggcagatatttttgactgcccactgtgtgcaaggctctttctaagccctgagaaaatattgttgactaaacaaagtctccactctgtgacttacattctcatggaaaaaaacacactcaaatgtcagatggcaaaaaaaagtgctgtgaagaaaaataaagcaaggtaagggggttaagaaatggctgatttgggcagggtgaaggttactctttgatcaggtgtcagggaaagcttccctgatgagttggtgtttgaacagagaccttaaagaaatgaggaagggagctctgtggatttctgaggggaaagcagagggaatagaaggtactaaagccctagagttgatagcatgtttggcgtttagtggaga

SEQ ID NO: 48003 - DNA, 1033 bp, Homo sapiens
gcccagctaactcagtcagtagagcacgagacccttaaataagacttctttttgtagggatccatttagcttttctaaaaggtatttgtgttttaattaaaaaacataatatggccgggcgcagtggctcgtgtctgtaatcccactacttcaggaggccaaggcaggtggatcacttgaggtcagaagttcaagaccagcctggtcaatatggtgaagcctcatctctactgaaaaaacaaaaatttaaaattagttgggcgtggtggcaggcatctgtaattctagctactagggagactgaggcaggagaattgcttgaacccaggaggtggaggttgccatgagccgacatcgtacctctgcactccagcctgggcaacagagcaagaccctgtctccaaaaaaaaaaaaaaaaagaaaagcgtaatatattgatatttaataccttctctaccacagaatttatgtctgtgacaagaattaaacttgtaacaaaaaatgttctgtgcttcatgtgtctgtgatctaacaacatatttgtaaataaaagcatataggaaaaaagcattcatacttttgttgtatatgttttgtactgttcttttaaataaaaatgttatctccacaataataccatctccattttaaaaagcattctttgtatatttttatatgattttaattttttcttcatatgactgccgatacctgttttgtttagatataatattacaagaaaaatctatgtaagtaactgtatggcttgtataaacaagtgactttcacctaagtttaatgtacaaagtatctaaattaaagtgtgcaaaatatatttgttgttatgagacatttaatatagaatttatttatgtccctctttttttcctttttaggtatccaatgtccccagcatcagtagattgccaactccctctccttgccacactccagccagtgttatgctggtgctgtcatacccatcccagattactgtagcagaatgcagttgttctttagttgtgaggtaagt

SEQ ID NO: 48004 - DNA, 1038 bp, Homo sapiens
acggataccgagggacgactgtatattgtaaagggtctaaccaaatgtgtgccactttttcctaagagttatgtcagtggttctcaaactttagatagtataaaaataatgtgatacctttatttaaaatgaagattgttggtttcatcctccaaaagaccttgattcagtgggtaccagtaatctgcatagtggttaaacacaagggttctgcaaccaggctacctacttgggtttgaatgccagctctaccactgattaactctgtggggtaaggtatttaacttctccatgattccagtttctcatttgtacagtggggtaataatagtaccttccttgtagagttgtgaggattgaatgatacagcttactgttttagccatttttattgttttcaaataagcaggtcagtcgcttctggtgaaaaacactgaattatgaataggaaaatcaattaaaaatggcataaaaacatctattattgacccttagcactctttccatttacttaaaaccttgaaataaatcttggatttggtcttaatgaaagtggcacatgattaagcctacaagaatttgaaaagtggaaaaccaagtaatagtatttgcatcattatgtttgatgagagtgaaaacttacgtttatccctgttgtattgttatgatgcattatatatttgtcatgtaggggaaattgttggattttttagtgataattatagaatattggtgatttaagcttttatatcaactttaacatttacttacgactttgttaaattggtaaaattctttttcctttatctgttttgtaatcaaagaaagactattagactgaaaagtgaatatcagttttcctaatagttactttttcctaaaaagtcttttcatttaacatttaagagagaaatctaatgttatatgacttatcttttgtacataattatgacagaaagttacaggaagtatttttaaaaactaatgtgttgagtctcaataacataagttttaaaaataatttaacagccttagtta

SEQ ID NO: 48005 - DNA, 1049 bp, Homo sapiens
attttatatttaatccacacctttacccttcccaacattctgcctgcctttatattgatccatgataccatctgatatcatttttctactgtctaaagagctcttttagcatttcttgtaatataggtctgccaacaatgaattctgaggtttttttttgactgaaaaagtttttatttttccttacatcttgaaggatggagaggggtgtgtgtgtgtgtgtgtgtgtgtgtgtgtgtgtgtgtgtgtgtaatgcatatacatatatgactctgtattgacaggttttttcctatcagcactttaagtatgacgtgttttactatgcatagttttttaaaagaagcctgctgacttccttatctttgttcctataggggtggtctatcttatttctcttaactgcctttaagattttctctttataattagctttcatcaatttgtcatgtgcatttggtgtgagcttatgtgtgtgtgtttgtgtttatcttgcttgaggttcatttcgcttctttgatccatagactttcagtcttctctgtgctcttttcaaggctgctcatattttcttctgcagtgtctaatccagtgaactgtttactgaatataattttttatctctaaaagttacatttagttctgttttttatatatcttcatttctctcattatcttcatgttttaatttctaatctctaacttaatcatctttgtaatttctaagtctttctgttgtttttctcctagttatattcttttgcttcttggcatgtccagtaatttttattggaaattagacattgtgaacattgctttgttgagtctggagttttatttacttcctttgaggaggattaggctttgttctggcaagcagttaaatttcttgtagaacagtttgaaaagtccaggttttaagctgttttagggtgtgtctgagatagccttcactccagttcagccctacaatagcataatgcctctcaggcctctgctaaatgcccctaagtggtggctgaagactttctgcttcagctggtcagaac

SEQ ID NO: 48006 - DNA, 1031 bp, Homo sapiens
aattttttgtattcttagtagaaacggggtttcaccatgttagccaggctggtctagaactcctgacctcaggtgatctgtccacctcagcctcccaaagtgcagggattacaggtgtcagccaccgtgcccagcccatatttcttgtgtaatagagtttcttttttaagatcaaggacccgatcctactttcattatagttaagttgctatcatcttgacctcttcataacctagagttgaggttccttctactcacccacacctttctcttttatataatcttaattaagaaaccctttatcaacatttctagcaattccctacacttttatgtatgaggaattagaaattctgccagatgacttggaattaggcacctggagtttttgaagtatgacagacctagattttaactttgtttaacaactttcttaaactaagaggcagtttcctcatctgaaaaataaggttaatacctagctgataggcttgttgtgagattaaaggagacaatgaatataaagtgcttagtggcacagggttcaataatgtaagctaatattgtccaagagtcatgaaatagagctgatgactaaagaggagtagaggatgtttgcttgggtacgttgggcttcagattcctgggctttgtcgaaagaaaggaggaatgtctagtcagacacacgttttggttgccaggtgctgaagtaagactgatccctgcatttttctttctgtgagctgaggttctgtggactcttcagagtccacagactcttctctgaggggagagaaccctgtaaatgcgttatatattacaaatgtctgatgagaggagacctcgaatactagataaaaggtatgtgtggaggacagtgtgaataccctaacagagcgttcccgcttcactattttacttaagagtgatacttaacttactggacaaaaacagctttgaggttaaaaaaaaattttatcactgctttaaagttcacattaatgagaagtaaacaattgcaagagtcagag

SEQ ID NO: 48007 - DNA, 1047 bp, Homo sapiens
tgtgtaaatgtagatgaagttcttccacactggttatcatggcttccactgcatgaagataaagaggaagctattcagactttgagttttctctgtgacctaattgaaagtaaccacccagttgtaattggtccaaataattccaatcttcccaaaataatcagtataattgcagaaggaaaaattaatgagactattaactatgaggatccttgtgccaaacgcctagctaatgtcgtgcgtcaggtacagacttctgaagatttatggttggaatgtgtatcacaacttgatgatgaacagcaggaagccttacaggagttgctaaattttgcttgaagcactttaatataacttgaatattatctattataaaagtaactacaaataagtgttgtgaatagattttattataaatcagagaactgttttctccctgctaagcagtttatagttcttctccatgtttctccagaattaatcagtgttagtcctctgtttatctcgcatgttttatcttccaaacacagaccttggtgataacctgtgcttcaaactgtcttaaacaatgtttgtcacctttcccctagttgatgtaaagtatataaattgttgctatttgtttgaactattattgatgctagccaagcagtatacttgatgtgaagatgtcatgctatcacaatatgctaagagctcacaaaaataagatagaatttccaggacaaacatctttggaattgtgagtgaaggatatagtggcaggcttgtccctctttaattaatactcttggtatttgtggtgatgggaggatgctgttactaggagagttttgagatactgcagtggatgtgggatgtatatgaacttcttcataatgtactcctgggaactgggtaggacatatccatattgtagttcccaaggtgtctggttgagagttagagaacttttaaatttctttagccagacaggtctctatttttttaagttatccaggactccaagaaccatagttactgaaaagggagtcctgatacatctaa

SEQ ID NO: 48008 - DNA, 1031 bp, Homo sapiens
gccttatctgccattggagaaggatgccatcaacaaatggaatcaattctagatgaaacagttaactccgttttgctttttcttcaggatcctcatccaagggtgagggctgcagcctgtactacacttggacagatggctacagattttgcacctaatttccaaaagaaatttcatgaaacagtgattgcagctctgttacgtaccatggaaaatcaaggtaatcagcgtgtgcaatcacatgcagcttctgctcttattatttttattgaagactgccctaaatcattgctagttctatatgtggatagtatggtgaaaaatctacattccgtcttggtgattaaacttcaagagttgattcggaatggaactaagttggctttggaacaacttgtgacaaccattgcatcagttgcagatacaatagaagaaaaatttgtcccatattatgatatattcatgccctcactaaagcacattgttgagcttgctgttcagaaggaactcaagcttctgagaggaaaaactatcgagtgcattagccatattggtcttgctgttgggaaggaaaaatttatgcaagatgcatcaaatgtgatgcagctgttgttgaagacacaatcagacttaaataatatggaagatgatgaccctcagacctcttacatggtttcagcatgggctagaatgtgtaaaattcttggaaaagattttcaacagtaccttccactggttatcgagcctcttattaagactgcttcagctaaacctgatgttgctctcttagacacacaggatgtggaaaatatgagtgacgatgatggctggcaatttgtaaatcttggagaccagcagagttttggaattaaaacttcaggacttgaagcaaaagcaactgcttgccaaatgttggtttactatgctaaggagttaagggaagggtttgtggaatatacagaacaagttgtgaagctgatggttcctttactgaaattttatttccatgacaatgttcgagtggcagcagc

SEQ ID NO: 48009 - DNA, 1026 bp, Homo sapiens
gtatggtgcggaggcaagcagaggaaatctatgaaaatatcccaggtctgtgtaagactaccttcctcttagatgccgtcagaaatagaagagcaggttatgaggtgagacaaatggctgccgcactgctacgacggcttttgtcctctgggtttgaggaggtttatccaaatctgcctgctgatgttcagagagatgtcaagattgaactgattctggctgttaagttagaaacacatgctagcatgaggaaaaaactttgtgatatttttgcagtgctggccaggaatttgatagatgaggatggcactaaccactggccggaaggtctgaagtttcttattgattcaatctactccaaaaatgtggttctatgggaagttgcacttcacgttttctggcactttcctgggatttttgggacccaagagcggcatgatttggatatcatcaaacggttgttggaccagtgtattcaagatcaagaacatccagcaatcaggacattatccgctagagctgcagctgcatttgtacttgctaatgagaataatattgctcttttcaaagactttgcagacttgcttcctggaatcttacaggctgtgaatgactcatgctaccaggatgatgattcagtgctagaatcccttgttgagattgcagataccgtacctaagtacttgggtccttatttagaagatactctacagttgagtttgaagttatgtggagactctaggcttagtaatctgcagcgccagctggccctcgaagttatagtgaccttgtctgaaactgccactccgatgttgaaaaaacatacaaatattattgcacaggcagttcctcatatattagcaatgatggttgatctacaagatgatgaggactgggtaaatgctgatgaaatggaagaagatgattttgacagcaatgcagttgctgcggagagtgcactagacagactggcttgtgggcttggtggaaaagttgttttaccaatgaccaaggagcatatcatgc

SEQ ID NO: 48010 - DNA, 1052 bp, Homo sapiens
aagttattttatttttaaattttcatttgtttaaagtttaaatttttgtatctttttttagtatttaatttttgccttcagcttcgcagacatacacattttgaatgggactgatacatctattactcatttcccttcccttcctgcacagggtactgggaacatgaaataacagtctacgattgagtcagcattgctcaccggaatgttagtcatggcatatgccctgaaagtggtgccttccaggaccgttgagatgaggatggccagcccctaacagccatctgcatccggggcctgggagagccgaacctgagactgccaggaatggtgtcacattaaaagtgcctcattcttttggggctgatcaggcccttgactcgatatttggtaatactaagaaattatagagtgatgatttgttttcacctcataggtgtgtcttccttaaaccttgttaagatgttgacacattacccatttaaagggggaaagaaaagggaaaaaaaaaggaaaaaactgaagttcattgttctaggtgtgacaattgtgtttgtagttatttatttattttttgagacgggatctcactctgtcacccaggttggagtgcagtggcaccatctcggcttactgcagtctccgcctcacagactccagtgatccttccatgtcagcctgcccagtagctggtactacagatgcatgctatcacaccaggctaattttttgtacttttagtggagacactgttccgccatgctgcccaggctgatcttgaacttctgagctcgaatgctctgcccacatcggccccccaaagtgctaggattacaggcatgagccattgcacccggcctgtagttatatttttaaaaacaatacttatctttgaaggctgcatattgacatttgaactgatgataggatgtttgaagtttgcttcaaaatatatagttcagcatgaaagtggttagtgagaaatataataggaaacaagattgaccgtaaaccaaattgttacagctggctgacacacacgtcgtagttcc

SEQ ID NO: 48011 - DNA, 1025 bp, Homo sapiens
tttagtagagatggggtttcaccatattatccaggctggtctcgaactcctgaccttgtgatccacccacctcggcctcccaaagtgctgggattacaggagtgagccaccacgcccggcacaacatccatttctaattctcagtatgtttggctagggttcttagtaaagggaaagataaattaatttttaaaatctttaaaatttgttttttctttgaactcccgttccaaccttggcaaaggaacttttagctcttctgaactatcaccctcaccctatctctgccatgtcatctacaaattctttttttttttaagtttacattgagtattgctcctgaacttgcacacctgtgatgatacactgatactgaaagggcctgggttatagtcatcacaatactgttgaattccatcaactccagctgttttcaccttgtgggctcttatacctgttattcagttgttctactttttctggtctattgaatttcttgtggattctttgtagaatgaatctgagttttggaagaagttgtctgctcaatttccccattctgcattaagcagcagctccttaatcagcctgagtaaatgccatacactggagggtcttgtttttcttttcttcttttttttcttgaggtggagtctcactctgtggcccaggctgcagtgcagtggtgtgatctcggatcactgcaacctccacctcccaggttcaagtgattctcccacttcagcctcccaagtagtctggattacaggcatgcaccaccacgcccggctaattttttgtatgtttagtagaaatggggtttcaccatgttggccaggctggtctcgaactcctgatctcaggtgatccgcccaccttggcctcccaaagtgttaggattacaggtgtgagccaccacgcccggcatggagggccttgtttttctaggacagtttaagctgtgctcacataaacttggtgtttctgaggctccccgttcactggccagccctgcagctccagac

SEQ ID NO: 48012 - DNA, 1032 bp, Homo sapiens
tatggagatccacaaaccctgagacgaaaggcagttgtctgaaggaatgttcctgggtcgaaggtctctctggccttcagggtgcttcaggggaaatgaagagtggggccaggtcttccgtagttctgagactgtgtggattctagcctttgtagatgaggagattctcccagtgatgctcccactgcccccaacagaggactgacagcttgcagactggttctgctgctgaagatgttgcagcaacctgaactcagccctaagggtgaatggagccgtagccagcaaagggaaaattttagttgcacacttcactggacccagcaacagagaggaagcacagggagagtgctcagaacaggttgcccgggcagccagcgttataggcactggcgtgaggcaaagtcagctagttatagcaatacaacttcgatctcagagctggctgacattcagtattaagtaaaaaggacattctgcaactaaaaccatgagtttcaattttaaacaatcaggactgggcacggtggctcacagtcccagcactttgggaggctgagataggaggatcacgtaaggccaggagtttgagaacagcctgggtgacatagtaagaccccatctacaaaaaaaataataaaattatcaaataaataatcaggatgggatactcttgaaaacaaaattagtgacttggaaaggtacttggaggaaatattccaaaacaaaaacccaaaatatacagattaaggctgtgagggaaaagttaaggaactcagaagacagattcagaagattcagcatttggggatgagaacatggaagagttaattaatattcatctgaggaagtgaaaaaaaattgtataaccaaaatgatggtaaaaaatgaaatgattaaagataaaagctagaatgaatgacctagaagataaaatagtcacaaggattaataaatacaaaaactgattatttgaaagatccagtgaaatcagttaactcttttcttgcctaaggaaaaaatatatatata

SEQ ID NO: 48013 - DNA, 1026 bp, Homo sapiens
ttctgtgtctacaacagggcttacatattggctaatttgtcatgatttactgctggctagagtccagtgaaatctaggggacctatatgcacgtcacattttttgtaagaagaaacacaggtttcttgacaactctgcacagagggagaatttcgaataccatgtcagccactgatgttatactcaaaatagcaggtgcagtcacaggtgtcatcaaggaaccatttcctggtaatttcatttatacctgactaattagagtcagtcaatgtgtctgtagagttctgtagtcacaaaaagttttgaatctgaatgtttcctttccctttcattattgtatgatatttcagatataaccatagcataatttttaggaagtagccttagtagtatttcacaactctaaagtattttttattgtggtaaaatatacataacacaaaatttactgctttacgtatttttaagtgtacagttcagaggcattaagtatattcacactgttgtacagccatcaccattatccgtctgagagctttttgattttctcaaattcaagctcaggacctgttaaacagtaactcttcggttcctctttccctttttccctggcccctggcggcctccattctactttctggctccatgaatttgactactttaggaacctcgtataagtggatcatacaatatttgtccttttgtgtctggcttatttcacttagcataatgtcttcaaggttcatcaatgttgtggcatgtgtcagaatttacttccttttttctttttttcagacagggtctcattcttttgctcaggctggagtgcagtagcaggatcttggctcactgcaaccttggcctcccaggctcaagtgatcttcctgcttcagcctcccgcttagctgggactactggcacgcatcactatgcctggcgatttttaaaagtttttgtagagacaggagtctcactacattgcccaggctggtctggaactcctgacctgaagtgatcctcctgcct

SEQ ID NO: 48014 - DNA, 2695 bp, Homo sapiens
ataggtgtgaaccactgtacctggccttcccatttacttttgtgtttgtttcttgttccacttagtgaagaaagagaacaatctattgctatataagagtttatgccaaccatacctgaagcaactcattgtgtttcatggaaagaaatctgttttgggggcttttcttccctgaaaagttagcaaaacattgtatttttgtgtaagttccctttttggacaactatgtcccacttttaaatgaagacagtaacggtacttaccttataaggttgtggtggaacttaaataaattaacatatgtatagcgcttagaacagtgcctggcacatagcttttctcatcatcgtcattattattaaagttattattgctattgctattataatatgtatatatgcatttttgttttctttcttttcagcctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacaggtaagggcatttcttttcttattgtttcagcaatctattcttgtatagcatacaccacaaaacttaaaggcttagaacaacaacttttttgtgttattctgtgacttgctagacagttccactccactggggagagcatggctagaaggtgcatcgtgttctccctcacatagctggtgaggagctgtgggctgggagtgcatttgaggatgttcactagggccatagtttttctccatatggggctttccttgtagttccttgagcttccttgttccttacagcacaatgtcggggttcagaatgcgtgttcccagatgaagcatggagaagctgcaaatctctaatggccgaacctcctaagttacactgcatcccttccagattagtctatctattaaagcaagtcacgaggcgagcccagattgaatcggggaggggacaacacctgggtgtgaattttggtagatgtcgttcattgcggactgtctttggaagctagcttactacacctgtcagtgacacagcataagaagaaggatcaagcacacatgctgaattccaacaagtgtctcagtttagcagggccaggagaacctggatcctgctttggtaatgtcactaactttgaaaggtcccttctcctcttccagcctcaatttctttgtaaaggaaagactttgaagaagaacagtgattttcaaaagcaacagcctccagcaaaatctcctgagcacttgttaaaaatacaaactccgggccccgctccagacgcactgatcataacctccagggggtgagactaagactctttatttttatttttatttatttatttgtttttttagatggagttttgctcttgttgcccaggctggagtgcaatggcgtgatctcggctcaccgcaacctctgcctcctgcattcaagagattctcctgcctcagcctcccgagtagctgggattacaggcatgtgctaccacacctggctaattttgtatttttagtagagatggggtttctccatgttggtcaggctggtctctaactcctgacctcaggtgatccgcctggctcggcctcccaaagtgttgggattacaggtgtgagccaccacgcctggcctagaatctttatttttaagacaagaccaagtgattctaatacacagtcaatttggaatcccctggatttgtggtctctctgccttcatgatgatagatgacagatggaccgatggacagatgatagatagatagatagatagatacatacatacatacatacatacatacatacatacatagatgaatgatagatgggcaggaatcatgttatcggtatgtgagtttacattttagaatatctttagaaaatgagttatggtatctgcccctaggttcttcacctcctgctgctcaaagtatagttctctaccagcagcctcagagttgacccctctgggagctggttagtaatgcaaaatttctgtttcaagatgccctaccttctgttttgtaacatagactacacagcaaagccatttactttgtaaaaacaatacaccctataaaatacaaaccctttgggaagagggtatgtggcaatgaaaggatacagtgctctcaattgcgtcttaaagtctcacttcataaataggtaggagctgatagcatgaaagtcaagctttagtataccttctttagaacttcattacttatttttgttttgttttaagagacaaacctcagtgaattctgaaccttgagtctatgatagttattaaatgttgaaaattaagaaatttcgccctctagtgacggaatataatcacattttcactgtcatattggagagtgatttttcaagactattttaattctggttattagctcttgcagtaaattgtgatcccagccaggatcccagaagactgacctaagaatcaggaaatttgtcttcttaaagcagtggtttacagccttggctaggaattagatcccatggtgactttataacatccctgatgcccacatcacaatcccagattgaatcataatctcaatggagaatgactggggtgagggaagggacccaggcgtgagtatttctttaaagttccctac

SEQ ID NO: 48015 - DNA, 1047 bp, Homo sapiens
gtccttttgtattatgttttgcctcaggaaggtgccacctcttttcaaatatgagctcttccagtatgataggaaggaaaggtggttggcacaggcttttcctctgttgaacagcaagctgatctttatttatttatttgtttttttggttgttttttttttttttgagatggagtcttgctctgtcacccaggctggcatgcagcggcccaatctcagctcactgcaacctctgccttccagtttccagcgattctcttgcctcagcctcctgagtagctgggattacaggcgcctgccaccatgcccaactaatttttctatttttagtagagacagggtttcaccatgttggtcaggctggtctcgaactcctgatctcatgatctgcccacctcggcctcccaaagtgctgggattacaggcataagccgccatgcctggccacatggtgatctttatatggtggcctcactttctgtagcttaccctccatttgttgaattctctgcttacgttttccctttcggtgcagctgactgctcctgtcttgctgtttctcctcaggttcctccaggtttccgtctgatcataagtccatttagggcctcagttttctgcctctaggttcattttccaggtgaatttgggctgtctgcagtgaaccagttatgttcctgtttctttcttttttttttttttgagacggagtctttctcttgttgcccaggctggagtgcaatggcgtgatgtcggctcactgcaacctccgtcttccgggttcaagcgatactcctgcctcagcctcctgagtagctgggattacaggcacccacgaccatgcctggctaatattttttgtatttttagtagagatggggtttcaccatgctggccaggctggtctcgaactcctgacctcaggtgatccgcccgccttggcctcccaaagtgctgggattacaggcatgagccattgtgcccggccttatgttcctgttgcttaatttcttccagttcatgtatagctgataatttattatttaa

SEQ ID NO: 48016 - DNA, 1044 bp, Homo sapiens
ggcgtgaacccgggaggcacagcttgcagtgagctgagatcgtgccactggactccagcctgagcgacagagtgagactccgtctcaaaaaaaaaaaaaaaaaaaaaaaaaagattctcctgcctcagcctcccaagtagctgggattacacgcctagctcatttttgtatttttagtagagatggagttttgctgtgttggccaggctggtctcgagctcctgacctcaggtgatccaccctccttggccttccaagtgctgggattacagttgtgagccactgtgcctggccagaagcatggtttttgtacagacgtggtggttgatccagagaggcaggagatgaggctgtcagtcagtttctagatggggtagtgatgttgatgtcattgattaacagagggggaacagggagaagtggaagaagagattgggtcttgcttgagcagaattgggtttgaggtattcgtggaacatgcatttggaaaagttgaagcaaaagttgcaaagtagagtctagagatccagagagagaagagatggagttgcagatttagtgagttttccgacaaattcatgagaattagtgaaatttcccagggatggagtgtggggaagaaagaaaagccaggatataaggaaataaaacatgcagaaggagagaggcagggcagtctgagatgaagtcatcagaggcagaaggatatattttcaggcagggagttacggacccctgtgtcgtattctcgacctttcttaggcagaagagggaagaaagtctgcataaagacataaggatcctccgaggtgggaggagttgaggggctgcatttctgacgatctctctgcatgagagacaggaaggctgagactgagtactagggaaaagtgaatttcagaagagctattgtgtgcatctgggtggcgaggacccttgatcggtctgcagggagggtctgctgagagcatctgggtggcgaggaccctcgatcggcctgcagggagggtctgctgagattgaatagcgggaatttgtaaggcc

SEQ ID NO: 48017 - DNA, 1031 bp, Homo sapiens
atgtacctcaagaaaccagaaaactaagaacaaatcaatggaaaatcagcagaagaaaagaaacaataaagatcagagcaaacgtaaatgaaatagagactgataaaaatataaaggatcaattaaataaaaagtttgttcttcacaaagataagcaaaattgataaacctctagctagactaaccaagaaaagaagacccaataaacaactgataccacagaaatgcaaaggatcatcagaggctcttatgaacaactatatgctaacaaactggaaaacctagaggaaattgataaattcctacacaaatacaacctaccaagattgcatgaggaagaaaccgaaaacctgaatagactaaaaacaagcagcaacattgaatcagtaataaaatacctcccaacaaagaaaagctcaggacaagatggattcactgctgaattcagccaaatgtataaaggataactgatctggtttagctgtgtccctggactcaaatctcatctgaattgtagttcccataatccccatgtgtcatggaagggaccaggtggagataattgaatcatggaggcagtttccctgaacctgttctcgtgatagtgagttcgttcttatgagatctgatggtttcataacgggcttcccccttcactgggcactcattgttctccttcctgctacaatgtgaagaagggcatgtttgcttcccctgccaccatgattgtaagtttcctgaagcctccctagccatgcagaactgtgagccaattaaaccttttccctttataaattacatagtctttgttatgtctttattagcagtgtgagaacggactaatacaacaactaatacctatcctcctcaaactattccaaaaagttgaagagaacagaattctccctaactcattctatgaggccaacattaccctgataccaaaactggacaaggatacaacaaaaaaatgaaactacaggccaatatccctgatgaacatagatgcaaaaattctcaacaaaatacta

SEQ ID NO: 48018 - DNA, 1027 bp, Homo sapiens
ctgttacctcttggtatctgttgtatcagccttaattggggcagttgcactggacctaccagcgctaacattctaccctgtcacattctgtagtaacctctaagaggacccccaacctcaagtggcttagaggggtcacaaaaataagaagaagctccatgtaagagaacatagagcagtgaggcctgtggcatggccttcccaaaatcttcaaatattcaaatgttcattattttaagttactgtgctggaaaaccaaaacatatctgtagtctcattcacctccaccctcaagagccagaccacgtttcattcagtttgcatactgcagcatctttgtcacatatttgataggatgcaaagattttgtttgtttccttgcctcttggtgaagttatatcttcctttattctgctccaagcattcaggagaacattttcaatgctaggaaaattcacaccggattgcacgttgtcttcttttctcaaatggtcgcagcttatttctttcctgctcttcctcttgatcagaatagctcctttaaaattatgcagtatcctttaaaacactttctatagtttctaatttagggcttagggctccatagtgagtttagagaaaataaggcaaatcataaatagcacctggggcaccataaaaaactcttagttatgtcaatttttatgaaccagaaatctttcatcactccaacctactttttattgttatatgattcttattattttgccatgtgatattttttcatagccctgctttaattatttatttttgattataagttatgtaatgggttacaaattacggaaatatgatagctcgacctgttagtaagccgttaattcactctccaccaatataactttaaaccatgggcaataatatagtcatgcaccacttgatgacagggatacctttggagaaatgtgttcttgggtgattttgtcactgtgtaaacatcgtggagtatagcaaacctagatagtatagtctattatacacttaagct

SEQ ID NO: 48019 - DNA, 1079 bp, Homo sapiens
aactaattacctaccttaattttagacagaactattctgtttggtttgtagctggttaaacttgcatgcaaatccctagtatttctatatttactatccatatgcctttgtgacccctgctcttcacaccaaagaaacattttaagaattcctttgagtcattcatttgtttgaaaacatccattctgttcatacctagtgccagttagtgaacacagtgtctttttggtttttgggttgcaagatgggaaagtagctacaggcttcaaatgtaaaaatataatctctaggaagagaaggacaggaaacttgataatcctatcacccataagtgaaagagactaaggcatgtaaaacttgattggttgcaactttctacccaccctctgataagtcttctgcacacttgaattttaggatatagcacacaaccatgcagcgttctccaaataaaataccttggaagacgtaattaacttagttcagaacaagtcattattattcttggatatccacacttatattacctccgcagagctcttatgtcatatttagaacttcattcattttttcttgagctattttcaaccctagcttaaggaagtctatatttgattcagatacttggaccatctggtttctattatcagctttaataaaatcaattccagctcatattatgactgtactatatctatacagattgtatagatataatatctatgtacccttaagtatggcctaggtcataatccttggaacctcgtgaacattgcaaaaaccgacgttcataaccccagaaatctttgttaccgaggttcagtcattattagttgaccaagtgaacgcaagcaatttctgttatttccagcataattttcttccagaaaatttcctaatttacattttccaaatttgcaaatatacgtttgaaattgaacgtagccactgtgagacttcagcagtattcactgcaatctacaaaacattataacaggttgtgtaggcacagttcaggaatcagaggaatgtgtcaagtttctcattcaaacggaagcatgactttgttgatttctgag

SEQ ID NO: 48020 - DNA, 1030 bp, Homo sapiens
tcctttcataccagccacataaaaacatcctgagcttcccaaatgtactgcccttatttatgtctgttggaaattgctttcatatttgtttatattgtccttcttgattctttctgtcaaacctctacctatccttcacgattcaacttaggtgctaccacctgtctttgacttcgttcagtaaagttagttatcttctcgttgagtctatattatgtaatagctgcattaacacgcagcatgttatattacaattatttgttatcttttaagcactaatttagtgaaaatcttcaagcacagcaacccttatgtgcttcgagacaccaattatctcaatatctgccactcagtaaccacgatattcaacctttgtcatgtgaataaagaaaagacatcaggaagcctgcttattattttggtgagacactttaaagaactgtagaatcaggacagtcagtatctcaagtgtgaatgcctttggtgtcgactgtaatcaaaatgaaagatgtagaatccttggaatttctactctgcaagtaaagagctgtgcacgttcccagagctattcaagtccttgtatgtcagtggcaagcagttactcacttaggagtcaactctaactccctataggccatatgcactattgttcattatcactgacacaccaggtgcttagattggttttaaagtttagtcagctaaagcggaaaggatattttacatgatcaagtcaggtttgtgtgagtgggttgaatttgggggtgtactttgagtctgagtagttgtttgaagagtgaaactttaagaagagctagaaggagggcattgagtttagctgaaagggtttagtatcaagacaaatctgtctgattaagtgtattgtcaatatgtcttatttttaatttttccacatagttcttttaaaatttaaatttccatgttaaagtcaccatattttgatactttttgaccccgtacattttatttcaaagttattttaataaatatatgcgattacaaggctgga

SEQ ID NO: 48021 - DNA, 1058 bp, Homo sapiens
ggcacagtctccgctcactgcaacctccacttcctgggctcaagtcatcctctcacctcagcctccctagtagctggaactacaggcacgcgccaccatgcttagctaatcttttttttttttttttcttgagatggagtctcactctgtcaccgaggctggagtgcagtggcaccatgttggctcactgcaaactccatctcctgggttcaagcaattctcctgccttagcctcccaagtagctgggattacaggtgcccaccaccacacctggctgtcatatatatatatatatatatatatatatatatatatatatatatatatatatatatatatattttttttttttttttttttagtagagaccgagtttctccatgttggccaggctggtctcgaactcctgacttcaggggatccacctgcctcagcctcccaaagtgctggaattataggcgttagccaccacacccggccttcttggctaatttttatatttttttgtagagatggttttaccatcttgcccaggctggtctcgaactcctgagctcaagtgatctgccagccttggcttcccaaagtgctgggattatagtcgtgagccaccacacccagctgtacctgacccatttcaagtaaccttgacttggttgggagccccatcccctcctgcctacgtagatgtgtttcttgttaattcagaaactccaagccagcctctatcatgaagtgaagaattaaagagaaaggtcctgtgattggatggagataccattttagaaccaattctttaacctaaaatttagtatattcttttttcttcagtttgctttagcttcacttatttcttcactaaactgtgtgtgtgtgtgtgtgtgtgtgtgtgtgtgtgtgtgtctgtctgtctgtctgtctgctatgtggaaagctctgtgtgaagtggtgggaatataaaaattttaaacagtgtgggcctacaccagcctgtaatctatcttcagaattcatagctagtgtttaggatgctctcaagcaatcttctcagactttg

SEQ ID NO: 48022 - DNA, 1037 bp, Homo sapiens
atgtttgtcctcctttgaaaaagaagaccatatggggatgggaatggaaagaaaccactctagtttgccatgttaatttaatgtgtccaactcactctcttttgaaatgattaactccaaaaagcctgagagtcagggttataatctgctgtatagaatgtcatagcaaagtactgggtgtgatgttgcattaaggaggagggctcttataagccttggttcaaacctaggttggaaaattgtgataatatccctcagcagaaaattatagtctttgccattgccagtttaaaatgccttgtatatccactattatttgaaaaagctagacgtgtgtttgtatctgatttctgttcattccggtgtcttgaatggcccagatgattttgcttgttgtttcttgaatgcatgtctggacagtagagctgtgatctcagggaagggcatatgcgacttctgttcgagcagcatgagtaagctcttcttcagggctggccaaccagttttgtggtttaggtagtgctccgagaaccattcggctgtaagatgcatgcagattaaagattcatatagattatagtaatgtaatcctcaggtgaatgtttttcttctggatgagttttcataatagcttctgttagttgtatttcatacataaatttcgtttgctatttaccagtctttaaaaaagaaaaactaaatgcagaccaagaacctactgttagcatcttctttgtcagaccagtttcactctaacgaaatcacttgtagcatactgttacattctagacctgagtttacactgtggtcattataattaaacctgaatgtttacctgatctcagaaatagaacattttttttaaattgtagagacacactcttcataatttaattcctcagatggtttagttcatccatttacttgttgctttttgtcatttttccacttcagattgtgaatacttcttcattctccttccttattgttaaagagccttgctgtagtcactatatactcgcaatatttctttcttt

SEQ ID NO: 48023 - DNA, 1059 bp, Homo sapiens
gcctcctgagtagatgggattacaggcacgcaccactatacccggttaattttcgtattttagtagagatggggtttcaccatgttggccaggctagtcttgaactcctgaccttgtgatccacccaccttggccttcctaagtgctgggattgtaggagtgagccaccatgcctggctcaaataacccattctttagagtgtcccataatggtccgtatttttagtgtcagatccatgatccctaaaatcttaatgcctaaattccagatgttttaaatctctaaactgtcagggtgttactgggaacataaggtaaatgccttgaaaccaaacaataatgtgtttttaatgaagaggcctttctgtattgctgaaatctgaatcaagagttttcctctcttgcaatagccttttcataccaccctttgtaatgaaacatatggctcacatcacagtaaaatatgtagagtaggaagaagaaaaagcatgtttcacatacgtgtcatatctgatgtaatgccatatgtacaacaaccatagaggactgagacttaactgcagtcctggaataattagagtgagagtgtccttaatttattttaaatactgcaaatggtttcacattttgaagtaattaacactcccttcacttataatatttgcatttcattattaagaaacaatccctcaataatttttaatgaactcttgaaactgatatttaaaaagcattaattttctgaaaataaattatcaagagaatagttcagtcttgtcttgaatttaccatatttagtaagctaatgagagagaatttttaaaaaggaaatacattttgtggctttttatgaagtgtgtatgactagctgtctttgtgctcatggtctcattttgatgtgggacatttttatttgatataagagaggggtaacttatgatcattctcttctagaaaacgaaaaacttttctcaaaaatagcaaaattccaaaagaagattgtgaccttttttttttttgttttagggaacatcactttctcttaggtgtgctatttct

SEQ ID NO: 48024 - DNA, 1066 bp, Homo sapiens
aacttggcaattaagaattggggcagttcatctctaattatcccttcatctatatgtttttaaacatgcagatatagataaacatgtatattcctaaacatctattggcctatagcattttctgctgtggctaccaacagtatgcatagattatttggaaaggcttaacttcatacgtttttgttagaaacctaaacctgcctttgtggtcatcatagtttatcatttggcacttaatttcttcagaagtgttttcttatcgaagttaaaagaactttgctccatagtgtaactatacaaggtaaaaagtgccttttctttttttttgaacatgcgacttggtgcatacttttatgcattttgtttgagcttatttttcaaaatgagagtatattaacaaataatcttctcctctagatcttatatgttacatagtgaacagtagcatagattgctttagataactttgactttagaattttacgcgtttccacttcataaataagactttgtaataattttctaactctaaaatttttggactgtcttaaaaggacattgcaatctattcttacgtgggctatgatgaaaatattactgagatagtgataaatgatatattgattgctgttactccgtctccacaacccaaaagttttcatctatcagtccagtgactgtggtattggtggtggtatccaatgtgtgaaattaattctccatcatactttcttttgtgtaattcctaagtaggctatttaattttttcattggctgggtgtggtggctcacacctgtaatcccaccactttgggaggctgaggtgggcgaattgcctgaggtcaggagttcgagatcagcatggccaaccgtggtgaaacgctgtctctactaaaaaatagaaaaaaattatctgggagtagtagtggtgcctgtgatcccagctacttgggaggctgaggcaggagaattgtttgaacctgggaggcggaggttgcagtgagccgagatcatgccattgcactccagcctgggtgacagagtgagactcatctcaaaaaaaatt

SEQ ID NO: 48025 - DNA, 1049 bp, Homo sapiens
tgttgttcacctctcacaccattcccctttaactaaagaaacctctattccagtggtatggtggcatccttgactcatgtgtgcttctaaatcctaaatcggttagacatgtgaacaggatgttgatgaaagaaaaagacaaaacacgatgatacttttgagtttaaagtggtgtcaatgatgaagagcagggggaaatcaattggggactttcatgaccttgtgcaaaatgcatagcattttcattttgtagagcatacatgtccccaagcagtgtttgaaatttaggtttctaatttatgtagaacttaacatacaagagtgagtacactagactgaattagtgcattcagtggaatacagattctctttagacccattttgccttgtctcgccatacataccactgttgcccaccttcattgtatattttattaaaggttcatctctaagttgaaatggaaggactgtggatatgaaacaaatttcaggaaaggagcagaccacactcgttggaactgttagtaagatcaagttctgaataaccatgaaagacgttttgtgttttatttcataaacttatatctaaaagggtgatgattaagatatgaggtgagctctaaccaaatccatattagagaaagcaaaatccttaaaaaaaaaaaaaaagctattcaaagttctttaaccattcacaaataaaattacccacacagaaaactagtgaaactttctaaataatagtttaattctctcctcatgtgtagttgctttgtttgtttgattatagtgattatagtgttcattagtattgattgggtaggtaggtgcagtggtttgtatctccaaataagctggagtctgtgaaaactcccagcttctattttcatctttttaaagccttacttctaactttgttgttgttgttgttgagatggagtctcgctctgtcacccaggctggagtgcagtggtgcgatctcggctcactgcaacctctgcctcccgggttcaagcgattctcctgcctcagcctcacaagtagctggg

SEQ ID NO: 48026 - DNA, 1028 bp, Homo sapiens
cagctggcatatttgatggcttgtatttcctattgttagaaatttgcctcactgatttcacagggccttgtaaagtcttgaatatcgccagagctagccaggagaggagtatgtcaggttgcaaccaagagctaatatttaaatactgtattcaaatgacatgtacgatttggcgactttttttctttataggacactgactgaaggaaagctttgccatcaaaggagataacctcttgacaactggccttgcaaactttttcaaaagtataagtggtgttaactgttaggaccaggtctcagaggaacacagaattgtgtgtttttttttgtttttgtttttttttcctgcaaggattttagagacctcattttattcactcactcacttgtgttcccatttatacatccattctttaaagcaccagacattaaactatgctaaatgcaaagtactgtgggaatataaggctgagtaaagcactattatacttgtcagtgcaagtataatttgcactgacaaattttagagatctggatttttaagattttagaaaacttgtgccggtaatgtccatttttaattggagagctttatgttgtcatgtggaaaaaagctactcaaattccaccatgatagtagagcttactggtttcattaaataataacaccaactaccaaagtaggagatgggggttagagccttagctgcctagccacacttcactttgctccacagttaattgagctcatgtaatttcctgtgacctagcatatagaatagctcttagcttgggatttggctattattggaccatctttttgtattatttatacccatcttccttgaaaaaggatttgtggcagctattaaatcatatgcttcattatccttaataaatcaccttggtagagcagacaatggattattgtacagatggttagtttctatgagaaattttttaaaatatgcataatcttggcctcattttgagtgatattttatttcaaggcttttaaaaatgat

SEQ ID NO: 48027 - DNA, 1024 bp, Homo sapiens
tggtatatttgtactcatcaagctaatcgtaaaataaaatattggccgggcacggtggctcacccttgtaatctcagaactctgggaggctgaggcaggaggattgcttgagcccaggagttcgagaccagcctgggcaacacggcaaaaccccgtctctacaaaaaatagaaaaattagctgggcatggtgacatatgcctatcgtcccagctacttgggggcctgaggcaggaaggttgctcgagcacaggcagtcaaggctgcggtgagcaaagattgcactcctgcactccagcctggtttgacagagtgacaccctgtctctcctgcctcacttcaaaaagaaatatgttttttctaaaagattgacacagttcatttttcatctgtgtaattgattatgatcccctttggtgattgccattcgaaccaataaattctatttcgatgttgacagcaaagtttcagcaacacaaggagactgtcggtcatttctttctaggacttatgttgaattcgagtacatatatatgagtctctttgtatactgaatatagatctccacagatcccataatattgaacccttgtaaatcatacctctgtagattatgaaaatattgtttatgcatgtactgtagaaggatcctcaaatcatgtattgcacaagagagagtgatcaccataatgaatgactatctcaaaatgtaggctattcttatgtatacataatctaaaatggaattgaaagaatttaagcagcatgggactgaattcaaggtcaaacgaaaaatttacttatgggacttatattaggaaatcaacagcattttataaacaatgactatttggtttgggattatctaaattgttttatgtataccttggattttctaagtaattaatcgtcttcaaaataaaatcaaacatcttgcttagggtatttcttaattttttataaattaactagctatctaccttcctcttattcataaaattaaaaaatataattgaaacagattt

SEQ ID NO: 48028 - DNA, 1022 bp, Homo sapiens
tgtgttccaagtaaatagtttgtttctattcaggtatctgtcccattctgaatttgaggttagttgtttgccatgtgactccagttttttgatggattcaaggaatattattaaacgtgctttgacccacttttttctggttatgaaggtataagttatgatacatatatatacaatttatgtggctttttattttttgtaggtatttcagtacagtgttaattacggtgatactaaacatctttatattcttttctcatttcaaggagtaagctttaaatatttcttcataagctggaaagccttttcctatttattttctagaagagtttgtgtaaattggtgttagttatcccttccttaaataattagtggaactcaatgatacagttttctgtgtctagattttttttagtgtgtgtaaatatttattattaagtgtataattaagttaataaatacaaaactattttcattgtagttcttttgaatggattttgtggtgttttctagaaagactgtcatttcatttaaaattcatttcatttgaaaataatttttcataatatcctacaactttctgattaatacctaaaaaatgtataatggtgatacttttttctttttttctttcctgatattaatttctgcctttctctttcttatcatatttgccactggtttattaatttcattctttttttaaaaaacaactttgggctttgttgatacttattttacatttgtattatagtttattgttatttttatacttatttccatagttttgtgggaaacaggtggtatttggttacatgagtacaatttagtatgttttgctattttctttgttatttaatattttctaatacctttagtttttgagatcaatacactcctcaatatattagttttcagccattcattttcacaaatttgtttatggatgtaaattttcctctaaacacttgatttgtagcattgtataggtattgatataacattttttcattatctttcaa

SEQ ID NO: 48029 - DNA, 1067 bp, Homo sapiens
tgagcaagaagcaaaatcgaaaacccctgataaactcatcaggtctggtgagacttactatcacaagaatagcacaggaaagactggcccccatgattcaattacctccccctggtaacctcccaccacacatgggaattctgagagatacaattcaagttgagatttgggtggggacacagccaaaccatataagcatcttataaaatgaattaattggctttgattttgggtattgcaacttaaataactgctcttttgaacttaaaatgcatttattcatttatccaatcattctacataatttgcctacctacaaactttctgcttttatagatactggaacaaataaaggtgaataagacaccacctctgctaaaaggcacacatagctttgataattcattgtatatatgactagaaaaaggtgacgctagagtacattcaaatgagggaatgtttcataccaaaggctgcatttaagttgtctcttaatgaattagtagtagtctattaaattcagaatatgctgaggaaaaatcttgaggcatagaaaatgccatgaacaaagagagagaggaaaaaaatgtttataactctggtctatttcagaaaacttgtggtggaagaatggttttcgcatttgtcgttgcagcagtgggttaaaagttgcaagatatctgtttttttcttcaaaatcaactggcaaacagcagaagacgttttatctttcatgcatgaatgcagcaaggggtgcttagaagcgaagcatcctgctagttcctcttcctgagaatcatcagctgccaggttctccagcactgtgttcccaggttgttgttttttcctccgatatggcactgacgggaactaattccttcctgccagtacaatgcagtttcttaagggaaaacatttcgtctttttcaagtgaaagtagaaaaagaaagtctggaaatgaacatgagaggaaacatcgtagcgcttccctggtagtttgccttgcacaggactgtagatggaaactagaggcaaacaaaaagggcaatttgagaggggtgattggg

SEQ ID NO: 48030 - DNA, 1027 bp, Homo sapiens
ctatagccactaaaggtattcccacacaaacagcagcaaatcaacaagctatcttgattaattactgtgtatcgattaagaggatcagagcaactgggaatacagaaacctgaaattccgcaacatttctggatttccatgtaattgacatattactaattgggttgagacaaacaaaaaatattggcaagagtaattgaaatatcttcttttttaatgaaatgctatcatatagtagacaagaatctgtggcaggtggagatcaataggaaacatgaaaatgaactccaggagttttacttatacatctatttttaaaaaattagaagttgaccaaaattaacatagtctatttttattgtgatgtgctattattccttgttgatattgaggagagatgcaagcatgtgtctgaaatgtacgtaattaatttcctttgaaaaattgcaagaaaagcaaaaaaaaagagcagaagacatatacctttaatcttagtcaccatggtagcctgaacatccttttgggatagatatgacaagaaaaagcctatagcttaagaataagagttatggctttggatccatttcaaggggtggcttaaattacctatctactcttccagtcatcataaatcatacatctggtgtggcgttgctgaatgtatgattttagggatgcttcatatgacttttaggagagagccaggattggaaaaagataaaataaacaaaataatataaattcctcattaggcaattctgcaactgtgttttagggttttttgtttgcttttgttatttttgtcacttctttatgggattactggactaaaattaacttcaattgtgaagtccatatgcagtcagctctctgttcttgtttgcagaaattattaagaggaagtcaatttttctggtgacttaaaagttactcagatgattcattcatttgttaaaatatttattatctgctattgcattgggcactcggttgagattagagatactagtggttaaggaaggccaca

SEQ ID NO: 48031 - DNA, 1031 bp, Homo sapiens
atttaggaatagcaaaaatgaagttttctctgcaagtaatgtaatttattccattatttattcactatctactgatctactgaacacccaaaatgtgatagacattatgccttttttcactgtacacctttaaaaaaatcaacccttcaaattacttattaaaaattttaattcaatgtaatttattgaaaactgcataactctaaggagggtgggaaaaattcaccttaaaaattagggatattgtattatttggacatactaggtagggtctatgagatttgcatgacctgagatgatatttggcatcagaaaaaaatgcatggctctaaaaataaaattaatatttaataatgaacaccaataaatgtttaattagatgattattaaacagtattatagtaactagccaacaagaattcaacttatttagttcagaaataaaactaaaatcacaaggataaaattggtaaattatttttaaaagcaaacattattttaaaagaccattttaacatgtaatgtaaggacttcagaaataaatacccagagcctacttaaaatttaaaatggtaaatatattcttaccaattatgttttaacagaatgttagatatcatgtactttgttaaccaaaacagactatatttcatatgatgattagaggaagaaggcaaatatacatggagcagagatcaacatataatatgagtatttctacgatgaatggtagttagaaaaataataaaaatttacaaaccagtgacttaccaaactaagaaacatatctgaagagggtggacggctggttggtaaagagatagtttttaaacacactttagactacctcattcatcgcttattttaccataatgtgacacttcccaagtagacatcaatgactatggaagtaaaagcaacacaagttgaatgaggaacgtaagaggaaaacctgaaagtgtttttactaagactgtacacctaagtaatcaataagaggaatttatcaaagctctctcttgtccaacata

SEQ ID NO: 48032 - DNA, 1051 bp, Homo sapiens
ttgagaaacaatgacctacacttacccattgagagcttttctccaatcacaggaaatggttcagaaatgaatatatgaggattaagagggcatttgctgggggcactagaagaggcagtgtctcttcctctgaatgttgctgtgtttgaatgtgaggctcagaactgatggtatcattttttttttctcaccagccaaaggactaagcaaaccctttgagaagagtagggccaagagaatttcagagaagtggagactgagctctaattgaatcacagctaaccagtgccctacctctggattttaatcagttatgttaatcttaacaagccactcaatactgtttaagtggtttgagttggctcttctttttcttttggttgaatccatcaaagctgatactttacagagggaaatactacaaacattctagatacccaccaagagaaacggttatataattgcaactacaatggcatagtaagaaggagataagggtgacactgtagaagaaactataatgtcatagaattatattcatactatttttgtgtaaaaagtaatttaaaaaacaatatatgtactataatctatttttactcacaatatatatttatacttaaaaattatgcgaagactggaaaagcagtagtacagtgtctggaatatagtaaatatgcagtacatttttgctattatttttatttaacaaaattttagcagttgtatttaggtgacgggataacaaataacattttcttatcttggcttagctttattttctcgattaaactcacttcgttttttaacaaaaagaaaaaacatctctttcaaaatgatgaaatcttaatgcactattgtatcttcatcattaatttttaaaggatcaatagatcattatgattacctcataaagaattcttttttccccagctttatggagatttaattgacaaataaaatggcatatatttaggtgtatatatttgatatatgtatacattgtgaaacgattactataatgaagttaattaacatattcctcatcttg

SEQ ID NO: 48033 - DNA, 1030 bp, Homo sapiens
cctgatataatgaagacagtgtagtaaatggtatcccagtcagttggacaccctataaaaagacatgatttggattttggatctcagatgactggggttgatatgttattcttctactaattaactcttggatttttgtcagttggatatgttacttaacattttctctataccaattttctaatccaaaaagtggtatacattatgtacatgacaaggcaatgcagttgggaaaactgaataagataacatatgcatgtagcataaagcttcactagacagtgcttaataaaatttagttatctcctctacttttaaattgacataaataggtcaaagggtacaaagttgcagctctgttggataaatagttctaggaatctaatgcacagcatgaggactatagttaataatattgtattgcattctgaaaatttactgagagtaggttttaggtgctactaccccaaaaagagaatgtaaaagttaactatgtgagataatatatatgttaattcatctgactgtagtaaccagtaaccatttccctatgtatatcaaaacattatgctgtgtaaataaatacatagaatatatatcataaaatggcttttttttttttttttttgagacggagtctcgctctgtcgcccaggctggagtgcagtggcacgatctcagctcactgcaagctccgcctcccaggttcacgccattctcctgcctcagcctcccaagtagctggggctacagacgcctgccacctggctaatttttgtatttttagtagagatgaggtttcaccatgttagccacagtggtctcgatctcctgacctcgtgatccatccacctcggcctcccaaagtgctgggattacaggcgtgagccaccacacccggcctaattttttaaaatgtcttccacattcaaggatgttgaaatataatgtaattaagtaggttaattaaactgacaatttgttttcagtaatgatctggttgttctcttgttcaaaatgattatttata

SEQ ID NO: 48034 - DNA, 1039 bp, Homo sapiens
tgtgtaggccagggttttctcataaagatgaagtttctaggtagcaggcttcagagagaatagattgtaaatgtttcttgtcagacctaatctgttctatcagtaattccaaaagggaggagggtataataaggcatgtctggctaccccttcttatcatggcctgaactcattattcaggttaactttggaatgcccttggctgagaggaggagtccattcagatggttggggggccttagaatttctatttttggtgtacagtagttaattttttctaaagcttttcctttctgtacattacagttattcatatagcaaagttatcaatgttttatccttcactttgcctgtcttgctcttgcatttaatgtaaatcatagctgataaatgtcatataaggaaggaactctagatttctctgaaatgtagtgtgaagggcatgggccttcagagctcagggccctgagttcgtaacctggctgggctcctgattagcaggcaactgacttctctgagcctctgcctgctttgttggtaaaatggaaataataacatttttcctcacagcactcttagtatcaaatgagatgaggtggttgcatatgatagcacctgataaatgctagaaatattgttaccactgcgaaagtcagtgtaacttcagagctgtggtgatacatatagtggaattgtggggggccatctgaaagagtgttctaacactactatgaatttgtatcccgactttcaaaataaacttgtaaagtgccttcctactttcttattctagagatttcctcataatttctgccagaaagggaagctaaaaacaaaaaggattctaggagaattgagagctgcaaggtctcattgattggtgaagtgaatgtgccactccttaacattttaaataagagatgttttggatgggagatatttaaacctagtgagaggttttatcaatcaaaaccccagcacttgtataataagccaagtatctagttttcaagataatgggaaattgcaaaatatccat

SEQ ID NO: 48035 - DNA, 1087 bp, Homo sapiens
gaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaataagcagcaagcattttttttgttctttttactgtggaaaagctttgttatatactgttcaagatttacaacttaaaattggtttttatcatgtctaactgcacatatggtgtccatagttacagctaaaggaactttggacaacatcattatggaaagcttaatattttttacctccacaattttttctagcactaaagattcatagactcctcatagatgagaggaagatgacattgtagaaagagaagtatcctgcctgtatatgtttttctcaaatgctgttaatgcagtaatattgtaagttgctcttttgtgtggtcaagaactattcaagtgtattcagatggacaaaatcataatcaaaattatttgtattaataaacatgacaagtccaacttgaacactgagcaaggaatgaggggaactctgttctactagttttgtaccaaattagctaacaaacgtgcatttccctctcattcatcttatctgtaaaatgatagattattttatcacaaaggttctatttagttctaaaatataagaattccgtgattcttagttacacaaaacgaatagaagaaactgcatattgtaacaactcaaagttgttaaccaatcattgtaaatttaggcgctcaatgtaacaaaactcattttagtatcccagtgacacatctaccttcttagccatcatttagtggctctccataacgaaagatgccattatttcatggtaggctgctggaagatgaactaacctcacatctgagtttgagctagcaaagaatttttatagaggatgctccataccagactgtatgggagaaagccacccaaccccttcaagtttcataatgtctaagtgcccccaacaagaacagcccagtttaaatagtgtcttc

SEQ ID NO: 48036 - DNA, 1927 bp, Homo sapiens
tgtctactgatgatggaaacccattttcatcagtctgtccttaaagaccccatactaactttctaaattactaccatgagtttcctattagctggccctaattctacagtttttgtttaagtcctagtcttcctacaacatcagtttaaatttaaagaagattagtttgaatgagattatgactatccactaaaattttaggtagattggaatcaatttcatctacccttttagcttcaatttatttatgtcactagacacattctctgtttaaaagaaaaaaaatcagtaggaactgtgtttaaattgctcatcaaattatcaaatgccactgttgcttaacaggtatctgtctctagattaaattctgaaataagtggtatttagggagtatgttacttgcaaaaccttctgaaataattgttgtatatttgtaggtgagtgaaggcagcctgtcatctttcacttttccactctctggatccagtacatctgagtcactggaaagtagctcaaagaagaatgcatgtaagattggttcagtattttaaacatggtttgaatttggctgtcaacactgatttttttgtcttgtttacctctgagctttcttttcccccaaatcatcccatatccaaatataggtacaaaaacacgtgttagcaaaaagtctgaacaacatgaagttctgcctatggcagcttttcccatttgatgtttaccctacaagatacactaaacattataatcaggattctgtaatttttttttcttactaagcagattggtgtttttgattttattccttttctgtgtttaatgtaacaccagtaaatcagaagatgccattaagtgaagccttctttttccatgaagattgcaaaaatttgagaaaattaatgtgatcctcctgtgttttaattacgtgaaatcatgctgcagagggatttttggcttggtgcattggttgagagttgttcaaattgaagaaactaacaatatggcaatctctgtttgcagtatgactaatattctagaaatttaggcacttaaatttgtgaatttttttaatgcatccatgactttattcctctcagccgtgcacatgtgcctttctatgcaaaacacattctgcccttgactcattcaaagtggattacatagttatataatcaacacttaaaatgagaaggaagaatgggatggtatacacgtttttccaactggaaaaataaatagttctgtgtaagacagatctaatcatgtgtactagcagctttgagcacccccttaaaaaaagaaacctaggttatcatttagtcccatccagctttagatattttaacgaacataaaaagtgaatgaacataaaataaccctattttatcttttttgcctttacagtggcatctgaaatacagggattaagaacagtcgaaatgaaaaaggtaacttggggagagaaaacaatataaaccctggcgttttaagagacatcttcatatgtgttttcttgttaactttcttacggttttaaagtattcatctcaaaaagtatgtattcttacatattacatgtgaaataacataatgtagtccttaatgaatttcctgatcacagcacctcatttgaaaaatcgttgtttgcatgctctgttttgctgaaaatagcataaaattgaccccacacaaaataataccatgcctctcacttcttataagtaaacctttctcttcaacagatacttattagttctgaaacagattcccttgacagccatgcacaagagacaaagtaaaagcagctgtgatttattgagcttttactattgttctgagcactcttatagacacttcatgtcatcatcatgtcatttaatattcactgcagccctctgtgagaggcactgttgtctccattttgtaa

SEQ ID NO: 48037 - DNA, 1028 bp, Homo sapiens
acattgttataattgttctattttattatcctcttatgtctaatttataaattaaaccttattttatgtttataaattaaaccttatatataggaaaaaacatagtatatatagagttcagcactatccatagtgtcaggcatccactggcggggggtcttagaacatattcccccctataataaagggggactactgtaattagtggggaatataagacagaggattgtatttaccgcatagatgcaactatgtaaaatacaatcttataagttttttaaacaataattatgaggtaattgttggacttatgggtccttttcttcccccatcttttttcattttatttccaaaattttctttttactgggcgtaaatcacttttgtattggaaaaattaacacttttttaaataatcaaaacccttgatatttgaaagagaagtgttacaggtaggtgaaagggtcgcaacattacacagtgaataacgtatggacttgttaaccttacagttatgtaaactgaaaatataaatagtttcaagaagagtttggtaagaaaccccaaaccaaacaaataaaaaaaccaacttatggatattacaagtcaagttttgacctttcagagtatgattcatgatcaacatcttcagaataacacatccctttgtactctcatcactgaataataatatcagtgcccaatatttatattaatcttactccattctagacactgtcataagcattgttcatggtttatttatctcaacaacctataatgatgtacatttttaaaattcagagtaaaagatttattaaggttaaacatccattacagtcacacagctaataaatcacatagtctggatttaatccagtgactccaaaacaggatctcaaacaccttcttgtgctacttcatattagactgtgcggcatttcttgcatgcctatggtttatttgtaaaggggtgcaagaaagattgtcttcagttcatgttttgtgttgatagcagtatttatcta

SEQ ID NO: 48038 - DNA, 1048 bp, Homo sapiens
atggctctgggagtaaaaattaagcaaagaagggagaaagaaacagcttttaacactcatgaatcagctgaaatcttttgtcatttttactatcctatatatttttaaattatagttatttgacaaagtaatttaatggtaatgtaacatttgttcattatgttatttacttcttagcaaccctgtgagcttgctattattttctccactttgaactgttcccataactccaaatagtagagctggaattgaactctggtcttctgcctccaagtcccatttcccatccattacctgtttcaacttgctactgggccccatctgcctttctgaaatgcctgtatgttccttctaggaatcctgtacttcagtcaaactgatttgaatcaagagctcatggagaaggttttgagaatttatccctctttgccttggtttatatcacttggtctttctgatttcttttaacttatataaatcctacatacactaaagatccaacttaaatctcacctctgtttattttgaaatattacttcaatattctggcttatatagtgcttactattaatgtcttcattttatttgtcacttaaccatgtttgaccctagagcttgtctcctgtgatgaactttgatgtgggtatcttttctgtacatctaaaacatacacatgctgagagaagaaattctcacttttttttccattactcagtgtcatcaacatagttcagactgtaagtatctgcgaaggaagagtgaatgaacggttatgtgccgtacatgcataaggggaaaaatgttgagatcaggagagtcaggaagagaatgatttttgcattgtctaaaagtgggagctctaataacagctcatttctagttctgttttgactccttagaaactcctgagaagtgaattatctttttttaatcttttatattttttaaaaatgggaaaatagaatataagcagaaagctctcatacatagaatctaaacccacagtagctgactgaaatgcaaattcaattgatcagaaaacattttt

SEQ ID NO: 48039 - DNA, 1035 bp, Homo sapiens
gtttatccaacaaatattttctgagtactctgccttataccagatactgctctttggactggagaataaaacaggtaggatatacaaggttttcagatatctgacttagtgacatgagggatggctgtcttttactgaatagaaaatacagaaagatatttgcaaaaatatggtacattctatttggggcaggttaagaacgaagtgcctgttggatagcctggtaaaaatgtacattgggacatttggtctccagtttagagatgatttcctgtatatgcagatttggcatttcttagccatggaggctgaggtgcttgctacagagagcatttagagagaaagagggccaagggcagaatcatgtggtagcaacagtaaggaggaaggctaaccaagagatcagagactatgaagaaccaggagggcatgtggcagagcagcggagaagagtgtccttcaagggtacactccacagctctacatgctgccatgtagcaagaatccagtgagaagatgagtagaaagagtcccttgggtgtggtaactaggagactgttagtggtttttgagaaagcaaatgatggacaagaagtcaaggagagagagaggcagtggctagagggtgacagagaattgggagagtggttttgttttgatttaggaaagctttggatacatgtgtatgatgaataaaaggagttagtagagaatgaaaagcttaaaattagaggaactttggtgattatcagtgggggtacctgtaggaagagaaacattctttcctaaatgaatatataaacatagagcttatgtatacataagatagatgtacaaatcattgtctcattccggctgctcctaacgttccactaagccacgtggttatttaagataattaggttataaggtaatatattttcttttcatattagttgtactaaatatgtctcttaaggaaatggagtattttaataacgttcattaaagttttcaattcacttgataaataacacagtaaagaataatgaatgg

SEQ ID NO: 48040 - DNA, 1070 bp, Homo sapiens
ttataatttgcattctagacagattatttaaaaaaaattagcttttagatgtagataaaaaattttgtggttttaattttgaacatgtttactggtattcataaaacatgtattaatatataagatgggcaaaatatatgtgcctctgttagtaataccgaagacattgagcaaaaataaaagaaatttgggatcagtttgacaactagtttcctttgtggtttgtggcctgatttagactcaggtatagattcaggtcattagagacaaatctttagttccagactgttttaagatgttgctattaatgactggatctgataggatctagtttcacacaggcagttctttaaatcggtatgtactttgcttttaaaactgagttgttttcaatacatttcctttgcgttcagcgcctcttatgtttccttttagaaatcccctttgccttccttgctgcacaacctttaccctaagtacaacttcagcagcactaacccatttgctgactctctacaaatcaacgccgacaaggttggataatgcccattgtcttgctgttggttgccttttgcaaatgttttgttctttgttactactgtgtctttgtcccagttcactatttgctacatttgggcagggaaaaaaaaacaaaaaaacaaagctgtttggagtgggcatgcagatcctttcttaagcacattttcctgccagagaatatttatttttattgctgaaattaaatggcccttctgaagagtaagggagaatcatgagtccagtgcctttctttcattttggtgtcatttaaaatttctgatatttaaatttttgttagttgccaaatgtatgatactttcacacataatttctttaaaaccatgtgttgatttaaatccttttcatacttctacaaggtgatcataaaagctcttccatgagttaatcactgcacaaataattgtgtatgtgtacatgcaggagtctgttgaatattcatgaagcatgcccatgtaattgcctgaatcaggaaacgtaactgtttcaatgctcgtaaatctatacttgga

SEQ ID NO: 48041 - DNA, 1031 bp, Homo sapiens
agaatttaagatgttaaggttcaaatgatgaaaataaccaacagctctttagatgagctctgtcaaagtaacttatcaatattctatgccatggactgtaaagtgaccagatttattttaatggcccttccttctgttgtgaagacaggtgtaactgtggtctgggtttactgtaaagagtgaatctagtagtttttaatgtaagcacttcaacatctgcaatttttaatcattcagttgtttattgttaggtaataattatccattcagaaagaaaatttgccaaatggtagggctgcatcatgctgcattctttacaaagctattccatttgtttaaataactataaatccttttacatttattcccatttgtgtgttaaacatagacacagcataataatgttaaatgggtgtttaagttaaagctattttttttgtgtgtgggtggattttagtcctttttttgttttatttataatttacaatttttacatcatttgggacaatactataaattgctgaatagtgattctcaatattgctttaaaaacttaaaactacaaatattcctttcaatgtcaggcacattttccaatgagccgggaagatcttgtctcatacacctggaaaatactcttattttgctctctgaggtataatgatacctgattttatagcaattgttccaggataaatcttgttatgaatgacatgtttagtcaagtcatacttattttgctttagaaaattaaagttaattttgcatttaaaatgagatatgttttgtttcaatgatttacttccttatggaaataattaggtctccagtaatctaaaaggaacaatcacaaatgcacatacttaaaagtctcttactggtaattgtgttatctgtagatataggataaagctcctaggaaatcttaaacataagctgaaaaaccagtgagttgctttggcccttaggctcttcaagaatcagaaatttccagaactagccctggtaatttcaccagtatgacccttcac

SEQ ID NO: 48042 - DNA, 1057 bp, Homo sapiens
acaggagggaaattcaaacacaaaaccaatgggtaggacctatagcaaagagattttattctaatagcttaaaaacaaaaacttaacattcaggtccaagaaagaatgagatgttcttggagagcctggacatttgcttgccagaaatgttgcaaagcgcattcaagctcagatggatgactggattagatgacttctgatctttaattcaacatattatatcagttgagacagttcagtattcctgtcaggggagaatggctgtaattttacatactttcttttgattcttcagtttctgtaaatatcaactgaaaacatttattgaatcagagtttttatagccttctctgctttaagaggaatatgtggacatatttctttagaaatccaatttttaccaacagccaaggcacaggccataatcagtttaaccattctctattgtcctctcagcctcatttattgatacaaagtattcctttggactaacaaaatatttcttgatgttgttattattgtacagttttctttacagtcaatcagtagactggacacattttgttacatgcctggcatttggcaaaatctaaattgctacataaacggaaggtgaccttgaacacagacgcgttgtaaactgcttcttccattaagaagtattctgtgccaggttcctctggatggggtgaagctggaccaaagtctttcacttaatttttcaaaaatggaaagaaaatcattggtccatccttaggaagcagagatactaaactcttggcaaacttgattagaaattcattcaggacaaggttcagggctgtgcatacatgcttaaaacctacatggtgcttctagcttcctgcacattataggaatttaagacatgcttgttcaatgggttttctttacaaacttggtatttatcctattttccccattcctttcctttatgctcctatgtctcatcaaggaaaaaacagactagacaagagtcttagtgttcagctctacgctatggtacgttgattctaaagcaaggttttaattttgtttg

SEQ ID NO: 48043 - DNA, 1045 bp, Homo sapiens
gggttctgctgcagattgtatggtttttttccagatgttttaagaattgacaaagtgacagggaaggggaaagtttaaatttactgtagcttcacttgattcatttgtagattaacaaaatgaagaggaaaccagtggtagaggatcacactgggggattttgcctgtttttgttttctgtgtttgctctgatagccaggagttatttggagttgtgtgtgtgcttgtatgcacacatgtgtggttaaggtaatttttattacaaataaagtaattctgtgctattacatgcaacccagcttagtatggcctttagtacttggtgtgtttcttggagttactggttaggatccacatataccatctgattgcctcacttaatgagagggtgttttttgttttttgctgaagtttcttcttacagaccagacaggctattcccacacatacagagattcagttggcctgcctttgatctggccatgcgcagaccatttctagtagaaattcctccaagttgctggtctaaggaccttggtgcttctttggtttccagttttgttgcagtgttttctctgttctattttgttagtttttctaacagggaatcagcagggtggagatagggagaaagaacagagccagatacttatgttcaagtcaccatccagctcagaagtatcatagaaggtttaaggaactgacagagtatgagattttcatctagatcagaggtttctggatttttgattgaatattccctctagtaaaaataactactcattttccctctttcttcctcactatatattcatatatattgttgttatatatattatatatatatatcctatataaacttagacattatatgctgtttacatatgtgtacatatacataattacatatatacacacctacatatacacatatttacaaagcaaatgagtttttaaaatgtttatttagaggttttattatattctttcagaaacctttgcagtaagggtactccatcttggagacaactgatctaggtctttt

SEQ ID NO: 48044 - DNA, 1035 bp, Homo sapiens
acttgatgtaattgaaagcttagaaaaatatctgttctgtgcatatcatcatttctgaagcttgtgccccttttaaaaccattcgatagtcaaattgccactctctaaaatagcactcgcataagtcttattaaaaatagaaaacacatttgtttcaattgaagcagatttcatcctgtcattttcttgtaattatctaaactttaaacttttgctaagtttgcacagataattatgtgcaatgaaaaaaataaatcaaactttactgtaaaattatatctcatttaagtggactgtcagagtttgtttaaagaaattagaaaacatcagctagccccaacctgactgtccattagaatctatagctttgatttctttgtgctcttcttaaggttctctgtaggatctgctgacaccatgctaatacatagtaccaatagcttattgatgatatattgtaccaatcaactaatgcttaattttagggagacttgctcttcagtccaacatagaatttgtaacaactctacacattagagaaggtggcatctgagaaacccactttcagttatcattcaggatgctgaattatgaggaattatgaggaataatgaattaagacatgtagagtcttaatcctgagttacacacaaactgctcaataaatggtagctggtctagttgttgttattcttttcctgatagttgaccaaagtgatattttctttctagatgaagtggcaaagctagatttaacttgttgatctgaattcataacattagttctttcagatgtactgcatcctgacttctccagaaattaagatgagccatctctgaaaatagaatttgctaaaaaaaacctgtttgatttaaaatttattgtacgcaaacaataatgtattctctgataagggaaggttcaaccttattcctgcctgatatccctttctgagcaaaaatatgatgatgcctatccctgttttcaggattaaaggaatcgtctctgctataattctttgctagagaattaaa

SEQ ID NO: 48045 - DNA, 1049 bp, Homo sapiens
ctggggcaggagaatcgcttgaacccgggaggcagcggttgcattgagccgagatcgcgccactgcactccggcctgggtgacagagcgagactctgactcaataaataagtaaataaataaaaaataaaaataaaagcctagcaaaacgttccttgacttgatcttctaatacaatactaagctttggatggaggcacctgtacccttgtgtgcaatgtaggcaaaactagttttgggtaccccttgactctccgttcttcttccctatctcatttgccaaaacaaacaaactaatgaagattattctcaacatattactaatagattatggtgtaccttatttcttacatatgttcctttttttttcctttgatcctttctgtgtttattcttttcacttaccttctctagttctggttttctttgtccctttaccacactcctttttattgactaggcctgaaggttgtggcttggaaagggagggatctttagtcaatttttagtgtgcttcaaagtcctatcacctagacattgctctgcttgacccttaaagacatctttccttttcagatgcatttaaatgtacctaactgtgaggaatagaggctggtctcagagtttagtatatttctacaagttgaagctattcagagagactcttggaaatccttgatatgtaactttacatggatttaggtctagttggccacttttagtttttaactgctagggtggagagattttgcttgacaaatgatcaagtgaatccattgtctagaattgagattaagggatttaaaagctggagaggaacaatgaattgcctggaaggtaactatcctcacttagaggtagattattttctccagattacatcccagatctgacatagtcttgtctctctcaggttgagttgcaggttggctacattttgtatatttggaaacgtacaaagtactctgaatttcatgaaatattttgaggcaaagttggactggaatgtccccaaatatggtagagcaaatagcacatctgccagagaaa

SEQ ID NO: 48046 - DNA, 1030 bp, Homo sapiens
aggacacacagtattttttaaaggcagactcgctctcttttttgccagtgagcagttctagctaaccaagttacacactgtgggtattcctgcctgcctcttgaatacaaaggcctagttcaagtgttgctttttttatttcaaatcaattttttcttctttcctttttgagataaaactattaaaagtactactatatatataaaatctcaaatcaacttttcggcctcctcctcgtgtaccaggaagtatattctgacgaagggccccacttttgcaggtcttgcacgcccctcccttacccagaactgcagagcttcaggatggcgaaggtcacccaagggcatgagtagggagtggtgtctccaaccatcagttccgtggcactgttcagcctttgtgtgctgccctgccacccaccactcacagtgcctctgaagcgtgttacccctggagtgacgtgagcatttgaggcttgtctaaggaaaaaaataaaaggcagtgaaggagactgtacataaagacatggcaaaaatcttaattatagcaatatagttatcgggtaatgttcgggtgggcagctccattaaaaaatatgtgaatgaatctgtgaagctgcaagtagcgagaagagcgaaaggtcttcttaatgaaccgcctaccttgtagacagtaatttgtacactgtatagttttgttaagaattttttttaaattaaaattcccatgtttgtaaagctaactttttaacaattataatggaactatatgttgtttccatttttaaagtaaacaagaatattccttgtttagagactggacttgagttaaaactctccagtctcttaagttatgtattaaaaagaaaatctgtccatgttaggagttatttcacagattcctgtgcttgaaaagcataggatactaatcctttaaaaaagtgtaaatggagaaaagttatattttatgaaggttattttgttgtatttagtattggaaaagttggtttccagagcatttcagaatgtcg

SEQ ID NO: 48047 - DNA, 1041 bp, Homo sapiens
aggaaaaatgggtctttatagttaactgcagattttttttttaaggaacagtgtatctgctttgatttttaactccaactcaaaaccaattaatttgcatttcaaattagaattcttggtatttaccattttagctttagaaatggaaaaacatcagtattccttcaccattcacttctagtcagctgttgcttcccaatattctccagcactgcactgattttgatttttaagataagcaactgagatgccttttcctccccacagcaattttgagattaattgcattactgctgcaccaattatagtgagacagtcatgctattcaatggaatattttgaataaaattagtttaaagatgtaactctcccataggtttccatattggaaaactctggtcaattttcctgacatcaagttaaatacttaaaattacccatgatgaataatcaggatattcaggaagtccattttctttatagaataaataatgtggcctctgaggagcctaaccgaagacttagttcatgtctctaagtcacaatatttaagtgttattagctgttcatctttttctctaaataaatgtctacttgtaatttatgtgcagatatttagaaaaatattctgcttcattttttttttgcctttaacagttcagattataaagactatatacttgccgagaatagcctcccagcaaattgcgatgaacaccgtgcagtggagaattccaacatgggtataatcaaaaataacattctcagtctagaaaaatatattccactatttcttcaaagagtgtatccttaggattttgtttcctaccacggaaactatttttgtacccaggagctaaaactcagatagtaacatcttttctatcattgcccaggggattttctcagttaattctcacaaatgtcaacaagaaatgttttgtgtaactctccatgcaccaccatggatgtaagagtaactcaaataacaatgctcatttgcttgtcctctgcttcccctcagtacagtttaatttactt

SEQ ID NO: 48048 - DNA, 1069 bp, Homo sapiens
ctaccaattgttgtagttatttatatgacttaattcaagtatgtaaaacaaaaacgtagaaaggatagaattttgcttcttgtattaaataaaaagcatttttgtaatttatgatccagccctcaccaagtgaatgcctaagcaaccaggttttttttaggaaaaaaaaaaataatcaggaaaagcagttctagtcatttaaaatgtatcctgtacttttgggtttcacagtgggcaagtttacccagaggcagtgtgacagcctattagcaaaataaatagatcttccaaacttgtagtcctctgctcttttccctccacttttaagtaaattagcttttcagtgcgtctgggcttgggttgtggtaggatgcattaacttctccccacactgttctgattgcgcagcaaagcgtccattaccaataccatatccaaagtgacgtttccatacaggctgcctgctgtttcattcataaccacaaaacaaactgaaatgactttacttctttttacaacttgcaaagagttaatggactgtgctggccccctgccaaaacctttaagaaactttattaatgtgttatgaggctgggacaccatagtgtgggattttattggttattcatcttaatgaataaaaatatgtatgcacaattaaagccacattctctagcaattgccttctaataaatgttgagtctttgtcagtgcccgtcattgcatttgcttatcgattgtgatccttttccttccaaatcctaaagttaccagtagtgcaattacgtgaactttaaagaaataccagcttagtattggaaacgagcaattattcagtgatgaaaagaacataagcatgtcataaaaatgaattaaaaatatctccatgtcagaaacagtagttataatctgcagcatttttcccactatatatgaaaaaggctgggctgtgatgtattgatgattcataagacagaggcaacataattttgctgtagatcatgtaagaaagtgatagtggaaaaaaataacttgtttactctgacatgctacttatcagaaaacattt

SEQ ID NO: 48049 - DNA, 1045 bp, Homo sapiens
aacctgcccaaagcgtttttacaagtaggtggtacatataataatgattataataaaaacaactacctgaaaatttaaaaagaagtaaaagagataaaggaatttctaagattccaaaaagataagatctttttatgtgtccccatttcatattgagtcacctggaacatggcattaaattagttttggtttgggttcatgtgaaagagaaaccacatgagtaacacactctaataaaattaaaatacagttacaaagagacatctcagatggactgaaaaagccaaacagtcagatcctttcttacgtagtggtaaagcctggctagaaaggaagctttttcattagaatattttcaaaatcaagcatacctcaatttgcaagcaatttgaatttatgtggaattaatatagcccaaataaattaaatgaacaattaaatgtttactgttttgaccactaaaatggagtgtggcttttgtaaatgggttcgagtggaacattgtatagtttagatgtgggaattactattaagaatcgtggccggatgcggttctgggaggctttgggaggctgaggcgggtagatgacctgaggtcaggagttcgagaccagcctggccaacgtggtgaaaccttatctctactaaacatgcaaaaaattagccaggcgtggtggtgtgctcctgtaatcccagctactcgagaggctgaggtgggaaaattgcttaaacctgggaggcggaggctgcagtgagccgagattgcgccactgcactcctgcctggatgacagtgagaccctgtctcaaaaaaaaaaaaaaaaagaatcataaagtttattatttcaataatctaatatctttgatgcatatgattctgttcctatataattatttttaaagtcagtagtttaacacaatagctttagattccttctactggttactatatgtcttcaaaagatagaaaatgcaaagttgtatgagtcatctgattaaaggaagagtaaatgaattattaatgagttaaaaataaaaacttggat

SEQ ID NO: 48050 - DNA, 1007 bp, Homo sapiens
tgccactacagcttgggatcctcagttactcatcttgcgaactccatttctccgctccccctttgcctttcgccaccagaatccacatgccactgcctcagaactgttctgagggatgattgtggaaagttcaatccaagctgggctttccagggcagtaggctagtcagtctcaggaaaaatgtctccaattctttgcacattgtgaaaggcccagtttgatctggattttacccacctttccaaacttgtttctcacttttctctctggaacttctgcctcatcgtctgtacaacctgcttcctctttaaatttgtcaaaaagtgctacttttttctacctaaatgccttcacttctattaatcccatttcctccagctaatttttattcaccctttaagtctaagcttaagctaatcttccttttctctttcatgtatttttagttaagtgcgtactatgtgcctgaaattattctgggttcttgaaattcagggttcatttggatatagactatatctctgctctcatgggacttacattctaggagaagccttcaacaaagaagtcttccttgacattccattctgttagcgccctttattttgcatttctgttgctctctaagtttcttcatagcattttattcactctgttaaacaaatatttgttaatacccattggaaatagtcatatagcttggacaagttctgccttccctgatgaactcaaagctctatgaggacatgatctctgacatatgtctatccaggaagatagaaggcaattcatagaacctgaatgaattaataaatgaatggctttctccctgtccccaaatattataattgtactctgcctgaattattttataccattcttttatactgtcttaaaaataccactaattagaaattcatcaggtcaggccaggcacagtggctcacgcctgtaatctcagcacattgggaggctaaggcgggctgatcacctgaggtcgggagtt

SEQ ID NO: 48051 - DNA, 1051 bp, Homo sapiens
ctgcttcagcagacagtgcttgctttcttcctagcacaaaaaggcctgaaagatttatggagcagctttgtttgtgctctgtgatgcttaatcaatttttattaaattctaaagtaaaacttggctttcacttcagtgacatctctgatgtatagaacaaggggagagatcatgatgccctgaaaaagttaggcatgggtgatctaaatccccaatctgtttcttcctgcaggacttcttgcaataacttttgtaagtctgaaggaatccttgtaggtttgcaatggaaaaagcaaatacagcccaaactttagacttttcaaacttctagagagtggatatttgtaatttgttttttaatactcatgcatatttccatatgtgggaaaaaacacataaattctttcaatgtgcagataatgtgctcattttgcattcagaatcatctgaaaaataaagactcactagttatgtttacagagaatcttaaaacttttggtaattgaggtttaacatattaaatatctgatagacatgtggactctgtcgccttttgctggctggtttgccttataggcttaacttctggaattttttttgccttttcaaacaaattcttctggttgaatatcagcatatggtaggaggctcactctgagacaggataatttataaatgaccatttcttgtcttgtgatcttatgtatataaagaatctagagtcatgagtcaaattgggatttttgttcaggaaaaaggttaaaaaattagacatacaattggctttctttgattctgtgtctataaggagaggaagaatgggatttaatttaaaatatatttctgcattgaatactgatatttctgtttttgaatttgcttttttttaacatctggtacacaccagactaacctgtacatattattcctttggaagcatatggttgtgggccctgatccaaaagtagcttatgtatctacatttcagagtgtaaagtttcttgaagaaaggtggggagggaacaactatgagatatgttgttaattattg

SEQ ID NO: 48052 - DNA, 1031 bp, Homo sapiens
aattattcagcataatcctgaaagcattgttcccttactaataagtatccaaggttaaacagcctattggttaaattgcatgttggaataaattgctctgttagatcagagcagttataaaactgtggtagatctgaatgaatgttctcagtgatgataagcagtacctttgcttctattaaattcatgttctaatacgagtcatcaaaaggttcttttatgctaactatgttcataaaagaacactcaatgtttgaccaccacaacagctacagccactaaaaacataaatatgggggaagtccacactgctcagacagtttagtaaattgtattatttaaacaaaatctatttataggagatactgagatactgatatgatgctttaagaaaaccttgtccgttaaaaaaaaatctcattttttctttagcatgataacaaataattctgcctacttatattaataaattcaatgacaaggaaaccatagctggcacattattggtcttagtcttagaattatgtttctttctttcgttttttttcttttttgagatggagtctcgctctgtcgctcaggctaaagtgctgtgaagcgatcttggcacaccacaacctctgtcccccgggttcaagcgattctcctgcctcagcctcccaagtagctgggattacaggtgcccgcaaccatgcccggctaattttttgtatttttagaagagacagggtttcgccacgttggccaggctggtctcaaactcccgactcaggtgatccacccaccttggcctcccaaagtgctggcattacaggtgtgagccactgcacctgtccagaattatctttctattactgaaagatttttgaggttttctctcttgttcattcagcactgagctaggcattgggaatgctgggttttgctggtcctggggaattcacagtctaatatccagcttgtagaagagtgactttcagtgtttcacagtttttttcagctgtgcagtagctgtaataaggcacagctgt

SEQ ID NO: 48053 - DNA, 1021 bp, Homo sapiens
gtcttccactccacctcagacactggcccatgttaccttaaaggatacaaggcctattgtagtttgacatgtagagttacacagataatacacagagaagctgagtttctttttgggattgatgagggggaaagagacggaaaatgtacttattaaaaagagtgccttgatttgctgtggagtttaaaactgggaacatgttttcccagacgagcaaaagctttgtagcattgctggctcgttaatgagtgatcttctttctccctggcgtgccctggctgggcatgttttcttgacttaggactgacactctcaatataatcttaattcatttttagtctaggctgactaaatcttctgatttggcaaagcagactgtcgggattgccattgttatgtttactctggatttatatcttaagttgaggctaagtaacacatttacataaatcaactcagcattagactctaacacaaaattgtttaccgagagaaaagactaattgtattgcttcctgagatttgctttcataatatattaaacctcaaaggatttaaaaatgtagcatgttctgttttaaaattaactcttctgggggttttgcttttataaaaagatagaatttttttttttttttttttttttttttgcgagaattgattatagctgttgctactgtggatgactttcctggaggtagaagataaagtggagcaggccgatgttatttagcaagagtcatatgctttcatagaaggatttatgttttatgaaactggcagcacaaatgctagaaaagaatttaaaaagttcttttaatactaaagatattgcaggaagatgaagaggctttaaatttatagctgcaaacattttcagtaggagtgtttttaaatgatagcattttatgattcatgcaaatatcatgttataatttatttcctttaaaataatggcaaggaaaaatgtcatggctctattgcatgggtcatcatcctattaagtcatgttctatttaaa

SEQ ID NO: 48054 - DNA, 1085 bp, Homo sapiens
gttgtgacagtttaggattaatttttctgaacttagcaccaaaactcatggtcgtaagatgctggtctctgaagtttagagtgactacagcatgaggcagggtggcagggacatagcttcccccagagatcatcacaggagacagaaacatctttgtgagcgctttgccatgtagaagtctactgttgtgcatggtaatttcaagtcacgagaaacagaaatctcaagtgaccttttatctctttaggtaatttctatctgtactttttgtgagaaaaaaggagggtacactggatgttcaagtacaatggggaactcagaaaagcagagttatagccttagagtaaggatgagtaaaagttcaagttccagcttaaatgtacttgacatttgaaccccctgtttgaagcccttactttaggtctatctgcagaggacatctgaaattcctttggcttctaatctatggcaagtgaacaggaatggatgacaaagggatataaagatagagctcaaacaagttgttgttaattctttctttcacctacgaggactaatgaaaagcttaaattactaaattcagactagaccattgtcgctacttgccaaacagtacatgcttgtgcgtctgtctaatccatatttgaaagccacaaacagaagcacataatttggcaaaacaccaaaaacatgcctcggcacacttctggagattcttccaaatgacttaatgattcaaaaatgtgtgtgtgtgtgtgtgtgtgtgtctgtgtgtgcgtgcacgtgtgtgcgcgggtgcacatgcatattgcctggagatgcttggaataaattctgccagcaaaccatgtgtattacacttgtttggaggatttgaggatttctttcaaaattctgaattgtagaaagcaaaagataaggctgtttcttgggcagttactttctcttttattttaaagatgagtaagtaaaaacttgttatttaaaaaaaatctcctcaaaatacaacatgtaaaacattctgtcttttaagaaagtttaagcattctatttgtttttgaaatgtgttttgagctttttttaac

SEQ ID NO: 48055 - DNA, 1032 bp, Homo sapiens
aactatataacatataaaagaatcctagtcttcctccaaggaaaccagttatcagttcggtctgtagtctccctggccaccttctatacctgaggattcttttccctattttactactcgtaaaatagtaaatttcattatttacaaaataggtgcatcctccaaggaaccacagacacctcctatgcacccacactgagctgtcatcctgagtccccccttgcctaacgttgtctcctgtggaagtggaattccctgggagctacttgttacaggagaagactagtcaatgaattgccttattcttttaaggtgtgttataaattgaatactgaccacaggagcactaatctgatagaaaatactgcctctaatctagttttaaaataagtaaagtgtgagtgtagggttagagaagattgaggtatttaaaaaatgattaggataggtcctccttggtaaggcaacatttaagtaaaggcttgaagggggtggtgaatgtagatactcttttaaacacttgaatgtgtgtgtgtgtgcgtattttcatctattccttacatcagccccatgaggcaagatctattagtatctcctttgtacatgtgagggaacgaaagaacagaaaaattatgcccagggtcacacaactagcaagtggtggaatcagcctttggacacaggcattttgttaaactattattttagatcagcccctaagctggcttagtgaggctgatccaggataggactaacctccttagcagactttgtactaaactagatatacaggactcagattaattcctcttcctgggaaataaaatcctggattctacctgtcatttccaaagtgtgtcattttgaagtaccatcttggatcaagttaatacgattggaatgggcacttcagctgctatcagagcaatcccgctggttgtgttgtcattgtgttttggtgctttaatcaaagcacgaaagatgtgagggaaggaaaattgttttagatgagaaatatgcaaaaggaatcta

SEQ ID NO: 48056 - DNA, 1045 bp, Homo sapiens
tttttttttgacggagtctcggtctgtcacccaggctggagtgcagtggcgtgatctcagctcactgcaagccgcctcccgggttcacaccattctcctgcctcagcctccctagtagctgggactacaggtgcccgccaccacgcccagctaattttttgtatttttagtagagacggggtttcaccgtgttagccaggatggtctcgatctcctgacctcgtgatccgcccgcctcggcctcccagagtgctgggattacaggtgtgagccaccgcgcccggcctataatagctcttttaaagtagctttcaatcttttaaggttacaaatcatatacccaaagatagatttgaacctagtttgtgaaattctcagttcctctgtacttccccatctcctcaggcaaataaaaagtgaatgaaagttcttagatgacagtgatcaggttttcttattttcatacttctcttccccttgttctcttataaggtgatatacagtgggttttgttgattctttagttcagtgttgattatgttgtgcacatgtagggagattatgaacactgacatttaaaaagaaatctttctcagtttgcccctttatgatggcatttaaaagccattctgtctgcagtgaagcggcttattcattcaacaactattcactgagcacctactatgtatcaggcactctgccaggtcctaaaattgcaatatagagaagacagacattttacagattttatagtagtgagagacagtttaagaagaattacccaatttttgttgttcttttttcttaagtgttcccattaagtgcttaataagttataaaaagagtaatggtagtgattatacaaacatcatctgaaagaaatgacatgaaaacttgtgacaacttctgagaaaatagtgagatcatgagaatggattattgtgatgaacaagtataattttctctgtatgacaaaaaatatttttgtagtgtgtacatggtagttatacataacaagcatacaagcatgcttgttatgacatct

SEQ ID NO: 48057 - DNA, 1033 bp, Homo sapiens
tggcattgatatatactgttttgggaatgtttgttttggtgacaaatttggtgttctgttaaaaaaaagttaataaaagaatctaataggaattttaacacagatgccaaaatatttaatactaaatggctttgattgattaatctcttttttattattgaatcgtaacattgaactctgatatctaaattattcttaaatatagtttagctcttagatttcagtgtatgtcctatacacattgtcttaaaatgtttcgtaaagtatcttttaaaactaattctggtatttcaattgtttatgttatataatcttgaatcaaaattgtcaatatatatttgtcatgtgtcaataatttgttttaagatattttggaattgagaagataattctataggcaattaaaaaatctagaaagcaaaatattctgcaaatatactgtatttaaaaatattcttaagttagctgagttgagttttgcatccagtttacatgactatcattattattttaaaaatcaagcgtggctgttgaactcagcagaagaaaaaatggtttttgtttgatgaggtatgttttattgtcagactaaaatatctgacctgatgcaaatttatacttttttgctgctaaaagcaatgggctgatctagtgacacacccaacaataaaataacacccagctttaaatattttgttctctgtaaatgatgcctcttccagaatataggtgtttcctcataggtaattgcagaaaaaagtgtaaaatgaaaactgtgggccgggcgcagtggctcatgcctgtaatcccagcactgtgggaggctgaggcaggcggatcacgaggtcagtagttcaagaccagcctggccatggtgaaaccccgtctctactaaaaaatacaaaaaattagccgggcctggtggtgcgcacctgtaatcccagctactcgggaagctgaggcagaagatcgtttgaacccgggaggcagaggttgcagtgagccgagatcgcgccattgcgctgcggcctga

SEQ ID NO: 48058 - DNA, 1008 bp, Homo sapiens
cattaaaaaaagaaaaattagactctaaattatttagtgacctgataatggaattaccttcttccattcctttgtttactgatgtagagattcactctacgccatatagtgattgaagcagcttgctgaagtggaagagaaaaacattgctggtcctactgtttgcaggtgcttgggaaactttgtccctctcagtaactcagtttctgtatctgtcagggaagagaattggcctagaggacatccactatccctgttagctctagcatcctaggaatttggtttctggttatcttggcagagagcagtcctcttcatagtaagcaatacttaataaagtttagcacatgcttgttaaatttagggttttaatacattttatttattaaagagaaatagaaaatgtgtaacctgactcttgagtaacactttcatgttgctcatttcaaagtccaatagttaactcatttggttcaatgtagataaaagcttactttttaagaaagaggtctttaacttgtagaattttagagccgggaaaatccctacagatcttctcactttacagtttgggatactgagtctaagagaggcccagtgcttctttggatgcgttacttttactgctgtaggaggaaaaataaacgtaaattatcaaaaaataatgaaaggttattatttcgtgaaaacatggcagcaatttttaaaggaaaatagaagaaaaataatgattaaacatcttgtattatcatttgtaattaagataaattaattcaagagactaggttttttcttttatacattttcataggaagtattctaacgaaatcaatctgcagccatggtctttctctttttttgtgtgtggatggaagatacactaaattgcactcaactaataccaaaatttgatgctggttgaaaaacagaaaggacccattaaaaatatatggccaattttccaataacataagaaaagatgattgagatttgttataagaaaacttt

SEQ ID NO: 48059 - DNA, 1089 bp, Homo sapiens
aaacctcattgctatcctgaaaaagtagtttcctttagccttgttgaacccttaaaattatgatctcttgttgggtggccacttttgttgctttattgttaaatgttataataattgaagtacattttgaagttgtgaaaaatgtgacttatttacaggggaagtcataatcattattactgtttttgaaatagaagccttcctggttgtcacatatcattagtgaggaagcaaatgctaagaattattttcttcctacagttactgaatttcagaatccttttgggtaacaattatttctttatgaaaagcttaagtagataattgtttgcaagttggcagtgtattttaacattttaatagatttcacttcatctgcaggtatttcccattatgggaaaaaataagctttcataattgattaaaatgaggctgctctctaggatgatttggtgtgtctgcactgtgaaatgctctgggaacataagagtttgtgtgtaggagaaatacttggtatgcatgtttgatttaggggagcactgttaagttttcccatctagcaacttgtccttgactgaacttgtgaactctagtgcacatttgtttgcattctggctcatacacaattcacaagataaagaagggctcttattggcatgtcttgctcctaggcttaatgagacctttgtgggaacatatattgtgagataagatacttagcaattttctcactgataagaaaacacagtctcccaccagaagttcaccctctatgccatgaggtctctgccacaagatagctttaacagacaatttaagagttaaactctgaggccccagttgccagctggggaagcttggcatctgtgttccgatatggcaaactaagctcttgcattgcagttaatatgatctcatttttcaaagggaagggtggggggagagaaggagagagggagggagggatgggacgcttatttgttacatcaattatgattttcaaatatttaaaaatatatagtgccccactttctggaggcagcaaaggttggtaaaatattctactgacagcattaggcatccttcccc

SEQ ID NO: 48060 - DNA, 1041 bp, Homo sapiens
ttttcatgtataactttttgtactgaattggaaacgggttgtggtcttcttttcttattttttgagcttttaaaattaaactgactatgcacatcttttcctcacccctctgtcttccacaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaaggtaggagcagattgttcttttttctagcacggcaaacaccgcctacaaatctccgtagacagagtatctggcttgagttagatggtcctcaaggcccctagatatcctccaccctctctgggtatagtagggtgtccgctttcactcacatgtccgctgccatgtgcgagccatgtaaatagacacagagctttcgtacctggataggcttggatatttaagaaagaccacaaagaggtgcgttttcaagtatctttaaaataatactgtttttcaaagacatagggtagtctaacaaatatagttcattacactatactttctgtcgtaggctacatttttgcatctaatctagtaatcttttcctgatttgaaaatataacttta

SEQ ID NO: 48061 - DNA, 1320 bp, Homo sapiens
gctttcccaagaggaaatgcatatgtaccttgatttaagcaaaactgataacagaaaattgaacttaatgaaagaaaaaagtctggatatggttactcactttacatagagtaagatttttaaaactaattttgcttagtagttaattttacaaaaatgaagagaaacaccctttaagtgtactcgtaatttaaaacacctttgaaatgtaattgtccaaatgtaatgctgctatgtatattatttgggttccagatttttccctttaaaattctcaaaacactcagtgtccttacaactgcagctaaaatggttaatcattctggcaagaaggtgacagtgtgtatattggaaaggcagacattcacatttgaaaatattttgcattattgttagctaaaatcaacctctccttgaatgtagatacaatatatggttttgcagtcaattctgaatggaaaaaaagaatcaagtctgaaatttatgtgaaatgtggcttcagatcatttgaacgatatgtagaaatctagatgaacatatcattagaggtgaaagcaaaatttgaaagcctaatgagatgaagcaacattatctctctctaatctgccaacaatattccctagattgtgttgccactgtattgattctgagtaatttggcttgtttatgcgtgatttaaatgcatgtggctgaatgcagtaatttttcaagttattgagtagtagagaattcaccactattcactgtctcccagagatgaacatataaaagaaaaaaaattctacttcatatatgtaagaataaagcaactaaatgatacaaaagtaaaaacttccaccagaatcagagatattccgacaagtgaattgtgagtctaacacgggaggacaaagctaggctcttgcaaggacagagcacacgtggatcatgctgtatgagctcactttgtgtccctggaattagtgtttttttgtgtgtgatctaactggcaagtttaatgaatagccaaaatctatgttattcttgaggctcctaaaattatgtgtgaaccccaagttctgtctagtattatatccctaaaatgcttttaatagtggtatgttacaagtggcataagaagatcctgtttttaaatttgtcaggcattttattattcagtacataatatgtatagatctgagtgctgttttccttgcattgtctattatttttaccttgtctttcccctaagagaatttgaagaaaatcttcaccaatatttctagtgttgatggtaattaggaaaatagtagttgagagatgtaagaatagtttgagaag

SEQ ID NO: 48062 - DNA, 1010 bp, Homo sapiens
taagggtggctttcactttaacatttgggatattttggagttcttgatacctcgaaggtctccatttctattggtattttgaatatctgtaacatgtaatgtcgttcttataacagttcaacactgatttttttggtatcgatagctttatatataaacaaagatgcggacaaaatagcttaacagaagttgtgggcttttttgtggctttgcctgcctgtttgaccaaatacagggtttaattgtttgcaggctgttaactaaagggaaagcttacctgcgtattgcaagctatatattcttgccagtatacattggatgatattttaacctactggtgcctgaagttcgtgttttataacctcaacaactataaaacatcctggtgctattcactttagcattgagtgacatttttaattcctgtaccaaagagttaattttctttttggttgactgagttttcttctcacatcgttgtgtatttataaagtagaatttaatgttactaagaacagtttgattaacagatcttattttttgcatgctgctctggcaatttaatggattttaaatgtttctcatttggatttttttttaggtaggcatgtatggattttaattttgtattttaatatagcttggctactttaaaaggtagtttgataggctgaaattacaaaagataattgaagcacttttcacaagttgttttatttctgcaacaatgaataaaaaggtaagaactctaatttatataaatgaactatatagcttattgggcactttagtgaatactgaaacaaaatactaagatgaagagttaaggttcgttctcattacaaatcgagttcagcgtgtgtgtgtgtgtgtgtgtgtgtgtgtgtgtgtgtgtaatctttagtggctttaaagaataatattgccatttgtctactttgcaaataaagataacagaacacctttaaaatatatgtatgtgtacatatgtgtgtgtagatatatagaga

SEQ ID NO: 48063 - DNA, 1209 bp, Homo sapiens
acatatcaaaagtacaaacttaggaggagtgtatgtacaaaaatgtaaaattttatgaaaatgaacatgtttttatgatgttatttctagttcataagaatgtgatgactgctttgcttcatttatgtacgttcccattatattcttgctgtcaatcaatcacaaatttatatcagattaggataaactaagccattttatgtattttattttaaaccttattttggcagagtaattccttagaattggaaaagctgttactttgaaattaccaatttattacaaaacatagaaatgtattgtagctacaaagacaaccaagcattttctgtgttttaatgaatatctaaaaaactacatttagtttattttactcagttttgaaatgatttttttactggctctattgccttaaaataactaagagattaatgattctttgtataattttccttttctttgttcttttttttacatttcgcagagttatatctatagttttagtaacaatttcttatgtattctggataactgaaaacaactaaaggtgttgggcattagaaaataattgtgagcagtaagattactgatgtaatatgtatgttggactgaagtatttctttataaacattctatttgattttaagcaaaatgtatgttaaagcatgtttttacatcagtaaagtcatttgtcgaccttctggaaatgaaaggtttttacctagatactgtaagttacacctccttaacaatcatatttgtcattgttgttttctgcaaacaaaaatgtttatgggcttcatgtaggcttaagattgtaggcaaaaatggactgagttcaggacccttcaagcagtaggcattcagttacagagcagttggtactttgtaacccagacttacagtttaaaaatatcaagttagctgatgtttcattataataaaaatactattttgcttaagagttgtattacaaatatttgtgcttaacattagaaatagctgttttaaattgtagttaacatattaactttttcagaaaaaaagcatggtttatttttaataatgaaatagagaacataatacgtaatgttcagtataacagctgagttaaaacatctgccaggattaacatcagtgcgtttttgccaatgcatagaggcatttttctctaagtatgatggctaatgataactattctttgttaca

SEQ ID NO: 48064 - DNA, 2467 bp, Homo sapiens
gcaattattctgtgattctatgatgtgctttggtattgttttctttgcacttttttctgttggagagtttatgtaactttgaatctgtggcctgatgtcattcttaagttgtggaaatttcttggcctttgtcacttcaaatattacctctgctcaattttttctcctgcagttctgggattctacttacatgtacgtgaagtctcattgtgctgcatatgttctgaatttatttcttaactttccttttttattccccctctgtgcttcattctggatatttcctattaatttatcctctggtttactaatcacctcttctgccatgtctaacctacccttaaatccttctaatgagttcttaattcagttattatatttttcacttttagaatttccatttgatactttctttcattgataatttctgtggtgaaatcatctattttgtcatctatttttttaaacgtgttaatcacagtttttaatgtctgtgtttgataactttaactttgagatccccttgtgggtccgtttctgttgactctttttttcttctcaatttccagatatttggccctgtcttctgacatgtctaagttagaatactgagcattttgcatgacaaattgtagaaagtgtgattgtgttctttcctcagatttgatttactctttttttttgataggatataagagaagcctcatttttatccaatcaggggtttgtataacaagaatttctaatgctaaataacagaacattggtcttaatatagcagtttttggaaagatgctatttattgcatttattggtattttgtaaggaatcttgattgctggatttgtctttgtgaaagactagtttcaatttgcctttattccaatagtctagtccttcggggtctcagctgaaaaactgaggtgtttattgtggattgtgccctacagttactgttttcctggccttggagattttgcaggatgttctgagtctccggttctacttgacttttcattcagtactgaatgtgaattgacaggtactttcagataaaaagcagtgcagaatatatggctcaccttaacgcctgtctactttctctgagattttggcctcttaagttctggggagtttggctacttgccagtatctttaaacagctgtgtatttattaattaattggattttatctggcttttaatagtgtttttggtgtgagtgttggtctcatacgaactgtttcctcataggtgtcaatggcaatagcattttgtttaaaaaatttcttcccaggtgattttaatcattgctgcctaattgcataactccaggaggcaacactcacatcatagtctatgtaaacagtatcctgtggagttgtgcagtgcaaaacttctgtggccataaggtctgagaagtgctgtagagtagggaatgagactcatggtggacttcataggtgagatagagattaaccaaatggggagatgaaggaggtcattgctgggcaaaaaaaacaacaaaacccttgaggctgtaactggaataattggttttaagggcaaatctttagtaaaattccagcagtataacaaacttctctaaagctaaataataaaataatgttcttacttcagcagttcttttgtaaattacatttactgtgtttttcataaaggtagaaaaaaattaccaataatttcagaaccaaagtcaccattattaccattgacatttaaaaaaataatgttttatggtggaatattcttcaaaaaatactgcctcatcagtgttttttgcaagtcttttcctgtgtttctttcatttttctctaaaacaagcaaaaatctgtatccagctgttgattatgtgtataaaactatgtgtgaataaagacagtatcaggaacttcatcttattatcctttctattattcaggatatggaataagatccccgaaggtccctaactatctttggatattgcattaatgattattatacatattttttgtgggagtaatgatgcagttaaagcatgtggtggactttgaccctgtgttcttctgtcagccagactgaagcaaaagctgtagtctgcattttctttctaccctttcacgtagataggtggcagcatagtatcttttctagcccatctttaaattccaaagctgaatggaattgcctgggtcagaagagaaagtgttaactttcttgtttttcttttcttgttttttaaggcgaaagtgtttattcattaaacaacaacaacaaaaaaaatgagttgcactttgaccattgatgtaatggcacttaacctgtattcagtagaaaactggtacgttgtatgttatgctcatggtaaagacagttgagagaaagcaggttgttcacaaattctgggaaatgaacagattgggagcctgattttcttccatttctctcttctcctcgccttctgt

SEQ ID NO: 48065 - DNA, 1047 bp, Homo sapiens
gacaactgattcttgttagggaatctctgttaggacccaaactttgtattgatttaggtaatttcaagtaatgtttttcttctcaaagcattacatagtgattttaaatgtattaattgagtgagggtcccttaaaatgagagtcttttaaaagactcatgtagaaggtgattccttcctttctgagggtcaaacaaaccaagcattgcattatattcattcaagcattcacagcattagtaaatctccaggttaaacaaaatgatgtatttactcacattaaacagcctcagtcatggagtttgccttttttttggttttgttttatattttgatttttctctcccttaaaaatgtatctgttagcttttaattttttaaagctatcataaattttcagttgaattctttttctcatagtctttttaaaaacattattacttggctagtacaaaaatcactagacatcagaatgtatcagtcgccaagatcctttgtggacatgagtaaaggaaggaaagggaaatgactaagaaaggctttagagatatgtagggtgtgttaagatggatggattttttttcttgctacacaaggcaaaagcaccttctagatgatcaattaaattgctggatttttgacaatagtgatttctcctctgttccctaaacatatagatatgtatgtgttcatatagatatgtgaaactgtgagtttttacaggtatttctcattttagatacttatgtaatatcttcatgttatcaaaggaatgactcaagttctttctttaaatcaatttatggtccagaccatagattagcaaataaattcttctttactataaaggcccgtagtaaatattttcagctttatgggccatacagtctctattacaactcctcagctctgccactgaaacacaaaagcagccatagacaatatgtaaatgatgggtacatcaaactttgtttatggacccagaaatttgaattttatgattttacatgtcacaaattgttattttcaataatttaaaattgtaaa

SEQ ID NO: 48066 - DNA, 1050 bp, Homo sapiens
taagtaacctgcccaaagatgctcatctagcaagtaagtggtagagctagaattggactgggatttgtttgaccgtttgtgtcttagagtattccaagttcctatcccttgttttagaacctgggcccacacttgcatgtgataactgagcttagagcaacagctggatatgatatctaagtataaacgcaataaaagtaattggtacattcttttggttcacattaggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaaatataacagaccctacagggggccacctggagtttgtcacctatttattcacaggatctgtgaatattgctccatagaaaacaaattgttatgattgagtgggtatacctttgtgattctgtctagtgaaaatgggacatttttaatagtgccagaaagattgataaataaatattttttacaagataagatacaatttttgtatctcaataccttttaaaataaatgccagcagtattataaagtgtaaggtttgtttattccagaagaccctcacccttaccccattccaaatctcagggagcaccagtctcatagtccttggatttttttaaaaaaaatttttggtcccgttacctctaatgaatttattctgaaatatgtatcgtaggtgctcctaccactttagtctgagtgaagctaactctactagttcattaaaccaaagttgaaccgcaaagttgtccctttggagccctttaaatgtgaaatctaagattagaggctggggttgaaaaagagaattttctatgatgaaaaagaaagactttagatgaaagaatcttgtaggtggaggctcatctacaaagctgtagttcaggtaagaattcggggggctggc

SEQ ID NO: 48067 - DNA, 1034 bp, Homo sapiens
gctaagatcatgccactgcactccaccccaggtgacagagtgagaccctgtctcaaaaaaaaaaaaaaaaaaaaaaaaaatatatatatatatatatatatatatatatatatatatatatatataaaataaaggtttgtggacacatgttacccatttagagaataatttatttttgaatgtgtatgatacctaagtgatatgcatatatataattaagacattttaaatctcttcagatatttcttcataagatacatgtatctatagatagctatatacaaaactacttacaaataataaatagacattgttttatacagttctttccaaagaaatgcaggatttcttatcctagtccttcctccccgagtccagttatttacatatttttgtctttaagtgttagattgcttgtttctgctgcctattgttggtagttttgtcttttacacatttgctgttagatttagttattttgaaatgttgaacttgaaatgtaatgaaaaggacacatcagaatttatcatcagggaagatatcttttatgttgagcagctgctatctgatcttgacagactgtcctcttagaggactgttgaagtccattctagtcattttgtaacttcataactgcagaaagaaatgatgcaaggactgtttagtggactgagatggctgagcaggttcttggcctgaattatccagaggagataggtggatctagcttcagaggaagtctacaccccattcccttctgcttacaatgtacccatgatatgtgtttagcacagtaatactgtaacaggacatcacatggaaaaatcaaagcagctggctcactgtatttaactgaaaagaatgcctacagattggatatttaatagggaaaattaaggcactttaataacaaacttcattatgtgaaacttgttgaatattaacatacaatataccttgtatattaatgccatagtttttagaaacactaatttaaacaacaaatttaaggggtgctggcatatcccagtgac
